US007415358B2

(12) United States Patent
Mendrick et al.

(10) Patent No.: US 7,415,358 B2
(45) Date of Patent: Aug. 19, 2008

(54) MOLECULAR TOXICOLOGY MODELING

(75) Inventors: Donna Mendrick, Gaithersburg, MD (US); Mark Porter, Gaithersburg, MD (US); Kory Johnson, Gaithersburg, MD (US); Brandon Higgs, Gaithersburg, MD (US); Arthur Castle, Gaithersburg, MD (US); Michael Elashoff, Gaithersburg, MD (US)

(73) Assignee: Ocimum Biosolutions, Inc., Indianapolis, IN (US)

( * ) Notice: Subject to any disclaimer, the term of this patent is extended or adjusted under 35 U.S.C. 154(b) by 110 days.

(21) Appl. No.: 10/152,319

(22) Filed: May 22, 2002

(65) Prior Publication Data

US 2004/0072160 A1 Apr. 15, 2004

Related U.S. Application Data

(60) Provisional application No. 60/372,794, filed on Apr. 17, 2002, provisional application No. 60/371,679, filed on Apr. 12, 2002, provisional application No. 60/370,144, filed on Apr. 8, 2002, provisional application No. 60/370,247, filed on Apr. 8, 2002, provisional application No. 60/370,206, filed on Apr. 8, 2002, provisional application No. 60/364,134, filed on Mar. 15, 2002, provisional application No. 60/357,844, filed on Feb. 21, 2002, provisional application No. 60/357,842, filed on Feb. 21, 2002, provisional application No. 60/357,843, filed on Feb. 21, 2002, provisional application No. 60/340,873, filed on Dec. 19, 2001, provisional application No. 60/336,144, filed on Dec. 6, 2001, provisional application No. 60/331,805, filed on Nov. 21, 2001, provisional application No. 60/330,867, filed on Nov. 1, 2001, provisional application No. 60/330,462, filed on Oct. 22, 2001, provisional application No. 60/324,928, filed on Sep. 27, 2001, provisional application No. 60/315,047, filed on Aug. 28, 2001, provisional application No. 60/303,808, filed on Jul. 10, 2001, provisional application No. 60/303,807, filed on Jul. 10, 2001, provisional application No. 60/303,810, filed on Jul. 10, 2001, provisional application No. 60/298,925, filed on Jun. 19, 2001, provisional application No. 60/297,523, filed on Jun. 13, 2001, provisional application No. 60/292,335, filed on May 22, 2001.

(51) Int. Cl.
G06F 19/00 (2006.01)

(52) U.S. Cl. .................. 702/19; 435/6; 700/30; 702/22; 707/104.1

(58) Field of Classification Search .................. 702/19, 702/22; 435/6; 700/30; 707/104.1
See application file for complete search history.

(56) References Cited

U.S. PATENT DOCUMENTS

| 5,811,231 | A | 9/1998 | Farr et al. ...................... 435/6 |
| 5,858,659 | A | 1/1999 | Sapolsky et al. |
| 5,953,727 | A | 9/1999 | Maslyn et al. ............... 707/104 |
| 5,965,352 | A | 10/1999 | Stoughton et al. ............... 435/4 |
| 6,132,969 | A | 10/2000 | Stoughton et al. |
| 6,153,421 | A | 11/2000 | Yanagi et al. |
| 6,160,105 | A | 12/2000 | Cunningham et al. ....... 536/23.1 |
| 6,185,561 | B1 | 2/2001 | Balaban et al. ................. 707/6 |
| 6,203,987 | B1 | 3/2001 | Friend et al. .................... 435/6 |
| 6,218,122 | B1 | 4/2001 | Friend et al. .................... 435/6 |
| 6,228,589 | B1 | 5/2001 | Brenner ......................... 435/6 |
| 6,229,911 | B1 | 5/2001 | Balaban et al. .............. 382/128 |
| 6,365,352 | B1 | 4/2002 | Yerramilli et al. ............... 435/6 |
| 6,372,431 | B1 | 4/2002 | Cunningham et al. .......... 435/6 |
| 6,403,778 | B1 | 6/2002 | Cunningham et al. ....... 536/22.1 |
| 6,421,612 | B1 | 7/2002 | Agrafiotis et al. |
| 6,461,807 | B1 | 10/2002 | Friend et al. |
| 2001/0039006 | A1 | 11/2001 | Snodgrass |
| 2001/0049139 | A1 | 12/2001 | Lagasse et al. |
| 2002/0119462 | A1 | 8/2002 | Mendrick et al. |
| 2002/0142284 | A1 | 10/2002 | Raha et al. ...................... 435/4 |
| 2003/0028327 | A1 | 2/2003 | Brunner et al. |
| 2003/0124552 | A1 | 7/2003 | Lindemann et al. |
| 2003/0154032 | A1 | 8/2003 | Pittman et al. |

FOREIGN PATENT DOCUMENTS

| WO | WO 93/01205 | 1/1993 |
| WO | WO 94/17208 | 4/1994 |
| WO | WO 94/17208 | 8/1994 |
| WO | WO 95/11755 | 5/1995 |
| WO | WO 97/13877 | 4/1997 |

(Continued)

OTHER PUBLICATIONS

"Nephrotoxic" definition, Merriam-Webster online dictionary, 2005, on the world wide web at http://www.m-w.com/cgi-bin/dictionary?book=Dictionary&va=nephrotoxic, 2 pages.* Yamaki et al. Cellular mechanism of lithium-induced nephrogenic diabetes insipidus in rats. American Journal of Physiology-Renal Physiology, 1991, vol. 261, F505-F511.*
Irizarry et al. (2003), "Summaries of Affymetrix GeneChip probe level data," *Nucl Acids Res* 31(4):e15, 8 pp.
Nguyen et al. (2002), "Tumor classification by partial least squares using microarray gene expression data," *Bioinformatics* 18(1):39-50.
Adamson & Harman et al., *Biochem Pharmacol.*, 45: 2289-2294 (1993).
Afshari et al., *Cancer Res.*, 59: 4759-4760 (1999).
Ahotupa et al., *Carcinogenesis.*, 15: 863-868 (1994).

(Continued)

*Primary Examiner*—Carolyn L. Smith
(74) *Attorney, Agent, or Firm*—Cooley Godward Kronish LLP

(57) ABSTRACT

The present invention is based on the elucidation of the global changes in gene expression and the identification of toxicity markers in tissues or cells exposed to a known renal toxin. The genes may be used as toxicity markers in drug screening and toxicity assays. The invention includes a database of genes characterized by toxin-induced differential expression that is designed for use with microarrays and other solid-phase probes.

11 Claims, No Drawings

FOREIGN PATENT DOCUMENTS

| | | |
|---|---|---|
| WO | WO 97/16732 | 5/1997 |
| WO | WO 99/12118 | 3/1999 |
| WO | WO 99/27090 | 6/1999 |
| WO | WO 99/32660 | 7/1999 |
| WO | WO 99/43345 | 9/1999 |
| WO | WO 99/58670 | 11/1999 |
| WO | WO 00/12760 | 3/2000 |
| WO | WO 00/28092 | 5/2000 |
| WO | WO 00/39336 | 7/2000 |
| WO | WO 00/47761 | 8/2000 |
| WO | WO 00/12760 | 9/2000 |
| WO | WO 00/63435 | 10/2000 |
| WO | WO 01/02609 | 1/2001 |
| WO | WO 01/11076 | 2/2001 |
| WO | WO 01/14425 | 3/2001 |
| WO | WO 01/20043 | 3/2001 |
| WO | WO 01/23886 | 4/2001 |
| WO | WO 01/25473 | 4/2001 |
| WO | WO 01/32928 | 5/2001 |
| WO | WO 01/36684 | 5/2001 |
| WO | WO 01/38579 | 5/2001 |
| WO | WO 01/44512 | 6/2001 |
| WO | WO 01/63279 | 8/2001 |
| WO | WO 02/31704 | 4/2002 |
| WO | WO 03/085083 | 10/2003 |
| WO | WO 03/095624 | 11/2003 |
| WO | WO 03/100030 | 12/2003 |

OTHER PUBLICATIONS

Al-Bayati & Stohs, *Arch. Environ. Contam. Toxicol.*, 20: 361-365 (1991).
Allan et al., *J. Biol. Chem.*, 276: 27272-27280 (2001).
Ameisen, *Nature*, 395: 117-119 (1998).
Andersen & Barton, *Environ. Health Perspect.*, 106: 349-355 (1998).
Anderson et al., *Mol. Carcinog.*, 26: 226-238 (1999).
Anderson et al., *Toxicol. Appl. Pharmacol.*, 137: 75-89 (1996).
Arano et al., *Arzneimittelforschung*, 46: 398-400 (1996).
Atchison et al., *Digestive Dis. Sci.*, 45: 614-620 (2000).
Bagetta et al., *Biochem. Biophys. Res. Commun.*, 197: 1132-1139 (1993).
Bajgar et al., *Neurochem. Int.*, 24: 555-558 (1994).
Baker et al., *Chem. Res. Toxicol.*, 14: 1218-1231 (2001).
Barner & Gray, *Ann. Pharmacother.*, 32: 70-77 (1998).
Bartosiewicz et al., *J. Pharmacol. Exp. Ther.*, 297: 895-905 (2001).
Beck et al, *Arch. Toxicol.*, 64: 210-217 (1990).
Becker et al., *Alzheimer Dis. Assoc. Disord.*, 10: 124-131 (1996).
Bedard et al., *Antimicrob. Agents Chemother.*, 43: 557-567 (1999).
Bedossa et al., *Hepatology*, 19: 1262-1271 (1994).
Beierschmitt et al., *Toxicol. Sci.*, 63: 15-21 (2001).
Belury et al., *Toxicol. Appl. Pharmacol.*, 151: 254-261 (1998).
Berndt et al., *Proc. Natl. Acad. Sci. U.S.A.*., 95: 12556-12561 (1998).
Birge et al., *Toxicol. Appl. Pharmacol.*, 105: 472-482 (1990).
Boelsterli et al., *Cell Biol. Toxicol.*, 3: 231-250 (1987).
Bort et al., *J. Pharmacol. Exp. Ther.*, 288: 65-72 (1999).
Bosio and Borlak, *Innovations in Pharmaceutical Technology*, 65-75 (2001).
Bouchard et al., *Liver*, 13: 193-202 (1993).
Bruck et al., *Dig. Dis. Sci.*, 44: 1228-1235 (1999).
Burchiel et al., *Toxicol. Sci.*, 59: 193-195 (2001).
Burczynski et al., *Toxicol. Sci.*, 58: 399-415 (2000).
Bursch et al., *Arch. Toxicol.*, 69: 253-258 (1995).
Buttar et al., *Toxicology.*, 6: 9-20 (1976).
Butterworth et al., *Cancer Res.*, 49: 1075-1084 (1989).
Cai et al., *J. Med. Chem.*, 41: 1970-1979 (1998).
Calabrese et al., *J. Amer. College Toxicol.*, 15: 62-69 (1996).
Castell et al., *Cell Biol. Toxicol.*, 13: 331-338 (1997).
Chan et al., *Proc. Natl. Acad. Sci. U.S.A.*., 98: 4611-4616 (2001).
Chanda et al., *Hepatology*, 21: 477-486 (1995).
Chen et al., *J. Biol. Chem.*., 275: 22619-22622 (2000).
Chisholm et al., *Am. J. Physiol.*, 276: G1165-G1173 (1999).

Chou et al., *Proc. Natl. Acad. Sci. U.S.A.*., 98: 8113-8118 (2001).
Christian et al., *Toxicol. Appl. Pharmacol.*, 82: 239-255 (1986).
Clive et al., *Fundam. Appl. Toxicol.*, 3: 587-602 (1983).
Coles et al., *Arch. Biochem. Biophys.*, 264: 253-260 (1988).
Conforti et al., *Agents Actions*, 40: 176-180 (1993).
Coni et al., *Hepatology*, 17: 1109-1116 (1993).
Corell et al., *Acta Pharmacol. Toxicol. (Copenh)*, 45: 232-239 (1979).
Corton & Stauber, *Toxicol. Sci.*, 58: 217-219 (2000).
Corton et al., *Cancer Lett.*, 134: 61-71 (1998).
Corton et al., *Cancer Lett.*, 137: 9-15 (1999).
Corton et al., *Mol. Pharmacol.*, 54: 463-473 (1998).
Crosby et al., *Toxicol. Appl. Pharmacol.*, 169: 205-221 (2000).
Cunningham et al., *Ann. N.Y. Acad. Sci.*, 919: 52-67 (2000).
D'Mello et al., *Exp. Toxicol. Pathol.*, 51: 549-553 (1999).
Davis et al., *Cancer Res.*, 60: 2887-2891 (2000).
De Fabiani et al., *J. Biol. Chem.*, 276: 30708-30716 (2001).
Del Giudice et al., *IL Farmaco.*, 51: 693-698 (1996).
Delaney & Timbrell, *Xenobiotica*, 25: 1399-1410 (1995).
Diel et al., *J. Steroid Biochem. Mol. Biol.*, 73: 1-10 (2000).
Dodds & Rivory, *Mol. Pharmacol.*, 56: 1346-1353 (1999).
Dos Santos et al., *J. Am. Soc. Nephrol.*, 8: 361-367 (1997).
Duivenvoorden et al., *Biochem. Biophys. Res. Commun.*, 215: 598-605 (1995).
Dutar et al., *Brain Res.*, 527: 32-40 (1990).
Eadie et al., *Med. Toxicol. Adverse Drug Exp.*, 3: 85-106 (1988).
Eldridge et al., *Carcinogenesis*, 11: 2245-2251 (1990).
Ellis & Isaacs, *Cancer Res.*, 45: 6041-6050 (1985).
Emmison et al., *Biochim. Biophys. Acta*, 1083: 147-152 (1991).
Enomoto et al., *Toxicol. Sci.*, 59: 169-177 (2001).
Falzon et al., *Br. J. Exp. Pathol.*, 66: 527-534 (1985).
Fan & Rozman, *Toxicol. Lett.*, 75: 209-216 (1995).
Fan et al., *J. Biol. Chem.*, 271: 24698-24710 (1996).
Farag & Hassib, *Clin. Sci. (Lond)*, 84: 387-390 (1993).
Farr & Dunn, *Toxicol. Sci.*, 50: 1-9 (1999).
Fernandez-Tome & Sterin-Speziale, *Pharmacology*, 48: 341-348 (1994).
Ficazzola et al., *Carcinogenesis*, 22: 1271-1279 (2001).
Fielden & Zacharewski, *Toxicol. Sci.*, 60: 6-10 (2001).
Fitten et al., *J. Gerontol.*, 42: 681-685 (1987).
Fracasso et al., *Agents Actions*, 22: 3-4 (1987).
Fracasso et al., *Agents Actions*, 31: 313-316 (1990).
Froesch et al., *J. Biol. Chem.*., 274: 6469-6475 (1999).
Frueh et al., *Mol. Pharmacol.*, 51: 363-399 (1997).
Fulgencio et al., *Biochem. Pharmacol.*, 62: 439-446 (2001).
Furr, *Ann. N.Y. Acad. Sci.*, 761: 79-96 (1995).
Furr, *Eur. Urol.*, 29: 83-95 (1996).
Ganem & Jefcoate, *Toxicol. Appl. Pharmacol.*, 150: 68-75 (1998).
Garcia-Allan et al., *J. Biochem. Mol. Toxicol.*., 14: 65-72 (2000).
Gerhold et al., *Physiol. Genomics*, 5: 161-170 (2001).
Ghatineh et al., *Arch. Toxicol.*, 66: 660-668 (1992).
Goll et al., *Toxicol. Appl. Pharmacol.*, 160: 21-32 (1999).
Gram & Bensten, *Acta Neurol. Scand. Suppl.*, 97: 81-90 (1983).
Greaves et al., *Cancer Res.*, 53: 3919-3924 (1993).
Green et al., *Toxicol. Appl. Pharmacol.*, 76: 139-149 (1984).
Guardavaccaro et al., *Mol. Cell. Biol.*, 20: 1797-17815 (2000).
Hamada et al., *Hepatology*, 21: 1455-1464 (1995).
Hamada et al., *J. Hepatol.*, 30: 807-818 (1999).
Hargus et al., *Chem. Res. Toxicol.*, 7: 575-582 (1994).
Hargus et al., *Chem. Res. Toxicol.*, 8: 993-996 (1995).
Harries et al., *Toxicol. In Vitro*, 15: 399-405 (2001).
Hartung & Wendel, *Biochem. Pharmacol.*, 42: 1129-1135 (1991).
He et al., *J. Biol. Chem.*., 276: 20858-20865 (2001).
Hellriegel et al., *Biochem. Pharmacol.*, 52: 1561-1568 (1996).
Hessel et al., *Braz. J. Med. Biol. Res.*, 29: 793-796 (1996).
Hillstrom et al., *Proc. Soc. Exp. Biol. Med.*, 200: 122-126 (1992).
Hissink et al., *Chem. Res. Toxicol.*, 9: 1249-1256 (1996).
Hogue, *Chemical and Engineering News*, 79: 33-34 (2001).
Hunter et al., *Br. J. Pharmacol.*, 98: 79-86 (1989).
Inohara et al., *EMBO J.*, 17: 2526-2533 (1998).
Iredale et al., *J. Clin. Invest.*, 102: 538-549 (1998).
Iswaran et al., *J. Toxicol. Sci.*, 22: 75-88 (1997).
Itoh et al., *Behav. Brain Res.*, 83: 165-167 (1997).

Itoh et al., *Eur. J. Pharmacol.*, 322: 11-19 (1997).
Izumi et al., *J. Biol. Chem.*, 272: 7381-7389 (1997).
Jean et al., *Toxicol. Lett.*, 95: 155-163 (1998).
Jenner & Timbrell, *Arch. Toxicol.*, 68: 349-357 (1994).
Johnston & Kroening, *Pharmacol. Toxicol.*, 83: 231-239 (1998).
Jover et al., *Toxic. in Vitro.*, 6: 47-52 (1992).
Kanaji et al., *J. Cell Biol.*, 151: 277-288 (2000).
Kannan et al., *Oncogene.*, 20: 2225-2234 (2001).
Karam & Ghanayem, *Carcinogenesis*, 18: 2077-2083 (1997).
Kasper & Mueller, *Carcinogenesis*, 17: 2271-2274 (1996).
Kesterson et al., *Hepatology*, 4: 1143-1152 (1984).
Kim & Ziegler, *Drug Metab. Dispos.*, 28: 1003-1006 (2000).
Kim et al., *Drug Metab. Dispos.*, 26: 66-72 (1998).
Kim et al., *Toxicol. Appl. Pharmacol.*, 102: 34-39 (1990).
Kinbara et al., *Scand. J. Gastroenterol.*, 32: 947-952 (1997).
Kingsley et al., *Epilepsia*, 21: 399-704 (1980).
Kingsley et al., *J. Clin. Pharmacol.*, 23: 178-185 (1983).
Knapp et al., *Am. J. Vet. Res.*, 56: 801-805 (1995).
Koga et al., *Fukuoka Igaku Zasshi*, 82: 197-206 (1991).
Kondo et al., *Cancer Res.*, 50: 6222-6228 (1990).
Kongo et al., *Toxicol. Lett.*, 105: 103-110 (1999).
Koopen et al., *Hepatology* 27: 537-545 (1998).
Koopen et al., *J. Lipid. Res.*, 40: 100-108 (1999).
Kossor et al., *Biochem. Pharmacol.*, 46: 2061-2066 (1993).
Kossor et al., *Fundam. Appl. Toxicol.*, 26: 51-62 (1995).
Kossor et al., *Toxicol. Appl. Pharmacol.*, 119: 108-114 (1993).
Kretz-Rommel & Boelsterli, *Toxicol. Appl. Pharmacol.*, 120: 155-161 (1993).
Kwak et al., *Mol. Med.*, 7: 135-145 (2001).
Lake, *Toxicology.*, 131: 9-20 (1998).
Lake, *Annu. Rev. Pharmacol. Toxicol.*, 35: 483-507 (1995).
Larsen & Jefocoate, *Arch. Biochem. Biophys.*, 321: 467-476 (1995).
Laskin et al., *Hepatology*, 21: 1045-1050 (1995).
Lauredo et al., *J. Appl. Physiol.*, 85: 2298-2304 (1998).
Lazartigues et al., *Eur. J. Pharmacol.*, 361: 61-71 (1998).
Lee et al., *J. Pharm. Pharmacol.*, 52: 341-355 (2000).
Lewis et al., *Hepatology*, 2: 870-873 (1982).
Liang et al., *Zhonghua Gan Zang Bing Za Zhi*, 7: 72-73 (1999).
Liu et al., *Infect. Immun.*, 66: 5089-5098 (1998).
Liu et al., *Mol. Cell. Biol.*, 20: 6105-6113 (2000).
Liu et al., *Proc. Natl. Acad. Sci. U.S.A..*, 98: 6192-6197 (2001).
Liu et al., *SHOCK*, 14: 361-365 (2000).
Lock et al., *Toxicol. Lett.*, 10: 427-435 (1982).
Lorenzini et al., *Carcinogenesis*, 17: 1323-1329 (1996).
Lovett, *Science*, 289: 536-537 (2000).
Lugovskoy et al., *Cell*, 99: 747-755 (1999).
Lullmann & Lullmann-Rauch, *Toxicol. Appl. Pharmacol.*, 61: 138-146 (1981).
Mann, *Toxicol. Pathol.*, 25: 72-79 (1997).
Manoukian & Carson, *Drug Saf.*, 15: 64-71 (1996).
Martelli et al., *Carcinogenesis*, 16: 1265-1269 (1995).
Masubuchi et al., *J. Pharmacol. Exp. Ther.*, 287: 208-213 (1998).
Masubuchi et al., *J. Pharmacol. Exp. Ther.*, 292: 982-987 (2000).
Mayeux & Sano, *N. Engl. J. Med.*, 341: 1670-1679 (1999).
Mayol et al., *Carcinogenesis.*, 13: 2381-2388 (1992).
Maziasz et al., *Toxicol. Appl. Pharmacol.*, 110: 365-373 (1991).
McKillop et al., *Xenobiotica.*, 28: 465-478 (1998).
Menegazzi et al., *Hepatology*, 25: 585-592 (1997).
Metz & Ritter, *J. Biol. Chem.*, 237: 5607-5614 (1998).
Metz et al., *Mol. Pharmacol.*, 58: 319-327 (2000).
Milam and Byard, *Toxicol. Appl. Pharmacol.*, 79: 342-347 (1985).
Minamide et al., *J. Pharm. Sci.*, 87: 640-646 (1998).
Mitchell & Acosta, *J. Toxicol. Environ. Health*, 7: 83-92 (1981).
Mitchell et al., *Ann. Intern. Med.*, 84: 181-192 (1976).
Monteith et al., *Drug Chem. Toxicol.*, 19: 71-84 (1996).
Moore et al., *Fundam. Appl. Toxicol.*, 3: 560-568 (1983).
Moran et al., *Immunopharmacology*, 12: 245-250 (1986).
Morigasaki et al., *Biochem. Biophys. Res. Commun.*, 273: 261-266 (2000).
Morooka et al., *J. Biol. Chem..*, 270: 30084-30092 (1995).
Motoki et al., *Cancer Lett.*, 135: 145-150 (1999).
Nicholls-Grzemski et al., *Toxicol. Sci.*, 56: 220-228 (2000).
Nims et al., *Carcinogenesis.*, 8: 67-71 (1987).
Nordberg & Svensson, *Drug Saf.*, 19: 465-480 (1998).
Nuwaisyr et al., *Mol. Carcinog.*, 24: 153-159 (1999).
Oberhammer et al., *Hepatology*, 23: 329-337 (1996).
Ohta et al., *Biochem. J.*, 324: 777-782 (1997).
Omiecinski et al., *Mol. Pharmacol.*, 38: 462-470 (1990).
Omogbai et al., *Drug Chem. Toxicol.*, 22: 629-242 (1999).
Ono et al., *Chem. Pharm. Bull.* (Tokyo), 43: 1483-1487 (1995).
Ono et al., *Chem. Pharm. Bull.* (Tokyo), 43: 1492-1496 (1995).
Orsler et at., *Toxicol. Sci.*, 47: 203-210 (1999).
Outinen et al., *Blood*, 94: 959-967 (1999).
Owen et al., *Biochem. J.*, 348 Pt 3: 607-614 (2000).
Park & Pirmohamed, *Toxicol. Lett.*, 120: 281-291 (2001).
Park et al., *Pharmacol. Ther.*, 68: 385-424 (1995).
Passreiter et al., *J. Cell Biol.*, 141: 373-383 (1998).
Pennie et al., *Toxicol. Lett.*, 120: 353-358 (2001).
Pennie et al., *Toxicol. Sci.* 54: 277-283 (2000).
Pennie, *Toxicol. Lett.*, 112-113: 473-477 (2000).
Perrone et al., *Toxicol. Appl. Pharmacol.*, 150: 277-286 (1998).
Pischedda et al., *Proc. Natl. Acad. Sci. U.S.A.*, 92: 3511-3515 (1995).
Pohl et al., *Arthritis Rheum.*, 37: 1557 (1994).
Pollenz et al., *Toxicol. Sci.*, 42: 117-128 (1998).
Poyet & Labrie, *Mol. Cell. Endocrinol.*, 42: 283-288 (1985).
Prevot et al. *J. Biol. Chem..*, 276: 9640-9648 (2001).
Pumford et al., *Drug Metab. Rev.*, 29: 39-57 (1997).
Ratanasavanh et al., *Xenobiotica.*, 18: 765-771 (1988).
Ray & Jena, *Arch. Toxicol.*, 73: 594-606 (2000).
Raymond et al., *J. Toxicol. Environ. Health*, 51: 463-476 (1997).
Reilly et al., *Biochem. Biophys. Res. Commun.*, 282: 321-328 (2001).
Reuter et al., *Life Sci.*, 55: 1-8 (1994).
Rice et al., *Carcinogenesis.*, 15: 395-402 (1994).
Rich et al., *Nature*, 407: 777-783 (2000).
Riekkinen et al., *Eur. J. Pharmacol.*, 322: 1-9 (1997).
Riekkinen et al., *Eur. J. Pharmacol.*, 323: 11-19 (1997).
Riendeau et al., *Br. J. Pharmacol.*, 121: 105-117 (1997).
Rininger et al., *Biochem. Pharmacol.*, 52: 1749-1755 (1996).
Rininger et al., *Drug Discov. Today*, 5: 560-568 (2000).
Roberts et al., *Toxicol. Appl. Pharmacol.*, 135: 192-199 (1995).
Rockett & Dix, *Environ. Health Perspect.*, 107: 681-685 (1999).
Rodrigues & Machinist, *Toxicol. Appl. Pharmacol.*, 137: 193-201 (1996).
Ruepp et al., *Toxicol. Sci.*, 65: 135-150 (2002).
Runge-Morris et al., *Drug Metab. Dispos.*, 26: 795-801 (1998).
Sachidanandam et al., *Nature*, 409: 928-933 (2001).
Safe, *Annu. Rev. Pharmacol. Toxicol.*, 38: 121-158 (1998).
Scales & Timbrell, *J. Toxicol. Environ. Health*, 10: 941-953 (1982).
Scali et al., *Pharmacol. Res.*, 36: 463-469 (1997).
Schiller et al., *Toxicol. Appl. Pharmacol.*, 81: 356-361 (1985).
Schiodt et al., *N. Engl. J. Med.*, 337: 1112-1117 (1997).
Scholer et al., *Am. J. Med.*, 80: 34-38 (1986).
Schulte-Hermann et al., *Cancer Res.*, 48: 2462-2468 (1988).
Seefeld et al., *Arch. Environ. Contam. Toxicol.*, 9: 317-327 (1980).
Servais & Galand, *Cell Biol. Int Rep.*, 16: 319-328 (1992).
Shannon et al., *J. Pharmacol. Exp. Ther.*, 255: 1071-1077 (1990).
Sidhu et al., *Arch. Biochem. Biophys.*, 103-113 (1993).
Sinz & Woolf, *Biochem. Pharmacol.*, 54: 425-427 (1997).
Skouteris and McMenamin, *Biochem. J.*, 281: 729-733 (1992).
Skrtic et al., *J. Hepatol.*, 27: 903-911 (1997).
Smith, *Trends Pharmacol. Sci.*, 22: 281-285 (2001).
Snape et al., *Neuropharmacology*, 38: 181-193 (1999).
Somani & Dube, *Int. J. Clin. Pharmacol. Yher. Toxicol.*, 27: 367-387 (1989).
Somani, *Biopharm. Drug Dispos.*, 10: 187-203 (1989).
Soni et al., *Regul. Toxicol. Pharmacol.*, 29: 165-174 (1999).
Stachlewitz et al., *J. Pharmacol. Exp. Ther.*, 282: 1591-1599 (1997).
Stohs et al., *Biochem. Biophys, Res. Commun.*, 111:854-859 (1983).
Tanak et al., *Clin. Exp. Pharmacol. Physiol.*, 20: 543-547 (1993).
Tarloff et al., *Fundam. Appl. Toxicol.*, 30: 13-22 (1996).
Tenniswood et al., *Mol. Cell. Endocrinol.*, 37: 153-158 (1984).
Timbrell et al., *J. Pharmacol. Exp. Ther.*, 213: 364-369 (1980).
Timbrell et al., *J. Toxicol. Environ. Health*, 10: 955-968 (1982).
Timbrell, *Arch. Toxicol. Suppl.*, 2: 1-8 (1979).
Tournier et al., *Lab. Invest.*, 59: 657-665 (1988).
Trauner et al., *N. Engl. J. Med.*, 339: 1217-1227 (1998).

Tucker et al., *Fundam. Appl. Toxicol.*, 3: 579-586 (1983).
Tucker, *Am. J. Med.*, 73: 27-30 (1982).
Tygstrup et al., *J. Hepatol.*, 25: 183-190 (1996).
Tygstrup et al., *J. Hepatol.*, 27: 156-162 (1997).
van Gijssel et al., *Carcinogenesis*, 18: 1027-1033 (1997).
Vance et al., *Epilepsia*, 35: 1016-1022 (1994).
Visen et al., *J. Pharmacol. Toxicol. Methods*, 40: 173-179 (1998).
Wan et al., *Infect. Immun.*, 63: 2435-2442 (1995).
Wang & Dickinson, *Drug Metab. Dispos.*, 26: 98-104 (1998).
Wang et al., *Neurorport.*, 10: 789-793 (1999).
Waring & Ulrich, *Annu. Rev. Pharmacol. Toxicol.*, 40: 335-352 (2000).
Waring et al., *Toxicol. Appl. Pharamocol.*, 175: 28-42 (2001).
Waring et al., *Toxicol. Lett.*, 120: 359-368 (2001).
Waterfield et al., *Biochem. Pharmacol.*, 46: 589-595 (1993).
Weber et al., *Fundam. Appl. Toxicol.*, 21: 523-534 (1993).
Weber et al., *Toxicology*, 66: 133-144 (1991).
Werner et al., *Mutat. Res.*, 395: 179-187 (1997).
White et al., *Biochem. Pharmacol.*, 45: 21-30 (1993).
White et al., *Carcinogenesis*, 13: 2197-2203 (1992).
Wiesenberg-Boettcher et al., *Drugs Exp. Clin. Res.*, 15: 501-509 (1989).
Woodward & Timbrell, *Toxicology.*, 30: 65-74 (1984).
Woolf et al., *Drug Metab. Dispos.*, 21: 874-882 (1993).
Yata et al., *J. Hepatol.*, 30: 419-424 (1999).
Zarif et al., *Imflammation*, 20: 217-227 (1996).
Zhao et al., *J. Biol Chem..*, 276: 27432-27440 (2001).
Zhou et al., *J. Clin. Invest.*, 108: 1167-1174 (2001).
Abernathy et al., *Proc. Soc. Exp. Biol. Med.*, 199: 54-58 (1992).
Accatino et al., *Hepatology*, 28: 129-140 (1998).
Agha & Gad, *Pharmacol. Res.*, 32: 279-285 (1995).
Akesson & Akesson, *Scand. J. Rheumatol.*, 13: 198-202 (1984).
al Casey et al., *Toxicol. Lett.*, 76: 257-265 (1995).
Ammann et al., *Toxicol. Appl. Pharmacol.*, 149: 217-225 (1998).
Andersson et al., *Toxicology*, 135: 11-20 (1999).
Anton et al., *Cell Biochem. Biophys.*, 32: 27-36 (2000).
Ashby & Lefevre, *J. Appl. Toxicol.*, 20: 35-47 (2000).
Aura et al., *Eur. J. Pharmacol.*, 342: 15-20 (1998).
Ax et al., *Biochem. Pharmacol.*, 59: 293-300 (2000).
Azri-Meehan et al., *Fundam. Appl. Toxicol.*, 22: 172-177 (1994).
Bagetta et al., *Eur. J. Pharmacol.*, 213: 301-304 (1992).
Basnet et al., *Biol. Pharm. Bull.*, 19: 1479-1484 (1996).
Becker et al., *Am. J. Kidney Dis.*, 22: 611-615 (1993).
Becquemont et al., *Fundam. Clin. Pharmacol.*, 10: 156-157 (1996).
Becquemont et al., *Pharmacogenetics*, 7: 251-253 (1997).
Belles et al., *Vet. Hum. Toxicol.*, 40: 269-272 (1998).
Benoit et al., *Biochem. Pharmacol.*, 53: 423-427 (1997).
Bentley et al., *Food Chem. Toxicol.*, 31: 857-907 (1993).
Bergeron et al., *Xenobiotica*, 28: 303-312 (1998).
Bergstrom et al., *Annu. Rev. Microbiol.*, 49: 607-639 (1995).
Berson et al., *Gastroenterology*, 110: 1878-1890 (1996).
Berthou et al., *Eur. J. Biochem.*, 232: 179-187 (1995).
Bezek et al., *Xenobiotica*, 26: 935-946 (1996).
Bhagwat et al., *Int. J. Oncol.*, 13: 281-288 (1998).
Blackard et al., *J. Clin. Gastroenterol.*, 26: 57-59 (1998).
Blazka et al., *J. Inflamm.*, 47: 138-150 (1995-96).
Blazka et al., *Res. Commun. Mol. Pathol. Pharmacol.*, 92: 259-273 (1996).
Blazka et al., *Toxicol. Appl. Pharmacol.*, 133: 43-52 (1995).
Bombick & Matsumura, *J. Biochem. Toxicol.*, 2: 141-154 (1987).
Booth et al., *Hepatology*, 23: 771-780 (1996).
Bort et al., *Drug Metab. Dispos.*, 24: 969-975 (1996).
Brown et al., *Arch. Biochem. Biophys.*, 342: 134-142 (1997).
Brown et al., *Environ. Health Perspect.*, 104: 634-6440 (1996).
Bruckner et al., *J. Pharmacol. Exp. Ther.*, 300: 273-281 (2002).
Bulera et al., *Toxicol. Appl. Pharmacol.*, 134: 313-320 (1995).
Burcham & Harman, *J. Biol. Chem.*, 266: 5049-5054 (1991).
Burczynski & Penning, *Cancer Res.*, 60: 908-915 (2000).
Bursch et al., *Arch. Toxicol.*, 59: 221-227 (1986).
Buttery et al., *Lab. Invest.*, 71: 755-764 (1994).
Byard & Dougherty, In Vitro *Cell Dev. Biol.*, 21: 489-494 (1985).
Cabre et al., *Clin. Exp. Pharmacol. Physiol.*, 27: 694-699 (2000).
Calabrese et al., *Food Chem. Toxicol.*, 34: 301-311 (1996).
Carfagna et al., *Toxicol. Appl. Pharmacol.*, 137: 173-181 (1996).
Carpenter-Deyo & Reed, *J. Pharmacol. Exp. Ther.*, 258: 747-752 (1991).
Carriero et al., *Pharmacol. Biochem. Behav.*, 58: 851-858 (1997).
Casley et al., *Pharmacogenetics*, 7: 283-293 (1997).
Cattley et al., *Cancer Lett.*, 33: 269-277 (1986).
Cattley et al., *Carcinogenesis*, 9: 1179-1183 (1988).
Chen et al., *Amino Acids*, 18: 319-327 (2000).
Chen et al., *Carcinogenesis*, 21: 1205-1211 (2000).
Chen et al., *J. Environ. Pathol. Toxicol Oncol.*, 14: 83-99 (1995).
Cheng et al., *Neuroreport.*, 8: 97-101 (1996).
Chico et al., *Exp. Clin. Endocrinol. Diabets.*, 104: 137-144 (1996).
Corton et al., *Biochimie.*, 79: 151-162 (1997).
Cousins et al., *Eur. J. Pharmacol.*, 322: 137-145 (1997).
Cousins et al., *Physiol. Behav.*, 64: 153-158 (1998).
Coyne et al., *Gastroentology*, 75: 76-90 (1978).
Crismon, *Ann. Pharmacother.*, 28: 744-751 (1994).
Cuevas et al., *Clin. Exp. Pharmacol. Physiol.*, 28: 637-642 (2001).
Darbre & King, *J. Steriod Biochem.*, 36: 385-390 (1990).
Davila et al., *Toxicology.*, 57: 267-286 (1989).
Davis et al., *Biochemistry*, 25: 1632-1636 (1986).
Davydov, *Trends Biochem. Sci.*, 26: 155-1560 (2001).
De Ferrari et al., *J. Neurosci. Res.*, 52: 435-444 (1998).
Delaney & Segel, *South. Med. J.*, 78: 1390-1392 (1985).
DeLeve et al., *Biochem. Pharmacol.*, 53: 1339-1345 (1997).
DeNoble et al., *Pharmacol. Biochem. Behav.*, 36: 957-961 (1990).
Dilworth et al., *Toxicol.* In Vitro, 4: 169-176 (2000).
Dirven et al., *Biochem. Pharmacol.*, 43: 261-299 (1992).
Eri & Tveter, *Eur. Urol.*, 26: 219-226 (1994).
Farghali et al., *Int. J. Immunopharmacol.*, 19: 599-604 (1997).
Farghali et al., *Methods Find. Exp. Clin. Pharmacol.*, 6: 449-454 (1984).
Fariss et al., *Hepatology*, 20: 240-246 (1994).
Fernandez-Salguero & Gonzalez, *Pharmacogenetics*, 5: S123-128 (1995).
Forestier et al., *Biochem. Biophys. Res. Commun.*, 225: 377-383 (1996).
Friedman et al., *Dig. Dis. Sci.*, 44: 1362-1363 (1999).
Fritz & Kaina, *Biochem. Biophys. Res. Commun.*, 268: 784-789 (2000).
Fujiki, *FEBS Lett.*, 476: 42-46 (2000).
Galisteo et al., *J. Pharmacol. Exp. Ther.*, 294: 160-167 (2000).
Gall et al., *J. Steroid Biochem. Mol. Biol.*, 70: 101-108 (1999).
Galli & Mori, *Arch. Toxicol.*, 65: 330-334 (1991).
Garcia-Allan et al., *Arch. Toxicol.*, 71: 409-415 (1997).
Gebhardt et al., *Cell. Biol. Toxicol.*, 12: 57-68 (1996).
Geiger et al., *Agents Actions*, 38: Spec No. C69-72 (1993).
Ghatineh & Timbrell, *Biochem. Soc. Trans.*, 18: 1217-1218 (1990).
Giacobini et al., *Neuroparmacology*, 35: 205-211 (1996).
Giacobini, *Neurochem. Int.*, 32: 413-419 (1998).
Gil et al., *Biochim. Biophys. Acta.*, 1272: 140-146 (1995).
Gomez-Lechon et al., *Altern. Lab. Anim.*, 29: 225-231 (2001).
Gong et al., *Pharmacogenetics*, 11: 357-368 (2001).
Gracon et al., *Alzheimer Dis. Assoc. Disord.*, 12: 93-101 (1998).
Guarner et al., *Liver*, 5: 35-39 (1985).
Gupta et al., *Carcinogenesis*, 6: 933-936 (1985).
Gupta et al., *Toxicol. Appl. Pharmacol.*, 146: 317-327 (1997).
Ha et al., *Biochem. Mol. Biol. Int.*, 29: 387-393 (1993).
Hakansson, *Acta Neurol. Scand. Suppl.*, 149: 7-9 (1993).
Hallak & Giacobini, *Neuropharmacology*, 26: 521-530 (1987).
Hanson et al., *Lab. Invest.*, 41: 500-503 (1979).
Hartung et al., *Dev. Biol. Stand.*, 86: 85-96 (1996).
Hase et al., *Planta Med.*, 63: 22-26 (1997).
Hassett et al., *Biochem. Pharmacol.*, 55: 1059-1069 (1998).
Hayashi et al., *Biochim. Biophys. Acta.*, 879: 140-148 (1986).
Henderson et al., *Proc. Natl. Acad. Sci. U.S.A.*, 97: 12741-12745 (2000).
Herbst et al., *Am. Pathol.*, 150: 1647-1659 (1997).
Hildebrand et al., *Arch. Toxicol.*, 73: 233-245 (1999).
Hill & Roth, *Toxicol. Appl. Pharmacol.*, 148: 169-175 (1998).
Hill et al., *Toxicol. Sci.*, 47: 118-125 (1999).
Hinz et al., *Neurochem. Res.*, 21: 331-337 (1996).
Hoebe et al., *Vet. Q.*, 22: 21-25 (2000).

Hoshi & Fujino, *Chem. Pharm. Bull.*, 38: 3446-3448 (1990).
Hoshi et al., *Jpn. J. Pharmacol.*, 50: 289-293 (1989).
Hussain et al., *Sci. Total. Environ.*, 274: 151-160 (2001).
Ibebunjo et al., *Can. J. Anaesth.*, 44: 1021-1026 (1997).
Iimuro et al., *J. Leukoc. Biol.*, 55: 723-728 (1994).
James & Roberts, *Carcinogenesis*, 17: 1623-32 (1996).
Jeon et al., *Toxicol. Appl. Pharmacol.*, 144: 27-35 (1997).
Jinno, et al., *Arch. Toxicol.*, 71: 550-555 (1997).
Jover et al., *Biochem. Pharmacol.*, 46: 1967-1974 (1993).
Jurima-Romet & Huang, *Biochem. Pharmacol.*, 46: 2163-2170 (1993).
Kaminski & Stevens, *Toxicology*, 75: 175-188 (1992).
Karchner et al., *Mar. Environ. Res.*, 50: 51-56 (2000).
Kasper & Mueller, *Carcinogenesis*, 20: 2185-2188 (1999).
Kato & Yamazoe et al., *Toxicol. Lett.*, 64-65: 661-667 (1992).
Kaufmann et al., *Carcinogenesis*, 9: 779-782 (1988).
Kawai et al., *Infect. Immun.*, 59: 2560-2566 (1991).
Keller et al., *Toxicol. Appl. Pharmacol.*, 104: 259-266 (1990).
Kemper, *Prog. Nucleic Acid Res. Mol. Biol.*, 61: 23-64 (1998).
King & Somani, *Life Sci.*, 41: 2007-2015 (1987).
Kishi et al., *Mol. Aspects Med.*, 18: S71-S77 (1997).
Kitteringham et al., *Hepatology*, 32: 321-333 (2000).
Knight et al., *Toxicol. Sci.*, 62: 212-220 (2001).
Kobayshi et al., *Drug Metab. Dispos.*, 26: 1026-1030 (1998).
Kocaoglu et al., *Arch. Immunol. Ther. Exp. (Warsz)*, 45: 73-77 (1997).
Kocarek et al., *Mol. Pharmacol.*, 54: 474-84 (1998).
Krall et al., *Ann. Pharmacother.*, 33: 441-450 (1999).
Kryger et al., *Structure Fold. Des.*, 7: 297-307 (1999).
Kullak-Ublick & Meier, *Clin. Liver Dis.*, 4: 357-385 (2000).
Kunstle et al., *Immunol. Lett.*, 55: 5-10 (1997).
Kuo et al., *J. Pharmacol. Exp. Ther.*, 282: 1072-1083 (1997).
Lacroix et al., *Gene*, 86: 201-207 (1990).
Lagadic-Gossmann et al., *Cell Biol. Toxicol.*, 14: 361-373 (1998).
Lahiri & Farlow, *J. Mol. Neurosci.*, 7: 41-49 (1996).
Lake et al., *Environ. Health Perspect.*, 67: 283-290 (1986).
Lamb et al., *Toxicol. Appl. Pharmacol.*, 101: 106-113 (1989).
Lang et al., *Alcohol Clin. Exp. Res.*, 22: 823-829 (1999).
Larrauri et al., *Mol. Toxicol.*, 1: 301-311 (1987-1988).
Laurent & Fraser, *FASEB J.*, 6: 2397-2404 (1992).
Lees et al., *Lipids*, 30: 221-226 (1995).
Lemberger et al., *J. Biol. Chem.*, 271: 1794-1769 (1996).
Lèullmann-Rauch & Scheid, *Virchows Arch. B Cell Pathol.*, 19: 255-268 (1975).
Li et al., *Biochem. Biophys. Res. Commun.*, 229: 982-999 (1996).
Li et al., *Zhonghua Gan Zang Bing Za Zhi*, 9: 103-104 (2001).
Lin et al., *Chem. Res. Toxicol.*, 9: 1183-1193 (1996).
Liu et al., *Biol. Pharm. Bull.*, 21: 44-49 (1998).
Liu et al., *Cancer Res.*, 52: 4139-4143 (1992).
Lomri et al., *Chem. Res. Toxicol.*, 6: 800-807 (1993).
Lupo et al., *Toxicology.*, 44: 229-239 (1987).
M'Harzi et al., *Pharmacol. Biochem. Behav.*, 56: 663-668 (1997).
Mahnke et al., *Arch. Biochem. Biophys.*, 337: 62-68 (1997).
Mancy et al., *Biochemistry*, 38: 14264-14270 (1999).
Marsman et al., *Toxicol. Appl. Pharmacol.*, 122: 1-6 (1993).
Martelli et al., *J. Pharmacol. Exp. Ther.*, 273: 113-120 (1995).
Martelli et al., *Mutagenesis*, 14: 463-472 (1999).
Matsuda et al., *Bioorg. Med. Chem. Lett.*, 8: 2191-2196 (1998).
Matsuo et al., *Acta Med. Okayama*, 46: 345-354 (1992).
Mayorga et al., *Pharmacol. Biochem. Behav.*, 56: 273-279 (1997).
McGirr et al., *Xenobiotica*, 20: 933-943 (1990).
McMartin et al., *Res. Commun. Chem. Pathol. Pharmacol.*, 31: 99-110 (1981).
Mejdoubi et al., *Biochem. Biophys. Res. Commun.*, 254: 93-99 (1999).
Meyers et al., *J. Pharmacol. Exp. Ther.*, 214: 87-93 (1980).
Migliari et al., *Arch. Ital. Urol. Androl.*, 71: 293-302 (1999).
Miller et al., *Toxicol. Sci.*, 48: 30-37 (1999).
Mino et al., *J. Histochem. Cytochem.*, 46: 1151-1160 (1998).
Mizutani & Miyamoto, *Toxicol. Lett.*, 105: 25-30 (1999).
Mohammed et al., *J. Neural. Transm. Park. Dis. Dement. Sect.*, 2: 285-294 (1990).
Monteith et al., *Arch. Toxicol.*, 72: 147-156 (1998).
Mus'ilkov'a & Tucek, *Neurosci. Lett.*, 125: 113-136 (1991).
Nabeshima et al., *Jpn. J. Pharmacol.*, 57: 311-319 (1991).
Nakamura & Lou, *J. Biol. Chem.*, 270: 7347-7353 (1995).
Neghab & Stacey, *Chem. Biol. Interact.*, 99: 179-192 (1996).
Nochi et al., *Biol. Pharm. Bull.*, 18: 1145-1147 (1995).
Nussler et al., *ALTEX*, 18: 91-101 (2001).
O'Hara et al., *Fundam. Appl. Toxicol.*, 13: 605-615 (1989).
O'Hara et al., *J. Appl. Toxicol.*, 11: 147-154 (1991).
Ohuchi et al., *Am. J. Physiol.*, 268 (6 Pt 1) G997-G1003 (1995).
Olivier & Krisans, *Biochim. Biophys. Acta*, 1529: 89-102 (2000).
Olsen et al., *Chem. Biol. Interact.*, 107: 93-108 (1997).
Olson et al., *Fundam. Appl. Toxicol.*, 22: 631-640 (1994).
Ono et al., *Biol. Pharm. Bull.*, 18: 1779-1783 (1995).
Padgham et al., *Biochem. Biophys. Res. Commun.*, 15: 599-605 (1993).
Panduro et al., *Nephron*, 65: 100-107 (1993).
Paoletti et al., *Exp. Neurol.*, 149: 349-355 (1998).
Paolini et al., *Chem. Biol. Interact.*, 95: 127-139 (1995).
Parte et al., *J. Androl.*, 21: 525-533 (2000).
Parzefall et al., *Carcinogenesis*, 22: 519-523 (2001).
Penzes et al., *Gene*, 191: 167-172 (1997).
Peruzzi et al., *Neuroreport.*, 8: 103-108 (1996).
Petrulis & Bunce, *J. Biochem. Mol. Toxicol.*, 14: 73-81 (2000).
Phillips et al., *Carcinogenesis*, 17: 89-94 (1996).
Plant et al., *Carcinogenesis*, 19: 925-931 (1998).
Plymale & de la Iglesia, *J. Appl. Toxicol.*, 19: 31-38 (1999).
Porubek et al., *Drug Metab. Dispos.*, 17: 123-130 (1993).
Porubek et al., *Mol. Pharmacol.*, 31: 647-653 (1987).
Preece et al., *Arch Toxicol.*, 64: 49-53 (1990).
Puri et al., *Mutagenesis*, 6: 471-478 (1991).
Qi et al., *Cell. Biochem. Biophys.*, 32: 187-204 (2000).
Rabe et al., *Drug Saf.*, 14: 25-38 (1996).
Riekkinen et al., *Eur. J. Pharmacol.*, 366: 13-18 (1999).
Roberts et al., *Toxicol. Lett.*, 112-113: 49-57 (2000).
Roberts et al., *Toxicol. Lett.*, 50: 283-288 (1990).
Robertson et al., *Arch. Toxicol.*, 72: 362-371 (1998).
Rodi et al., *Toxicol. Pathol.*, 27: 107-110 (1999).
Roskams et al., *Hepatology*, 24: 524-532 (1996).
Roskams et al., *J. Pathol.*, 185: 290-297 (1998).
Roy, *J. Endocrinol.*, 70: 189-195 (1976).
Runge-Morris et al., *Drug Metab. Dispos.*, 24: 734-737 (1996).
Runge-Morris, *Chem. Biol. Interact.*, 3: 15-27 (1998).
Rusyn et al., *Carcinogenesis*, 20: 2095-2100 (1999).
Sallustio & Holbrook, *Drug Metab. Dispos.*, 29: 1535-1538 (2001).
Scassa et al., *Exp. Cell Res.*, 244: 460-469 (1998).
Schiaffonati & Tiberio, *Liver*, 17: 183-191 (1997).
Schrenk et al., *Arch. Toxicol.*, 65: 114-118 (1991).
Seitz et al., *Chem. Res. Toxicol.*, 11: 513-519 (1998).
Seitz et al., *Hepatology*, 20: 487-493 (1994).
Sendo et al., *Chem. Pharm. Bull.* (Tokyo), 32: 795-796 (1984).
Sèurek, *Toxicology*, 75: 63-69 (1992).
Severson et al., *Can. J. Physiol. Pharmacol.*, 62: 244-247 (1984).
Shackleton et al., *Toxicol. Appl. Pharmacol.*, 130: 294-303 (1995).
Shear et al., *Skin Pharmacol.*, 8: 279-291 (1995).
Shervington, *Biochem. Mol. Biol. Int.*, 45: 303-313 (1998).
Sheweita et al., *Toxicology*, 28: 217-224 (2001).
Shiota et al., *Res. Commun. Mol. Pathol. Pharmacol.*, 94: 141-146 (1996).
Shirley et al., *Drug Metab. Dispos.*, 21: 580-586 (1993).
Shultz et al., *Toxicol. Appl. Pharmacol.*, 154: 84-96 (1999).
Sidhu & Omiecinski, *J. Biochem. Mol. Toxicol.*, 13: 1-9 (1999).
Sidhu & Omiecinski, *J. Biol. Chem.*, 273: 4769-4775 (1998).
Smith et al., *J. Neurosci. Res.*, 66: 236-241 (2001).
Smith et al., *J. Pharmacol. Exp. Ther.*, 280: 710-720 (1997).
Styles et al., *Carcinogenesis*, 18: 303-313 (1997).
Sundstrom et al., *Biochem. Pharmacol.*, 37: 1003-1008 (1988).
Takeuchi et al., *Neuropediatrics*, 19: 158-161 (1988).
Tamura et al., *Toxicology*, 63: 199-213 (1996).
Tanaka et al., *J. Physiol. Pharmacol.*, 50: 405-417 (1999).
Tang et al., *Drug Metab. Dispos.*, 27: 365-372 (1999).
Tansey & Shechter, *Prog. Nucleic Acid Res. Mol Biol.*, 75: 157-195 (2001).
Tarbet et al., *J. Biol. Chem.*, 266: 16667-16673 (1991).
Tee et al., *Toxicol. Appl. Pharmacol.*, 83: 294-314 (1986).

Theilig et al., *J. Am. Soc. Nephrol.*, 12: 2209-2220 (2001).
Thomas et al., *Oncogene*, 19: 5259-5269 (2000).
Timbrell & Waterfield, *Adv. Exp. Med. Biol.*, 403: 125-134 (1996).
Tithof et al., *Environ. Health Perspect.*, 104:52-58 (1996).
Titorenko & Rachubinski, *Nat. Rev. Mol. Cell. Biol.*, 2: 357-68 (2001).
Tobin et al., *Mol. Endocrinol.*, 14: 741-752 (2000).
Tsokos-Kuhn, *Arch. Biochem. Biophys.*, 265: 415-424 (1988).
Turnbull et al., *Biochem. Pharmacol.*, 32: 1887-1892 (1983).
Uhl et al., *Mutat. Res.*, 468: 213-225 (2000).
Vaananen et al., *Inflammation*, 16: 227-240 (1992).
Varone & Capena, *Arch. Biochem. Biophys.*, 341: 259-266 (1997).
Villalobos et al., *J. Med. Chem.*, 38: 2802-2808 (1995).
Vinggaard et al., *Toxicol. Appl. Pharmacol.*, 55: 150-160 (1999).
Vonen and Morland, *Arch. Toxicol.*, 56: 33-37 (1984).
Wagstaff & McTavish, *Drugs Aging*, 4: 51-540 (1994).
Wang & Tang, *Eur. J. Pharmacol.*, 349: 137-142 (1998).
Wang et al., *Arch. Toxicol.*, 71: 638-645 (1997).
Watanabe et al., *Biochem. Pharmacol.*, 60: 285-291 (2000).
Watanabe et al., *Free Radic. Biol. Med.*, 30: 1019-1028 (2001).
Weber et al., *Chemosphere*, 30: 2635-2641 (1998).
Weber et al., *Chemosphere*, 30: 629-639 (1995).
Williams et al., *Biochem. Pharmacol.*, 49: 209-17 (1995).
Williams et al., *Drug Chem. Toxicol.*, 21: 449-476 (1998).
Wong et al., *Toxicol. Appl. Pharmacol.*, 153: 109-118 (1998).
Woodcroft & Novak, *Drug Metab. Dispos.*, 26: 372-378 (1998).
Wormser & Calp, *Toxicology.*, 53: 323-329 (1988).
Wroblewski & Olson, *Drug Metab. Dispos.*, 16: 43-51 (1988).
Xiong et al., *Life Sci.*, 65: 421-430 (1999).
Yamada et al., *Life Sci.*, 61: 171-179 (1997).
Yamamura et al., *Drug Metab. Dispos.*, 27: 724-730 (1999).
Yasuhara et al., *Toxicol. Appl. Pharmacol.*, 79: 453-460 (1985).
Yoshida & Suzuki, *Eur. J. Pharmacol.*, 250: 117-124 (1993).
Yoshida et al., *Eur. J. Pharmacol.*, 214: 247-252 (1992).
Zeiger et al., *Mutat. Res.*, 393: 189-197 (1997).
Zhu et al., *Neurosci. Lett.*, 95: 252-256 (1988).
Schilter, et al, *J Pharmacol Exp Ther* 294(3):916-22 (Sep. 2000). Abstract only.
Bissig et al., *J Biol Chem* 269(4):3017-3021, 1994.
GenBank Accession No. L23413, Bissig et al., "*Rattus norvegicus* sulfate anion transporter (sat-1) mRNA," Apr. 12, 1994.
Raburn et al., *Endocrinology* 136(12):5769-5777, 1995.
GenBamk Accession No. L26268, Raburn et al., "*Rattus norvegicus* anti-proliferative factor (BTG1) mRNA," Jan. 26, 1996.
Kim et al., *Toxicology and Applied Pharmacology* 176: 118-126 (2001).
Yang et al., *Am J Physiology* 277(1):F10-F16 (1999).
Pfeffer et al., *J Immunology* 153(4):1789-1797 (1994).
Aardema and McGregor, Mutation Res., 499:13-25, (2002).
Adamson & Harman et al., *Biochem. Pharmacol.*, 45: 2289-2294 (1993).
Affymetrix Rat Toxicology U34 Datasheet, released Aug. 1999.
Afshari et al., *Cancer Res.*, 59: 4759-4760 (1999).
Agha et al., Lipid Peroxidation and Lysosomal Integriy ; 31., 279-285 (1995).
Ahotupa et al., *Carcinogenesis.*, 15: 863-868 (1994).
Ala-Kokko, et al., *Biochem. J.*, 244:75-79, (1987).
Al-Bayati & Stohs, *Arch. Environ. Contam. Toxicol.*, 20: 361-365 (1991).
Allan et al., *J. Biol. Chem..*, 276: 27272-27280 (2001).
Amelsen, Jean Claude., Setting death in motion, vol., (1998).
Andersen & Barton, *Environ. Health Perspect.*, 106: 349-355 (1998).
Andersen et al., *Toxicol. Appl. Parmacol.*, 137: 75-89 (1996).
Anderson, Steven P., Hepatic Expression of Acute-Phase Protein, 26: 226-238 (1999).
Andersson et al; Anthraquinone-induced cell injury; 135: 11-20 (1999).
Anton et al., *Cell Biochem. Biophys.*, 32: 27-36 (2000) Abstract only.
Arano et al ., *Arzneim-Forsch./Drug*, 46 : 398-400 (1996).
Atchison et al., *Digestive Dis. Sci.*, 45: 614-620 (2000).
Bajgar et al., *Neurochem. Int.*, 24: 555-558 (1994).
Baker et al., *Chem. Res. Toxicol.*, 14(9): 1218-1231 (2001).
Bandara, et al., *Toxicol. Sci.*, 73:195-206, (2003).

Barner & Gray, *Ann. Pharmacother.*, 32: 70-77 (1998).
Bartosciewicz et al., *J. Pharmacol. Exp. Ther.*, 297: 895-905 (2001).
Beck et al, *Arch. Toxicol.*, 64: 210-217 (1990).
Becker et al., *Alzheimer Dis. Assoc. Disord.*, 10: 124-131 (1996).
Bedard et al., *Antimicrob. Agents Chemother.*, 43: 557-567 (1999).
Bedossa et al., *Hepatology*, 19: 1262-1271 (1994).
Beierschmitt, William P., Induction of Hepatic Microsomal Drug-Metabolizing;, 15-21, 2001.
Belury et al., *Toxicol. Appl. Pharmacol.*, 151: 254-261 (1998).
Berbner et al., "induction of cytochrome P450 IA and NDA damage in isolated rainbow trout (*Onchorhynchus mykiss*) hepatocytes by 2, 3, 7, 8-tetrachlorodibenzo p-dioxin," *Biomarkers* 4: 214-228 (1999).
Bergeron et al., *Xenobiotica*, 28: 303-312 (1998).
Berndt et al., *Proc. Natl. Acad. Sci. U.S.A..*, 95: 12556-12561 (1998).
Birge et al., *Toxicol. Appl. Pharmacol.*, 472-482 (1990).
Bissig et al., "Functional expression cloning of the canalicular sulfate transport system of rat hepatocytes," *J Biol Chem* 269(4):3017-3021, 1994.
Boelsterli et al., *Cell Biol. Toxicol.*, 3: 231-250 (1987).
Boess, et al., *Toxicological Sciences*, 73:386-402, (2003).
Bogdan, "Human carbon catabolite repressor protein (CCR4)-associative factor 1: cloning, expression and characterization of its interaction with the B-cell translocation protein BTG1," *Biochem. J.* 336:471-481 (1998).
Boon, et al., *Proc. Natl. Acad. Sci. USA*, 99(17):11287-11292, (2002).
Boorman et al., "Toxicogenomics, Drug Discovery, and the Pathologist," *Toxicologic Pathology* 30(1):15-27 (2002).
Bort et al., *J. Pharmacol. Exp. Ther.*, 288: 65-72 (1999).
Bosio and Borlak, *Innovations in Pharmaceutical Technology*, 65-75, 2001.
Bouchard et al., *Liver*, 13: 193-202 (1993).
Bramow, Stephan, et al., *Pharmacol. & Toxicol.*, 89:133-139, (2001).
Browne, et al., *Targets*, 1(2):59-65, (2002).
Bruck et al., *Dig. Dis. Sci.*, 44: 1228-1235 (1999).
Bulera, S.J., et al., *Hepatology*, 33:1239-1258, (2001).
Burchiel et al., *Toxicol. Sci.*, 59: 193-195 (2001).
Burczynski & Penning, *Cancer Res.*, 60: 908-915 (2000) Abstract only.
Burczynski (Editor), "An Introduction to Toxicogenomics," Wyeth Research, Andover, MA, CRC Press pp. 226-259, (Pub. 2003).
Burczynski et al., *Toxicol. Sci.*, 58: 399-415 (2000).
Burris, Hicken and Farr, *Genetic Engineering News*, May 1, 1999, pp. 42-43, (1999).
Bursch et al., *Arch. Toxicol.*, 69: 253-258 (1995).
Buttar et al., *Toxicology.*, 6: 9-20 (1976).
Butterworth et al., *Cancer Res.*, 49: 1075-1084 (1989).
Cadet, et al., *Synapset*, 44:211-226 (2002).
Cai et al., *J. Med. Chem.*, 41: 1970-1979 (1998).
Calabrese et al., *J. Amer. College Toxicol.*, 15: 62-69 (1996).
Castell et al., *Cell Biol. Toxicol.*, 13: 331-338 (1997).
Castle, A., et al., "Apex Necrosis," Soc. Of Tox. Mtg. (2004).
Castle, A., et al., "Effects of Multiple Cardiac Apex Necrosis Agents on Genome Wide Expression," Soc. Of Tox. Mtg. (2003) Abstract only.
Castle, A.L., et al., "Liver Toxicity Prediction and Classification Using Microarray Data: . . . ," Soc. Of Tox. Mtg., (2002).
Castle, Carver & Mendrick, *Drug Disc. Today*, 7(13):728-736, (2002).
Chan et al., *Proc. Natl. Acad. Sci. U.S.A..*, 98: 4611-4616 (2001).
Chanda et al., *Hepatology*, 21: 477-486 (1995).
Chen et al., *J. Biol. Chem..*, 275: 22619-22622 (2000).
Chen et al., *J. Environ. Pathol. Toxicol. Oncol.*, 14: 83-99 (1995) Abstract only.
Chen, et al., *Mol. Carcinog.* 30:79-87, (2001).
Chisolm et al., *Am. J. Physiol.*, 276: G1165-G1173 (1999).
Chou et al., *Proc. Natl. Acad. Sci. U.S.A..*, 98: 8113-8118 (2001).
Christian et al., *Toxicol. Appl. Pharmacol.*, 82: 239-255 (1986).
Clive et al., *Fundam. Appl. Toxicol.*, 3: 587-602 (1983).
Coles et al., *Arch. Biochem. Biophys.*, 264: 253-260 (1988).
Conforti et al., *Agents Actions*, 40: 176-180 (1993).
Coni et al., *Hepatology*, 17: 1109-1116 (1993).
Copenhagen et al., Journal of Hepatology; 30: 1 pg. (1999).

Corell et al., Acta Pharmacol. Toxicol. (Copenh), 45: 232-239 (1979).
Corton & Stauber, Toxicol. Sci., 58: 217-219 (2000).
Cortn et al., Biochimie., 79: 151-162 (1997).
Corton et al., Cancer Lett., 134: 61-71 (1998).
Corton et al., Cancer Lett., 137: 9-15 (1999).
Corton et al., Mol. Pharmacol., 54: 463-473 (1998).
Cronin, M.T.D., IL Farmaco, 56:149-151, (2001).
Crosby et al., Toxicol. Appl. Pharmacol., 169: 205-221 (2000).
Cunningham et al., Ann. N.Y. Acad. Sci., 919: 52-67 (2000).
Cunningham, M.J., J. of Pharmacol. And Toxicol. Methods, 44:291-300, (2000).
Cutler, P., et al., Electrophoresis, 20:3647-3658, (1999).
D'Mello et al., Exp. Toxicol. Pathol., 51: 549-553 (1999).
Daniels, K., "Toxicogenomics: Database Construction, Predictive Modeling & Biomarker Discovery," U.S. Army—7th Annual Health Protection Conf. (2004) Abstract only.
Daniels, K., "Toxicogenomics: The Application of Gene Expression in Transforming Toxicology Screening," U.S. Army Center for Health Promotion & Preventive Medicine Seminar, (2004).
Database Geneseq [online], "Sindbis virus genomic cDNA PCR primer SEQ ID No. 3," Database Accession No. AAZ92894, retrieved from EBI Accession No. GSN:AAZ92894 (2000).
Database Geneseq 'Online!, "Reverse transcription primer used in cDNA analysis technique," Database Accession No. AAQ75569, retrieved from EBI Accession No. GSN:AAQ75569 (1995).
Davila et al., Toxicology., 57: 267-286 (1989).
Davis et al., Cancer Res., 60: 2887-2891 (2000).
De Fabiani et al., J. Biol. Chem., 276: 30708-30716 (2001).
Del Giudice et al., IL Farmaco., 51: 693-698 (1996).
Delaney & Timbrell, Xenobiotica., 25: 1399-1410 (1995).
Demeule, Brossard and Beliveau, Am. J. Physiol. Renal Physiol. 277:F832-F840, (1999).
Diel et al., J. Steriod Biochem. Mol. Biol., 73: 1-10 (2000).
Diez-Fernandez, et al., Biochem. Pharmacol., 51:1159-1163, (1996).
Dodds & Rivory, Mol. Pharmacol., 56: 1346-1353 (1999).
Dos Santos et al., J. Am. Soc. Nephrol., 8: 361-367 (1997).
Duivenvoorden et al., Biochem. Biophys. Res. Commun., 215(2): 598-605 (1995).
Dutar et al., Brain Res., 527: 32-40 (1990).
Eadie et al., Med. Toxicol. Adverse Drug Exp., 3: 85-106 (1988).
Eikmans, et al., Kidney Int'l, 62:1125-1135, (2002).
Eldridge et al., Carcinogenesis, 11: 2245-2251 (1990).
Ellis & Isaacs, Cancer Res., 45: 6041-6050 (1985).
Emmison et al., Biochim. Biophys. Acta, 1083: 147-152 (1991).
Enomoto et al., Toxicol., Sci., 59: 169-177 (2001).
Evans & Relling, Science, 286:487-491, (1991).
Falzon et al., Br. J. Exp. Pathol., 66: 527-534 (1985).
Fan & Rozman, Toxicol. Lett., 75: 209-216 (1995).
Fan et al., J. Biol. Chem.., 271: 24698-24710 (1996).
Farag & Hassib, Clin. Sci. (Lond), 84: 387-390 (1993).
Farghali et al., Methods Find. Exp. Clin. Pharmacol., 6: 449-454 (1984).
Farr & Dunn, Toxicol. Sci., 50: 1-9 (1999).
Farr et al., "Concise review: gene expression applied to toxicology," Toxicol Sci 50(1):1-9, 1999.
Fernandez-Tome & Sterin-Speziale, Pharmacology, 48: 341-348 (1994).
Ficazzola et al., Carcinogenesis, 22: 1271-1279 (2001).
Fielden & Zacharewski, Toxicol. Sci., 60: 6-10 (2001).
Fitten et al., J. Gerontol., 42: 681-685 (1987).
Forestier et al., Biochem. Biophys. Res. Commun., 225: 377-383 (1996).
Fracasso et al., Agents Actions, 22: 3-4 (1987).
Fracasso et al., Agents Actions, 31: 313-316 (1990).
Frazier JM, Predictive Toxicodynamics: Empirical/mechanistic approaches. Toxicology in Vitro, 1997. pp. 465-472, vol. 11.
Froesch et al., J. Biol. Chem.., 274: 6469-6475 (1999).
Frueh et al., Mol. Pharmacol., 51: 363-399 (1997).
Fulgencio et al., Biochem. Pharmacol., 62: 439-446 (2001).
Furr, Ann. N.Y. Acad. Sci., 761: 79-96 (1995).
Furr, Eur. Urol., 29: 83-95 (1996).
Gallagher, et al., Toxicol. And Appl. Pharmacol. 134:81-91, (1995).
Ganem & Jefcoate, Toxicol. Appl. Pharmacol., 150: 68-75 (1998).
Garcia-Allan et al., J. Biochem. Mol. Toxicol.., 14: 65-72 (2000).
Geiger et al., Agents Actions, 38: Spec No. C69-72 (1993) Abstract only.
GenBank Accession No. AA799479 (Apr. 30, 1998).
GenBank Accession No. AA891812 (Jan. 25, 1999).
GenBank Accession No. AI177366 (Jan. 20, 1999).
GenBank Accession No. L23413, Bissig et al., "*Rattus norvegicus* sulfate anion transporter (sat-1) mRNA," Apr. 12, 1994.
GenBank Accession No. L26268, Raburn et al., "*Rattus norvegicus* anti-proliferative factor (BTG1) mRNA," Jan. 26, 1996.
GenBank Accession No. M25823 (Apr. 27, 1993).
Genes on Cloneth Atlas Human Stress/Toxicology Array from email/website dated Oct. 29, 1998.
Gerhold et al., Physiol. Genomics, 5: 161-170 (2001).
Ghatineh & Timbrell, Biochem. Soc. Trans., 18: 1217-1218 (1990).
Ghatineh et al., Arch. Toxicol., 66: 660-668 (1992).
Gobe, G., et al., J. Am. Soc. Nephrol., 11:454-467, (2000).
Goll et al., Toxicol. Appl. Pharmacol., 160: 21-32 (1999).
Golub et al., "Molecular Classification of Cancer: Class Discovery and Class Prediction by gene Expression monitoring," Science 285:531-537 (1999).
Gombar et al. Assesment of Developmental Toxicity Potential of Chemicals by Quantitative Structure-Toxicity Relationship Models, Chemosphere, 1995, vol. 31, No. 1, pp. 2499-2510.
Gomez-Lechon, et al., Toxicol. Sciences, 65:299-308, (2002).
Gooderham et al., "Molecular and genetic toxicology of 2-amino-1-methyl-6-phenylimidazo[4,5-*b*]pyridine (PhIP)," Mutation Research 506-507:91-99 (2001).
Gram & Bentsen, Acta Neurol. Scand. Suppl., 97: 81-90 (1983).
Greaves et al., Cancer Res., 53: 3919-3924 (1993).
Green et al., Toxicol. Appl. Pharmacol., 76: 139-149 (1984).
Grigg, Environmental Health Inst. to use gene chips to evaluate chemicals for potential harm to humans NEIHS, Feb. 29, 2000, entire document.
Guardavaccaro et al., Mol. Cell. Biol., 20: 1797-1815 (2000).
Guarner et al., Liver, 5: 35-39 (1985) Abstract only.
Hamada et al., Hepatology, 21: 1455-1464 (1995).
Hamada et al., J. Hepatol., 30: 807-818 (1999).
Hamadah, et al., Toxicol. Sciences, 67:232-240, (2002).
Hamaya, Y., et al., Anesth. Analg., 90:1177-1183, (2000).
Hargus et al., Chem. Res. Toxicol., 7: 575-582 (1994).
Hargus et al., Chem. Res. Toxicol., 8: 993-996 (1995).
Harries et al., Toxicol. In Vitro, 15: 399-405 (2001).
Harris et al., "Comparison of basal gene expression profiles and effects of hepatocarcinogens on gene expression in cultured primary human hepatocytes and HepG2 cells," Mutation Research 539:79-99 (2004).
Hartmann, et al., J. of Pharma. And Experim. Therap., 303:273-281, (2002).
Hartung & Wendel, Biochem. Pharmacol., 42: 1129-1135 (1991).
Hasegawa et al., Gan To Kagaku Ryoho 30:325-333 abstract (2003).
Hassett et al., Biochem. Pharmacol., 55: 1059-1069 (1998) Abstract only.
Hayashi et al., Biochim. Biophys. Acta., 879: 140-148 (1986) Abstract only.
He et al., J. Biol. Chem.., 276: 20858-20865 (2001).
He, et al., J. Clin. Invest., 108: 1321-1330 (2001).
Hellriegel et al., Biochem. Pharmacol., 52: 1561-1568 (1996).
Henger and Kretzler, et al., Kidney Int'l, 65:904-917, (2004).
Hessel et al., Braz. J. Med. Biol. Res., 29: 793-796 (1996).
Hewitt et al., J. Am. Soc. Nephrol. 15:1677-1689, (2004) Abstract only.
Higgs, B., et al., "Effects of Rat Gender and Strain on Elucidating Liver Toxicity," Soc. Of Tox. Mtg., (2003) Abstract only.
Hildebrand et al., Arch. Toxicol., 73: 233-245 (1999) Abstract only.
Hillstrom et al., Proc. Soc. Exp. Biol. Med., 200: 122-126 , 1992.
Hissink et al., Chem., Res. Toxicol., 9: 1249-1256 (1996).
Hoebe et al., Vet. Q., 22: 21-25 (2000) Abstract only.
Hogstrand et al., "Application of genomics and proteomics for study of the integrated response to zinc exposure in a non-model fish species, the rainbow trout," Comparative Biochemistry and Physiology Part B 133:523-535 (2002).
Hogue, Chemical and Engineering News, 79: 33-34 (2001).

Hoshi et al., Jpn. J. Pharmacol., 50: 289-293 (1989).
Huang, et al., Toxicol. Sciences, 63:196-207, (2001).
Hunter et al., Br. J. Pharmacol., 98: 79-86 (1989).
Hwang, et al., Biochem. And Biophys. Res. Commun., 146(1):87-93, (1987).
Iida, et al., Carcinogenesis, 24(4):757-770, (2003).
Inohara et al., EMBO J., 17: 2526-2533 (1998).
International Search Report in Applicant's corresponding PCT application, WO 02/095000 A3, published Nov. 28, 2002.
International Search Report in Applicants' PCT Application No. PCTUS01/23872, Mar. 21, 2003.
International Search Report in Applicants' PCT Application No. PCT/US05/34780, Mar. 30, 2006.
International Search Report in Applicants' PCT Application No. PCT/US04/39593, Mar. 8, 2006.
International Search Report in Applicants' PCT Applicant No. PCT/US05/11532, mailed Sep. 13, 2006.
Iredale et al., J. Clin. Invest., 102: 538-549 (1998).
Iswaran et al., J. Toxicol. Sci., 22 75-88 (1997).
Itoh et al., Behav. Brain Res., 83: 165-167 (1997).
Itoh et al., Eur. J. Pharmacol., 322: 11-19 (1997).
Izumi et al., J. Biol. Chem.., 272: 7381-7389 (1997).
Jaeschke, et al., Toxicol. Sciences, 65: 166-176 (2002).
Jakubczak et al., An Oncolytic Adenovirus Selective for Retinoblastoma Tumor Suppressor Protein Pathway-Defective Tumors, Cancer Research, Apr. 1, 2003, vol. 63, pp. 1490-1499.
Jansen, Muller, and Sturm, Hepatology, 34(6):1067-1074 (2001).
Jean et al., Toxicol. Lett., 95: 155-163 (1998).
Jenner & Timbrell, Arch. Toxicol., 68: 349-357 (1994).
Jeon et al., Toxicol. Appl. Pharmacol., 144: 27-35 (1997).
Johnson and McMillian, 23rd Annual Mtg. Of the Amer. College of Toxicology, p. 532 (2002).
Johnson and Wolfgang, Current Topics in Med. Chem., 1(4):233-245, (2001).
Johnson, K., et al., "Predictive Modeling of Hepatotoxicants Using Microarrays and a Linear Discrinimant Modeling Approach," ISMB Conf., Aug. 2002, (2002).
Johnston & Kroening, Pharmacol. Toxicol., 83: 231-239 (1998).
Jover et al., Toxic. in Vitro., 6: 47-52 (1992).
Kanaji et al., J. Cell Biol., 151:277-288 (2000).
Kannan et al., Oncogene., 20: 2225-2234 (2001).
Karam & Ghanayem, Carcinogenesis, 18: 2077-2083 (1997).
Kasper & Mueller, Carcinogenesis, 17: 2271-2274 (1996).
Kawamoto, et al., Gene, 174:151-158 (1996).
Kesterson et al., Hepatology, 4: 1143-1152 (1984).
Kikuchi et al., Gene Expressions and Activities of Protein Phosphatases 1 alpha, 2A and 2C in Hepatocarcinogenesis and Regeneration After Partial Hepatectomy, Cancer Detection and Prevention, 1997, vol. 21(1), pp. 36-43.
Kim & Ziegler, Drug Metab. Dispos., 28: 1003-1006 (2000).
Kim et al., Drug Metab. Dispos., 26: 66-72 (1998).
Kim et al., Toxicol. Appl. Pharmacol., 102: 34-39 (1990).
Kim et al., Toxicology and Applied Pharmacology 176:118-126 (2001).
Kinbara et al., Scand. J. Gastroenterol., 32: 947-952 (1997).
Kingsley et al., Epilepsia, 21: 699-704 (1980).
Kingsley et al., J. Clin. Pharmacol., 23: 178-185 (1983).
Knapp et al., Am. J. Vet. Res., 56: 801-805 (1995).
Kocarek et al., Mol. Pharmacol., 54: 474-84 (1998).
Koga et al., Fukuoka Igaku Zasshi, 82: 197-206 (1991).
Kondo et al., Cancer Res., 50: 6222-6228 (1990).
Kongo et al., Toxicol. Lett., 105: 103-110 (1999).
Konstandi et al., "Stress-mediated modulation of B(alpha)P-induced hepatic CYP1A1: role of catechnolamines," Chemico-Biological Interactions 147:abstract, (2004).
Koopen et al., Hepatology 27: 537-545 (1998).
Koopen et al., J. Lipid. Res. 40: 100-108 (1999).
Kossor et al., Biochem. Pharmacol., 46: 2061-2066 (1993).
Kossor et al., Fundam. Appl. Toxicol., 26: 51-62 (1995).
Kossor et al., Toxicol. Appl. Pharmacol., 119: 108-114 (1993).
Kretz-Rommel & Boelsterli, Toxicol. Appl. Pharmacol., 120: 155-161 (1993).
Kurota and Yamaguchi, Molec. And Cell. Biochem., 151:55-60, (1995).
Kwak et al., Mol. Med., 7: 135-145 (2001).
Kwon, et al., Am. J. Physiol. Renal Physiol. 279:F552-F564, (2000).
Lake et al., Toxicology., 131: 9-20 (1998).
Lake et al., Hepatic Effects of Phthalate Esters and Related., 67: pp. 283-290, (1986).
Lake, Annu. Rev. Pharmacol. Toxicol., 35: 483-507 (1995).
Lang et al., Alcohol Clin. Exp. Res., 22: 823-829 (1998).
Larsen & Jefcoate, Arch. Biochem. Biophys., 321: 467-476 (1995).
Lashkari et al., PNAS 94: 13057-13062, (1997).
Laskin et al., Hepatology, 21:1045-1050 (1995).
Lauredo et al., J. Appl. Physiol., 85: 2298-2304 (1998).
Lazartigues et al., Eur. J. Pharmacol., 361: 61-71 (1998).
LeBlank, G., et al., Cancer Research, 52:540-547, (1992).
Lecureur, V., et al., Toxicology, 153:203-219, (2000).
Lee et al., J. Pharmacol., 52: 341-355 (2000).
Lees et al., Lipids, 30: 221-226 (1995).
Leifeld, et al., Amer. J. of Pathol., 154(6):1711-1720, (1999).
Lewis et al., Hepatology, 2: 870-873 (1982).
Li et al., Zhonghua Gan Zang Bing Za Zhi, 9: 103-104 (2001).
Liang et al., Zhonghua Gan Zang Bing Za Zhi, 7: 72-73 (1999).
Liu et al., Infect. Immun., 66: 5089-5098 (1998).
Liu et al., Mol. Cell. Biol., 20: 6105-6113 (2000).
Liu et al., Proc. Natl. Acad. Sci. U.S.A.., 98: 6192-6197 (2001).
Liu et al., SHOCK, 14: 361-365 (2000).
Lock et al., Toxicol. Lett., 10: 427-435 (1982).
Lorenzini et al., Carcinogenesis, 17: 1323-1329 (1996).
Lovett, Science, 289: 536-537 (2000).
Lubman, et al., "What do the FDA and Pharma Companies Think of Toxicogenomics" (2002).
Lugovskoy et al., Cell, 99: 747-755 (1999).
Luhe, A., et al., Toxicol. Sciences, 73:315-328, (2003).
Lullmann & Lullmann-Rauch, Toxicol. Appl. Pharmacol., 61: 138-146 (1981).
MacGregor, et al., Toxicol. Sciences, 59:17-36, (2001).
Mahnke et al., Arch. Biochem. Biophys., 337: 62-68 (1997).
Mann, Toxicol. Pathol., 25: 72-79 (1997).
Manoukian & Carson, Drug Saf., 15: 64-71 (1996).
Marketing Materials, "Symposium on Toxicogenomics Launches New National Academics Program," Emerging Issues, 2: 1-7, (2003).
Markovich et al., "Heavy metals mercury, cadmium, and chromium inhibit the activity if the mammalian liver and kidney sulfate transporter sat-1," Toxicol. Appl. Pharmacol. 154:181-187 (1999).
Martelli et al., J. Pharmacol. Exp. Ther., 273: 113-120 (1995).
Masubuchi et al., J. Pharmacol. Exp. Ther., 287: 208-213 (1998).
Masubuchi et al., J. Pharmacol. Exp. Ther., 292: 982-987 (2000).
Mattes, W., & Orr, M., "Concordance of Toxicogenomic Predictions and Mechanistic Analysis for compounds Tested in Both Rat Liver and Primary Rat Hepatocytes," LabFusion 2004 Presentation, (2004).
Mattes, W., et al., "Cross-Species Analysis of Phenobarbital-Induced Gene Expression Changes in Dog and Rat," Soc. Of Toxicol. Mtg. 2003, (2003) Abstract only.
Mattes, W., et al., "Cross-Species Analysis of Phenobarbital-Induced Gene Expression Changes in Dog and Rat," Soc. Of Toxicol. Mtg. 2004, (2004).
Mayeux & Sano, N. Engl. J. Med., 341: 1670-1679 (1999).
Mayol et al., Carcinogenesis., 13: 2381-2388 (1992).
Maziasz et al., Toxicol. Appl. Pharmacol., 110: 365-373 (1991).
McKillop et al., Xenobiotica., 28: 465-478 (1998).
MDS Pharma Services Marketing Materials, "Pharmotif Solutions: Smart Decisions in Discovery and New Applications for Existing Drugs," 1-6, (2003).
Mendrick, D. L., ToxExpress, FDA-DIA Pharmacogenomics Workshop May 2002, (2002).
Mendrick, D., "Discovery of Relevant biomarkers for Nonclinical and Clinical Applications," American College of Toxicology Mtg. Nov. 8, 2004, (2004).
Mendrick, D., "Role of Gene Expression Studies in Nonclinical Toxicogenomics," PhRMA/FDA Genomics (Microarray) Biostatistics Workshop, (2004).

Mendrick, D.L., et al., "Using Gene Markers Identified From a Large Database Built with Primary Rat Hepatocytes for Prediction of Human Hepatotoxicity," Society of Toxicology Mtg, (2002).
Mendrick, D.L., et al., Cross compound predictions and pathway analysis using gene expression profiles from acetaminophen or carbon tetrachloride, two structurally distinct liver toxicants, Society of Toxicology Mtg, (2002).
Mendrick 1, Cysteine Protease Inhibitor (2004).
Mendrick, Extracellular Matrix Protein Dermatopontin., (2004).
Mendrick., Chemokine (2004).
Mendrick., Lipid Transpoter (2004).
Mendrick., "General Biological Findings for 80 Genes" (2004).
Mendrick, "Genomic Search for Candidate Biomarkers" (2004).
Menegazzi et al., Hepatology, 25: 585-592 (1997).
Meneses-Lorente, et al., Chem. Res. Toxicol., 16(9):A-H, 1070-1077), (2003).
Metz & Ritter, J. Biol. Chem., 237: 5607-5614 (1998).
Metz et al., Mol. Pharmacol., 58: 319-327 (2000).
Meyer, K., et al., Carcinogenesis, 24(5):975-984, (2003).
Milam and Byard, Toxicol. Appl. Pharmacol., 79: 342-347 (1985).
Minamide et al., J. Pharm. Sci., 87: 640-646 (1998).
Mino et al., J. Histochem. Cytochem., 46: 1151-1160 (1998).
Miracle et al., The Path from Molecular Indicators of Exposure., 12 : 457-462 (2003).
Mitchell & Acosta, J. Toxicol. Environ. Health, 7: 83-92 (1981).
Mitchell et al., Ann. Intern. Med., 84: 181-192 (1976).
Monteith et al., Drug Chem. Toxicol., 19: 71-84 (1996).
Moore et al., Fundam. Appl. Toxicol., 3: 560-568 (1983).
Moran et al., Immunopharmacology, 12: 245-250 (1986).
Morgan, K.T., et al., Toxicol. Pathol., 30(4):435-451, (2002).
Morigasaki et al., Biochem. Biophys. Res. Commun., 273: 261-266 (2000).
Morooka et al., J. Biol. Chem.., 270: 30084-30092 (1995).
Motoki et al., Cancer Lett., 135: 145-150 (1999).
Nakamura, et al., Clinical Immun. And Immunopath., 66(1):33-42, (1993).
Newsholme, et al., Electrophoresis, 21:2122-2128, (2000).
Nicholls-Grzemski et al., Toxicol. Sci., 56: 220-228 (2000).
Nims et al., Carcinogenesis., 8: 67-71 (1987).
Nordberg & Svensson, Drug Saf., 19: 465-480 (1998).
Nuwaisyr et al., "Microarrays and toxicology: the advent of toxicogenomics," Molecular Carcinogenesis 24(3):153-159, 1999.
Nuwaysir, et al., Cancer Research, 56:3704-3710, (1996).
Oberhammer et al., Hepatology, 23: 329-337 (1996).
O'Brien, et al., Toxicol. And Appl. Pharma., 171:27-37, (2001).
Ohta et al., Biochem. J., 324: 777-782 (1997).
Olden & Guthrie, Mutation Research, 473:3-10, (2001).
Olson et al., Fundam. Appl. Toxicol., 22: 631-640 (1994).
Omiecinski et al., Mol. Pharmacol., 38: 462-470 (1990).
Omiecinski, et al.,Toxicol. Sciences, 48:151-156, (1999).
Omogbai et al., Drug Chem. Toxicol., 22: 629-242 (1999).
Ono et al., Biol. Pharm. Bull., 18: 1779-1783 (1995) Abstract only.
Ono et al., Chem. Pharm. Bull. (Tokyo), 43: 1492-1496 (1995).
Orr, M., et al., Concordance of Toxicogenomic Predictions and Mechanistic Analysis for Compounds Tested in Both Rat Liver and Primary Rat Hepatocytes, Soc. Of Toxicol. Mtg., (2004).
Orr, M., et al., "Cross-species Comparison—Human and Rat," Soc. Of Toxicol. Mtg., (2004).
Orr, M.S., et al., "Microarray Analysis of NRF2 Pathway and Novel Co-Regulated Genes Induced by Acetaminophen," Soc. Of Toxicol. Mtg., (2002).
Orr, M.S., et al., "Predicting Toxicity in Two distinct Sections of the Kidney via Microarray Analysis," Soc. Of Toxicol. Mtg., (2002).
Orr, M, et al. "Challenges and Limitations of Gene Expression Profiling" 60: 6-10 (2001).
Orr, Michael, "Comparison of Liver Gene Dysregulation" 21: 253-262 (2002).
Orsler et al., Toxicol. Sci., 47: 203-210 (1999).
Outinen et al., Blood, 94: 959-967 (1999).
Owen et al., Biochem. J., 348 Pt 3: 607-614 (2000).
Panduro et al., Nephron, 65: 100-107 (1993).
Park & Pirmohamed, Toxicol. Lett., 120: 281-291 (2001).
Park et al., Pharmacol. Ther., 68: 385-424 (1995).
Passreiter et al., J. Cell Biol., 141: 373-383 (1998).
Peng et al., JBC 271(6): 3324-3327 (1996).
Pennie & Kimber, Toxicology in Vitro, 16:319-326, (2002).
Pennie, et al., Toxicol. Lett., 120: 353-358 (2001).
Pennie, et al., Toxicol. Sci. 54: 277-283 (2000).
Pennie, Toxicol. Lett., 112-113: 473-477 (2000).
Perrone et al., Toxicol. Appl. Pharmacol., 150: 277-286 (1998).
Petricoin III, et al., Nature Genetics Supp., 32:474-479, (2002).
Pfeffer et al., J Immunology 153(4):1789-1797 (1994).
Pischedda et al., Proc. Natl. Acad. Sci. U.S.A., 92: 3511-3515 (1995).
Plant, N., et al., Toxicol. And Applied Pharma., 183:127-134, (2002).
Pohl et al., Arthritis Rheum., 37: 1557 (1994).
Pollenz et al., Toxicol. Sci., 42: 117-128 (1998).
Porter, M., et al., "Determination of Biological Replicate Number for Rat and Human Microarray-Based Predictive and Mechanistic Assays," Soc. Of Toxicol. Mtg., (2003) Abstract only.
Porter, M., et al., "Effects of Hydration, Fasting and Anesthesia on Baseline Gene Expression," Soc. Of Toxicol. Mtg., (2003) Abstract only.
Porter, M., et al., "Liver Effects at the Gene Expression Level of Food-Tasting, Water Deprivation, and Anesthetic Agent Adminstration in Untreated Rats," Soc. Of Toxicol. Mtg., (2003) Abstract only.
Porter, M.W., et al., "Comparison of Microarray Data Generated from the Same RNA at 19 Different Processing Sites," Soc. Of Toxicol. Mtg., (2002).
Porter, Mark, "Comparison of Microarray data Generated from the same RNA at 15 Different Processing Sites," Soc. Of Toxicol. Mtg. Oct. 2002, (2003) Abstract only.
Poyet & Labrie, Mol. Cell. Endocrinol., 42: 283-288 (1985).
Prevot et al. J. Biol. Chem.., 276: 9640-9648 (2001).
Pumford et al., Drug Metab. Rev., 29: 39-57 (1997).
Raats, et al., Am. J. Pathol. 156:1749-1765, (2000).
Raburn et al., "Stage-specific expression of B Cell Translocation Gene 1 in rat testis," Endocrinology 136(12):5769-5777, 1995.
Raburn et al., Endocrinology 136(12):5769-5777, 1995. Abstract only.
Rajeski, David, "Exploring the Genomics Frontier," Risk Policy Report, pp. 1-5, (2002).
Ratanasavanh et al., Xenobiotica., 18: 765-771 (1988).
Ray & Jena, Arch. Toxicol., 73: 594-606 (2000).
Raychaudhuri et al., "Basic microarray analysis: grouping and feature reduction," Trends Biotechnol. 19:189-193 (2001).
Raymond et al., J. Toxicol. Environ. Health, 51: 463-476 (1997).
Reilly et al., Biochem. Biophys. Res. Commun., 282: 321-328 (2001).
Rejeski D., Exploring the Genomics Frontier, Aug. 20, 2002.
Reuter et al., Life Sci., 55: 1-8 (1994).
Rice et al., Carcinogenesis., 15: 395-402 (1994).
Rich et al., Nature, 407: 777-783 (2000).
Richert, L., et al., Toxicol. And Appl. Pharmacol., 191:130-146, (2003).
Riekkinen et al., Eur. J. Pharmacol., 322: 1-9 (1997).
Riekkinen et al., Eur. J. Pharmacol., 323: 11-19 (1997).
Riendeau et al., Br. J. Pharmacol., 121: 105-117 (1997).
Rininger et al., Biochem. Pharmacol., 52: 1749-1755 (1996).
Rininger et al., Drug Discov. Today, 5: 560-568 (2000).
Roberts et al., Toxicol. Appl. Pharmacol., 135: 192-199 (1995).
Rockett & Dix, Environ. Health Perspect., 107: 681-685 (1999).
Rodi et al., Toxicol. Pathol., 27: 107-110 (1999) Abstract only.
Rodrigues & Machinist, Toxicol. Appl. Pharmacol., 137: 193-201 (1996).
Ronchetti et al., "Robust Linear Model Selection by Cross-Validation," J. Am. Statistical Assoc. 92:1017-1023 (1997).
Ruepp et al., Toxicol. Sci., 65: 135-150 (2002).
Runge-Morris et al., Drug Metab. Dispos., 26: 795-801 (1998).
Rusyn, et al., Cancer Research, 64:1050-1057. (2004).
Sachidanandam et al., Nature, 409: 928-933 (2001).
Safe, Annu. Rev. Pharmacol. Toxicol., 38: 121-158 (1998).
Salter and Nilsson, Drug Disc. and Dev., 6(1):117-122 (2003).
Sanz, et al., British J. of Cancer, 75(4):487-492, (1997).
Scales & Timbrell, J. Toxicol. Environ. Health, 10: 941-953 (1982).
Scali et al., Pharmacol. Res., 36: 463-469 (1997).
Scassa et al., Exp. Cell Res., 244: 460-469 (1998) Abstract only.

Schiaffonati & Tiberio, Liver, 17: 183-191 (1997) Abstract only.
Schiller et al., Toxicol. Appl. Pharmacol., 81: 356-361 (1985).
Schilter, B. et al. Activation of cytochrome P450 gene expression in rat brain by phenobarbital-like inducers. J Pharmacol Exp Ther 294(3):916-22 (Sep. 2000). Abstract only.
Schiodt et al., N. Engl. J. Med., 337: 1112-1117 (1997).
Schoetler et al., Am. J. Med., 80: 34-38 (1986).
Schulte-Hermann et al., Cancer Res., 48: 2462-2468 (1988).
Schuppe-Koistinen, et al., Toxicology, 179:197-219, (2002).
Seefeld et al., Arch. Environ. Contam. Toxicol., 9: 317-327 (1980).
Sendo et al., Chem. Pharm. Bull. (Tokyo), 32: 795-796 (1984).
Servais & Galand, Cell Biol. Int Rep., 16: 319-328 (1992).
Shankar, K., et al., "PPAR-a Mediates Diabetes-Induced Resistance Against Acetaminophen Hepatotoxicity: . . . ," Ann. Mtg. Of the Amer. College of Toxicol., p. 526 (2002) Abstract only.
Shannon et al., J. Pharmacol. Exp. Ther., 255: 1071-1077 (1990).
Shao, "Linear Model Selection by Cross-Validation," J. Am. Statistical Assoc. 88:486-494 (1993).
Shervington, Biochem. Mol. Biol. Int., 45: 303-313 (1998) Abstract only.
Shiota et al., Res. Commun. Mol. Pathol. Pharmacol. 94: 141-146 (1996).
Shultz et al., Toxicol. Appl. Pharmacol., 154:84-96 (1999) Abstract only.
Sidhu & Omiecinski, J. Biochem. Mol. Toxicol., 13: 1-9 (1999) Abstract only.
Sidhu & Omiecinski, J. Biol. Chem., 273: 4769-4775 (1998) Abstract only.
Sidhu et al., Arch. Biochem. Biophys., 301: 103-113 (1993).
Simmons, P.T. & Portier, C.J., Carcinogenesis, 23(6):903-905, (2002).
Sinz & Woolf, Biochem. Pharmacol., 54: 423-427 (1997).
Skouteris and McMenamin, Biochem. J., 281: 729-733 (1992).
Skrtic et al., J. Hepatol., 27: 903-911 (1997).
Smith, Trends Pharmacol. Sci., 22: 281-285 (2001).
Snape et al., Neuropharmacology, 38: 181-193 (1999).
Soffers, A.E.M.F., et al., Toxic, In Vitro, 15:539-551 (2001).
Somani & Dube, Int. J. Clin. Pharmacol. Ther. Toxicol., 27: 367-387 (1989).
Somani, Biopharm. Drug Dispos., 10: 187-203 (1989).
Soni et al., Regul. Toxicol. Pharmacol., 29: 165-174 (1999).
Sprankle, C., et al., Cancer Letters, 101:97-106, (1996).
Stachlewitz et al., J. Pharmacol. Exp. Ther., 282: 1591-1599 (1997).
Steiner, et al., Environ. Health Perspect., 112(12):1236-1248, (2004).
Stohs et al., Biochem. Biophys. Res. Commun., 111:854-859 (1983).
Su, et al., Proc. Natl. Acad. Sci. USA, 99(17):11181-11186, (2002).
Séurmen & Eryéurek, Toxicology, 75: 63-69 (1992) Abstract only.
Suter, et al., "Toxicogenomics: Correlation of acetaminophen-induced hepatoxicity with gene expression using DNA microarrays," Soc. Of Toxicogenomics Mtg., (2000).
Sutter, et al., Mol. Cancer Therapeutics, 1:1283-1292, (2002).
Suzuki and Sudo, Japan J. Pharmacol., 49:43-51, (1989).
Tamura et al., Toxicology, 63: 199-213 (1996) Abstract only.
Tao, et al., Experimental Hermatology, 31:251-260 (2003).
Tarloff et al., Fundam. Appl. Toxicol. 30: 13-22 (1996).
Tenniswood et al., Mol. Cell. Endocrinol., 37: 153-158 (1984).
Thomas, R.S., et al., Molecular Pharmacol., 60(6):1189-1194, (2001).
Timbrell et al., J. Pharmacol. Exp. Ther., 213: 364-369 (1980).
Timbrell et al., J. Toxicol. Environ. Health, 10: 955-968 (1982).
Timbrell, Arch. Toxicol. Suppl., 2: 1-8 (1979).
Tournier et al., Lab. Invest., 59: 657-665 (1988).
Trauner et al., N. Engl. J. Med., 339: 1217-1227 (1998).
Tu, Y., et al., Proc. Nat'l. Acad. Sci. USA, 99(22):14031-14036, (2002).
Tucker et al., Fundam. Appl. Toxicol., 3: 579-586 (1983).
Tucker, Am. J. Med., 73: 27-30 (1982).
Tygstrup et al., J. Hepatol., 25: 183-190 (1996).
Tygstrup et al., J. Hepatol., 27: 156-162 (1997).
Tygstrup, et al., Biochem. And. Biophys. Res. Commun., 290(1):518-525, (2002).
Uhl et al., Mutat. Res., 468: 213-225 (2000) Abstract only.
van Gijssel et al., Carcinogenesis, 18: 1027-1033 (1997).
Vance et al., Epilepsia, 35: 1016-1022 (1994).
Verstrepen, et al., Kidney Int'l, 43:1267-1279, (1993).
Venturelli et al., Overexpression of DR-nm23, 92: 7435-7439 (1995).
Visen et al., J. Pharmacol. Toxicol. Methods., 40: 173-179 (1998).
Wan et al., Infect. Immun., 63: 2435-2442 (1995).
Wang & Dickinson, Drug Metab. Dispos., 26: 98-104 (1998).
Waring & Ulrich, Annu. Rev. Pharmacol. Toxicol., 40: 335-352 (2000).
Waring et al., Toxicol. Appl. Pharmacol., 175: 28-42 (2001).
Waring et al., Toxicol. Lett., 120: 359-368 (2001).
Waring, et al., Environ. Health Perspect., 111:863-870, (2003).
Waterfield et al., Biochem. Pharmacol., 46: 589-595 (1993).
Weber et al., Fundam. Appl. Toxicol., 21: 523-534 (1993).
Weber et al., Toxicology, 66: 133-144 (1991).
Weisenberg-Boettcher et al., A Novelty Highly Potent, Nov. 12: 501-509 (1989).
Wessely, S., et al., Human & Experimental Toxicology, 18:740-764, (1999).
White et al., Biochem. Pharmacol., 45: 21-30 (1993).
White et al., Carcinogenesis, 13: 2197-2203 (1992).
Wilson, et al. PNAS 96:12833-12838 (1999).
Woodcroft & Novak, Drug Metab. Dispos., 26: 372-378 (1998) Abstract only.
Woodward & Timbrell, Toxicology., 30: 65-74 (1984).
Woolf et al., Drug Metab. Dispos., 21: 874-882 (1993).
Xiong et al., "Feature (Gene) Selection in Gene Expression-Based Tumor Classification," Mol. Genet. Metab. 73:239-247 (2001).
Xiong et al., Life Sci., 65: 421-430 (1999).
Xu, et al., World J. Gastreonterol, 10(2):250-254, (2004).
Yamada et al., Life Sci., 61: 171-179 (1997) Abstract only.
Yamaki et al., "Cellular mechanism of lithiumk-induced nephrogenic diabetes insipidus in rats," Am. J. Physiol. Renal Physiol. 261:F505-F511, (1991).
Yang et al., Am J Physiology 277(1):F10-F16 (1999).
Yata et al., J. Hepatol., 30: 419-424 (1999).
Zarif et al., The Effect of A Selective 5-Lipoxygenase, vol. 20, 217-227 (1996).
Zeeberg, et al., Genome biology, 4:R28: 1-8, (2003).
Zhao Y. et al, Activation of Pro-death Bet-2-Family, vol. 276: 27432-27440 (2001).
Zhou G., et al., Role of AMP-activated protein kinase in mechanism, 108: 1167-1174, 2001.

* cited by examiner

MOLECULAR TOXICOLOGY MODELING

RELATED APPLICATIONS

This application claims priority to U.S. Provisional Applications 60/292,335 filed on May 22, 2001; 60/297,523 filed on Jun. 13, 2001; 60/298,925 filed on Jun. 19, 2001; 60/303,810 filed on Jul. 10, 2001; 60/303,807 filed on Jul. 10, 2001; 60/303,808 filed on Jul. 10, 2001; 60/315,047 filed on Aug. 28, 2001; 60/324,928 filed on Sep. 27, 2001; 60/330,867 filed on Nov. 1, 2001; 60/330,462 filed on Oct. 22, 2001; 60/331,805 filed on Nov. 21, 2001; 60/336,144 filed on Dec. 6, 2001; 60/340,873 filed on Dec. 19, 2001; 60/357,843 filed on Feb. 21, 2002; 60/357,842 filed on Feb. 21, 2002; 60/357,844 filed on Feb. 21, 2002; 60/364,134 filed on Mar. 15, 2002; 60/370,206 filed on Apr. 8, 2002; 60/370,247 filed on Apr. 8, 2002; 60/370,144 filed on Apr. 8, 2002; 60/371,679 filed on Apr. 12, 2002; and 60/372,794 filed on Apr. 17, 2002, all of which are herein incorporated by reference in their entirety. This application is also related to U.S. application Ser. Nos. 09/917,800 and 10/060,087, both of which are also herein incorporated by reference in their entirety.

SEQUENCE LISTING SUBMISSION ON COMPACT DISC

The Sequence Listing submitted concurrently herewith on compact disc under 37 C.F.R. §§1.821(c) and 1.821(e) is herein incorporated by reference in its entirety. Three copies of the Sequence Listing, one on each of three compact discs are provided. Copy 1 and Copy 2 are identical. Copies 1 and 2 are also identical to the CRF. Each electronic copy of the Sequence Listing was created on May 22, 2002 with a file size of 3088 KB. The file names are as follows: Copy 1- gl5089us.txt; Copy 2- gl5089us.txt; CRF-gl5089us.txt.

BACKGROUND OF THE INVENTION

The need for methods of assessing the toxic impact of a compound, pharmaceutical agent or environmental pollutant on a cell or living organism has led to the development of procedures which utilize living organisms as biological monitors. The simplest and most convenient of these systems utilize unicellular microorganisms such as yeast and bacteria, since they are the most easily maintained and manipulated. In addition, unicellular screening systems often use easily detectable changes in phenotype to monitor the effect of test compounds on the cell. Unicellular organisms, however, are inadequate models for estimating the potential effects of many compounds on complex multicellular animals, as they do not have the ability to carry out biotransformations.

The biotransformation of chemical compounds by multicellular organisms is a significant factor in determining the overall toxicity of agents to which they are exposed. Accordingly, multicellular screening systems may be preferred or required to detect the toxic effects of compounds. The use of multicellular organisms as toxicology screening tools has been significantly hampered, however, by the lack of convenient screening mechanisms or endpoints, such as those available in yeast or bacterial systems. Additionally, previous attempts to produce toxicology prediction systems have failed to provide the necessary modeling data and statistical information to accurately predict toxic responses (e.g., WO 00/12760, WO 00/47761, WO 00/63435, WO 01/32928, and WO 01/38579).

SUMMARY OF THE INVENTION

The present invention is based on the elucidation of the global changes in gene expression in tissues or cells exposed to known toxins, in particular renal toxins, as compared to unexposed tissues or cells as well as the identification of individual genes that are differentially expressed upon toxin exposure.

In various aspects, the invention includes methods of predicting at least one toxic effect of a compound, predicting the progression of a toxic effect of a compound, and predicting the renal toxicity of a compound. The invention also includes methods of identifying agents that modulate the onset or progression of a toxic response. Also provided are methods of predicting the cellular pathways that a compound modulates in a cell. The invention also includes methods of identifying agents that modulate protein activities.

In a further aspect, the invention includes probes comprising sequences that specifically hybridize to genes in Tables 1-5. Also included are solid supports comprising at least two of the previously mentioned probes. The invention also includes a computer system that has a database containing information identifying the expression level in a tissue or cell sample exposed to a renal toxin of a set of genes comprising at least two genes in Tables 1-5.

DETAILED DESCRIPTION

Many biological functions are accomplished by altering the expression of various genes through transcriptional (e.g. through control of initiation, provision of RNA precursors, RNA processing, etc.) and/or translational control. For example, fundamental biological processes such as cell cycle, cell differentiation and cell death, are often characterized by the variations in the expression levels of groups of genes.

Changes in gene expression are also associated with the effects of various chemicals, drugs, toxins, pharmaceutical agents and pollutants on an organism or cell. For example, the lack of sufficient expression of functional tumor suppressor genes and/or the over expression of oncogene/protooncogenes after exposure to an agent could lead to tumorgenesis or hyperplastic growth of cells (Marshall (1991), *Cell* 64: 313-326; Weinberg (1991), *Science* 254: 1138-1146). Thus, changes in the expression levels of particular genes (e.g. oncogenes or tumor suppressors) may serve as signposts for the presence and progression of toxicity or other cellular responses to exposure to a particular compound.

Monitoring changes in gene expression may also provide certain advantages during drug screening and development. Often drugs are screened for the ability to interact with a major target without regard to other effects the drugs have on cells. These cellular effects may cause toxicity in the whole animal, which prevents the development and clinical use of the potential drug.

The present inventors have examined tissue from animals (kidney cells) exposed to known renal toxins which induce detrimental kidney effects, to identify global changes in gene expression induced by these compounds (Tables 5-5CC). These global changes in gene expression, which can be detected by the production of expression profiles (an expression level of one or more genes), provide useful toxicity markers that can be used to monitor toxicity and/or toxicity progression by a test compound. Some of these markers may also be used to monitor or detect various disease or physiological states, disease progression, drug efficacy, and drug metabolism.

Identification of Toxicity Markers

To evaluate and identify gene expression changes that are predictive of toxicity, studies using selected compounds with well characterized toxicity have been conducted by the present inventors to catalogue altered gene expression during exposure in vivo and in vitro. In the present study, cephaloridine, cisplatin, puromycin aminonucleoside (PAN), bromoethylamine hydrobromide (BEA), gentamicin, ifosfamide, cyclophosphamide, carboplatin, AY-25329, indomethacin, acyclovir, citrinin, mercuric chloride, diflunisal, cidofovir, pamidronate, lithium, hydralazine, colchicine, sulfadiazine, and adriamycin were selected as known renal toxins.

Cephaloridine is an amphoteric, semi-synthetic, broad-spectrum cephalosporin derived from cephalosporin C. Cephalosporins are β-lactam-containing antibiotics which prevent bacterial growth by inhibiting polymerization of the peptidoglycan bacterial cell wall. The linear glycan chains (composed of N-acetylglucosime and N-acetylmuramic acid) are cross-linked to each other by the coupling of short chains of several amino acids, the coupling resulting from the action of a transpeptidase. It is believed that cephalosporins act by blocking the activity of the transpeptidase (*Goodman & Gilman's The Pharmalogical Basis of Therapeutics* 9th ed., J. G. Hardman et al. Eds., McGraw Hill, New York, 1996, pp. 1074-1075, 1089-1095).

Cephaloridine is administered intramuscularly and is used to treat infections of the respiratory tract, gastrointestinal tract and urinary tract, as well as infections of soft tissue, bones and joints. Noted adverse effects include hypersensitivity reactions (such as anaphylactic shock, urticaria and bronchospasm), gastrointestinal disturbances, candidiasis, and cardiovascular and blood toxicity, in particular, toxicity to the hematopoietic system (cells responsible for the formation of red and white blood cells and platelets).

Although cephaloridine may be nephrotoxic at high dosages, it is not as harmful to the kidneys as are the aminoglycosides and polymixins. High dosages of cephaloridine may cause acute renal tubular necrosis (*Cecil Textbook of Medicine*, 20th ed., part XII, p. 586, J. C. Bennett and F. Plum Eds., W. B. Saunders Co., Philadelphia, 1996) or drug-induced interstitial nephritis, which is accompanied by elevated IgE levels, fever, arthralgia and maculopapular rash. Renal biopsoy demonstrates edema and interstitial inflammatory lesions, mainly with lymphocytes, monocytes, eosinophils and plasma cells. Vasculitis of small vessels may develop, leading to necrotising glomerulonephritis (G. Koren, "The nephrotoxic potential of drugs and chemicals. Pharmacological basis and clinical relevance.," *Med Toxicol Adverse Drug Exp* 4(1):59-72, 1989).

Cephaloridine has also been shown to reduce mitochondrial respiration and uptake of anionic succinate and carrier-mediated anionic substrate transport (Tune et al. (1990), *J Pharmacol Exp Ther* 252: 65-69). In a study of oxidative stress and damage to kidney tissue, cephaloridine depleted reduced glutathione (GSH) and produced oxidized glutathione (GSSG) in the renal cortex. This drug also inhibited glutathione reductase and produced malondialdehyde and conjugated dienes (Tune et al. (1989), *Biochem Pharmacol* 38: 795-802). Because cephaloridine is actively transported into the proximal renal tubule, but slowly transported across the lumenal membrane into the tubular fluid, high concentrations can accumulate and cause necrosis. Necrosis can be prevented by administering inhibitors of organic anion transport, although such treatment may be counterproductive, as cephaloridine is passed in and out of the kidney by the renal organic anion transport system (Tune et al. (1980), *J Pharmacol Exp Ther* 215: 186-190).

Cisplatin ($Pt(NH_3)_2(Cl)_2$), a broad-spectrum anti-tumor agent, is commonly used to treat tumors of the testicles, ovaries, bladder, skin, head and neck, and lungs (PDR 47th ed., pp. 754-757, Medical Economics Co., Inc., Montvale, N.J., 1993; *Goodman & Gilman's The Pharmalogical Basis of Therapeutics* 9th ed., pp. 1269-1271, J. G. Hardman et al. Eds., McGraw Hill, New York, 1996). Cisplatin diffuses into cells and functions mainly by alkylating the $N^7$ of guanine, a highly reactive site, causing interstrand and intrastrand crosslinks in the DNA that are lethal to cells. The drug is not sensitive to the cell cycle, although its effects are most pronounced in S phase.

Because the drug is cleared from the body mainly by the kidneys, the most frequent adverse effect of cisplatin usage is nephrotoxicity, the severity of which increases with increasing dosage and treatment terms. Other adverse effects include renal tubule damage, myelosuppression (reduced numbers of circulating platelets, leukocytes and erythrocytes), nausea and vomiting, ototoxicity, serum electrolyte disturbances (decreased concentrations of magnesium, calcium, sodium, potassium and phosphate, probably resulting from renal tubule damage), increased serum concentrations of urea and creatinine, and peripheral neuropathies.

In one study on rats (Nonclercq et al. (1989), *Exp Mol Pathol* 51: 123-140) administration of cisplatin or carboplatin induced renal injury, carboplatin causing less damage than cisplatin. The most prominent injury was to the straight portion of proximal renal tubule.

In another rat study (Goldstein et al. (1981), *Toxicol Appl Pharmacol* 60: 163-175) animals injected with cisplatin displayed decreased food intake as drug dosage increased. On day 2, the high-dose groups (10-15 mg/kg) exhibited a six or seven-fold elevation in BUN. On day 4, BUN elevation was noted in the 5 mg/kg group. An increase in urine volume was observed beginning on days 3-4, along with decreased urine osmolality in the low-dose groups (2.5 or 5 mg/kg). Another experiment on rats (Agarwal et al. (1995), *Kidney Int* 48: 1298-1307) showed that cisplatin treatment produced elevations in serum creatinine levels, which began on day 3 and progressed for the duration of the study.

PAN ($C_{22}H_{29}N_7O_5$), an antibiotic produced by *Streptomyces alboniger*, inhibits protein synthesis and is commonly used experimentally on rats to mimic human minimal change disease. One study showed that PAN-injected rats demonstrated an increase in levels of serum non-esterified fatty acids, while the serum albumin concentration was negatively affected (Sasaki et al. (1999), *Adv Exp Med Biol* 467: 341-346).

In another rat study, an adenosine deaminase inhibitor prevented PAN nephrotoxicity, indicating that PAN toxicity is linked to adenosine metabolism (Nosaka et al. (1997), *Free Radic Biol Med* 22: 597-605). Another group showed that PAN, when administered to rats, led to proteinuria, a condition associated with abnormal amounts of protein in the urine, and renal damage, e.g. blebbing of glomerular epithelial cells, focal separation of cells from the glomerular basement membrane, and fusion of podocytes (Olson et al. (1981), *Lab Invest* 44: 271-279). In another study on rats, administration of PAN induced glomerular epithelial cell apoptosis in a dose- and time-dependent manner (Sanwal et al. (2001), *Exp Mol Pathol* 70: 54-64).

One study with PAN-injected rats (Koukouritaki et al. (1998), *J Investig Med* 46: 284-289) examined the changes in the expression of the proteins paxillin, focal adhesion kinase, and Rho, all of which regulate cell adhesion to the extracellular matrix. Paxillin levels increased steadily, peaked at day 9 after PAN injection, and then remained elevated even after proteinuria resolved. There was no observed change in expression of either focal adhesion kinase or Rho.

BEA, ($C_2H_6BrN \cdot HBr$), is commonly used experimentally on rats to induce papillary necrosis and renal cortex damage, which is similar to human analgesic nephropathy. BEA-induced papillary necrosis in rats eventually leads to the onset of focal glomerular sclerosis and nephrotic proteinuria (Garber et al. (1999), *Am J Kidney Dis* 33: 1033-1039). Even at low doses (50 mg/kg), BEA can induce an apex limited renal papillary necrosis (Bach et al. (1983), *Toxicol Appl Pharmacol* 69: 333-344). In male Wistar rats, BEA administered at 100 mg/kg was shown to cause renal papillary necrosis within 24 hours (Bach et al. (1991), *Food Chem Toxicol* 29: 211-219). Additionally, Bach et al. showed that there was an increase in urinary triglycerides, and lipid deposits were seen by Oil Red O lipid staining in the cells of the collecting ducts and hyperplastic urothelia adjacent to the necrosed region.

It has also been shown that succinate and citrate concentrations are significantly lower in the urine of BEA-treated rats (Holmes et al. (1995), *Arch Toxicol* 70: 89-95). Moreover, BEA treatment induced glutaric and adipic aciduria, which is symptomatic of an enzyme deficiency in the acyl CoA dehydrogenases. The same study examined urinary taurine levels in desert mice, and in BEA-treated desert mice there was an increase in the urinary taurine level which is indicative of liver toxicity.

Another study on BEA-treated rats showed that there was an increase in the concentrations of creatine in the renal papilla and glutaric acid in the liver, renal cortex, and renal medulla as soon as 6 hours post-treatment (Garrod et al. (2001), *Magn Reson Med* 45: 781-790).

Discovered and purified in the early 1960's, gentamicin is a broad-spectrum aminoglycoside antibiotic that is cidal to aerobic gram-negative bacteria and commonly used to treat infections, e.g., those of the urinary tract, lungs and meninges. As is typical for an aminoglycoside, the compound is made of two amino sugar rings linked to a central aminocyclitol ring by glycosidic bonds. Aminoglycosides are absorbed poorly with oral administration, but are excreted rapidly by the kidneys. As a result, kidney toxicity is the main adverse effect, although ototoxicity and neuromuscular blockade can also occur. Gentamicin acts by interfering with bacterial protein synthesis. This compound is more potent than most other antibacterial inhibitors of protein synthesis, which are merely bacteriostatic, and its effects on the body are, likewise, more severe (*Goodman & Gilman's The Pharmalogical Basis of Therapeutics* $9^{th}$ ed., pp. 1103-1115, J. G. Hardman et al. Eds., McGraw Hill, New York, 1996).

Aminoglycosides work rapidly, and the rate of bacterial killing is concentration-dependent. Residual bactericidal activity remains after serum concentration has fallen below the minimum inhibitory concentration (MIC), with a duration that is also dosage/concentration-dependent. The residual activity allows for once-a-day administration in some patients. These drugs diffuse into bacterial cells through porin channels in the outer membrane and are then transported across the cytoplasmic membrane via a membrane potential that is negative on the inside (Goodman & Gilman, supra).

Kidney damage, which can develop into renal failure, is due to the attack of gentamicin on the proximal convoluted tubule, particularly in the S1 and S2 segments. The necrosis, however, is often patchy and focal (Shanley et al. (1990), *Ren Fail* 12: 83-87). A rat study by Shanley et al. showed that superficial nephrons are more susceptible to necrosis than juxtamedullary nephrons, although the initial segment of the superficial nephrons is remarkably resistant to necrosis.

Reported enzymatic changes upon gentamicin treatment are increased activities of N-acetyl-beta-D-glucosaminidase and alkaline phosphatase and decreased activities of sphingomyelinase, cathepsin B, $Na^+/K^+$-ATPase, lactate dehydrogenase and NADPH cytochrome C reductase, along with decreased protein synthesis and alpha-methylglucose transport (Monteil et al. (1993), *Ren Fail* 15: 475-483). An increase in gamma-glutamyl transpeptidase activity in urine has also been reported (Kocaoglu et al. (1994), *Arch Immunol Ther Exp (Warsz)* 42: 125-127), and the quantification of this enzyme in urine is a useful marker for monitoring gentamicin toxicity.

One source of renal pathology resulting from gentamicin treatment is the generation of reactive oxygen metabolites. Gentamicin has been shown, both in vitro and in vivo, to be capable of enhancing the production of reactive oxygen species. Iron, a necessary co-factor that catalyzes free-radical formation, is supplied by cytochrome P450 (Baliga et al. (1999), *Drug Metab Rev* 31: 971-997).

A gene delivery experiment in rats, in which the human kallikrein gene was cloned into an adenovirus vector and the construct then co-administered with a gentamicin preparation, showed that kallikrein can protect against gentamicin-induced nephrotoxicity. Significantly increased renal blood flow, glomerular filtration rates and urine flow were observed, along with decreased renal tubular damage, cellular necrosis and lumenal protein casts. Kallikrein gene delivery also caused a decrease in blood urea nitrogen levels and increases in urinary kinin and nitrite/nitrate levels. This study provides evidence that the tissue kallikrein-kinin system may be a key pathway that is perturbed during the induction of nephrotoxicity by gentamicin (Murakami et al. (1998), *Kidney Int* 53: 1305-1313).

Ifosfamide, an alkylating agent, is commonly used in chemotherapy to treat testicular, cervical, and lung cancer. Ifosfamide is slowly activated in the liver by hydroxylation, forming the triazene derivative 5-(3,3-dimethyl-1-triazeno)-imidazole-4-carboxamide (DTIC) (*Goodman & Gilman's The Pharmacological Basis of Therapeutics* $9^{th}$ ed., p.1235, J. G. Hardman et al., Eds., McGraw Hill, New York, 1996). Cytochrome P450 activates DTIC via an N-demethylation reaction yielding an alkylating moiety, diazomethane. The active metabolites are then able to cross-link DNA causing growth arrest and cell death. Though ifosfamide is therapeutically useful, it is also associated with nephrotoxicity, urotoxicity, and central neurotoxicity.

Mesna, another therapeutic, is often administered concomitantly to prevent kidney and bladder problems from arising (Brock and Pohl (1986), *IARC Sci Publ* 78: 269-279). However, there are documented cases in which tubular toxicity occurred and elevated urinary levels of alanine aminopeptidase and N-acetyl-beta-D-glucosaminidase were found in patients even though mesna was administered alongside ifosfamide (Goren et al. (1987), *Cancer Treat Rep* 71: 127-130).

One study examined 42 patients that had been administered ifosfamide to treat advanced soft-tissue sarcoma (Stuart-Harris et al. (1983), *Cancer Chemother Pharmacol* 11: 69-72). The ifosfamide dosage varied from 5.0 $g/m^2$ to 8.0 $g/m^2$, and all of the patients were given mesna to counteract the negative effects of ifosfamide. Even so, nausea and vomiting were common to all of the patients. Out of the 42 patients, seven developed nephrotoxicity, and two of the cases progressed to fatal renal failure.

In another clinical study, renal tubular function was monitored in 18 neuroblastoma patients (Caron et al. (1992), *Med Pediatr Oncol* 20: 42-47). Tubular toxicity occurred in at least 12 of the patients, and seven of those patients eventually developed Debre-de Toni-Fanconi syndrome, although in 3 cases the syndrome was reversible.

Fanconi syndrome is a disorder marked by dysfunction of the proximal tubules of the kidney. It is associated with aminoaciduria, renal glycosuria, and hyperphosphaturia. Ifosfamide is often used experimentally on rats to induce Fanconi syndrome. In one study, rats that were administered 80 mg/kg of ifosfamide had significantly lower body weight and hematocrit than control rats (Springate and Van Liew (1995), *J Appl Toxicol* 15: 399-402). Additionally, the rats had low-grade glucosuria, proteinuria, and phosphaturia. In a mouse study, ifosfamide induced elevated serum creatinine and urea levels and decreased the clearance rate of creatinine (Badary (1999), *J Ethnopharmacol* 67: 135-142).

Cyclophosphamide, a nitrogen mustard and alkylating agent, is highly toxic to dividing cells and is commonly used in chemotherapy to treat malignant lymphomas, such as non-Hodgkin's lymphomas and Burkitt's lymphoma, multiple myeloma, leukemias, neuroblastomas, ovarian adenocarcinomas and retinoblastomas, as well as breast and lung cancer (*Goodman & Gilman's The Pharmacological Basis of Therapeutics* 9th ed., pp.1234, 1237-1239, J. G. Hardman et al., eds., McGraw Hill, New York, 1996; Physicians Desk Reference, 47th ed., pp. 744-745, Medical Economics Co., Inc., Montvale, N.J., 1993). Additionally, cyclophosphamide is used as an immunosuppressive agent in bone marrow transplantation and following organ transplantation. Although cyclophosphamide is therapeutically useful against certain types of cancer, it is also associated with cardiotoxicity, nephrotoxicity (including renal tubular necrosis), hemorrhagic cystitis, myelosuppression, hepatotoxicity, impairment of male and female reproductive systems, interstitial pneumonitis and central nervous system toxicity.

Once in the liver, cyclophosphamide is hydroxylated by the cytochrome P450 mixed function oxidase system, producing the active metabolites phosphoramide mustard and acrolein, which cross-link DNA and cause growth arrest and cell death. These metabolites, however, are highly toxic and cause adverse effects in the other organs into which they are transported, such as the kidneys. Acrolein is removed from the kidneys by secretion into the urine, resulting in cystitis (inflammation of the bladder), often hemorrhagic cystitis.

In the kidney, cyclophosphamide induces necrosis of the renal distal tubule. Cyclophosphamide, which is structurally similar to the anti-cancer drug ifosfamide, does not induce damage to the renal proximal tubule nor does it induce Debre-de Toni-Fanconi syndrome (Rossi et al. (1997), *Nephrol Dial Transplant* 12: 1091-1092).

One clinical trial of patients being treated with cyclophosphamide showed that renal damage from the drug leads to a reduced biotransformation rate and low renal clearance of the drug, resulting in a build-up of toxic alkylating metabolic products (Wagner et al. (1980), *Arzneimittelforschung* 30: 1588-1592).

In a study of patients suffering from malignant lymphomas and mammary carcinomas, a direct relationship was found between the dose of cyclophosphamide used in treatment and the concentration of alkylating metabolites in the patients' urine. The upper limit of the dose was determined by the nature and degree of the toxic side effects, rather than by the rate at which the drug could be metabolized (Saul et al. (1979), *J Cancer Res Clin Oncol* 94: 277-286). It is the acrolein itself that is toxic, not the alkylating activity of cyclophosphamide (Brock et al. (1979), i Arzneimittelforschung 29: 659-661). A study on rats also showed that acrolein from the kidneys can produce hemorrhagic cystitis and that the acrolein concentration is directly related to the frequency and severity of the cystitis (Chijiwa et al. (1983), *Cancer Res* 43: 5205-5209).

Carboplatin, a platinum coordination complex, is commonly used in chemotherapy as an anti-tumor agent. As a chemotherapeutic agent, carboplatin acts similarly to cisplatin. Carboplatin enters the cell by diffusion where it is activated by hydrolysis (*Goodman & Gilman's The Pharmacological Basis of Therapeutics* 9th ed., p. 1270-1271, J. G. Hardman et al. Eds., McGraw Hill, New York 1996). Once activated, the platinum complexes are able to react with DNA causing cross-linking to occur. One of the differences between carboplatin and cisplatin is that carboplatin is better tolerated clinically. Some of the side-effects associated with cisplatin, such as nausea, neurotoxicity, and nephrotoxicity, are seen at a lesser degree in patients administered carboplatin. Some other side-effects are hypomagnesaemia and hypokalaemia (Kintzel (2001), *Drug Saf* 24: 19-38).

In one study on male Wistar rats, carboplatin was administered at a dosage of 65 mg/kg (Wolfgang et al. (1994), *Fundam Appl Toxicol* 22: 73-79). After treatment with carboplatin, CGT excretion was increased approximately two-fold.

Another study compared cisplatin and carboplatin when given in combination with vindesine and mitomycin C (Jelic et al. (2001) *Lung Cancer* 34: 1-13). The study showed that carboplatin administered with vindesine and mitomycin C was advantageous in terms of overall survival, although the regimen was more hematologically toxic than when cisplatin was given.

AY-25329, is a phenothiazine that has been shown to be mildly hepatotoxic and to induce nephrosis. Its structure is shown below.

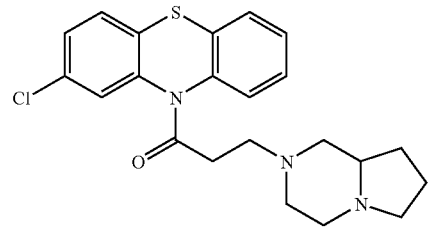

Phenothiazines are a class of psychoactive drugs. They have been used to treat schizophrenia, paranoia, mania, hyperactivity in children, some forms of senility, and anxiety. Some side effects associated with prolonged use of the drugs are reduced blood pressure, Parkinsonism, reduction of motor activity, and visual impairment.

Chlorpromazine (Thorazine or Largactil) is an aliphatic phenothiazine and is widely used for treating schizophrenia and manic depression. Prolactin secretion is increased while taking chlorpromazine, and galactorrhea and gynecomastia have both been associated with the drug. Trifluoperazine is another prescribed phenothiazine. It is used to treat anxiety, to prevent nausea and vomiting, and to manage psychotic disorders. Negative side-effects that have been associated with the drug are liver damage, bone marrow depression, and Parkinsonism.

Acyclovir (9-[(2-hydroxyethyl) methyl] guanine, Zovirax®), an anti-viral guanosine analogue, is used to treat herpes simplex virus (HSV), varicella zoster virus (VZV) and Epstein-Barr virus (EBV) infections. It is transported into cells by the nucleoside transporter that imports guanine, and acyclovir is phosphorylated by virally encoded thymidine kinase (TK). Other kinases convert acyclovir to its activated di- and triphosphate forms, which prevent the polymerization of viral DNA. Acyclovir triphosphate competes with dGTP for the viral polymerase, and acyclovir is preferentially incorporated, but as a monophosphate. As a result, chain elongation ceases (*Fields Virology* 3d ed., Fields et al., eds., pp. 436-440, Lippincott-Raven Publishers, Philadelphia, 1996; *Cecil Textbook of Medicine*, 20<sup>th</sup> ed., part XII, p. 1742, J. C. Bennett and F. Plum Eds., W. B. Saunders Co., Philadelphia, 1996).

The pharmacokinetics of acyclovir show that it has a useful half-life of about three hours and that most of it is excreted in the urine largely unchanged (Brigden et al. (1985), *Scand J Infect Dis Suppl* 47: 33-39). Not surprisingly, the most frequent adverse effect of acyclovir treatment is damage to various parts of the kidney, particularly the renal tubules. Crystalluria, or the precipitation of crystals (in this case, crystals of acyclovir), in the lumina of the renal tubules can occur (Fogazzi (1996), *Nephrol Dial Transplant* 11: 379-387). If the drug crystallizes in the renal collecting tubules, obstructive nephropathy and tubular necrosis can result (Richardson (2000), *Vet Hum Toxicol* 42: 370-371). Tissues from biopsies of affected patients showed dilation of the proximal and distal renal tubules, with loss of the brush border, flattening of the lining cells and focal nuclear loss (Becker et al. (1993), *Am J Kidney Dis* 22: 611-615).

Citrinin, a mycotoxin produced by the fungus *Penicillium citrinum*, is a natural contaminant of foods and feeds (Bondy and Armstrong (1998) *Cell Biol. Toxicol*. 14: 323-332). It is known that mycotoxins can have negative effects on the immune system, however citrinin-treated animals have been shown to stimulate responses against antigens (Sharma (1993) *J. Dairy Sci*. 76: 892-897). Citrinin is a known nephrotoxin, and in birds such as chickens, ducklings, and turkeys, it causes diarrhea, increased food consumption and reduced weight gain due to kidney degeneration (Mehdi et al. (1981) *Food Cosmet. Toxicol*. 19: 723-733; Mehdi et al. (1984) *Vet. Pathol*. 21: 216-223). In the turkey and duckling study, both species exhibited nephrosis with the occurrence of hepatic and lymphoid lesions (Mehdi et al., 1984).

In one study, citrinin was administered to rabbits as a single oral dose of either 120 or 67 mg/kg (Hanika et al. (1986) *Vet. Pathol*. 23: 245-253). Rabbits treated with citrinin exhibited renal alterations such as condensed and distorted mitochondria, distended intercellular spaces of the medullary and straight cortical distal tubules, and disorganization of interdigitating processes. In another rabbit study, citrinin-administered rabbits displayed azotaemia and metabolic acidosis (Hanika et aL (1984) *Food Chem. Toxicol*. 22: 999-1008). Renal failure was indicated by decreased creatinine clearance and increased blood urea nitrogen and serum-creatinine levels.

In the past, mercury was an important component of pharmaceuticals, particularly of antiseptics, antibacterials, skin ointments, diuretics and laxatives. Although, mercury has been largely replaced by more effective, more specific and safer compounds, making drug-induced mercury poisoning rare, it is still widely used in industry. Poisoning from occupational exposure and environmental pollution, such as mercury release into public water supplies, remains a concern as wildlife, domestic animals and humans are affected.

Because of their lipid solubility and ability to cross the blood-brain barrier, the most dangerous form of mercury is the organomercurials, the most common of which is methylmercury, a fungicide used for disinfecting crop seeds. In a number of countries, incidents involving large-scale illness and death from mercury poisoning have been reported when mercury-contaminated seeds were planted and the crops harvested and consumed. A second source of organic mercury poisoning results from industrial chemicals containing inorganic mercury, such as mercury catalysts, which form methylmercury as a reaction product. If this waste product is released into reservoirs, lakes, rivers or bays, the surrounding population can become sick or die, particularly those who eat local fish.

The inorganic salt mercuric chloride, $HgCl_2$, as well as other mercuric salts, are more irritating and more toxic than the mercurous forms. Mercuric chloride is used today in industry, for the manufacture of bleach, electronics, plastics, fungicides and dental amalgams. The main source of human exposure is industrial dumping into rivers (Goodman & Gilman's: The Pharmacological Basis of Therapeutics (9th ed.), pp. 1654-1659, McGraw-Hill, New York, 1996).

When inorganic mercury salts are ingested, about 10% of the mercuric ions are absorbed by the gastrointenstinal tract, and a considerable portion of the $Hg^{2+}$ can remain bound to the mucosal surfaces. The highest concentration of $Hg^{2+}$ is found in the kidneys, as it is retained there longer than in other tissues. Consequently, the kidneys are the organ most adversely affected by inorganic mercury poisoning. The proximal tubules are the major site of damage, where tubular necrosis results. The mercury affects primarily the S2 and S3 portions of the proximal tubules, but, at high levels of mercury exposure, the S1 and distal portions of the tubules are also damaged. These regions of the nephrons are affected because they contain enzymes (such as gamma-glutamyl-transpeptidase) and transport proteins (such as the basolateral organic anion transport system) involved in mercury uptake (Diamond et al. (1998), *Toxicol Pathol* 26: 92-103).

Urinary markers of mercury toxicity which can be detected in NMR spectra include elevated levels of lactate, acetate and taurine and decreased levels of hippurate (Holmes et al. (2000), *Chem Res Toxicol* 13: 471-478). Known changes in gene expression in kidneys exposed to $Hg^{2+}$ include up-regulation of the heat-shock protein hsp72 and of the glucose-regulated protein grp94. The degree of tissue necrosis and level of expression of these proteins is proportional to both the dose of mercury ($Hg^{2+}$) and the length of the exposure time to mercury ($Hg^{2+}$), with hsp72 accumulating in the renal cortex and grp94 accumulating in the renal medulla (Goering et al. (2000), *Toxicol Sci* 53: 447-457).

Diflunisal a non-steroidal anti-inflammatory drug (NSAID), is a difluorophenyl derivative of salicylic acid (*Goodman & Gilman's The Pharmacological Basis of Therapeutics* 9<sup>th</sup> ed., p. 631, J. G. Hardman et al., Eds., McGraw Hill, New York, 1996). It is most frequently used in the treatment of osteoarthritis and musculoskeletal strains. NSAIDs have analgesic, antipyretic and anti-inflammatory actions, however hepatotoxicity is known to be an adverse side effect of NSAID treatment (Masubuchi et al. (1998) *J Pharmacol. Exp. Ther*. 287: 208-213). Diflunisal has been shown to be less toxic than other NSAIDs, nevertheless over long periods of dosage it can lead to deleterious effects on platelet or kidney function (Bergamo et al. (1989) *Am. J. Nephrol*. 9: 460-463). Other side effects that have been associated with diflunisal treatment are diarrhea, dizziness, drowsiness, gas or heartburn, headache, nausea, vomiting, and insomnia (http://arthritisinsight.com/medical/meds/dolobid.html).

Masubuchi et al. compared the hepatotoxicity of 18 acidic NSAIDs. In the study, diflunisal (administered at a concentration of 500 μM) was shown to increase LDH leakage in rat hepatocytes, a marker for cell injury, when compared to the control sample. In addition, treatment with diflunisal led to decreased intracellular ATP concentrations.

One study compared the effects of diflunisal and ibuprofen when given to patients over a two week period (Muncie and Nasrallah (1989) *Clin. Ther.* 11: 539-544). In both the ibuprofen and the diflunisal group, two patients complained of abdominal cramping. The study indicated that even during short-term usage some gastrointestinal effects may occur. The toxic dose used in this study was chosen as one that did not induce significant gastric ulceration in rats. The group of rats given the high dosage of diflunisal had increased concentrations of creatinine which is consistent with renal injury, although dehydration may also cause increases in creatinine concentration.

Cidofovir (Vistide®) is an antiviral cytosine analog used in the treatment of viral infections such as herpesvirus, adenovirus, papillomavirus, poxvirus and hepadnavirus (*Goodman & Gilman's The Pharmacological Basis of Therapeutics* 9$^{th}$ ed., p. 1216, J. G. Hardman et al., Eds., McGraw Hill, New York, 1996). It is also useful for the treatment of cytomegalovirus (CMV) infection, which is a type of herpesvirus.

Some mild side effects seen in patients receiving cidofovir are nausea, vomiting, and fever. The most serious reported side effect of the drug is kidney toxicity (http://tthivclinic.com/cido.html). In response to the threat of nephrotoxicity, it is necessary for patients receiving cidofovir to have their kidneys checked before treatment, and the patients must be monitored during treatment for early symptoms of kidney problems. In addition, cidofovir is given with fluids to help reduce the risk of kidney toxicity (http://www.aidsinfonyc.org/network/simple/cido.html). Probenecid, a drug that helps protect the kidneys, is normally administered concomitantly (Lalezari and Kuppermann (1997) *J. Acquir. Immune Defic. Syndr. Hum. Retrovirol.* 14: S27-31).

One study compared the safety and efficacy of cidofovir in the treatment of CMV (Lalezari et al. (1998) *J. Acquir. Immune Defic. Syndr. Hum. Retrovirol.* 17: 339-344). Approximately 40% of the patients exhibited dose-dependent asymptomatic proteinuria and 25% of the patients had elevated serum creatinine levels.

Pamidronate (Aredia®) is a bisphosphonate drug that is clinically used to inhibit bone resorption and make bones more stable. It is used to treat hypercalcemia (too much calcium in the blood) that occurs with some types of cancer. Typically administered by intravenous injection, pamidronate is frequently used in patients with breast cancer or multiple myeloma whose disease has spread to the bones. Some side effects related to pamidronate treatment are abdominal cramps, chills, confusion, fever, muscle spasms, nausea, muscle stiffness, and swelling at the injection site. Patients with kidney problems may be prohibited from using pamidronate as it is excreted through the kidneys.

In one study, rats and mice were given varying doses of labeled pamidronate (Cal and Daley-Yates (1990) *Toxicology* 65: 179-197). Pamidronate treatment led to significant weight loss and a decrease in creatinine clearance. Morphological studies showed a loss of brush border membranes and the presence of focal proximal tubular necrosis.

Another study compared the tolerability of different treatments for hypercalcemia of malignancy by reviewing articles published between 1979 and 1998 (Zojer et al. (1999) *Drug Saf.* 21: 389-406). The authors found that elevated serum creatinine level, nausea, and fever were reported following treatment with bisphosphonates such as pamidronate.

Markowitz et al. (2001, *J. Am. Soc. Nephrol.* 12: 1164-1172) tried to determine whether there was a correlation between pamidronate treatment and collapsing focal segmental glomerulosclerosis (FSGS). The authors examined the histories of seven patients who had developed collapsing FSGS, and they found that the only drug treatment in common was the administration of pamidronate. When given at the recommended dose of 90 mg per month, renal toxicity was rare. However, when pamidronate was given at higher doses nephrotoxicity occurred.

Lithium, an alkali metal, is the main pharmacological treatment for bipolar disorders. It is typically given as a salt, such as lithium carbonate or lithium citrate. Some common side effects of lithium treatment are an increase in urination, increase in drinking, dry mouth, weight gain, fine tremor, and fatigue. Some more serious side effects related to lithium treatment are blurred vision, mental confusion, seizures, vomiting, diarrhea, muscle weakness, drowsiness, and coarse tremor (*Goodman & Gilman's The Pharmacological Basis of Therapeutics* 9$^{th}$ ed., p. 448, J. G. Hardman et al., Eds., McGraw Hill, New York, 1996).

Since lithium is often used on a maintenance basis for a lifelong period, numerous studies have been performed to try and elucidate the effects of lithium on the kidney. One group administered lithium in daily doses within the human therapeutic range to male Wistar rats (Kling et al. (1984) *Lab Invest* 50: 526-535). Rats that were given lithium developed marked polyuria within three weeks of the initial dosing. The rats displayed elevated free water clearance and vasopressin-resistant diabetes insipidus. The cortical collecting tubules displayed morphological changes, e.g. dilation of the tubules, bulging cells lining the tubules, enlarged nuclei, following lithium treatment.

Another study examined a human population that had been given lithium for the treatment of bipolar disorder (Markowitz et al. (2000) *J. Am. Soc. Nephrol.* 11: 1439-1448). The patients had a mean age of 42.5 years and had been undergoing lithium treatment from 2 to 25 years (mean of 13.6 years). Approximately one fourth of the patients had nephrotic proteinuria, almost 90% of them had nephrogenic diabetes insipidus (NDI), and renal biopsies revealed a chronic tubulointerstitial nephropathy in all of the patients. Following cessation of lithium treatment, seven of the patients proceeded to end-stage renal disease.

Even though nephrotoxicity is a known side effect of lithium treatment, some studies have indicated that in actuality it is not all that common (Johnson (1998) *Neuropsychopharmacology* 19: 200-205). One study showed that the NDI-like effect in lithium treatment was easily overcome by increasing the levels of arginine vasopressin (AVP) (Carney et al. (1996) *Kidney Int* 50: 377-383). Other studies have suggested that patients with psychiatric disorders display certain defects in renal function without undergoing lithium treatment (Gitlin (1999) *Drug Saf* 20: 231-243).

Hydralazine, an antihypertensive drug, causes relaxation of arteriolar smooth muscle. Such vasodilation is linked to vigorous stimulation of the sympathetic nervous system, which in turn leads to increased heart rate and contractility, increased plasma renin activity, and fluid retention (*Goodman & Gilman's The Pharmacological Basis of Therapeutics* 9$^{th}$ ed., p. 794, J. G. Hardman et al., Eds., McGraw Hill, New York, 1996). The increased renin activity leads to an increase in angiotensin II, which in turn causes stimulation of aldosterone and sodium reabsorption.

Hydralazine is used for the treatment of high blood pressure (hypertension) and for the treatment of pregnant women suffering from high blood pressure (pre-eclampsia or eclampsia). Some common side effects associated with hydralazine use are diarrhea, rapid heartbeat, headache, decreased appetite, and nausea. Hydralazine is often used concomitantly with drugs that inhibit sympathetic activity to combat the mild pulmonary hypertension that can be associated with hydralazine usage.

In one hydralazine study, rats were fed hydralazine and mineral metabolism was monitored (Peters et al. (1988) *Toxicol Lett* 41: 193-202). Manganese and zinc concentrations were not effected by hydralazine treatment, however tissue iron concentrations were decreased and kidney copper concentrations were increased compared to control groups.

Another study compared the effects of hydrazine, phenelzine, and hydralazine treatment on rats (Runge-Morris et al. (1996) *Drug Metab Dispos* 24: 734-737). Hydralazine caused an increase in renal GST-alpha subunit expression, although unlike hydrazine and phenelzine it did not alter renal cytochrome P4502E1 expression.

Colchicine, an alkoloid of *Colchicum autumale*, is an antiinflammatory agent used in the treatment of gouty arthritis (*Goodman & Gilman's The Pharmacological Basis of Therapeutics* $9^{th}$ ed., p. 647, J. G. Hardman et al., Eds., McGraw Hill, New York, 1996).

An antimitotic agent, colchicine binds to tubulin which leads to depolymerization and disappearance of the fibrillar microtubules in granulocytes and other motile cells. In doing so, the migration of granulocytes into the inflamed area is inhibited. Through a series of events, the inflammatory response is blocked.

Some common, mild side effects associated with colchicine treatment are loss of appetite and hair loss. More severe side effects that warrant cessation of treatment are nausea, vomiting, diarrhea, and abdominal pain. Colchicine overdose can induce multiorgan failure with a high incidence of mortality. In this setting, renal failure is multifactorial and related to prolonged hypotension, hypoxemia, sepsis, and rhabdomyolysis. In rats, less dramatic doses have been shown to inhibit the secretion of many endogenous proteins such as insulin and parathyroid hormone.

One study investigated the effects of colchicine on microtubule polymerization status and post-translational modifications of tubulin in rat seminiferous tubules (Correa and Miller (2001) *Biol Reprod* 64: 1644-1652). Colchicine caused extensive microtubule depolymerization, and total tubulin levels decreased twofold after colchicine treatment. The authors also found that colchicine treatment led to a decrease in tyrosination of the microtubule pool of tubulin which was associated with depolymerization of microtubules.

Sulfadiazine, a sulfonamide, is an antimicrobial agent. It is commonly used concomitantly with pyrimethamine to treat toxoplasmosis, an infection of the brain, in patient suffering from AIDS. These drugs are able to cross the blood-brain barrier and are used at relatively high doses. In addition, sulfadiazine has been shown to be effective at preventing certain types of meningococcal diseases and in treating urinary tract infections.

Sulfonamides in general are structural analogs of para-aminobenzoic acid (PABA). Because they are competitive antagonists of PABA, sulfonamides are effective against bacteria that are required to utilize PABA for the synthesis of folic acid (*Goodman & Gilman's The Pharmacological Basis of Therapeutics* $9^{th}$ ed., p. 1058-1060, J. G. Hardman et al., Eds., McGraw Hill, New York, 1996).

The main side effects associated with sulfadiazine treatment are fever and skin rashes. Decreases in white blood cells, red blood cells, and platelets, nausea, vomiting, and diarrhea are some other side effects that may result from sulfadiazine treatment. The most troublesome problem with this drug for HIV/AIDS patients is kidney toxicity. These patients tend to use these drugs for extended periods of time, which puts a constant strain on the kidneys. In addition, kidney stones tend to form in the bladder and ureter thereby blocking the flow of urine. Kidney damage may result, and if left untreated kidney failure may occur. Therefore, patients being treated with sulfadiazine are instructed to increase their fluid intake in order to prevent crystal formation in the kidneys.

One case study examined four HIV-positive patients who had been given sulfadiazine to treat toxoplasmosis (Crespo et al. (2000) *Clin Nephrol* 54: 68-72). All four of the patients, one of whom was a previously healthy person, developed oliguria, abdominal pain, renal failure, and displayed multiple radiolucent renal calculi in echography. Following extensive hydration and alcalinization, the renal function of the patients returned to normal.

Adriamycin, known generically as doxorubicin, is an anthracycline antibiotic produced by the fungus *Streptomyces peucetius*. It is an anti-tumor drug used in the treatment of breast, ovarian, bladder, and lung cancers as well as non-Hodgkin's lymphoma, Hodgkin's disease and sarcoma (*Goodman & Gilman's The Pharmacological Basis of Therapeutics* $9^{th}$ ed., p. 1264-1265, J. G. Hardman et al., Eds., McGraw Hill, New York, 1996).

Adriamycin has tetracycline ring structures with the sugar daunosamine attached by glycosidic linkage. It is able to intercalate with DNA, it affects DNA and RNA synthesis, and it can interact with cell membranes and alter their functions. Typically the drug is cell-cycle specific for the S phase of cell division. By binding to the cancer cells' DNA and blocking topoisomerase II, cancer cells are unable to divide and grow.

Some common side effects associated with adriamycin treatment are fatigue, a drop in white blood cell, red blood cell, or platelet count, hair loss, skin discoloration, and watery eyes. More serious side effects include myocardial toxicity, ulceration and necrosis of the colon, and development of a second cancer.

Because of its utility in fighting cancer, numerous studies have been performed in attempts to further understand the mechanisms and effects of adriamycin. In one study, investigators injected mice with a single dose of adriamycin (Chen et al. (1998) *Nephron* 78: 440-452). The mice exhibited signs of combined glomerular albuminuria and immunoglublinuria, progressively elevated levels of nitrite/nitrate in the urine, abnormal renal function, and other symptoms indicative of focal segmental glomerulosclerosis.

In another study, rats were given adriamycin and the effects on angiotensin converting enzyme (ACE) were monitored (Venkatesan et al. (1993) *Toxicology* 85: 137-148). The rats developed glomerular and tubular injury, and serum ACE levels were significantly elevated 20, 25, and 30 days post-treatment. A different study followed rabbits for up to one year that were treated with either adriamycin, nephrectomy, or combinations thereof (Gadeholt-Gothlin et al. (1995) *Urol Res* 23: 169-173). The rabbits that were treated with adriamycin exhibited signs of nephrotoxicity at relatively low doses.

Toxicity Prediction and Modeling

The genes and gene expression information, gene expression profiles, as well as the portfolios and subsets of the genes provided in Tables 1-5, may be used to predict at least one toxic effect, including the nephrotoxicity of a test or unknown compound. As used, herein, at least one toxic effect includes, but is not limited to, a detrimental change in the physiological status of a cell or organism. The response may be, but is not required to be, associated with a particular pathology, such as tissue necrosis. Accordingly, the toxic effect includes effects at the molecular and cellular level. Nephrotoxicity is an effect as used herein and includes but is not limited to the pathologies of nephritis, kidney necrosis, glomerular and tubular injury, and focal segmental glomerulosclerosis. As used herein, a gene expression profile comprises any quantitative representation of the expression of at least one MRNA species in a cell sample or population and includes profiles made by various methods such as differential display, PCR, hybridization analysis, etc.

In general, assays to predict the toxicity or nephrotoxicity of a test agent (or compound or multi-component composition) comprise the steps of exposing a cell population to the test compound, assaying or measuring the level of relative or absolute gene expression of one or more of the genes in Tables 1-5 and comparing the identified expression level(s) to the expression levels disclosed in the Tables and database(s) disclosed herein. Assays may include the measurement of the expression levels of about 2, 3, 4, 5, 6, 7, 8, 9, 10, 15, 20, 25, 30, 50, 75, 100 or more genes from Tables 1-5.

In the methods of the invention, the gene expression level for a gene or genes induced by the test agent, compound or compositions may be comparable to the levels found in the Tables or databases disclosed herein if the expression level varies within a factor of about 2, about 1.5 or about 1.0 fold. In some cases, the expression levels are comparable if the agent induces a change in the expression of a gene in the same direction (e.g., up or down) as a reference toxin.

The cell population that is exposed to the test agent, compound or composition may be exposed in vitro or in vivo. For instance, cultured or freshly isolated renal cells, in particular rat renal cells, may be exposed to the agent under standard laboratory and cell culture conditions. In another assay format, in vivo exposure may be accomplished by administration of the agent to a living animal, for instance a laboratory rat.

Procedures for designing and conducting toxicity tests in in vitro and in vivo systems are well known, and are described in many texts on the subject, such as Loomis et al., Loomis's Esstentials of Toxicology, 4th Ed., Academic Press, New York, 1996; Echobichon, The Basics of Toxicity Testing, CRC Press, Boca Raton, 1992; Frazier, editor, In Vitro Toxicity Testing, Marcel Dekker, New York, 1992; and the like.

In in vitro toxicity testing, two groups of test organisms are usually employed: One group serves as a control and the other group receives the test compound in a single dose (for acute toxicity tests) or a regimen of doses (for prolonged or chronic toxicity tests). Because, in some cases, the extraction of tissue as called for in the methods of the invention requires sacrificing the test animal, both the control group and the group receiving compound must be large enough to permit removal of animals for sampling tissues, if it is desired to observe the dynamics of gene expression through the duration of an experiment.

In setting up a toxicity study, extensive guidance is provided in the literature for selecting the appropriate test organism for the compound being tested, route of administration, dose ranges, and the like. Water or physiological saline (0.9% NaCl in water) is the solute of choice for the test compound since these solvents permit administration by a variety of routes. When this is not possible because of solubility limitations, vegetable oils such as corn oil or organic solvents such as propylene glycol may be used.

Regardless of the route of administration, the volume required to administer a given dose is limited by the size of the animal that is used. It is desirable to keep the volume of each dose uniform within and between groups of animals. When rats or mice are used, the volume administered by the oral route generally should not exceed about 0.005 ml per gram of animal. Even when aqueous or physiological saline solutions are used for parenteral injection the volumes that are tolerated are limited, although such solutions are ordinarily thought of as being innocuous. The intravenous $LD_{50}$ of distilled water in the mouse is approximately 0.044 ml per gram and that of isotonic saline is 0.068 ml per gram of mouse. In some instances, the route of administration to the test animal should be the same as, or as similar as possible to, the route of administration of the compound to man for therapeutic purposes.

When a compound is to be administered by inhalation, special techniques for generating test atmospheres are necessary. The methods usually involve aerosolization or nebulization of fluids containing the compound. If the agent to be tested is a fluid that has an appreciable vapor pressure, it may be administered by passing air through the solution under controlled temperature conditions. Under these conditions, dose is estimated from the volume of air inhaled per unit time, the temperature of the solution, and the vapor pressure of the agent involved. Gases are metered from reservoirs. When particles of a solution are to be administered, unless the particle size is less than about 2 μm the particles will not reach the terminal alveolar sacs in the lungs. A variety of apparatuses and chambers are available to perform studies for detecting effects of irritant or other toxic endpoints when they are administered by inhalation. The preferred method of administering an agent to animals is via the oral route, either by intubation or by incorporating the agent in the feed.

When the agent is exposed to cells in vitro or in cell culture, the cell population to be exposed to the agent may be divided into two or more subpopulations, for instance, by dividing the population into two or more identical aliquots. In some preferred embodiments of the methods of the invention, the cells to be exposed to the agent are derived from kidney tissue. For instance, cultured or freshly isolated rat renal cells may be used.

The methods of the invention may be used generally to predict at least one toxic response, and, as described in the Examples, may be used to predict the likelihood that a compound or test agent will induce various specific kidney pathologies, such as nephritis, kidney necrosis, glomerular and tubular injury, focal segmental glomerulosclerosis, or other pathologies associated with at least one of the toxins herein described. The methods of the invention may also be used to determine the similarity of a toxic response to one or more individual compounds. In addition, the methods of the invention may be used to predict or elucidate the potential cellular pathways influenced, induced or modulated by the compound or test agent due to the similarity of the expression profile compared to the profile induced by a known toxin (see Tables 5-5CC).

Diagnostic Uses for the Toxicity Markers

As described above, the genes and gene expression information or portfolios of the genes with their expression information as provided in Tables 1-5 may be used as diagnostic markers for the prediction or identification of the physiological state of tissue or cell sample that has been exposed to a compound or to identify or predict the toxic effects of a compound or agent. For instance, a tissue sample such as a sample of peripheral blood cells or some other easily obtainable tissue sample may be assayed by any of the methods described above, and the expression levels from a gene or genes from Tables 1-5 may be compared to the expression levels found in tissues or cells exposed to the toxins described herein. These methods may result in the diagnosis of a physiological state in the cell or may be used to identify the potential toxicity of a compound, for instance a new or unknown compound or agent. The comparison of expression data, as well as available sequence or other information may be done by researcher or diagnostician or may be done with the aid of a computer and databases as described below.

In another format, the levels of a gene(s) of Tables 1-5, its encoded protein(s), or any metabolite produced by the encoded protein may be monitored or detected in a sample, such as a bodily tissue or fluid sample to identify or diagnose a physiological state of an organism. Such samples may include any tissue or fluid sample, including urine, blood and easily obtainable cells such as peripheral lymphocytes.

Use of the Markers for Monitoring Toxicity Progression

As described above, the genes and gene expression information provided in Tables 1-5 may also be used as markers for the monitoring of toxicity progression, such as that found after initial exposure to a drug, drug candidate, toxin, pollutant, etc. For instance, a tissue or cell sample may be assayed by any of the methods described above, and the expression levels from a gene or genes from Tables 1-5 may be compared to the expression levels found in tissue or cells exposed to the renal toxins described herein. The comparison of the expression data, as well as available sequence or other information may be done by a researcher or diagnostician or may be done with the aid of a computer and databases.

Use of the Toxicity Markers for Drug Screening

According to the present invention, the genes identified in Tables 1-5 may be used as markers or drug targets to evaluate the effects of a candidate drug, chemical compound or other agent on a cell or tissue sample. The genes may also be used as drug targets to screen for agents that modulate their expression and/or activity. In various formats, a candidate drug or agent can be screened for the ability to stimulate the transcription or expression of a given marker or markers or to down-regulate or counteract the transcription or expression of a marker or markers. According to the present invention, one can also compare the specificity of a drug's effects by looking at the number of markers which the drug induces and comparing them. More specific drugs will have less transcriptional targets. Similar sets of markers identified for two drugs may indicate a similarity of effects.

Assays to monitor the expression of a marker or markers as defined in Tables 1-5 may utilize any available means of monitoring for changes in the expression level of the nucleic acids of the invention. As used herein, an agent is said to modulate the expression of a nucleic acid of the invention if it is capable of up- or down-regulating expression of the nucleic acid in a cell.

In one assay format, gene chips containing probes to one, two or more genes from Tables 1-5 may be used to directly monitor or detect changes in gene expression in the treated or exposed cell. Cell lines, tissues or other samples are first exposed to a test agent and in some instances, a known toxin, and the detected expression levels of one or more, or preferably 2 or more of the genes of Tables 1-5 are compared to the expression levels of those same genes exposed to a known toxin alone. Compounds that modulate the expression patterns of the known toxin(s) would be expected to modulate potential toxic physiological effects in vivo. The genes in Tables 1-5 are particularly appropriate markers in these assays as they are differentially expressed in cells upon exposure to a known renal toxin. Tables 1 and 2 disclose those genes that are differentially expressed upon exposure to the named toxins and their corresponding GenBank Accession numbers. Table 3 discloses the human homologues and the corresponding GenBank Accession numbers of the differentially expressed genes of Tables 1 and 2.

In another format, cell lines that contain reporter gene fusions between the open reading frame and/or the transcriptional regulatory regions of a gene in Tables 1-5 and any assayable fusion partner may be prepared. Numerous assayable fusion partners are known and readily available including the firefly luciferase gene and the gene encoding chloramphenicol acetyltransferase (Alam et al. (1990), *Anal Biochem* 188: 245-254). Cell lines containing the reporter gene fusions are then exposed to the agent to be tested under appropriate conditions and time. Differential expression of the reporter gene between samples exposed to the agent and control samples identifies agents which modulate the expression of the nucleic acid.

Additional assay formats may be used to monitor the ability of the agent to modulate the expression of a gene identified in Tables 1-5. For instance, as described above, mRNA expression may be monitored directly by hybridization of probes to the nucleic acids of the invention. Cell lines are exposed to the agent to be tested under appropriate conditions and time, and total RNA or mRNA is isolated by standard procedures such those disclosed in Sambrook et al. (Molecular Cloning: A Laboratory Manual, 2nd Ed. Cold Spring Harbor Laboratory Press, Cold Spring Harbor, N.Y., 1989).

In another assay format, cells or cell lines are first identified which express the gene products of the invention physiologically. Cells and/or cell lines so identified would be expected to comprise the necessary cellular machinery such that the fidelity of modulation of the transcriptional apparatus is maintained with regard to exogenous contact of agent with appropriate surface transduction mechanisms and/or the cytosolic cascades. Further, such cells or cell lines may be transduced or transfected with an expression vehicle (e.g., a plasmid or viral vector) construct comprising an operable non-translated 5'-promoter containing end of the structural gene encoding the gene products of Tables 1-5 fused to one or more antigenic fragments or other detectable markers, which are peculiar to the instant gene products, wherein said fragments are under the transcriptional control of said promoter and are expressed as polypeptides whose molecular weight can be distinguished from the naturally occurring polypeptides or may further comprise an immunologically distinct or other detectable tag. Such a process is well known in the art (see Sambrook et al., supra).

Cells or cell lines transduced or transfected as outlined above are then contacted with agents under appropriate conditions; for example, the agent comprises a pharmaceutically acceptable excipient and is contacted with cells comprised in an aqueous physiological buffer such as phosphate buffered saline (PBS) at physiological pH, Eagles balanced salt solution (BSS) at physiological pH, PBS or BSS comprising serum or conditioned media comprising PBS or BSS and/or serum incubated at 37° C. Said conditions may be modulated as deemed necessary by one of skill in the art. Subsequent to contacting the cells with the agent, said cells are disrupted and the polypeptides of the lysate are fractionated such that a polypeptide fraction is pooled and contacted with an antibody to be further processed by immunological assay (e.g., ELISA, immunoprecipitation or Western blot). The pool of proteins isolated from the agent-contacted sample is then compared with the control samples (no exposure and exposure to a known toxin) where only the excipient is contacted with the cells and an increase or decrease in the immunologically generated signal from the agent-contacted sample compared to the control is used to distinguish the effectiveness and/or toxic effects of the agent.

Another embodiment of the present invention provides methods for identifying agents that modulate at least one activity of a protein(s) encoded by the genes in Tables 1-5.

Such methods or assays may utilize any means of monitoring or detecting the desired activity.

In one format, the relative amounts of a protein (Tables 1-5) between a cell population that has been exposed to the agent to be tested compared to an un-exposed control cell population and a cell population exposed to a known toxin may be assayed. In this format, probes such as specific antibodies are used to monitor the differential expression of the protein in the different cell populations. Cell lines or populations are exposed to the agent to be tested under appropriate conditions and time. Cellular lysates may be prepared from the exposed cell line or population and a control, unexposed cell line or population. The cellular lysates are then analyzed with the probe, such as a specific antibody.

Agents that are assayed in the above methods can be randomly selected or rationally selected or designed. As used herein, an agent is said to be randomly selected when the agent is chosen randomly without considering the specific sequences involved in the association of a protein of the invention alone or with its associated substrates, binding partners, etc. An example of randomly selected agents is the use a chemical library or a peptide combinatorial library, or a growth broth of an organism.

As used herein, an agent is said to be rationally selected or designed when the agent is chosen on a nonrandom basis which takes into account the sequence of the target site and/or its conformation in connection with the agent's action. Agents can be rationally selected or rationally designed by utilizing the peptide sequences that make up these sites. For example, a rationally selected peptide agent can be a peptide whose amino acid sequence is identical to or a derivative of any functional consensus site.

The agents of the present invention can be, as examples, peptides, small molecules, vitamin derivatives, as well as carbohydrates. Dominant negative proteins, DNAs encoding these proteins, antibodies to these proteins, peptide fragments of these proteins or mimics of these proteins may be introduced into cells to affect function. "Mimic" used herein refers to the modification of a region or several regions of a peptide molecule to provide a structure chemically different from the parent peptide but topographically and functionally similar to the parent peptide (see G. A. Grant in: Molecular Biology and Biotechnology, Meyers, ed., pp. 659-664, VCH Publishers, New York, 1995). A skilled artisan can readily recognize that there is no limit as to the structural nature of the agents of the present invention.

Nucleic Acid Assay Formats

The genes identified as being differentially expressed upon exposure to a known renal toxin (Tables 1-5) may be used in a variety of nucleic acid detection assays to detect or quantify the expression level of a gene or multiple genes in a given sample. The genes described in Tables 1-5 may also be used in combination with one or more additional genes whose differential expression is associate with toxicity in a cell or tissue. In preferred embodiments, the genes in Tables 1-5 may be combined with one or more of the genes described in prior and related applications 60/292,335; 60/297,523; 60/298,925; 60/303,810; 60/303,807; 60/303,808; 60/315,047; 60/324,928; 60/330,867; 60/330,462; 60/331,805; 60/336,144; 60/340,873; 60/357,843; 60/357,842; 60/357,844; 60/364,134; 60/370,206; 60/370,247; 60/370,144; 60/371,679; 60/372,794; 09/917,800 and 10/060,087 all of which are incorporated by reference on page 1 of this application.

Any assay format to detect gene expression may be used. For example, traditional Northern blotting, dot or slot blot, nuclease protection, primer directed amplification, RT-PCR, semi- or quantitative PCR, branched-chain DNA and differential display methods may be used for detecting gene expression levels. Those methods are useful for some embodiments of the invention. In cases where smaller numbers of genes are detected, amplification based assays may be most efficient. Methods and assays of the invention, however, may be most efficiently designed with hybridization-based methods for detecting the expression of a large number of genes.

Any hybridization assay format may be used, including solution-based and solid support-based assay formats. Solid supports containing oligonucleotide probes for differentially expressed genes of the invention can be filters, polyvinyl chloride dishes, particles, beads, microparticles or silicon or glass based chips, etc. Such chips, wafers and hybridization methods are widely available, for example, those disclosed by Beattie (WO 95/11755).

Any solid surface to which oligonucleotides can be bound, either directly or indirectly, either covalently or non-covalently, can be used. A preferred solid support is a high density array or DNA chip. These contain a particular oligonucleotide probe in a predetermined location on the array. Each predetermined location may contain more than one molecule of the probe, but each molecule within the predetermined location has an identical sequence. Such predetermined locations are termed features. There may be, for example, from 2, 10, 100, 1000 to 10,000, 100,000 or 400,000 or more of such features on a single solid support. The solid support, or the area within which the probes are attached may be on the order of about a square centimeter. Probes corresponding to the genes of Tables 1-5 or from the related applications described above may be attached to single or multiple solid support structures, e.g., the probes may be attached to a single chip or to multiple chips to comprise a chip set.

Oligonucleotide probe arrays for expression monitoring can be made and used according to any techniques known in the art (see for example, Lockhart et al. (1996), *Nat Biotechnol* 14: 1675-1680; McGall et al. (1996), *Proc Nat Acad Sci USA* 93: 13555-13460). Such probe arrays may contain at least two or more oligonucleotides that are complementary to or hybridize to two or more of the genes described in Tables 1-5. For instance, such arrays may contain oligonucleotides that are complementary to or hybridize to at least 2, 3, 4, 5, 6, 7, 8, 9, 10, 20, 30, 50, 70, 100 or more of the genes described herein. Preferred arrays contain all or nearly all of the genes listed in Tables 1-5, or individually, the gene sets of Tables 5-5CC. In a preferred embodiment, arrays are constructed that contain oligonucleotides to detect all or nearly all of the genes in any one of or all of Tables 1-5 on a single solid support substrate, such as a chip.

The sequences of the expression marker genes of Tables 1-5 are in the public databases. Table 1 provides the GenBank Accession Number or NCBI RefSeq ID for each of the sequences. Table 3 provides the LocusLink and Unigene names and descriptions for the human homologues of the genes described in Tables 1 and 2. The sequences of the genes in GenBank and/or RefSeq are expressly herein incorporated by reference in their entirety as of the filing date of this application, as are related sequences, for instance, sequences from the same gene of different lengths, variant sequences, polymorphic sequences, genomic sequences of the genes and related sequences from different species, including the human counterparts, where appropriate. These sequences may be used in the methods of the invention or may be used to produce the probes and arrays of the invention. In some embodiments, the genes in Tables 1-5 that correspond to the genes or fragments previously associated with a toxic response may be excluded from the Tables.

As described above, in addition to the sequences of the GenBank Accession Numbers or NCBI RefSeq ID's disclosed in the Tables 1-5, sequences such as naturally occurring variants or polymorphic sequences may be used in the methods and compositions of the invention. For instance, expression levels of various allelic or homologous forms of a gene disclosed in Tables 1-5 may be assayed. Any and all nucleotide variations that do not alter the functional activity of a gene listed in the Tables 1-5, including all naturally occurring allelic variants of the genes herein disclosed, may be used in the methods and to make the compositions (e.g., arrays) of the invention.

Probes based on the sequences of the genes described above may be prepared by any commonly available method. Oligonucleotide probes for screening or assaying a tissue or cell sample are preferably of sufficient length to specifically hybridize only to appropriate, complementary genes or transcripts. Typically the oligonucleotide probes will be at least about 10, 12, 14, 16, 18, 20 or 25 nucleotides in length. In some cases, longer probes of at least 30, 40, or 50 nucleotides will be desirable.

As used herein, oligonucleotide sequences that are complementary to one or more of the genes described in Tables 1-5 refer to oligonucleotides that are capable of hybridizing under stringent conditions to at least part of the nucleotide sequences of said genes. Such hybridizable oligonucleotides will typically exhibit at least about 75% sequence identity at the nucleotide level to said genes, preferably about 80% or 85% sequence identity or more preferably about 90% or 95% or more sequence identity to said genes.

"Bind(s) substantially" refers to complementary hybridization between a probe nucleic acid and a target nucleic acid and embraces minor mismatches that can be accommodated by reducing the stringency of the hybridization media to achieve the desired detection of the target polynucleotide sequence.

The terms "background" or "background signal intensity" refer to hybridization signals resulting from non-specific binding, or other interactions, between the labeled target nucleic acids and components of the oligonucleotide array (e.g., the oligonucleotide probes, control probes, the array substrate, etc.). Background signals may also be produced by intrinsic fluorescence of the array components themselves. A single background signal can be calculated for the entire array, or a different background signal may be calculated for each target nucleic acid. In a preferred embodiment, background is calculated as the average hybridization signal intensity for the lowest 5% to 10% of the probes in the array, or, where a different background signal is calculated for each target gene, for the lowest 5% to 10% of the probes for each gene. Of course, one of skill in the art will appreciate that where the probes to a particular gene hybridize well and thus appear to be specifically binding to a target sequence, they should not be used in a background signal calculation. Alternatively, background may be calculated as the average hybridization signal intensity produced by hybridization to probes that are not complementary to any sequence found in the sample (e.g. probes directed to nucleic acids of the opposite sense or to genes not found in the sample such as bacterial genes where the sample is mammalian nucleic acids). Background can also be calculated as the average signal intensity produced by regions of the array that lack any probes at all.

The phrase "hybridizing specifically to" or "specifically hybridizes" refers to the binding, duplexing, or hybridizing of a molecule substantially to or only to a particular nucleotide sequence or sequences under stringent conditions when that sequence is present in a complex mixture (e.g., total cellular) DNA or RNA.

Assays and methods of the invention may utilize available formats to simultaneously screen at least about 100, preferably about 1000, more preferably about 10,000 and most preferably about 1,000,000 different nucleic acid hybridizations.

As used herein a "probe" is defined as a nucleic acid, capable of binding to a target nucleic acid of complementary sequence through one or more types of chemical bonds, usually through complementary base pairing, usually through hydrogen bond formation. As used herein, a probe may include natural (i.e., A, G, U, C, or T) or modified bases (7-deazaguanosine, inosine, etc.). In addition, the bases in probes may be joined by a linkage other than a phosphodiester bond, so long as it does not interfere with hybridization. Thus, probes may be peptide nucleic acids in which the constituent bases are joined by peptide bonds rather than phosphodiester linkages.

The term "perfect match probe" refers to a probe that has a sequence that is perfectly complementary to a particular target sequence. The test probe is typically perfectly complementary to a portion (subsequence) of the target sequence. The perfect match (PM) probe can be a "test probe", a "normalization control" probe, an expression level control probe and the like. A perfect match control or perfect match probe is, however, distinguished from a "mismatch control" or "mismatch probe."

The terms "mismatch control" or "mismatch probe" refer to a probe whose sequence is deliberately selected not to be perfectly complementary to a particular target sequence. For each mismatch (MM) control in a high-density array there typically exists a corresponding perfect match (PM) probe that is perfectly complementary to the same particular target sequence. The mismatch may comprise one or more bases.

While the mismatch(es) may be located anywhere in the mismatch probe, terminal mismatches are less desirable as a terminal mismatch is less likely to prevent hybridization of the target sequence. In a particularly preferred embodiment, the mismatch is located at or near the center of the probe such that the mismatch is most likely to destabilize the duplex with the target sequence under the test hybridization conditions.

The term "stringent conditions" refers to conditions under which a probe will hybridize to its target subsequence, but with only insubstantial hybridization to other sequences or to other sequences such that the difference may be identified. Stringent conditions are sequence-dependent and will be different in different circumstances. Longer sequences hybridize specifically at higher temperatures. Generally, stringent conditions are selected to be about 5° C. lower than the thermal melting point (Tm) for the specific sequence at a defined ionic strength and pH.

Typically, stringent conditions will be those in which the salt concentration is at least about 0.01 to 1.0 M $Na^+$ ion concentration (or other salts) at pH 7.0 to 8.3 and the temperature is at least about 30° C. for short probes (e.g., 10 to 50 nucleotides). Stringent conditions may also be achieved with the addition of destabilizing agents such as formamide.

The "percentage of sequence identity" or "sequence identity" is determined by comparing two optimally aligned sequences or subsequences over a comparison window or span, wherein the portion of the polynucleotide sequence in the comparison window may optionally comprise additions or deletions (i.e., gaps) as compared to the reference sequence (which does not comprise additions or deletions) for optimal alignment of the two sequences. The percentage is calculated by determining the number of positions at which the identical submit (e.g. nucleic acid base or amino acid residue) occurs in both sequences to yield the number of matched positions, dividing the number of matched positions by the total number of positions in the window of comparison and multiplying the result by 100 to yield the percentage of sequence identity. Percentage sequence identity when calculated using the programs GAP or BESTFIT (see below) is calculated using default gap weights.

Probe Design

One of skill in the art will appreciate that an enormous number of array designs are suitable for the practice of this invention. The high density array will typically include a number of test probes that specifically hybridize to the sequences of interest. Probes may be produced from any region of the genes identified in the Tables and the attached representative sequence listing. In instances where the gene reference in the Tables is an EST, probes may be designed from that sequence or from other regions of the corresponding full-length transcript that may be available in any of the sequence databases, such as those herein described. See WO 99/32660 for methods of producing probes for a given gene or genes. In addition, any available software may be used to produce specific probe sequences, including, for instance, software available from Molecular Biology Insights, Olympus Optical Co. and Biosoft International. In a preferred embodiment, the array will also include one or more control probes.

High density array chips of the invention include "test probes." Test probes may be oligonucleotides that range from about 5 to about 500, or about 7 to about 50 nucleotides, more preferably from about 10 to about 40 nucleotides and most preferably from about 15 to about 35 nucleotides in length. In other particularly preferred embodiments, the probes are 20 or 25 nucleotides in length. In another preferred embodiment, test probes are double or single strand DNA sequences such as cDNA fragments. DNA sequences are isolated or cloned from natural sources or amplified from natural sources using native nucleic acid as templates. These probes have sequences complementary to particular subsequences of the genes whose expression they are designed to detect. Thus, the test probes are capable of specifically hybridizing to the target nucleic acid they are to detect.

In addition to test probes that bind the target nucleic acid(s) of interest, the high density array can contain a number of control probes. The control probes may fall into three categories referred to herein as 1) normalization controls; 2) expression level controls; and 3) mismatch controls.

Normalization controls are oligonucleotide or other nucleic acid probes that are complementary to labeled reference oligonucleotides or other nucleic acid sequences that are added to the nucleic acid sample to be screened. The signals obtained from the normalization controls after hybridization provide a control for variations in hybridization conditions, label intensity, "reading" efficiency and other factors that may cause the signal of a perfect hybridization to vary between arrays. In a preferred embodiment, signals (e.g., fluorescence intensity) read from all other probes in the array are divided by the signal (e.g., fluorescence intensity) from the control probes thereby normalizing the measurements.

Virtually any probe may serve as a normalization control. However, it is recognized that hybridization efficiency varies with base composition and probe length. Preferred normalization probes are selected to reflect the average length of the other probes present in the array, however, they can be selected to cover a range of lengths. The normalization control(s) can also be selected to reflect the (average) base composition of the other probes in the array, however in a preferred embodiment, only one or a few probes are used and they are selected such that they hybridize well (i.e., no secondary structure) and do not match any target-specific probes.

Expression level controls are probes that hybridize specifically with constitutively expressed genes in the biological sample. Virtually any constitutively expressed gene provides a suitable target for expression level controls. Typically expression level control probes have sequences complementary to subsequences of constitutively expressed "housekeeping genes" including, but not limited to the actin gene, the transferrin receptor gene, the GAPDH gene, and the like.

Mismatch controls may also be provided for the probes to the target genes, for expression level controls or for normalization controls. Mismatch controls are oligonucleotide probes or other nucleic acid probes identical to their corresponding test or control probes except for the presence of one or more mismatched bases. A mismatched base is a base selected so that it is not complementary to the corresponding base in the target sequence to which the probe would otherwise specifically hybridize. One or more mismatches are selected such that under appropriate hybridization conditions (e.g., stringent conditions) the test or control probe would be expected to hybridize with its target sequence, but the mismatch probe would not hybridize (or would hybridize to a significantly lesser extent). Preferred mismatch probes contain a central mismatch. Thus, for example, where a probe is a 20 mer, a corresponding mismatch probe will have the identical sequence except for a single base mismatch (e.g., substituting a G, a C or a T for an A) at any of positions 6 through 14 (the central mismatch).

Mismatch probes thus provide a control for non-specific binding or cross hybridization to a nucleic acid in the sample other than the target to which the probe is directed. For example, if the target is present the perfect match probes should be consistently brighter than the mismatch probes. In addition, if all central mismatches are present, the mismatch probes can be used to detect a mutation, for instance, a mutation of a gene in the accompanying Tables 1-5. The difference in intensity between the perfect match and the mismatch probe provides a good measure of the concentration of the hybridized material.

Nucleic Acid Samples

Cell or tissue samples may be exposed to the test agent in vitro or in vivo. When cultured cells or tissues are used, appropriate mammalian cell extracts, such as liver extracts, may also be added with the test agent to evaluate agents that may require biotransformation to exhibit toxicity. In a preferred format, primary isolates of animal or human renal cells which already express the appropriate complement of drug-metabolizing enzymes may be exposed to the test agent without the addition of mammalian kidney extracts.

The genes which are assayed according to the present invention are typically in the form of mRNA or reverse transcribed mRNA. The genes may or may not be cloned. The genes may or may not be amplified. The cloning and/or amplification do not appear to bias the representation of genes within a population. In some assays, it may be preferable, however, to use polyA+RNA as a source, as it can be used with less processing steps.

As is apparent to one of ordinary skill in the art, nucleic acid samples used in the methods and assays of the invention may be prepared by any available method or process. Methods of isolating total mRNA are well known to those of skill in the art. For example, methods of isolation and purification of nucleic acids are described in detail in Chapter 3 of *Laboratory Techniques in Biochemistry and Molecular Biology*, Vol. 24, Hybridization With Nucleic Acid Probes: Theory and Nucleic Acid Probes, P. Tijssen, Ed., Elsevier Press, New York, 1993. Such samples include RNA samples, but also include cDNA synthesized from a mRNA sample isolated from a cell or tissue of interest. Such samples also include DNA amplified from the cDNA, and RNA transcribed from the amplified DNA. One of skill in the art would appreciate that it is desirable to inhibit or destroy RNase present in homogenates before homogenates are used.

Biological samples may be of any biological tissue or fluid or cells from any organism as well as cells raised in vitro, such as cell lines and tissue culture cells. Frequently the sample will be a tissue or cell sample that has been exposed to a compound, agent, drug, pharmaceutical composition, potential environmental pollutant or other composition. In some formats, the sample will be a "clinical sample" which is a sample derived from a patient. Typical clinical samples include, but are not limited to, sputum, blood, blood-cells (e.g., white cells), tissue or fine needle biopsy samples, urine, peritoneal fluid, and pleural fluid, or cells therefrom. Biological samples may also include sections of tissues, such as frozen sections or formalin fixed sections taken for histological purposes.

Forming High Density Arrays

Methods of forming high density arrays of oligonucleotides with a minimal number of synthetic steps are known. The oligonucleotide analogue array can be synthesized on a single or on multiple solid substrates by a variety of methods, including, but not limited to, light-directed chemical coupling, and mechanically directed coupling (see Pirrung, U.S. Pat. No. 5,143,854).

In brief, the light-directed combinatorial synthesis of oligonucleotide arrays on a glass surface proceeds using automated phosphoramidite chemistry and chip masking techniques. In one specific implementation, a glass surface is derivatized with a silane reagent containing a functional group, e.g., a hydroxyl or amine group blocked by a photolabile protecting group. Photolysis through a photolithographic mask is used selectively to expose functional groups which are then ready to react with incoming 5' photoprotected nucleoside phosphoramidites. The phosphoramidites react only with those sites which are illuminated (and thus exposed by removal of the photolabile blocking group). Thus, the phosphoramidites only add to those areas selectively exposed from the preceding step. These steps are repeated until the desired array of sequences have been synthesized on the solid surface. Combinatorial synthesis of different oligonucleotide analogues at different locations on the array is determined by the pattern of illumination during synthesis and the order of addition of coupling reagents.

In addition to the foregoing, additional methods which can be used to generate an array of oligonucleotides on a single substrate are described in PCT Publication Nos. WO 93/09668 and WO 01/23614. High density nucleic acid arrays can also be fabricated by depositing pre-made or natural nucleic acids in predetermined positions. Synthesized or natural nucleic acids are deposited on specific locations of a substrate by light directed targeting and oligonucleotide directed targeting. Another embodiment uses a dispenser that moves from region to region to deposit nucleic acids in specific spots.

Hybridization

Nucleic acid hybridization simply involves contacting a probe and target nucleic acid under conditions where the probe and its complementary target can form stable hybrid duplexes through complementary base pairing. See WO 99/32660. The nucleic acids that do not form hybrid duplexes are then washed away leaving the hybridized nucleic acids to be detected, typically through detection of an attached detectable label. It is generally recognized that nucleic acids are denatured by increasing the temperature or decreasing the salt concentration of the buffer containing the nucleic acids. Under low stringency conditions (e.g., low temperature and/or high salt) hybrid duplexes (e.g., DNA:DNA, RNA:RNA, or RNA:DNA) will form even where the annealed sequences are not perfectly complementary. Thus, specificity of hybridization is reduced at lower stringency. Conversely, at higher stringency (e.g., higher temperature or lower salt) successful hybridization tolerates fewer mismatches. One of skill in the art will appreciate that hybridization conditions may be selected to provide any degree of stringency.

In a preferred embodiment, hybridization is performed at low stringency, in this case in 6× SSPET at 37° C. (0.005% Triton X-100), to ensure hybridization and then subsequent washes are performed at higher stringency (e.g., 1× SSPET at 37° C.) to eliminate mismatched hybrid duplexes. Successive washes may be performed at increasingly higher stringency (e.g., down to as low as 0.25× SSPET at 37° C. to 50° C.) until a desired level of hybridization specificity is obtained. Stringency can also be increased by addition of agents such as formamide. Hybridization specificity may be evaluated by comparison of hybridization to the test probes with hybridization to the various controls that can be present (e.g., expression level control, normalization control, mismatch controls, etc.).

In general, there is a tradeoff between hybridization specificity (stringency) and signal intensity. Thus, in a preferred embodiment, the wash is performed at the highest stringency that produces consistent results and that provides a signal intensity greater than approximately 10% of the background intensity. Thus, in a preferred embodiment, the hybridized array may be washed at successively higher stringency solutions and read between each wash. Analysis of the data sets thus produced will reveal a wash stringency above which the hybridization pattern is not appreciably altered and which provides adequate signal for the particular oligonucleotide probes of interest.

Signal Detection

The hybridized nucleic acids are typically detected by detecting one or more labels attached to the sample nucleic acids. The labels may be incorporated by any of a number of means well known to those of skill in the art. See WO 99/32660.

Databases

The present invention includes relational databases containing sequence information, for instance, for the genes of Tables 1-5, as well as gene expression information from tissue or cells exposed to various standard toxins, such as those herein described (see Tables 5-5CC). Databases may also contain information associated with a given sequence or tissue sample such as descriptive information about the gene associated with the sequence information (see Tables 1 and 2), or descriptive information concerning the clinical status of the tissue sample, or the animal from which the sample was derived. The database may be designed to include different parts, for instance a sequence database and a gene expression database. Methods for the configuration and construction of such databases and computer-readable media to which such databases are saved are widely available, for instance, see U.S. Pat. No. 5,953,727, which is herein incorporated by reference in its entirety.

The databases of the invention may be linked to an outside or external database such as GenBank; KEGG; SPAD); HUGO; Swiss-Prot; Prosite; OMIM; and GDB. In a preferred embodiment, as described in Tables 1-5, the external database is GenBank and the associated databases maintained by the National Center for Biotechnology Information (NCBI).

Any appropriate computer platform, user interface, etc. may be used to perform the necessary comparisons between sequence information, gene expression information and any other information in the database or information provided as an input. For example, a large number of computer workstations are available from a variety of manufacturers, such has those available from Silicon Graphics. Client/server environments, database servers and networks are also widely available and appropriate platforms for the databases of the invention.

The databases of the invention may be used to produce, among other things, electronic Northerns that allow the user to determine the cell type or tissue in which a given gene is expressed and to allow determination of the abundance or expression level of a given gene in a particular tissue or cell.

The databases of the invention may also be used to present information identifying the expression level in a tissue or cell of a set of genes comprising one or more of the genes in Tables 1-5, comprising the step of comparing the expression level of at least one gene in Tables 1-5 in a cell or tissue exposed to a test agent to the level of expression of the gene in the database. Such methods may be used to predict the toxic potential of a given compound by comparing the level of expression of a gene or genes in Tables 1-5 from a tissue or cell sample exposed to the test agent to the expression levels found in a control tissue or cell samples exposed to a standard toxin or renal toxin such as those herein described. Such methods may also be used in the drug or agent screening assays as described herein.

Kits

The invention further includes kits combining, in different combinations, high-density oligonucleotide arrays, reagents for use with the arrays, protein reagents encoded by the genes of the Tables, signal detection and array-processing instruments, gene expression databases and analysis and database management software described above. The kits may be used, for example, to predict or model the toxic response of a test compound, to monitor the progression of renal disease states, to identify genes that show promise as new drug targets and to screen known and newly designed drugs as discussed above.

The databases packaged with the kits are a compilation of expression patterns from human or laboratory animal genes and gene fragments (corresponding to the genes of Tables 1-5). In particular, the database software and packaged information that may contain the databases saved to a computer-readable medium include the expression results of Tables 1-5 that can be used to predict toxicity of a test agent by comparing the expression levels of the genes of Tables 1-5 induced by the test agent to the expression levels presented in Tables 5-5CC. In another format, database and software information may be provided in a remote electronic format, such as a website, the address of which may be packaged in the kit.

The kits may used in the pharmaceutical industry, where the need for early drug testing is strong due to the high costs associated with drug development, but where bioinformatics, in particular gene expression informatics, is still lacking. These kits will reduce the costs, time and risks associated with traditional new drug screening using cell cultures and laboratory animals. The results of large-scale drug screening of pre-grouped patient populations, pharmacogenomics testing, can also be applied to select drugs with greater efficacy and fewer side-effects. The kits may also be used by smaller biotechnology companies and research institutes who do not have the facilities for performing such large-scale testing themselves.

Databases and software designed for use with microarrays is discussed in Balaban et al., U.S. Pat. No. 6,229,911, a computer-implemented method for managing information, stored as indexed Tables 1-5, collected from small or large numbers of microarrays, and U.S. Pat. No. 6,185,561, a computer-based method with data mining capability for collecting gene expression level data, adding additional attributes and reformatting the data to produce answers to various queries. Chee et al., U.S. Pat. No. 5,974,164, disclose a software-based method for identifying mutations in a nucleic acid sequence based on differences in probe fluorescence intensities between wild type and mutant sequences that hybridize to reference sequences.

Without further description, it is believed that one of ordinary skill in the art can, using the preceding description and the following illustrative examples, make and utilize the compounds of the present invention and practice the claimed methods. The following working examples therefore, specifically point out the preferred embodiments of the present invention, and are not to be construed as limiting in any way the remainder of the disclosure.

EXAMPLES

Example 1

Identification of Toxicity Markers

The renal toxins cephaloridine, cisplatin, puromycin aminonucleoside (PAN), bromoethylamine hydrobromide (BEA), gentamicin, ifosfamide, cyclophosphamide, carboplatin, AY-25329, indomethacin, acyclovir, citrinin, mercuric chloride, diflunisal, cidofovir, pamidronate, lithium, hydralazine, colchicine, sulfadiazine, and adriamycin and control compositions were administered to male Sprague-Dawley rats at various timepoints using administration diluents, protocols and dosing regimes as previously described in the art and previously described in the priority applications discussed above. The low and high dose level for each compound are provided in the chart below.

| Renal Toxin | Low Dose (mg/kg) | High Dose (mg/kg) | Method of Administration |
|---|---|---|---|
| cephaloridine | 100 | 800 | intravenous |
| cisplatin | 1 | 5 | intravenous |
| PAN | 10 | 150 | intravenous |
| BEA | 10 | 200 | intraperitoneal |
| gentamicin | 2 | 80 | intramuscular |
| ifosfamide | 5 | 100 | intraperitoneal |
| cyclophosphamide | 20 | 2000 | intraperitoneal |
| carboplatin | 5 | 50 | intravenous |
| AY-25329 | 25 | 250 | oral gavage |
| indomethacin | 1 | 10 | oral gavage |
| acyclovir | 10 | 100 | intraperitoneal |
| citrinin | 1 | 35 | intraperitoneal |
| mercuric chloride | 0.1 | 1 | intravenous |
| diflunisal | 2 | 400 | oral gavage |
| cidofovir | 10 | 100 | intraperitoneal |
| pamidronate | 1 | 60 | intraperitoneal |
| lithium | 0.3 (nmol/kg) | 3 (nmol/kg) | intraperitoneal |
| hydralazine | 2.5 | 25 | intraperitoneal |
| colchicine | 0.15 | 1.5 | intraperitoneal |
| sulfadiazine | 100 | 1000 | intravenous |
| adriamycin | 1.3 | 12.8 | intravenous |

After administration, the dosed animals were observed and tissues were collected as described below:

| OBSERVATION OF ANIMALS | |
|---|---|
| 1. Clinical Observations- | Twice daily: mortality and moribundity check. Cage Side Observations - skin and fur, eyes and mucous membrane, respiratory system, circulatory system, autonomic and central nervous system, somatomotor pattern, and behavior pattern. Potential signs of toxicity, including tremors, convulsions, salivation, diarrhea, lethargy, coma or other atypical behavior or appearance, were recorded as they occurred and included a time of onset, degree, and duration. |
| 2. Physical Examinations- | Prior to randomization, prior to initial treatment, and prior to sacrifice. |
| 3. Body Weights- | Prior to randomization, prior to initial treatment, and prior to sacrifice. |
| CLINICAL PATHOLOGY | |
| 1. Frequency | Prior to necropsy. |
| 2. Number of animals | All surviving animals. |
| 3. Bleeding Procedure | Blood was obtained by puncture of the orbital sinus while under 70% $CO_2$/30% $O_2$ anesthesia. |
| 4. Collection of Blood Samples | Approximately 0.5 mL of blood was collected into EDTA tubes for evaluation of hematology parameters. Approximately 1 mL of blood was collected into serum separator tubes for clinical chemistry analysis. Approximately 200 uL of plasma was obtained and frozen at ~−80° C. for test compound/metabolite estimation. An additional ~2 mL of blood was collected into a 15 mL conical polypropylene vial to which ~3 mL of Trizol was immediately added. The contents were immediately mixed with a vortex and by repeated inversion. The tubes were frozen in liquid nitrogen and stored at ~−80° C. |
| TERMINATION PROCEDURES | |
| Terminal Sacrifice | |

Approximately 3, 6, 24, 48, 72, 120, 144, 168, 336, and/or 360 hours after the initial dose, rats were weighed, physically examined, sacrificed by decapitation, and exsanguinated. The animals were necropsied within approximately five minutes of sacrifice. Separate sterile, disposable instruments were used for each animal, with the exception of bone cutters, which were used to open the skull cap. The bone cutters were dipped in disinfectant solution between animals.

Necropsies were conducted on each animal following procedures approved by board-certified pathologists.

Animals not surviving until terminal sacrifice were discarded without necropsy (following euthanasia by carbon dioxide asphyxiation, if moribund). The approximate time of death for moribund or found dead animals was recorded.

Postmortem Procedures

Fresh and sterile disposable instruments were used to collect tissues. Gloves were worn at all times when handling tissues or vials. All tissues were collected and frozen within approximately 5 minutes of the animal's death. The liver sections and kidneys were frozen within approximately 3-5 minutes of the animal's death. The time of euthanasia, an interim time point at freezing of liver sections and kidneys, and time at completion of necropsy were recorded. Tissues were stored at approximately −80° C. or preserved in 10% neutral buffered formalin.

Tissue Collection and Processing

Liver
1. Right medial lobe—snap frozen in liquid nitrogen and stored at ~−80° C.
2. Left medial lobe—Preserved in 10% neutral-buffered formnalin (NBF) and evaluated for gross and microscopic pathology.
3. Left lateral lobe—snap frozen in liquid nitrogen and stored at ~−80° C.

Heart
A sagittal cross-section containing portions of the two atria and of the two ventricles was preserved in 10% NBF. The remaining heart was frozen in liquid nitrogen and stored at ~−80° C.

Kidneys (Both)
1. Left—Hemi-dissected; half was preserved in 10% NBF and the remaining half was frozen in liquid nitrogen and stored at ~−80° C.
2. Right—Hemi-dissected; half was preserved in 10% NBF and the remaining half was frozen in liquid nitrogen and stored at ~−80° C.

Testes (both)
A sagittal cross-section of each testis was preserved in 10% NBF. The remaining testes were frozen together in liquid nitrogen and stored at ~−80° C.

Brain (whole)
A cross-section of the cerebral hemispheres and of the diencephalon was preserved in 10% NBF, and the rest of the brain was frozen in liquid nitrogen and stored at ~−80° C.

Microarray sample preparation was conducted with minor modifications, following the protocols set forth in the Affymetrix GeneChip Expression Analysis Manual. Frozen tissue was ground to a powder using a Spex Certiprep 6800 Freezer Mill. Total RNA was extracted with Trizol (Gibco-BRL) utilizing the manufacturer's protocol. The total RNA yield for each sample was 200-500 μg per 300 mg tissue weight. MRNA was isolated using the Oligotex MRNA Midi kit (Qiagen) followed by ethanol precipitation. Double stranded cDNA was generated from mRNA using the SuperScript Choice system (GibcoBRL). First strand cDNA synthesis was primed with a T7-(dT24) oligonucleotide. The cDNA was phenol-chloroform extracted and ethanol precipitated to a final concentration of 1 μg/ml. From 2 μg of cDNA, cRNA was synthesized using Ambion's T7 MegaScript in vitro Transcription Kit.

To biotin label the cRNA, nucleotides Bio-11-CTP and Bio-16-UTP (Enzo Diagnostics) were added to the reaction. Following a 37° C. incubation for six hours, impurities were removed from the labeled cRNA following the RNeasy Mini kit protocol (Qiagen). cRNA was fragmented (fragmentation buffer consisting of 200 mM Tris-acetate, pH 8.1, 500 mM KOAc, 150 mM MgOAc) for thirty-five minutes at 94° C. Following the Affymetrix protocol, 55 μg of fragmented cRNA was hybridized on the Affymetrix rat array set for twenty-four hours at 60 rpm in a 45° C. hybridization oven. The chips were washed and stained with Streptavidin Phycoerythrin (SAPE) (Molecular Probes) in Affymetrix fluidics stations. To amplify staining, SAPE solution was added twice with an anti-streptavidin biotinylated antibody (Vector Laboratories) staining step in between. Hybridization to the probe arrays was detected by fluorometric scanning (Hewlett Packard Gene Array Scanner). Data was analyzed using Affymetrix GeneChip® version 2.0 and Expression Data Mining (EDMT) software (version 1.0), GeneExpress2000, and S-Plus.

Tables 1 and 2 disclose those genes that are differentially expressed upon exposure to the named toxins and their corresponding GenBank Accession and Sequence Identification numbers, the identities of the metabolic pathways in which the genes function, the gene names if known, and the unigene cluster titles. The model code represents the various toxicity state that each gene is able to discriminate as well as the individual toxin type associated with each gene. The codes are defined in Table 4. The GLGC ID is the internal Gene Logic identification number.

Table 3 discloses those genes that are the human homologues of those genes in Tables 1 and 2 that are differentially expressed upon exposure to the named toxins. The corresponding GenBank Accession and Sequence Identification numbers, the gene names if known, and the unigene cluster titles of the human homologues are listed.

Table 4 defines the comparison codes used in Tables 1, 2, 3, and 5.

Tables 5-5CC disclose the summary statistics for each of the comparisons performed. Each of these tables contains a set of predictive genes and creates a model for predicting the renal toxicity of an unknown, i.e., untested compound. Each gene is identified by its Gene Logic identification number and can be cross-referenced to a gene name and representative SEQ ID NO. in Tables 1 and 2. For each comparison of gene expression levels between samples in the toxicity group (samples affected by exposure to a specific toxin) and samples in the non-toxicity group (samples not affected by exposure to that same specific toxin), the tox mean (for toxicity group samples) is the mean signal intensity, as normalized for the various chip parameters that are being assayed. The non-tox mean represents the mean signal intensity, as normalized for the various chip parameters that are being assayed, in samples from animals other than those treated with the high dose of the specific toxin. These animals were treated with a low dose of the specific toxin, or with vehicle alone, or with a different toxin. Samples in the toxicity groups were obtained from animals sacrificed at the timepoint(s) indicated in the Table 5 headings, while samples in the non-toxicity groups were obtained from animals sacrificed at all time points in the experiments. For individual genes, an increase in the tox mean compared to the non-tox mean indicates up-regulation upon exposure to a toxin. Conversely, a decrease in the tox mean compared to the non-tox mean indicates down-regulation.

The mean values are derived from Average Difference (AveDiff) values for a particular gene, averaged across the corresponding samples. Each individual Average Difference value is calculated by integrating the intensity information from multiple probe pairs that are tiled for a particular fragment. The normalization multiplies each expression intensity for a given experiment (chip) by a global scaling factor. The intent of this normalization is to make comparisons of individual genes between chips possible. The scaling factor is calculated as follows:

1. From all the unnormalized expression values in the experiment, delete the largest 2% and smallest 2% of the values. That is, if the experiment yields 10,000 expression values, order the values and delete the smallest 200 and the largest 200.

2. Compute the trimmed mean, which is equal to the mean of the remaining values.

3. Compute the scale factor SF=100/(trimmed mean).

The value of 100 used here is the standard target value used. Some AveDiff values may be negative due to the general noise involved in nucleic acid hybridization experiments. Although many conclusions can be made corresponding to a negative value on the GeneChip platform, it is difficult to assess the meaning behind the negative value for individual fragments. Our observations show that, although negative values are observed at times within the predictive gene set, these values reflect a real biological phenomenon that is highly reproducible across all the samples from which the measurement was taken. For this reason, those genes that exhibit a negative value are included in the predictive set. It should be noted that other platforms of gene expression measurement may be able to resolve the negative numbers for the corresponding genes. The predictive ability of each of those genes should extend across platforms, however. Each mean value is accompanied by the standard deviation for the mean. The linear discriminant analysis score (discriminant score), as disclosed in the tables, measures the ability of each gene to predict whether or not a sample is toxic. The discriminant score is calculated by the following steps:

Calculation of a Discriminant Score

Let $X_1$ represent the AveDiff values for a given gene across the non-tox samples, $i=1 \ldots n$.

Let $Y_i$ represent the AveDiff values for a given gene across the tox samples, $i=1 \ldots t$.

The calculations proceed as follows:

1. Calculate mean and standard deviation for $X_1$'s and $Y_i$'s, and denote these by $m_X, m_Y, s_X, s_Y$.

2. For all $X_1$'s and $Y_i$'s, evaluate the function $f(z)=((1/s_Y)*\exp(-0.5*((z-m_Y)/s_Y)^2))/(((1/s_Y)*\exp(-0.5*((z-m_Y)/s_Y)^2))+((1/s_X)*\exp(-0.5*((z-m_X)/s_X)^2)))$.

3. The number of correct predictions, say P, is then the number of $Y_i$'s such that $f(Y_i)>0.5$ plus the number of $X_1$'s such that $f(X_1)<0.5$.

4. The discriminant score is then $P/(n+t)$.

Linear discriminant analysis uses both the individual measurements of each gene and the calculated measurements of all combinations of genes to classify samples. For each gene a weight is derived from the mean and standard deviation of the toxic and nontox groups. Every gene is multiplied by a weight and the sum of these values results in a collective discriminate score. This discriminant score is then compared against collective centroids of the tox and nontox groups. These centroids are the average of all tox and nontox samples respectively. Therefore, each gene contributes to the overall prediction. This contribution is dependent on weights that are large positive or negative numbers if the relative distances between the tox and nontox samples for that gene are large and small numbers if the relative distances are small. The discriminant score for each unknown sample and centroid values can be used to calculate a probability between zero and one as to the group in which the unknown sample belongs.

Example 2

General Toxicity Modeling

Samples were selected for grouping into tox-responding and non-tox-responding groups by examining each study individually with Principal Components Analysis (PCA) to determine which treatments had an observable response. Only groups where confidence of their tox-responding and non-tox-responding status was established were included in building a general tox model (Table 5).

Linear discriminant models were generated to describe toxic and non-toxic samples. The top discriminant genes and/or EST's were used to determine toxicity by calculating each gene's contribution with homo and heteroscedastic treatment of variance and inclusion or exclusion of mutual information between genes. Prediction of samples within the database exceeded 80% true positives with a false positive rate of less than 5%. It was determined that combinations of genes and/or EST's generally provided a better predictive ability than individual genes and that the more genes and/or EST used the better predictive ability. Although the preferred embodiment includes fifty or more genes, many pairings or greater combinations of genes and/or EST can work better than individual genes. All combinations of two or more genes from the selected list (Table 5) could be used to predict toxicity. These combinations could be selected by pairing in an agglomerate, divisive, or random approach. Further, as yet undetermined genes and/or EST's could be combined with individual or combination of genes and/or EST's described here to increase predictive ability. However, the genes and/or EST's described here would contribute most of the predictive ability of any such undetermined combinations.

Other variations on the above method can provide adequate predictive ability. These include selective inclusion of components via agglomerate, divisive, or random approaches or extraction of loading and combining them in agglomerate, divisive, or random approaches. Also the use of composite variables in logistic regression to determine classification of samples can also be accomplished with linear discriminate analysis, neural or Bayesian networks, or other forms of regression and classification based on categorical or continual dependent and independent variables.

Example 3

Modeling Methods

The above modeling methods provide broad approaches of combining the expression of genes to predict sample toxicity. One could also provide no weight in a simple voting method or determine weights in a supervised or unsupervised method using agglomerate, divisive, or random approaches. All or selected combinations of genes may be combined in ordered, agglomerate, or divisive, supervised or unsupervised clustering algorithms with unknown samples for classification. Any form of correlation matrix may also be used to classify unknown samples. The spread of the group distribution and discriminate score alone provide enough information to enable a skilled person to generate all of the above types of models with accuracy that can exceed discriminate ability of individual genes. Some examples of methods that could be used individually or in combination after transformation of data types include but are not limited to: Discriminant Analysis, Multiple Discriminant Analysis, logistic regression, multiple regression analysis, linear regression analysis, conjoint analysis, canonical correlation, hierarchical cluster analysis, k-means cluster analysis, self-organizing maps, multidimensional scaling, structural equation modeling, support vector machine determined boundaries, factor analysis, neural networks, bayesian classifications, and resampling methods.

Example 4

Grouping of Individual Compound and Pathology Classes

Samples were grouped into individual pathology classes based on known toxicological responses and observed clinical chemical and pathology measurements or into early and late phases of observable toxicity within a compound (Tables 5A-3CC). The top 10, 25, 50, 100 genes based on individual discriminate scores were used in a model to ensure that combination of genes provided a better prediction than individual genes. As described above, all combinations of two or more genes from this list could potentially provide better prediction than individual genes when selected in any order or by ordered, agglomerate, divisive, or random approaches. In addition, combining these genes with other genes could provide better predictive ability, but most of this predictive ability would come from the genes listed herein.

Samples may be considered toxic if they score positive in any pathological or individual compound class represented here or in any modeling method mentioned under general toxicology models based on combination of individual time and dose grouping of individual toxic compounds obtainable from the data. The pathological groupings and early and late phase models are preferred examples of all obtainable combinations of sample time and dose points. Most logical groupings with one or more genes and one or more sample dose and time points should produce better predictions of general toxicity, pathological specific toxicity, or similarity to known toxicant than individual genes.

Although the present invention has been described in detail with reference to examples above, it is understood that various modifications can be made without departing from the spirit of the invention. Accordingly, the invention is limited only by the following claims. All cited patents, patent applications and publications referred to in this application are herein incorporated by reference in their entirety.

TABLE 1

SUMMARY

Atty. Docket No. 44921-5089US
Doc. No. 1803440.1

| Sequence ID No. | Identifier | GenBank Acc/Ref. Seq ID | Model Code | Gene Name | Unigene Cluster Title |
|---|---|---|---|---|---|
| 1 | 6949 | AA012785 | q | | ESTs |
| 2 | 25098 | AA108277 | h, v | | |
| 3 | 17312 | AA108308 | r | | ESTs, Highly similar to includes exons 3 through 12 [*M. musculus*] |
| 4 | 16882 | AA684537 | o | | ESTs, Moderately similar to NADH-ubiquinone oxidoreductase subunit CI-SGDH [*H. sapiens*] |
| 5 | 6049 | AA685178 | y | | ESTs, Highly similar to alpha NAC/1.9.2. protein [*M. musculus*] |

TABLE 1-continued

SUMMARY

Atty. Docket No. 44921-5089US
Doc. No. 1803440.1

| Sequence ID No. | Identifier | GenBank Acc/Ref. Seq ID | Model Code | Gene Name | Unigene Cluster Title |
|---|---|---|---|---|---|
| 6 | 4426 | AA685974 | l, m | | ESTs |
| 7 | 21815 | AA686423 | g | | ESTs, Weakly similar to T23657 hypothetical protein M01F1 6 - *Caenorhabditis elegans* [*C. elegans*] |
| 8 | 1600 | AA686470 | i | DNA-damage inducible transcript 3 | DNA-damage inducible transcript 3 |
| 8 | 1599 | AA686470 | i | DNA-damage inducible transcript 3 | DNA-damage inducible transcript 3 |
| 9 | 21997 | AA799325 | u | | ESTs |
| 10 | 18396 | AA799330 | v | | ESTs, Highly similar to AF132951 1 CGI-17 protein [*H. sapiens*] |
| 11 | 6581 | AA799412 | f, l | | ESTs, Weakly similar to ESR1 RAT ESTROGEN RECEPTOR [*R. norvegicus*] |
| 12 | 16538 | AA799449 | k | | ESTs, Weakly similar to nucleosome assembly protein [*R. norvegicus*] |
| 13 | 23294 | AA799472 | u | | ESTs, Moderately similar to CGI-116 protein [*H. sapiens*] |
| 14 | 18290 | AA799497 | r | | ESTs |
| 15 | 18981 | AA799523 | e | | ESTs, Moderately similar to hnRNP protein [*R. norvegicus*] |
| 16 | 20843 | AA799545 | h | | ESTs, Weakly similar to TCPA RAT T-COMPLEX PROTEIN 1, ALPHA SUBUNIT [*R. norvegicus*] |
| 17 | 16993 | AA799560 | b | | ESTs |
| 18 | 16576 | AA799570 | d | | ESTs |
| 19 | 18361 | AA799591 | i | | ESTs, Highly similar to TBB1 RAT TUBULIN BETA CHAIN [*R. norvegicus*] |
| 20 | 17712 | AA799598 | z | | ESTs |
| 22 | 18346 | AA799718 | f | | ESTs |
| 23 | 8768 | AA799726 | l | | ESTs |
| 24 | 11687 | AA799732 | w | | ESTs, Highly similar to Dgcr6 protein [*M. musculus*] |
| 25 | 18349 | AA799744 | u | | ESTs |
| 26 | 17494 | AA799751 | n | | ESTs |
| 27 | 18360 | AA799771 | General | | ESTs |
| 28 | 18880 | AA799801 | w | | ESTs |
| 29 | 20998 | AA799803 | z | | ESTs, Weakly similar to serine protease [*R. norvegicus*] |
| 30 | 21006 | AA799861 | c | | ESTs, Highly similar to IRF7 MOUSE INTERFERON REGULATORY FACTOR 7 [*M. musculus*] |
| 31 | 15011 | AA799893 | General | | ESTs, Highly similar to DDRT helix-destabilizing protein - rat [*R. norvegicus*] |
| 32 | 20811 | AA799899 | a | | ESTs, Highly similar to 60S RIBOSOMAL PROTEIN L18A [*R. norvegicus*] |
| 33 | 23202 | AA799971 | General | | ESTs, Weakly similar to S52675 probable membrane protein YDR109c yeast (*Saccharomyces cerevisiae*) [*S. cerevisiae*] |
| 34 | 4832 | AA800190 | b | | ESTs, Highly similar to glycogen phosphorylase [*R. norvegicus*] |
| 35 | 21656 | AA800202 | d | | ESTs |
| 36 | 18433 | AA800218 | j, y, z | | ESTs, Weakly similar to T15476 hypothetical protein C09F5 2 - *Caenorhabditis elegans* [*C. elegans*] |
| 37 | 6386 | AA800235 | u | | ESTs |
| 38 | 18442 | AA800258 | h, k | | ESTs |
| 39 | 21092 | AA800380 | y | | ESTs, Weakly similar to CORTICOSTEROID 11-BETA-DEHYDROGENASE, ISOZYME 1 [*R. norvegicus*] |
| 40 | 17325 | AA800587 | General | | ESTs, Weakly similar to glutathione peroxidase [*R. norvegicus*] |
| 41 | 13930 | AA800613 | cc, General | | *Rattus norvegicus* gene for TIS11, complete cds |
| 42 | 21372 | AA800693 | v | | ESTs |
| 42 | 21373 | AA800693 | s | | ESTs |
| 43 | 18161 | AA800701 | k | | ESTs |

TABLE 1-continued

SUMMARY

| Sequence ID No. | GenBank Identifier | Acc/Ref. Seq ID | Model Code | Gene Name | Unigene Cluster Title |
|---|---|---|---|---|---|
| 44 | 6595 | AA800753 | w | | ESTs |
| 45 | 13348 | AA800928 | General | | ESTs |
| 46 | 23115 | AA801165 | o, y | | ESTs, Highly similar to H2A1 RAT HISTONE H2A. 1 [*R. norvegicus*] |
| 47 | 12399 | AA801307 | General | | ESTs |
| 48 | 7543 | AA801395 | General | | ESTs |
| 49 | 24237 | AA817726 | t, General | | ESTs |
| 50 | 11215 | AA817921 | o | | ESTs, Moderately similar to T25763 hypothetical protein F46F11.4 - *Caenorhabditis elegans* [*C. elegans*] |
| 51 | 5985 | AA818005 | g | | ESTs |
| 52 | 11338 | AA818016 | x | | ESTs, Highly similar to rabkinesin-6 [*M. musculus*] |
| 53 | 2845 | AA818026 | k, General | | ESTs, Weakly similar to PRSC MOUSE 26S PROTEASOME REGULATORY SUBUNIT S12 [*M. musculus*] |
| 54 | 16756 | AA818089 | i, k, General | | ESTs, Highly similar to glycyl-tRNA synthetase [*H. sapiens*] |
| 55 | 17771 | AA818224 | e, g, p, General | | ESTs, Highly similar to TBB1 RAT TUBULIN BETA CHAIN [*R. norvegicus*] |
| 56 | 6522 | AA818261 | g, m | | ESTs, Moderately similar to autoantigen p542 [*H. sapiens*] |
| 57 | 5924 | AA818359 | y | | ESTs |
| 58 | 7806 | AA818421 | b, aa | | ESTs |
| 59 | 8237 | AA818512 | v | | ESTs |
| 60 | 17434 | AA818574 | h | | ESTs |
| 61 | 8728 | AA818615 | General | | ESTs |
| 62 | 6054 | AA818658 | b, v, cc, General | Diphtheria toxin receptor (heparin binding epidermal growth factor - like growth factor) | Diphtheria toxin receptor (heparin binding epidermal growth factor - like growth factor) |
| 63 | 11590 | AA818721 | d | | ESTs, Moderately similar to S65785 mel-13a protein - mouse [*M. musculus*] |
| 64 | 4291 | AA818741 | q, General | | ESTs |
| 65 | 4330 | AA818747 | o, General | | ESTs |
| 66 | 19723 | AA818761 | v, General | | ESTs |
| 67 | 13684 | AA818770 | h, j, l, m | | *Rattus norvegicus* serine protease gene, complete cds |
| 68 | 6322 | AA818801 | k | | ESTs |
| 69 | 7690 | AA818875 | General | uroguanylin | uroguanylin |
| 70 | 4952 | AA818907 | q, General | | ESTs |
| 71 | 6094 | AA818911 | t | | ESTs |
| 72 | 10985 | AA818998 | o, General | | ESTs, Weakly similar to HP33 [*R. norvegicus*] |
| 73 | 6120 | AA819008 | t | | ESTs |
| 74 | 2586 | AA819081 | c | | ESTs, Weakly similar to testis specific protein [*R. norvegicus*] |
| 76 | 6438 | AA819269 | o | | ESTs |
| 77 | 24721 | AA819306 | d, w | | ESTs |
| 78 | 6250 | AA819376 | o, y | | *Rattus norvegicus* mRNA for inositol hexakisphosphate kinase, complete cds |
| 80 | 6281 | AA819517 | j | | ESTs, Weakly similar to JC5707 HYA22 protein [*H. sapiens*] |
| 81 | 10141 | AA819526 | j | | ESTs |
| 82 | 6551 | AA819558 | t | | ESTs |
| 83 | 6723 | AA819653 | r | | ESTs, Moderately similar to dJ30M3 1 [*H. sapiens*] |
| 84 | 14958 | AA819744 | aa | | ESTs |
| 85 | 19433 | AA819776 | v | | ESTs, Weakly similar to HS9B RAT HEAT SHOCK PROTEIN HSP 90-BETA [*R. norvegicus*] |
| 86 | 6204 | AA819889 | aa | | ESTs |
| 87 | 22820 | AA848315 | General | HMm: inosine 5'-phosphate dehydrogenase 2 | ESTs, Weakly similar to guanosine monophosphate reductase [*R. norvegicus*] |
| 88 | 6614 | AA848389 | bb | | ESTs, Weakly similar to T26686 hypothetical protein Y38F1A.6 - *Caenorhabditis elegans* [*C. elegans*] |
| 89 | 21125 | AA848437 | General | | ESTs |

TABLE 1-continued

SUMMARY

| Sequence ID No. | Identifier | GenBank Acc/Ref. Seq ID | Model Code | Gene Name | Unigene Cluster Title |
|---|---|---|---|---|---|
| 90 | 23504 | AA848496 | q | | ESTs, Moderately similar to IF4B_HUMAN EUKARYOTIC TRANSLATION INITIATION FACTOR 4B [*H. sapiens*] |
| 91 | 18532 | AA848675 | g | | ESTs, Weakly similar to FMO1 RAT DIMETHYLANILINE MONOOXYGENASE [*R. norvegicus*] |
| 92 | 21140 | AA848738 | c | | ESTs |
| 93 | 16128 | AA848807 | o | | ESTs, Moderately similar to AF132946 1 CGI-12 protein [*H. sapiens*] |
| 94 | 22923 | AA848929 | g | | ESTs |
| 95 | 17339 | AA849497 | General | | ESTs |
| 96 | 11727 | AA849518 | l | | ESTs |
| 97 | 21275 | AA849796 | i, l, m, General | | ESTs |
| 98 | 16678 | AA849827 | aa | | ESTs |
| 99 | 8515 | AA849917 | e | | ESTs |
| 100 | 18447 | AA849939 | General | | ESTs |
| 101 | 12130 | AA850037 | p | | ESTs |
| 102 | 23981 | AA850040 | x, aa | cyclase-associated protein homologue | cyclase-associated protein homologue |
| 103 | 13615 | AA850364 | t | | ESTs, Moderately similar to RB17 MOUSE RAS-RELATED PROTEIN RAB-17 [*M. musculus*] |
| 105 | 2637 | AA850893 | x | | ESTs, Highly similar to hypothetical protein [*H. sapiens*] |
| 106 | 22093 | AA850909 | d | | ESTs |
| 107 | 21766 | AA850916 | c | | ESTs |
| 108 | 2847 | AA850919 | w | | ESTs, Weakly similar to dithiolethione-inducible gene-1 [*R. norvegicus*] |
| 109 | 12162 | AA850975 | h | | *Rattus norvegicus* mRNA for ras-GTPase-activating protein SH3-domain binding protein, partial cds |
| 110 | 9514 | AA850978 | General | | ESTs |
| 111 | 3924 | AA851017 | e, q | | ESTs, Highly similar to molybdopterin-synthase large subunit [*M. musculus*] |
| 111 | 3925 | AA851017 | o, General | | ESTs, Highly similar to molybdopterin-synthase large subunit [*M. musculus*] |
| 112 | 4490 | AA851184 | a, k | | *Rattus norvegicus* mRNA for cathepsin Y, partial cds |
| 113 | 19187 | AA851230 | General | | ESTs, Weakly similar to T28050 hypothetical protein ZK856.11 - *Caenorhabditis elegans* [*C. elegans*] |
| 114 | 19189 | AA851237 | c | | ESTs, Highly similar to ubiquitin specific protease UBP43 [*M. musculus*] |
| 115 | 15386 | AA851241 | m | | ESTs, Highly similar to hypothetical protein [*H. sapiens*] |
| 116 | 21462 | AA851261 | g, l, General | | ESTs, Weakly similar to A61382 phosphorylation regulatory protein HP-10 [*H. sapiens*] |
| 117 | 21471 | AA851343 | General | | ESTs |
| 118 | 16902 | AA851379 | p | HHs: NADH dehydrogenase (ubiquinone) Fe-S protein 8 (23 kD) (NADH-coenzyme Q reductase) | ESTs, Moderately similar to NUIM_HUMAN NADH-UBIQUINONE OXIDOREDUCTASE 23 KD SUBUNIT PRECURSOR [*H. sapiens*] |
| 119 | 23376 | AA851392 | i, x | | ESTs, Moderately similar to kinesin-like DNA binding protein [*H. sapiens*] |
| 119 | 23377 | AA851392 | x | | ESTs, Moderately similar to kinesin-like DNA binding protein [*H. sapiens*] |
| 120 | 13349 | AA851417 | General | | ESTs |
| 121 | 21527 | AA851733 | r, u | | ESTs |
| 122 | 4048 | AA851814 | i, o, u, General | | *Rattus norvegicus* osteoactivin mRNA, complete cds |
| 123 | 10561 | AA851871 | bb | | ESTs, Highly similar to SSRA HUMAN TRANSLOCON-ASSOCIATED PROTEIN, ALPHA SUBUNIT PRECURSOR [*H. sapiens*] |
| 124 | 17411 | AA858621 | j, y | | *Rattus norvegicus* CaM-kinase II inhibitor alpha mRNA, complete cds |

TABLE 1-continued

SUMMARY

Atty. Docket No. 44921-5089US
Doc. No. 1803440.1

| Sequence ID No. | Identifier | GenBank Acc/Ref. Seq ID | Model Code | Gene Name | Unigene Cluster Title |
|---|---|---|---|---|---|
| 125 | 1801 | AA858636 | k, s, x, bb | | ESTs, Weakly similar to MCM6 RAT DNA REPLICATION LICENSING FACTOR MCM6 [*R. norvegicus*] |
| 126 | 18350 | AA858674 | p | | ESTs |
| 127 | 19484 | AA858693 | e | | ESTs |
| 128 | 6360 | AA858696 | d | | ESTs |
| 129 | 17334 | AA858704 | p | | ESTs, Weakly similar to Reg receptor [*R. norvegicus*] |
| 130 | 6380 | AA858758 | q | | ESTs, Weakly similar to dJ413H6 1 1 [*H. sapiens*] |
| 131 | 13219 | AA858759 | a | | ESTs |
| 132 | 6384 | AA858788 | l, m, General | | ESTs |
| 134 | 13412 | AA858830 | p | | ESTs, Highly similar to p40 seven-transmembrane-domain protein [*M. musculus*] |
| 135 | 7279 | AA858892 | f | | ESTs |
| 136 | 18217 | AA858930 | t | | ESTs |
| 137 | 5867 | AA858953 | v, General | HHs: asparaginyl-tRNA synthetase | ASPARAGINYL-TRNA SYNTHETASE, CYTOPLASMIC [*H. sapiens*] |
| 138 | 14479 | AA858969 | r | | ESTs, Moderately similar to I56526 interleukin 1 receptor type I - rat [*R. norvegicus*] |
| 139 | 6431 | AA859085 | t | | ESTs |
| 140 | 17361 | AA859114 | o, General | | ESTs |
| 141 | 21025 | AA859241 | General | outer membrane protein | outer membrane protein |
| 142 | 10076 | AA859271 | c | | ESTs |
| 143 | 21791 | AA859333 | k | | ESTs, Weakly similar to CYSR RAT CYSTEINE-RICH PROTEIN 1 [*R. norvegicus*] |
| 144 | 16314 | AA859348 | cc, General | | ESTs |
| 145 | 18862 | AA859520 | f | | ESTs |
| 146 | 15059 | AA859545 | r | | ESTs |
| 147 | 19894 | AA859581 | s | | *Rattus norvegicus* late gestation lung protein 1 (Lgl1) mRNA, complete cds |
| 148 | 14353 | AA859585 | h | | ESTs |
| 149 | 16318 | AA859648 | h | | ESTs, Weakly similar to DnaJ homolog 2 [*R. norvegicus*] |
| 150 | 17316 | AA859652 | General | | ESTs |
| 151 | 19067 | AA859663 | n, q | | ESTs |
| 152 | 22406 | AA859680 | n | | ESTs |
| 153 | 20599 | AA859690 | x | | ESTs |
| 154 | 14261 | AA859693 | u | | ESTs, Weakly similar to YNH2_CAEEL HYPOTHETICAL 31.0 KD PROTEIN R107.2 IN CHROMOSOME III [*C. elegans*] |
| 155 | 14138 | AA859700 | v | HHs: protoporphyrinogen oxidase | ESTs, Highly similar to PPOX MOUSE PROTOPORPHYRINOGEN OXIDASE [*M. musculus*] |
| 155 | 14139 | AA859700 | v | HHs: protoporphyrinogen oxidase | ESTs, Highly similar to PPOX MOUSE PROTOPORPHYRINOGEN OXIDASE [*M. musculus*] |
| 157 | 22374 | AA859804 | l | | ESTs, Weakly similar to IF4E MOUSE EUKARYOTIC TRANSLATION INITIATION FACTOR 4E [*R. norvegicus*] |
| 158 | 22385 | AA859805 | b, k | | ESTs, Moderately similar to LYOX RAT PROTEIN-LYSINE 6-OXIDASE PRECURSOR [*R. norvegicus*] |
| 159 | 22773 | AA859885 | n | | ESTs |
| 160 | 22816 | AA859898 | k, x, z | | ESTs |
| 161 | 11891 | AA859926 | x | | ESTs |
| 162 | 23070 | AA859942 | k | | ESTs, Highly similar to N-myristoyltransferase 1 [*M. musculus*] |
| 163 | 23121 | AA859948 | k | | ESTs |
| 164 | 23166 | AA859954 | cc, General | | ESTs |
| 165 | 18468 | AA859966 | aa | | ESTs, Weakly similar to Edp1 protein [*M. musculus*] |
| 166 | 23336 | AA859981 | q | HHs: inositol(myo)-1-(or 4)-monophosphatase 2 | MYO-INOSITOL-1-(OR 4)-MONOPHOSPHATASE [*R. norvegicus*] |

TABLE 1-continued

SUMMARY

Atty. Docket No. 44921-5089US
Doc. No. 1803440.1

| Sequence ID No. | Identifier | GenBank Acc/Ref. Seq ID | Model Code | Gene Name | Unigene Cluster Title |
|---|---|---|---|---|---|
| 167 | 4222 | AA860024 | a, bb | | ESTs, Highly similar to EF1G_HUMAN ELONGATION FACTOR 1-GAMMA [*H. sapiens*] |
| 168 | 13974 | AA860030 | u, x, General | | *Rattus norvegicus* mRNA for class I beta-tubulin, complete cds |
| 169 | 7090 | AA860039 | x | Hyaluronan mediated motility receptor (RHAMM) | EST, Hyaluronan mediated motility receptor (RHAMM) |
| 170 | 23769 | AA860055 | k, x | | ESTs, Moderately similar to T08661 anti-silencing protein ASF1 homolog DKFZp547E2110.1 [*H. sapiens*] |
| 171 | 16323 | AA866240 | w | | EST |
| 172 | 4462 | AA866264 | General | | ESTs, Weakly similar to PE2R RAT 20 ALPHA-HYDROXYSTEROID DEHYDROGENASE [*R. norvegicus*] |
| 173 | 15884 | AA866276 | k | | ESTs, Weakly similar to A60543 protein kinase [*R. norvegicus*] |
| 174 | 17742 | AA866302 | c, y | 4-hydroxyphenylpyruvic acid dioxygenase | 4-hydroxyphenylpyruvic acid dioxygenase |
| 175 | 16333 | AA866414 | a, h | Solute carrier family 4, member 1, anion exchange protein 1 (kidney band 3) | Solute carrier family 4, member 1, anion exchange protein 1 (kidney band 3) |
| 176 | 18918 | AA866444 | p, q | | ESTs, Moderately similar to AF1418841 oligophrenin-1 like protein [*H. sapiens*] |
| 177 | 16853 | AA866454 | j, l, m, y, z | | ESTs |
| 178 | 18995 | AA866459 | h, m | | ESTs |
| 179 | 16013 | AA866482 | s | | ESTs, Highly similar to FGD1 MOUSE PUTATIVE RHO/RAC GUANINE NUCLEOTIDE EXCHANGE FACTOR [*M. musculus*] |
| 180 | 26036 | AA874849 | r | | |
| 181 | 16059 | AA874857 | h | | ESTs |
| 182 | 16069 | AA874873 | r | | ESTs |
| 183 | 21633 | AA874951 | f | | ESTs, Weakly similar to RNA binding protein [*H. sapiens*] |
| 184 | 16192 | AA874995 | w | | ESTs |
| 185 | 16254 | AA875025 | j | | ESTs, Highly similar to RET3 BOVIN RETINOIC ACID-BINDING PROTEIN I, CELLULAR [*R. norvegicus*] |
| 186 | 16312 | AA875032 | cc, General | | ESTs |
| 187 | 20701 | AA875097 | b | | Rat alpha-fibrinogen mRNA, 3' end |
| 188 | 16416 | AA875098 | bb | | ESTs, Highly similar to ARF3_HUMAN ADP-RIBOSYLATION FACTOR [*R. norvegicus*] |
| 189 | 16419 | AA875102 | bb | | ESTs, Highly similar to RUXE_HUMAN SMALL NUCLEAR RIBONUCLEOPROTEIN E [*M. musculus*] |
| 190 | 15313 | AA875126 | l, m, General | | ESTs |
| 191 | 10936 | AA875146 | w | | ESTs, Weakly similar to AF151834 1 CGI-76 protein [*H. sapiens*] |
| 192 | 18084 | AA875186 | h | | ESTs |
| 193 | 15371 | AA875205 | u | | ESTs, Highly similar to IF39_HUMAN EUKARYOTIC TRANSLATION INITIATION FACTOR 3 SUBUNIT 9 [*H. sapiens*] |
| 194 | 15401 | AA875257 | x, z | | ESTs |
| 195 | 15410 | AA875268 | p, s | HHs NADH dehydrogenase (ubiquinone) Fe-S protein 7 (20 kD) (NADH-coenzyme Q reductase) | ESTs, Highly similar to NUKM HUMAN, partial CDS [*H. sapiens*] |
| 196 | 15420 | AA875286 | f | | ESTs |
| 197 | 15446 | AA875327 | s, w | | ESTs |
| 198 | 7936 | AA875495 | b, General | | ESTs |
| 199 | 17314 | AA875509 | i, l, m | | ESTs, Highly similar to includes exons 3 through 12 [*M. musculus*] |
| 200 | 24472 | AA875523 | k | | ESTs, Highly similar to MLES RAT MYOSIN LIGHT CHAIN ALKALI, SMOOTH-MUSCLE ISOFORM [*R. norvegicus*] |
| 201 | 15587 | AA875577 | j | | ESTs |

TABLE 1-continued

SUMMARY

| Sequence ID No. | Identifier | GenBank Acc/Ref. Seq ID | Model Code | Gene Name | Unigene Cluster Title |
|---|---|---|---|---|---|
| 202 | 15617 | AA875620 | General | | ESTs |
| 202 | 15618 | AA875620 | General | | ESTs |
| 203 | 5384 | AA891041 | f, cc, General | jun B proto-oncogene | jun B proto-oncogene |
| 204 | 24814 | AA891209 | f, p | | ESTs, Moderately similar to R33729 1, partial CDS [*H. sapiens*] |
| 205 | 21930 | AA891322 | d | | ESTs, Weakly similar to AF151373 1 nucleolin-related protein NRP [*R. norvegicus*] |
| 206 | 17225 | AA891553 | h | | ESTs, Highly similar to eIF3 p66 [*M. musculus*] |
| 207 | 7522 | AA891571 | j, m | | ESTs, Weakly similar to S67314 regulatory protein RMS1 - yeast (*Saccharomyces cerevisiae*) [*S. cerevisiae*] |
| 208 | 9071 | AA891578 | b | | ESTs |
| 209 | 19321 | AA891666 | u | melanoma antigen, family D, 1 | melanoma antigen, family D, 1 |
| 210 | 17693 | AA891737 | j, l, m, n, y, z | | ESTs |
| 211 | 17256 | AA891739 | General | | ESTs, Weakly similar to T22521 hypothetical protein F52H3 5 - *Caenorhabditis elegans* [*C. elegans*] |
| 213 | 18269 | AA891769 | General | | ESTs, Moderately similar to FINC RAT FIBRONECTIN PRECURSOR [*R. norvegicus*] |
| 214 | 9905 | AA891774 | s, bb, D239General | | ESTs |
| 215 | 17061 | AA891812 | d | | ESTs, Highly similar to alpha-adducin, hypertensive phenotype [*R. norvegicus*] |
| 216 | 7050 | AA891824 | h | | *Rattus norvegicus* clone ZG52 mRNA sequence |
| 217 | 4463 | AA891831 | General | | ESTs, Weakly similar to PE2R RAT 20 ALPHA-HYDROXYSTEROID DEHYDROGENASE [*R. norvegicus*] |
| 218 | 14289 | AA891838 | i | | ESTs, Highly similar to muscle protein 684 [*M. musculus*] |
| 219 | 20523 | AA891842 | r, cc | | ESTs |
| 220 | 17779 | AA891914 | g, s, z | | ESTs, Moderately similar to ACY1_HUMAN AMINOACYLASE-1 [*H. sapiens*] |
| 221 | 17438 | AA891943 | General | | ESTs |
| 222 | 22862 | AA891944 | p | | ESTs |
| 223 | 1159 | AA891949 | e, z | | ESTs |
| 224 | 4473 | AA891965 | General | | ESTs, Weakly similar to T31496 hypothetical protein Y116A8C.25 - *Caenorhabditis elegans* [*C. elegans*] |
| 225 | 6362 | AA892053 | f, j, l, m | | ESTs, Highly similar to chromatin structural protein homolog Supt5hp [*M. musculus*] |
| 226 | 9037 | AA892066 | y | | ESTs |
| 227 | 19469 | AA892112 | General | | ESTs, Weakly similar to proline dehydrogenase [*M. musculus*] |
| 228 | 14595 | AA892128 | o, t, v | | ESTs |
| 229 | 16527 | AA892154 | cc | | ESTs |
| 230 | 4482 | AA892173 | bb | | EST |
| 231 | 20917 | AA892238 | h | | ESTs |
| 232 | 2357 | AA892268 | d | | ESTs, Weakly similar to PC4221 protein-tyrosine kinase [*R. norvegicus*] |
| 233 | 18183 | AA892271 | h | | ESTs |
| 234 | 6523 | AA892299 | d | | ESTs |
| 236 | 13647 | AA892367 | a | | ESTs, Highly similar to RL3 RAT 60S RIBOSOMAL PROTEIN L3 [*R. norvegicus*] |
| 237 | 3473 | AA892378 | v | | ESTs, Highly similar to AF151893 1 CGI-135 protein [*H. sapiens*] |
| 238 | 17682 | AA892382 | j, p, s, x, General | | ESTs, Moderately similar to AF185570 1 putative N-acetyltransferase Camello 4 [*R. norvegicus*] |
| 239 | 820 | AA892395 | g, s | Aldolase B, fructose-biphosphate | Aldolase B, fructose-biphosphate |
| 240 | 14754 | AA892414 | u | | ESTs |
| 241 | 17439 | AA892446 | f | | ESTs |

TABLE 1-continued

SUMMARY

Atty. Docket No. 44921-5089US
Doc. No. 1803440.1

| Sequence ID No. | Identifier | GenBank Acc/Ref. Seq ID | Model Code | Gene Name | Unigene Cluster Title |
|---|---|---|---|---|---|
| 242 | 16469 | AA892462 | p | | ESTs, Moderately similar to UCRY_HUMAN UBIQUINOL-CYTOCHROME C REDUCTASE COMPLEX 6 4 KD PROTEIN [*H. sapiens*] |
| 243 | 13609 | AA892468 | i, General | | *Rattus norvegicus* mRNA for prostasin precursor, complete cds |
| 243 | 13610 | AA892468 | n, v, General | | *Rattus norvegicus* mRNA for prostasin precursor, complete cds |
| 244 | 9254 | AA892470 | n, u | | ESTs, Highly similar to HISTONE H2A.Z [*R. norvegicus*] |
| 245 | 11991 | AA892483 | s | | ESTs |
| 246 | 1522 | AA892486 | f | | ESTs, Moderately similar to LYAG MOUSE LYSOSOMAL ALPHA-GLUCOSIDASE PRECURSOR [*M. musculus*] |
| 247 | 11994 | AA892507 | aa | | ESTs, Moderately similar to S63540 protein DS 1, 24 K [*H. sapiens*] |
| 248 | 23888 | AA892520 | w | | ESTs |
| 248 | 23889 | AA892520 | h | | ESTs |
| 249 | 8599 | AA892522 | p | | ESTs |
| 250 | 15154 | AA892532 | p | | *R. norvegicus* (Wistar) CaBP1 mRNA |
| 251 | 17468 | AA892545 | r | | ESTs, Highly similar to multimembrane spanning polyspecific transporter [*M. musculus*] |
| 252 | 11203 | AA892554 | f, h | | ESTs, Highly similar to ras-GTPase-activating protein SH3-domain binding protein [*M. musculus*] |
| 253 | 18906 | AA892561 | a, bb, General | | ESTs, Moderately similar to PTD012 [*H. sapiens*] |
| 254 | 19327 | AA892562 | f, j, y, z | | *R. norvegicus* mRNA for nucleolar protein NAP57 |
| 255 | 18274 | AA892572 | p | | ESTs |
| 256 | 4512 | AA892578 | cc | | ESTs |
| 257 | 15876 | AA892582 | w | | ESTs, Highly similar to RL8_HUMAN 60S RIBOSOMAL PROTEIN L [*R. norvegicus*] |
| 258 | 19085 | AA892598 | General | | ESTs |
| 258 | 19086 | AA892598 | General | | ESTs |
| 259 | 20065 | AA892647 | l | | ESTs, Highly similar to H4_HUMAN HISTONE H4 [*R. norvegicus*] |
| 260 | 20088 | AA892666 | a, n | | ESTs |
| 261 | 23783 | AA892773 | n | | ESTs |
| 262 | 17549 | AA892776 | f, z | | Rat mitochondrial proton/phosphate symporter mRNA, complete cds |
| 263 | 13542 | AA892798 | b | | ESTs |
| 264 | 22537 | AA892799 | General | HHs glyoxylate reductase/hydroxypyruvate reductase | ESTs, Weakly similar to SERA RAT D-3-PHOSPHOGLYCERATE DEHYDROGENASE [*R. norvegicus*] |
| 264 | 22539 | AA892799 | v | HHs glyoxylate reductase/hydroxypyruvate reductase | ESTs, Weakly similar to SERA RAT D-3-PHOSPHOGLYCERATE DEHYDROGENASE [*R. norvegicus*] |
| 264 | 22538 | AA892799 | General | HHs: glyoxylate reductase/hydroxypyruvate reductase | ESTs, Weakly similar to SERA RAT D-3-PHOSPHOGLYCERATE DEHYDROGENASE [*R. norvegicus*] |
| 265 | 6951 | AA892820 | h | | ESTs, Weakly similar to S70642 ubiquitin ligase Nedd4 - rat [*R. norvegicus*] |
| 266 | 23322 | AA892821 | j, z | | *Rattus norvegicus* aiar mRNA for androgen-inducible aldehyde reductase, complete cds |
| 267 | 17923 | AA892843 | f | | ESTs, Weakly similar to T29904 hypothetical protein F59A3.3 - *Caenorhabditis elegans* [*C. elegans*] |
| 268 | 22871 | AA892859 | m | | ESTs, Weakly similar to procollagen-lysine 5-dioxygenase [*R. norvegicus*] |
| 269 | 9053 | AA892861 | p, v, General | | ESTs |
| 270 | 16482 | AA892940 | w | | ESTs, Weakly similar to EF2 RAT ELONGATION FACTOR 2 [*R. norvegicus*] |
| 271 | 12020 | AA893035 | j, y | | *Rattus norvegicus* HP33 mRNA, complete cds |

TABLE 1-continued

SUMMARY

Atty. Docket No. 44921-5089US
Doc. No. 1803440.1

| Sequence ID No. | GenBank Identifier | Acc/Ref. Seq ID | Model Code | Gene Name | Unigene Cluster Title |
|---|---|---|---|---|---|
| 272 | 3863 | AA893060 | General | | ESTs |
| 273 | 13332 | AA893080 | i, General | | ESTs |
| 274 | 21305 | AA893082 | General | | ESTs |
| 275 | 16591 | AA893191 | j, z | | ESTs |
| 276 | 17447 | AA893192 | General | | ESTs |
| 277 | 3876 | AA893205 | n | | ESTs |
| 278 | 3878 | AA893230 | General | | ESTs, Weakly similar to CALM_HUMAN CALMODULIN [*R. norvegicus*] |
| 279 | 20986 | AA893242 | q | Acyl CoA synthetase, long chain | Acyl CoA synthetase, long chain |
| 280 | 16168 | AA893280 | i, z, General | | ESTs, Moderately similar to adipophilin [*H. sapiens*] |
| 281 | 3886 | AA893289 | j, m, y | | ESTs |
| 282 | 15209 | AA893327 | y | | ESTs |
| 283 | 17800 | AA893436 | cc | | ESTs |
| 284 | 17836 | AA893626 | h | | ESTs, Weakly similar to LIS1 MOUSE PLATELET-ACTIVATING FACTOR ACETYLHYDROLASE IB ALPHA SUBUNIT [*R. norvegicus*] |
| 285 | 9084 | AA893717 | x | | ESTs |
| 286 | 22731 | AA893743 | d | | ESTs |
| 287 | 12031 | AA893860 | v | HHs. threonyl-tRNA synthetase | ESTs, Moderately similar to SYTC_HUMAN THREONYL-TRNA SYNTHETASE, CYTOPLASMIC [*H. sapiens*] |
| 288 | 17897 | AA893905 | k | | ESTs |
| 289 | 3447 | AA893982 | d | | ESTs |
| 290 | 22583 | AA894009 | n | | |
| 291 | 10540 | AA894027 | j | | EST |
| 292 | 4569 | AA894059 | x | | ESTs, Highly similar to A55748 protein kinase [*M. musculus*] |
| 293 | 18419 | AA894130 | d | | ESTs, Weakly similar to APP2 RAT AMYLOID-LIKE PROTEIN 2 PRECURSOR [*R. norvegicus*] |
| 294 | 17336 | AA894297 | j | | ESTs |
| 295 | 19120 | AA894318 | f, j | | ESTs |
| 296 | 19762 | AA899113 | i | | ESTs |
| 297 | 18286 | AA899219 | u | | Rat mRNA for beta-tubulin T beta 15 |
| 298 | 22051 | AA899498 | w | | ESTs, Weakly similar to T26581 hypothetical protein Y32B12A.3 - Caenorhabditis elegans [*C. elegans*] |
| 298 | 22052 | AA899498 | q | | ESTs, Weakly similar to T26581 hypothetical protein Y32B12A.3 - Caenorhabditis elegans [*C. elegans*] |
| 299 | 21628 | AA899563 | aa | | ESTs |
| 300 | 4262 | AA899590 | i | | ESTs |
| 301 | 4661 | AA899709 | t, General | receptor activity modifying protein 3 | receptor activity modifying protein 3 |
| 302 | 21354 | AA899721 | q | | ESTs |
| 303 | 17905 | AA899762 | General | | *Rattus norvegicus* epidermal growth factor receptor related protein (Errp) mRNA, complete cds |
| 304 | 15231 | AA899840 | r | | ESTs |
| 305 | 23778 | AA899854 | c, k, x | topoisomerase (DNA) II alpha | topoisomerase (DNA) II alpha |
| 306 | 22060 | AA899898 | b | | ESTs |
| 307 | 9114 | AA899951 | v, General | | ESTs |
| 308 | 8988 | AA900148 | f | | ESTs |
| 309 | 11841 | AA900247 | v | | *Rattus norvegicus* mRNA for Hsp70/Hsp90 organizing protein |
| 310 | 4725 | AA900290 | cc | | ESTs, Highly similar to ALPHA-2-MACROGLOBULIN PRECURSOR [*R. norvegicus*] |
| 311 | 4747 | AA900465 | General | | ESTs |
| 312 | 20988 | AA900562 | o | | ESTs |
| 313 | 3822 | AA900863 | b, g, General | | ESTs, Weakly similar to nuclear RNA helicase [*R. norvegicus*] |
| 315 | 12420 | AA901017 | b | | ESTs, Weakly similar to T20702 hypothetical protein F10C2 6 - Caenorhabditis elegans [*C. elegans*] |
| 316 | 4849 | AA901155 | s | | *Rattus norvegicus* CDK105 mRNA |

TABLE 1-continued

SUMMARY

Atty. Docket No. 44921-5089US
Doc. No. 1803440.1

| Sequence ID No. | Identifier | GenBank Acc/Ref. Seq ID | Model Code | Gene Name | Unigene Cluster Title |
|---|---|---|---|---|---|
| 317 | 3959 | AA901338 | General | | ESTs, Highly similar to IF2B_HUMAN EUKARYOTIC TRANSLATION INITIATION FACTOR 2 BETA SUBUNIT [*H. sapiens*] |
| 318 | 22846 | AA923982 | a, d | | ESTs, Highly similar to ATP-specific succinyl-CoA synthetase beta subunit [*M. musculus*] |
| 319 | 4895 | AA923999 | k | | ESTs |
| 320 | 21546 | AA924188 | cc, General | | ESTs |
| 321 | 24192 | AA924210 | n, General | | ESTs |
| 322 | 4933 | AA924301 | g, l, General | | EST |
| 323 | 4944 | AA924405 | l, General | | ESTs, Moderately similar to NO56_HUMAN NUCLEOLAR PROTEIN NOP56 [*H. sapiens*] |
| 324 | 4948 | AA924428 | r | | ESTs |
| 325 | 4949 | AA924432 | General | | ESTs, Weakly similar to NPT2 RAT RENAL SODIUM-DEPENDENT PHOSPHATE TRANSPORT PROTEIN 2 [*R. norvegicus*] |
| 326 | 18891 | AA924598 | e | | ESTs |
| 327 | 22540 | AA924630 | v, General | HHs glyoxylate reductase/hydroxypyruvate reductase | ESTs, Weakly similar to SERA RAT D-3-PHOSPHOGLYCERATE DEHYDROGENASE [*R. norvegicus*] |
| 327 | 22541 | AA924630 | General | HHs glyoxylate reductase/hydroxypyruvate reductase | ESTs, Weakly similar to SERA RAT D-3-PHOSPHOGLYCERATE DEHYDROGENASE [*R. norvegicus*] |
| 328 | 14759 | AA924766 | k | | ESTs |
| 329 | 23123 | AA924794 | x | | ESTs |
| 330 | 4067 | AA924813 | g, p | | ESTs |
| 331 | 2888 | AA924902 | r, General | | ESTs |
| 332 | 18130 | AA924964 | d | | ESTs, Highly similar to sec7 domain family member [*H. sapiens*] |
| 333 | 23141 | AA925019 | r | | ESTs |
| 334 | 23195 | AA925026 | General | | ESTs, Weakly similar to MCT7 RAT MAST CELL PROTEASE 7 PRECURSOR [*R. norvegicus*] |
| 335 | 21458 | AA925049 | f, aa, General | | ESTs |
| 336 | 5073 | AA925061 | m | | ESTs, Moderately similar to S20710 hypothetical protein, 16 K - mouse [*M. musculus*] |
| 337 | 14790 | AA925087 | o, General | | ESTs |
| 338 | 5089 | AA925126 | g | | EST, Highly similar to T50621 hypothetical protein DKFZp762O0076 1 [*H. sapiens*] |
| 339 | 23261 | AA925145 | k, General | | ESTs, Moderately similar to BHMT RAT BETAINE—HOMOCYSTEINE S-METHYLTRANSFERASE [*R. norvegicus*] |
| 340 | 17363 | AA925150 | a | | ESTs, Moderately similar to neurodegeneration-associated protein 1 [*R. norvegicus*] |
| 341 | 23448 | AA925167 | l | | ESTs |
| 342 | 23159 | AA925318 | e | I-kappa-B-beta | I-kappa-B-beta |
| 343 | 21500 | AA925353 | k | | ESTs |
| 344 | 22479 | AA925418 | t | | ESTs |
| 345 | 21151 | AA925539 | b | | ESTs |
| 346 | 16944 | AA925541 | f | heterogeneous nuclear ribonucleoprotein L | heterogeneous nuclear ribonucleoprotein L |
| 346 | 16945 | AA925541 | t | heterogeneous nuclear ribonucleoprotein L | heterogeneous nuclear ribonucleoprotein L |
| 347 | 17514 | AA925554 | bb | HHs succinate dehydrogenase complex, subunit A, flavoprotein (Fp) | ESTs, Highly similar to DHSA_HUMAN SUCCINATE DEHYDROGENASE [*H. sapiens*] |
| 348 | 5183 | AA925662 | i, General | | ESTs |
| 349 | 23189 | AA925844 | r | | ESTs |
| 350 | 23190 | AA925863 | aa | | ESTs, Highly similar to IMB3_HUMAN IMPORTIN BETA-3 SUBUNIT [*H. sapiens*] |
| 351 | 5252 | AA926051 | General | | EST |
| 352 | 22967 | AA926080 | h, cc | | ESTs |

TABLE 1-continued

SUMMARY

Atty. Docket No. 44921-5089US
Doc. No. 1803440.1

| Sequence ID No. | Identifier | GenBank Acc/Ref. Seq ID | Model Code | Gene Name | Unigene Cluster Title |
|---|---|---|---|---|---|
| 353 | 17157 | AA926129 | b | | ESTs |
| 354 | 13411 | AA926196 | u, General | | ESTs |
| 355 | 5295 | AA926247 | General | putative potassium channel TWIK | putative potassium channel TWIK |
| 356 | 22928 | AA926262 | General | | ESTs, Moderately similar to NEURONAL PROTEIN 3 1 [*M. musculus*] |
| 357 | 8948 | AA926316 | r | | ESTs, Moderately similar to T13963 formin related protein, lymphocyte specific - mouse [*M. musculus*] |
| 358 | 21798 | AA926365 | aa | | ESTs, Moderately similar to AF151827 1 CGI-69 protein [*H. sapiens*] |
| 359 | 9942 | AA942697 | s | | ESTs |
| 360 | 6039 | AA942716 | x, General | | ESTs, Highly similar to HN1 [*M. musculus*] |
| 361 | 11174 | AA942745 | g, o, w | | ESTs |
| 362 | 23005 | AA942770 | g | | ESTs |
| 363 | 21318 | AA942774 | General | | ESTs |
| 364 | 6615 | AA942889 | v | | ESTs, Weakly similar to T26686 hypothetical protein Y38F1A.6 - *Caenorhabditis elegans* [*C. elegans*] |
| 365 | 6691 | AA943028 | c | | ESTs, Highly similar to KFMS RAT MACROPHAGE COLONY STIMULATING FACTOR I RECEPTOR PRECURSOR [*R. norvegicus*] |
| 366 | 22142 | AA943066 | p | | ESTs, Weakly similar to p68 RNA helicase [*R. norvegicus*] |
| 367 | 21993 | AA943149 | v, General | | ESTs, Weakly similar to T00084 hypothetical protein KIAA0512 [*H. sapiens*] |
| 368 | 9061 | AA943508 | General | | ESTs, Weakly similar to T08666 hypothetical protein DKFZp547N0510.1 [*H. sapiens*] |
| 369 | 24390 | AA943531 | b, j, n, y | | ESTs, Weakly similar to VIL1 MOUSE VILLIN [*M. musculus*] |
| 370 | 13976 | AA943532 | f, s, x | | *Rattus norvegicus* mRNA for class I beta-tubulin, complete cds |
| 371 | 22248 | AA943537 | cc, General | | *Rattus norvegicus* zyxin mRNA, partial cds |
| 372 | 22257 | AA943558 | m | | ESTs, Highly similar to T2DA_HUMAN TRANSCRIPTION INITIATION FACTOR TFIID 20/15 KDA SUBUNITS [*H. sapiens*] |
| 373 | 12673 | AA943773 | u, cc, General | | ESTs |
| 374 | 13641 | AA944154 | u | | ESTs |
| 375 | 2658 | AA944155 | f | | ESTs |
| 376 | 12770 | AA944161 | d | | ESTs |
| 377 | 20903 | AA944180 | i, x | | ESTs, Highly similar to CKS2 MOUSE CYCLIN-DEPENDENT KINASES REGULATORY SUBUNIT 2 [*M. musculus*] |
| 378 | 13507 | AA944244 | v | | ESTs |
| 379 | 15596 | AA944353 | General | | ESTs |
| 380 | 22681 | AA944413 | i, v, cc, General | | ESTs |
| 381 | 6711 | AA944439 | General | | ESTs, Highly similar to hypothetical protein [*M. musculus*] |
| 382 | 14763 | AA944481 | i, q, General | | ESTs, Weakly similar to FIBA RAT FIBRINOGEN ALPHA/ALPHA-E CHAIN PRECURSOR [*R. norvegicus*] |
| 383 | 22466 | AA944605 | h | | ESTs |
| 384 | 12301 | AA944727 | b | | ESTs, Weakly similar to A44437 regenerating liver inhibitory factor RL/IF-1 - rat [*R. norvegicus*] |
| 385 | 7023 | AA944792 | d, m, aa | HHs polymerase (RNA) II (DNA directed) polypeptide E (25 kD) | ESTs, Highly similar to RNA polymerase II 23 kD subunit [*H. sapiens*] |
| 386 | 22536 | AA944803 | bb | | ESTs |
| 387 | 22501 | AA944811 | g, l | | ESTs |
| 388 | 23967 | AA944831 | s | | ESTs |

TABLE 1-continued

SUMMARY

Atty. Docket No. 44921-5089US
Doc. No. 1803440.1

| Sequence ID No. | GenBank Identifier | Acc/Ref. Seq ID | Model Code | Gene Name | Unigene Cluster Title |
|---|---|---|---|---|---|
| 389 | 26084 | AA944922 | i | | |
| 390 | 11974 | AA944958 | General | | ESTs |
| 391 | 22547 | AA944970 | aa | | ESTs |
| 392 | 22554 | AA945076 | z, General | | ESTs |
| 393 | 14352 | AA945181 | General | | ESTs |
| 395 | 1798 | AA945569 | General | | *R. norvegicus* alpha-1-macroglobulin mRNA, complete cds |
| 396 | 22050 | AA945604 | i, aa | | ESTs |
| 397 | 19731 | AA945615 | d, o | | ESTs |
| 398 | 22612 | AA945624 | a, General | | ESTs, Weakly similar to DHQU RAT NAD(P)H DEHYDROGENASE [*R. norvegicus*] |
| 399 | 22618 | AA945656 | aa | | ESTs |
| 400 | 11871 | AA945679 | v | | ESTs |
| 401 | 22656 | AA945818 | General | | ESTs |
| 402 | 6720 | AA945828 | p | | ESTs |
| 403 | 22351 | AA945867 | m | | ESTs |
| 404 | 22665 | AA945877 | f | | ESTs |
| 405 | 24243 | AA945950 | b | | ESTs |
| 406 | 22689 | AA945962 | General | | ESTs |
| 407 | 22692 | AA945986 | d | | ESTs |
| 408 | 22696 | AA945996 | c, General | | ESTs |
| 408 | 22697 | AA945996 | c, o | | ESTs |
| 409 | 22658 | AA945998 | w | | ESTs |
| 410 | 20832 | AA946040 | s | HMm RIKEN cDNA 2010000G05 gene | ESTs, Highly similar to COXG MOUSE CYTOCHROME C OXIDASE POLYPEPTIDE VIB [*M. musculus*] |
| 411 | 18337 | AA946046 | General | | ESTs |
| 412 | 825 | AA946108 | General | | *Rattus norvegicus* laminin-5 alpha 3 chain mRNA, complete cds |
| 413 | 8639 | AA946221 | e, cc, General | | ESTs |
| 414 | 23237 | AA946224 | f | | ESTs |
| 415 | 15600 | AA946250 | o, aa | | ESTs |
| 416 | 19387 | AA946275 | t | | ESTs, Highly similar to AR21_HUMAN ARP2/3 COMPLEX 21 KD SUBUNIT [*H. sapiens*] |
| 417 | 6351 | AA946344 | d | PCTAIRE-1 protein kinase, alternatively spliced | PCTAIRE-1 protein kinase, alternatively spliced |
| 418 | 22057 | AA946348 | e | | ESTs, Highly similar to autoantigen [*H. sapiens*] |
| 419 | 22069 | AA946349 | aa | | ESTs |
| 420 | 13962 | AA946351 | General | | ESTs |
| 421 | 18280 | AA946361 | g | | ESTs, Highly similar to Ring3 [*M. musculus*] |
| 422 | 18944 | AA946391 | v | | ESTs |
| 424 | 21410 | AA946408 | t | | ESTs, Moderately similar to p18 component of aminoacyl-tRNA synthetase complex [*H. sapiens*] |
| 425 | 643 | AA946439 | o, y | | Rat H4 gene for somatic histone H4 |
| 426 | 20736 | AA946443 | x | | ESTs, Highly similar to NPD1 MOUSE NEURAL PROLIFERATION DIFFERENTIATION AND CONTROL PROTEIN-1 PRECURSOR [*M. musculus*] |
| 427 | 21878 | AA946448 | r | | ESTs |
| 428 | 21947 | AA946451 | bb | | ESTs, Highly similar to AF151863 1 CGI-105 protein [*H. sapiens*] |
| 429 | 17499 | AA946467 | General | | ESTs |
| 430 | 1809 | AA946503 | x, General | | Rat mRNA for alpha-2u globulin-related protein |
| 431 | 23360 | AA955104 | f | | ESTs |
| 432 | 23471 | AA955162 | General | | ESTs |
| 433 | 9452 | AA955206 | b, General | | ESTs |
| 434 | 23512 | AA955282 | General | | ESTs |
| 435 | 22596 | AA955298 | General | | ESTs |
| 436 | 23283 | AA955391 | h | lipoprotein-binding protein | lipoprotein-binding protein |
| 437 | 23546 | AA955393 | General | | ESTs |
| 438 | 12404 | AA955408 | b | | ESTs, Weakly similar to SX10 RAT TRANSCRIPTION FACTOR SOX-10 [*R. norvegicus*] |
| 439 | 23626 | AA955540 | aa | | ESTs |

TABLE 1-continued

SUMMARY

Atty. Docket No. 44921-5089US
Doc. No. 1803440.1

| Sequence ID No. | Identifier | GenBank Acc/Ref. Seq ID | Model Code | Gene Name | Unigene Cluster Title |
|---|---|---|---|---|---|
| 441 | 17540 | AA955914 | bb | | EST, EST, Moderately similar to FBRL MOUSE FIBRILLARIN [*M. musculus*], ESTs, Highly similar to FBRL MOUSE FIBRILLARIN [*M. musculus*] |
| 442 | 24277 | AA955962 | General | | ESTs |
| 443 | 19939 | AA955980 | General | | ESTs, Moderately similar to pescadillo [*H. sapiens*] |
| 444 | 24000 | AA956005 | i | | ESTs, Weakly similar to AF139894 1 RNA-binding protein alpha-CP1 [*M. musculus*] |
| 445 | 11050 | AA956164 | s, v | | ESTs, Weakly similar to TCPA RAT T-COMPLEX PROTEIN 1, ALPHA SUBUNIT [*R. norvegicus*] |
| 446 | 498 | AA956278 | a, General | | ESTs |
| 447 | 23409 | AA956294 | q | | ESTs |
| 449 | 23773 | AA956476 | f, x | | ESTs |
| 450 | 23799 | AA956530 | d | | ESTs, Highly similar to ET putative translation product [*M. musculus*] |
| 451 | 23800 | AA956534 | aa | | ESTs, Weakly similar to RNG1_HUMAN RING 1 PROTEIN [*H. sapiens*] |
| 452 | 23834 | AA956659 | cc, General | | EST |
| 453 | 16425 | AA956688 | f, x | | ESTs, Moderately similar to C8 [*M. musculus*] |
| 454 | 23847 | AA956723 | s | | EST |
| 455 | 23852 | AA956746 | j, l, m, z | | ESTs, Highly similar to Mi-2 protein [*H. sapiens*] |
| 456 | 5989 | AA956907 | g, s | | ESTs, Highly similar to p162 protein [*M. musculus*] |
| 456 | 5990 | AA956907 | General | | ESTs, Highly similar to p162 protein [*M. musculus*] |
| 457 | 23957 | AA957123 | u, General | | ESTs, Weakly similar to AF187065 1 p75NTR-associated cell death executor [*R. norvegicus*] |
| 458 | 22357 | AA957264 | General | | ESTs, Highly similar to hypothetical protein [*H. sapiens*] |
| 459 | 23314 | AA957270 | g, l, m, p, v, cc, General | | ESTs |
| 460 | 23995 | AA957292 | a, b | | ESTs |
| 461 | 2702 | AA957307 | General | HHs: seryl-tRNA synthetase | ESTs, Moderately similar to SYS_HUMAN SERYL-TRNA SYNTHETASE [*H. sapiens*] |
| 462 | 24040 | AA957422 | c | | ESTs, Highly similar to HIGH AFFINITY IMMUNOGLOBULIN EPSILON RECEPTOR GAMMA-SUBUNIT PRECURSOR [*R. norvegicus*] |
| 463 | 12478 | AA957554 | m | | ESTs, Highly similar to P3 MOUSE P3 PROTEIN [*M. musculus*] |
| 464 | 21306 | AA957811 | v | | ESTs |
| 465 | 24183 | AA957889 | t | | ESTs |
| 466 | 24178 | AA957905 | d | | ESTs |
| 467 | 17034 | AA963071 | e | | ESTs, Highly similar to epsilon-COP [*M. musculus*] |
| 468 | 24053 | AA963092 | General | | ESTs, Weakly similar to AF187065 1 p75NTR-associated cell death executor [*R. norvegicus*] |
| 469 | 2767 | AA963201 | o | | ESTs |
| 470 | 2022 | AA963259 | g | | ESTs |
| 471 | 2126 | AA963488 | d | | ESTs |
| 472 | 24246 | AA963703 | b | | ESTs, Highly similar to cell cycle protein p38-2G4 homolog [*H. sapiens*] |
| 473 | 2195 | AA963746 | General | | ESTs |
| 474 | 19370 | AA963797 | i | | ESTs |
| 475 | 2282 | AA964147 | e | | ESTs |
| 476 | 2284 | AA964152 | x | | EST |
| 478 | 2350 | AA964368 | g, General | | ESTs, Highly similar to TGT_HUMAN QUEUINE TRNA-RIBOSYLTRANSFERASE [*H. sapiens*] |

TABLE 1-continued

SUMMARY

Atty. Docket No. 44921-5089US
Doc. No. 1803440.1

| Sequence ID No. | Identifier | GenBank Acc/Ref. Seq ID | Model Code | Gene Name | Unigene Cluster Title |
|---|---|---|---|---|---|
| 479 | 18830 | AA964496 | aa | | ESTs, Highly similar to ATRTC actin beta - rat [*R. norvegicus*] |
| 480 | 2392 | AA964541 | b | | EST |
| 481 | 2395 | AA964554 | General | | ESTs, Highly similar to U3 snoRNP associated 55 kDa protein [*H. sapiens*] |
| 482 | 2410 | AA964589 | i, aa | | EST |
| 483 | 19145 | AA964613 | t | | ESTs |
| 484 | 2424 | AA964617 | g | | ESTs |
| 485 | 3107 | AA964687 | General | | ESTs |
| 486 | 2457 | AA964752 | q, t | | EST |
| 487 | 6778 | AA964763 | b | | ESTs, Highly similar to DRIM protein [*H. sapiens*] |
| 489 | 2468 | AA964807 | l | | ESTs, Weakly similar to T23337 hypothetical protein K05C4.2 - *Caenorhabditis elegans* [*C. elegans*] |
| 490 | 2469 | AA964814 | w | Glutamate-cysteine ligase (gamma-glutamylcysteine synthetase), regulatory | Glutamate-cysteine ligase (gamma-glutamylcysteine synthetase), regulatory |
| 491 | 12561 | AA964815 | General | | ESTs |
| 492 | 2326 | AA964892 | aa | | ESTs, Highly similar to PROCOLLAGEN ALPHA 1(IV) CHAIN PRECURSOR [*M. musculus*] |
| 493 | 21339 | AA964962 | General | | ESTs, Highly similar to ABC1 MOUSE ATP-BINDING CASSETTE, SUB-FAMILY A, MEMBER 1 [*M. musculus*] |
| 494 | 21390 | AA964988 | General | | ESTs |
| 495 | 12569 | AA965023 | g | | ESTs |
| 496 | 2583 | AA965166 | bb | | ESTs, Moderately similar to inorganic pyrophosphatase [*H. sapiens*] |
| 497 | 15885 | AA965207 | r | | ESTs, Highly similar to KIAA0958 protein [*H. sapiens*] |
| 499 | 2905 | AA996727 | b, l, m, u, General | | ESTs |
| 500 | 2915 | AA996782 | u, bb | | ESTs, Moderately similar to S27267 lamin A - rat [*R. norvegicus*] |
| 501 | 2920 | AA996813 | d | | ESTs |
| 502 | 19525 | AA996856 | aa, General | | EST |
| 503 | 2984 | AA997015 | c | | ESTs |
| 504 | 2986 | AA997028 | General | | ESTs |
| 505 | 3145 | AA997237 | General | | ESTs |
| 506 | 19249 | AA997342 | m | | ESTs |
| 507 | 16883 | AA997345 | General | | ESTs, Weakly similar to nitrilase homolog 1 [*M. musculus*] |
| 508 | 12598 | AA997362 | s | | ESTs, Moderately similar to LONN_HUMAN MITOCHONDRIAL LON PROTEASE HOMOLOG PRECURSOR [*H. sapiens*] |
| 509 | 3470 | AA997374 | p | | ESTs, Weakly similar to LIS1 MOUSE PLATELET-ACTIVATING FACTOR ACETYLHYDROLASE IB ALPHA SUBUNIT [*R. norvegicus*] |
| 510 | 3180 | AA997425 | t | | ESTs |
| 511 | 3245 | AA997608 | General | | ESTs, Weakly similar to PAI2 RAT PLASMINOGEN ACTIVATOR INHIBITOR-2, TYPE A [*R. norvegicus*] |
| 512 | 3020 | AA997656 | t | | ESTs, Moderately similar to T09071 SH3 domains-containing protein POSH - mouse [*M. musculus*] |
| 513 | 3269 | AA997800 | x, aa | | ESTs, Moderately similar to T30249 cell proliferation antigen Ki-67 - mouse [*M. musculus*] |
| 514 | 3288 | AA997877 | f | | ESTs |
| 515 | 23992 | AA998164 | k, x | Cyclin B1 | Cyclin B1 |
| 516 | 17470 | AA998264 | b | | ESTs, Moderately similar to FLRE_HUMAN FLAVIN REDUCTASE [*H. sapiens*] |
| 517 | 3773 | AA998356 | General | | ESTs, Weakly similar to BCL3_HUMAN B-CELL LYMPHOMA 3-ENCODED PROTEIN [*H. sapiens*] |
| 518 | 19623 | AA998422 | General | | EST |
| 519 | 3572 | AA998516 | x | | ESTs, Highly similar to CGA2 MOUSE CYCLIN A2 [*M. musculus*] |

TABLE 1-continued

SUMMARY

Atty. Docket No. 44921-5089US
Doc. No. 1803440.1

| Sequence ID No. | Identifier | GenBank Acc/Ref. Seq ID | Model Code | Gene Name | Unigene Cluster Title |
|---|---|---|---|---|---|
| 520 | 2782 | AA998565 | c | | ESTs, Moderately similar to CYCLIN-DEPENDENT KINASE INHIBITOR 1C [*M. musculus*] |
| 521 | 26119 | AA998576 | i, r, w, General | | |
| 522 | 22737 | AA998660 | aa | | ESTs |
| 523 | 3696 | AA999030 | e | | ESTs, Moderately similar to AF1329661 CGI-32 protein [*H. sapiens*] |
| 524 | 3079 | AA999169 | k, x, General | | ESTs |
| 525 | 3081 | AA999171 | e, p, r | Signal transducer and activator of transcription 1 | Signal transducer and activator of transcription 1 |
| 526 | 3082 | AA999172 | General | HHs: guanine monphosphate synthetase | ESTs, Highly similar to GUAA_HUMAN GMP SYNTHASE [*H. sapiens*] |
| 527 | 17337 | AB000717 | k | | ESTs |
| 528 | 1535 | AB000778 | a | Phoshpolipase D gene 1 | Phoshpolipase D gene 1 |
| 529 | 1382 | AB002406 | k | RuvB-like protein 1 | RuvB-like protein 1 |
| 530 | 20184 | AB003753 | d | | |
| 531 | 4312 | AB010635 | c, i, j, k, y, z | | *Rattus norvegicus* mRNA for carboxylesterase precursor, complete cds |
| 532 | 21666 | AB012214 | k | HMm.DNA methyltransferase (cytosine-5) 1 | ESTs, Highly similar to JE0378 DNA [*R. norvegicus*] |
| 533 | 15772 | AB015645 | g | | *Rattus norvegicus* mRNA for G protein coupled receptor, complete cds |
| 534 | 1183 | AF013144 | h | | *Rattus norvegicus* MAP-kinase phosphatase (cpg21) mRNA, complete cds |
| 535 | 1582 | AF015911 | h, z | | *Rattus norvegicus* NAC-1 protein (NAC-1) mRNA, complete cds |
| 536 | 11483 | AF020618 | u, cc, General | | ESTs, Moderately similar to MY16 MOUSE MYELOID DIFFERENTIATION PRIMARY RESPONSE PROTEIN MYD116 [*M. musculus*], *Rattus norvegicus* progression elevated gene 3 protein mRNA, complete cds |
| 537 | 20295 | AF024712 | aa | | *Rattus norvegicus* MHC class lb M4 (RT1.M4) pseudogene, complete sequence |
| 538 | 19077 | AF030358 | y, z | | *Rattus norvegicus* chemokine CX3C mRNA, complete cds |
| 539 | 23044 | AF034218 | General | hyaluronidase 2 | hyaluronidase 2 |
| 540 | 25178 | AF035955 | d | | |
| 541 | 1564 | AF035963 | x, bb, General | | *Rattus norvegicus* kidney injury molecule-1 (KIM-1) mRNA, complete cds |
| 542 | 8426 | AF036335 | f | | *Rattus norvegicus* NonO/p54nrb homolog mRNA, partial cds |
| 543 | 21817 | AF036537 | k | | *Rattus norvegicus* homocysteine respondent protein HCYP2 mRNA, complete cds |
| 544 | 21145 | AF038571 | General | Solute carrier family 1 A1 (brain glutamate transporter) | Solute carrier family 1 A1 (brain glutamate transporter) |
| 545 | 22602 | AF044574 | General | putative peroxisomal 2,4-dienoyl-CoA reductase | putative peroxisomal 2,4-dienoyl-CoA reductase |
| 546 | 13464 | AF047707 | h | UDP-glucose: ceramide glycosyltransferase | UDP-glucose: ceramide glycosyltransferase |
| 547 | 24024 | AF052695 | x | cell cycle protein p55CDC | cell cycle protein p55CDC |
| 548 | 12259 | AF061266 | h | transient receptor protein 1 | *Rattus norvegicus* trp1 beta variant mRNA, complete cds |
| 549 | 4589 | AF062389 | y, z | | *Rattus norvegicus* kidney-specific protein (KS) mRNA, complete cds |
| 550 | 16007 | AF062594 | t | nucleosome assembly protein 1-like 1 | *Rattus norvegicus* nucleosome assembly protein mRNA, complete cds |
| 551 | 15761 | AF062741 | u | | *Rattus norvegicus* pyruvate dehydrogenase phosphatase isoenzyme 2 mRNA, complete cds |
| 552 | 17426 | AF073839 | p | | *Rattus norvegicus* bithoraxoid-like protein mRNA, complete cds |

TABLE 1-continued

SUMMARY

| Sequence ID No. | GenBank Identifier | Acc/Ref. Seq ID | Model Code | Gene Name | Unigene Cluster Title |
|---|---|---|---|---|---|
| 553 | 18615 | AF074608 | s | RT1 class lb gene | RT1 class lb gene |
| 554 | 15797 | AF084205 | f | | *Rattus norvegicus* serine/threonine protein kinase TAO1 mRNA, complete cds |
| 555 | 12932 | AF102552 | s | ankyrin 3 (G) | *Rattus norvegicus* 190 kDa ankyrin isoform mRNA, complete cds |
| 556 | 18603 | AI007649 | x | | ESTs, Highly similar to A49013 tumor cell suppression protein HTS1 [*H. sapiens*] |
| 557 | 22733 | AI007668 | r | | ESTs |
| 558 | 22746 | AI007672 | r | | ESTs |
| 559 | 24109 | AI007725 | General | | ESTs |
| 560 | 15848 | AI007820 | n, v | | ESTs, ESTs, Highly similar to HS9B RAT HEAT SHOCK PROTEIN HSP 90-BETA [*R. norvegicus*] |
| 561 | 10108 | AI007857 | f | Hrs | Hrs |
| 562 | 6804 | AI007877 | General | | ESTs |
| 563 | 20099 | AI007893 | f, u | | ESTs |
| 564 | 11368 | AI007948 | d | | ESTs, Weakly similar to T18778 hypothetical protein B0513 2b - *Caenorhabditis elegans* [*C. elegans*] |
| 565 | 15849 | AI008074 | h | | ESTs, ESTs, Highly similar to HS9B RAT HEAT SHOCK PROTEIN HSP 90-BETA [*R. norvegicus*] |
| 566 | 3121 | AI008160 | General | | ESTs, Moderately similar to AF151841 1 CGI-83 protein [*H. sapiens*] |
| 567 | 16646 | AI008190 | t | | ESTs, Highly similar to Chain G, G Protein Heterotrimer Gi alpha 1 Beta 1 Gamma 2 With Gdp Bound [*R. norvegicus*] |
| 568 | 12683 | AI008203 | x | | ESTs, Weakly similar to G2/MITOTIC-SPECIFIC CYCLIN B1 [*R. norvegicus*] |
| 569 | 22018 | AI008309 | b | | ESTs, Moderately similar to PIM1 RAT PROTO-ONCOGENE SERINE/THREONINE-PROTEIN KINASE PIM-1 [*R. norvegicus*] |
| 570 | 23917 | AI008441 | n | | ESTs, Highly similar to 6PGD_HUMAN 6-PHOSPHOGLUCONATE DEHYDROGENASE, DECARBOXYLATIN [*H. sapiens*] |
| 571 | 22599 | AI008458 | General | | ESTs |
| 572 | 22698 | AI008578 | p, General | | ESTs |
| 573 | 14405 | AI008579 | r, x | | ESTs |
| 574 | 4086 | AI008629 | x | | ESTs, Moderately similar to JH0446 75 K autoantigen [*H. sapiens*] |
| 575 | 3808 | AI008643 | i, v, General | | ESTs, Weakly similar to heat shock protein hsp40-3 [*M. musculus*] |
| 576 | 3931 | AI008697 | l | | ESTs, Weakly similar to T29897 hypothetical protein F38A5.1 - *Caenorhabditis elegans* [*C elegans*] |
| 577 | 7785 | AI008758 | aa | Dipeptidyl peptidase 4 | Dipeptidyl peptidase 4 |
| 578 | 16701 | AI008838 | q | | ESTs, Weakly similar to LONN_HUMAN MITOCHONDRIAL LON PROTEASE HOMOLOG PRECURSOR [*H. sapiens*] |
| 579 | 21789 | AI008930 | k | | ESTs, Weakly similar to CYSR RAT CYSTEINE-RICH PROTEIN 1 [*R. norvegicus*] |
| 580 | 21895 | AI008971 | General | | ESTs |
| 581 | 410 | AI008974 | l, aa, General | | *R. norvegicus* mRNA encoding 45 kDa protein which binds to heymann nephritis antigen gp330 |
| 582 | 21632 | AI009167 | General | | ESTs, Highly similar to BAG-family molecular chaperone regulator-2 [*H. sapiens*] |
| 583 | 21596 | AI009168 | General | | ESTs |
| 584 | 22801 | AI009197 | General | | ESTs |
| 585 | 11876 | AI009321 | cc, General | | ESTs, Highly similar to similar to human DNA-binding protein 5 [*H. sapiens*] |
| 586 | 2506 | AI009341 | General | | ESTs |

TABLE 1-continued

SUMMARY

Atty. Docket No. 44921-5089US
Doc. No. 1803440.1

| Sequence ID No. | Identifier | GenBank Acc/Ref. Seq ID | Model Code | Gene Name | Unigene Cluster Title |
|---|---|---|---|---|---|
| 587 | 6382 | AI009362 | General | | ESTs |
| 588 | 14370 | AI009427 | k | | ESTs, Highly similar to Lmp10 proteasome subunit [*M. musculus*] |
| 589 | 19275 | AI009460 | x | | ESTs, Highly similar to filamin [*H. sapiens*] |
| 590 | 4154 | AI009467 | g | | ESTs |
| 591 | 3464 | AI009589 | cc | | ESTs |
| 592 | 3926 | AI009592 | e | | ESTs, Highly similar to molybdopterin-synthase large subunit [*M. musculus*] |
| 593 | 19358 | AI009675 | c | | EST |
| 594 | 22545 | AI009747 | g | | ESTs |
| 595 | 15089 | AI009752 | cc, General | | ESTs |
| 596 | 5458 | AI009756 | h | ALG-2 interacting protein 1 | ALG-2 interacting protein 1 |
| 597 | 6844 | AI009770 | e, r, cc | | ESTs |
| 598 | 15627 | AI009810 | aa | | ESTs, Highly similar to RS16_HUMAN 40S RIBOSOMAL PROTEIN S1 [*R. norvegicus*] |
| 599 | 22619 | AI009825 | d | | ESTs |
| 600 | 7857 | AI009898 | j, l, m, z | | ESTs |
| 601 | 13259 | AI009946 | r | | ESTs |
| 602 | 21105 | AI010067 | General | | ESTs |
| 603 | 24627 | AI010102 | aa | Testis enhanced gene transcript | Testis enhanced gene transcript |
| 604 | 12716 | AI010178 | General | | ESTs, Moderately similar to YA00_HUMAN HYPOTHETICAL PROTEIN CGI-100 PRECURSOR [*H. sapiens*] |
| 605 | 18757 | AI010216 | aa | | ESTs |
| 606 | 2912 | AI010220 | aa, General | | ESTs, Weakly similar to claudin-7 [*R. norvegicus*] |
| 607 | 3316 | AI010237 | t | | ESTs |
| 608 | 15644 | AI010256 | General | | *R. norvegicus* mRNA for histone H3.3 |
| 609 | 657 | AI010262 | b | | *Rattus norvegicus* mRNA for inetrleukin-4 receptor (membrane-bound form), complete cds |
| 610 | 3271 | AI010303 | b | | ESTs |
| 611 | 11081 | AI010407 | bb | | ESTs, Moderately similar to erythroblast macrophage protein EMP [*H. sapiens*] |
| 612 | 16521 | AI010470 | c, s, t, General | Ceruloplasmin (ferroxidase) | Ceruloplasmin (ferroxidase) |
| 613 | 6927 | AI010542 | General | | ESTs |
| 614 | 17524 | AI010568 | a, j, y General | Growth hormone receptor | Growth hormone receptor |
| 615 | 6946 | AI010642 | n | | ESTs |
| 616 | 23509 | AI010962 | aa | | ESTs, Highly similar to SDP3 [*M. musculus*] |
| 617 | 6044 | AI011285 | t | | ESTs |
| 618 | 13855 | AI011361 | o | | ESTs |
| 619 | 21779 | AI011380 | cc | | ESTs |
| 621 | 12534 | AI011460 | cc | | ESTs |
| 622 | 12629 | AI011492 | e, f | | ESTs, Moderately similar to HYA22 [*H. sapiens*] |
| 623 | 735 | AI011560 | f | | ESTs, Weakly similar to B Chain B, Solution Structure Of The C-Terminal Negative Regulatory Domain Of P53 In A Complex With Ca2+-Bound S100b(Bb) [*R. norvegicus*] |
| 624 | 3941 | AI011598 | General | | ESTs Moderately similar to LMA5 MOUSE LAMININ ALPHA-5 CHAIN [*M. musculus*] |
| 625 | 17550 | AI011607 | j, General | | ESTs, Weakly similar to JE0360 gamma-Butyrobetaine hydroxylase [*H. sapiens*] |
| 626 | 10636 | AI011634 | e | | ESTs, Weakly similar to I(3)S12 protein [*D. melanogaster*] |
| 627 | 3995 | AI011678 | General | | ESTs |
| 628 | 16112 | AI011706 | h | | ESTs, Weakly similar to SFR5 RAT SPLICING FACTOR, ARGININE/SERINE-RICH 5 [*R. norvegicus*] |

TABLE 1-continued

SUMMARY

Atty. Docket No. 44921-5089US
Doc. No. 1803440.1

| Sequence ID No. | Identifier | GenBank Acc/Ref. Seq ID | Model Code | Gene Name | Unigene Cluster Title |
|---|---|---|---|---|---|
| 629 | 13354 | AI011757 | c | | ESTs, Weakly similar to A35902 Fc gamma [R. norvegicus] |
| 630 | 12745 | AI011799 | cc | | ESTs |
| 631 | 18684 | AI011812 | t | | ESTs, Highly similar to AF151842 1 CGI-84 protein [H. sapiens] |
| 632 | 4205 | AI011982 | b | | ESTs |
| 633 | 6518 | AI012114 | General | | ESTs, Moderately similar to R29425 1 [H. sapiens] |
| 634 | 17407 | AI012145 | General | | ESTs |
| 635 | 13093 | AI012177 | r | | ESTs, Weakly similar to PPP5 RAT SERINE/THREONINE PROTEIN PHOSPHATASE 5 [R. norvegicus] |
| 636 | 15395 | AI012216 | f | | ESTs, Moderately similar to Y33K__HUMAN HYPOTHETICAL 33.4 KDA PROTEI [H. sapiens] |
| 637 | 21796 | AI012221 | d, General | | ESTs, Weakly similar to S70484 RS43 protein - rat (fragment) [R. norvegicus] |
| 638 | 3981 | AI012235 | i, General | | ESTs |
| 639 | 6606 | AI012308 | i, r | | ESTs |
| 640 | 3417 | AI012337 | w | | ESTs, Highly similar to NHPX RAT NHP2/RS6 FAMILY PROTEIN YEL026W HOMOLOG [R. norvegicus] |
| 641 | 24200 | AI012356 | b, t, General | | ESTs |
| 642 | 7471 | AI012379 | cc | | ESTs |
| 643 | 7247 | AI012438 | g | | ESTs |
| 644 | 7127 | AI012464 | p, General | | ESTs |
| 645 | 3304 | AI012471 | b | | ESTs, Weakly similar to T26998 hypothetical protein Y48B6A.6 - Caenorhabditis elegans [C elegans] |
| 646 | 2311 | AI012485 | aa | | ESTs |
| 647 | 20817 | AI012589 | g, n, q | glutathione S-transferase, pi 2 | glutathione S-transferase, pi 2 |
| 648 | 3493 | AI012590 | v, General | | ESTs |
| 649 | 8975 | AI012613 | General | | ESTs |
| 650 | 11335 | AI012619 | j | | ESTs, Highly similar to unknown [H. sapiens] |
| 651 | 21409 | AI012637 | General | | ESTs |
| 652 | 8015 | AI012638 | aa | | ESTs, Moderately similar to AF1518341 CGI-76 protein [H. sapiens] |
| 653 | 8476 | AI012647 | w | | ESTs, Highly similar to RS20__HUMAN 40S RIBOSOMAL PROTEIN S2 [R. norvegicus] |
| 654 | 4232 | AI012958 | e, p, General | | ESTs |
| 655 | 23128 | AI013011 | General | | ESTs |
| 656 | 20086 | AI013260 | General | lamin | lamin |
| 657 | 11969 | AI013273 | k | | ESTs, Highly similar to GLIA DERIVED NEXIN PRECURSOR [R. norvegicus] |
| 658 | 26147 | AI013387 | aa | | |
| 659 | 8815 | AI013437 | p | | ESTs |
| 660 | 19722 | AI013508 | k | | Rattus norvegicus Hsp70 binding protein HspBP mRNA, complete cds |
| 661 | 6674 | AI013568 | General | | ESTs |
| 662 | 23145 | AI013647 | o, t | | ESTs |
| 663 | 15130 | AI013676 | w | | ESTs |
| 664 | 7274 | AI013715 | aa | | ESTs, Moderately similar to BMP6 RAT BONE MORPHOGENETIC PROTEIN 6 PRECURSOR [R. norvegicus] |
| 665 | 7276 | AI013730 | e | | ESTs, Highly similar to KIAA1102 protein [H. sapiens] |
| 666 | 7278 | AI013738 | y, z, aa | | ESTs |
| 667 | 22592 | AI013740 | s, x, bb, General | | ESTs, Highly similar to proteolipid protein 2 [M. musculus] |
| 668 | 16584 | AI013765 | w | Arrestin, beta 2 | Arrestin, beta 2 |
| 669 | 24143 | AI013804 | j, l | | ESTs, Highly similar to T27225 ADP-ribosylation factor Y57G11C.13 [similarity]- Caenorhabditis elegans [C. elegans] |
| 670 | 15928 | AI013829 | a, General | | ESTs |

TABLE 1-continued

SUMMARY

| Sequence ID No. | Identifier | GenBank Acc/Ref. Seq ID | Model Code | Gene Name | Unigene Cluster Title |
|---|---|---|---|---|---|
| 671 | 21950 | AI013861 | j | 3-hydroxyisobutyrate dehydrogenase | 3-hydroxyisobutyrate dehydrogenase |
| 672 | 3260 | AI013875 | t | | ESTs |
| 673 | 2708 | AI013882 | d, q | | ESTs, Moderately similar to MSSP [*M. musculus*] |
| 674 | 8585 | AI013886 | i | | ESTs |
| 675 | 7299 | AI013911 | p, r, t, General | | ESTs, Weakly similar to CIRP [*R. norvegicus*] |
| 676 | 15904 | AI013971 | General | | Rat ankyrin binding glycoprotein-1 related mRNA sequence |
| 677 | 12781 | AI014023 | w | | ESTs, Moderately similar to R32184 1 [*H. sapiens*] |
| 678 | 19372 | AI014135 | aa | | *Rattus norvegicus* mRNA for beta-carotene 15, 15'-dioxygenase, complete cds |
| 679 | 4241 | AI014140 | w | | ESTs, Highly similar to hypothetical protein [*H. sapiens*] |
| 680 | 15247 | AI014169 | c, u | | *Rattus norvegicus* clone N27 mRNA |
| 681 | 7315 | AI028831 | n | | ESTs, Moderately similar to mitogen-activated protein kinase kinase kinase 6 [*H. sapiens*] |
| 682 | 16631 | AI028856 | General | | ESTs |
| 683 | 23297 | AI028953 | x | | ESTs, Highly similar to S55054 Sm protein G [*H. sapiens*] |
| 684 | 11326 | AI029015 | b | | ESTs |
| 685 | 2866 | AI029058 | n, y | | ESTs |
| 686 | 12812 | AI029126 | General | | ESTs |
| 687 | 17602 | AI029156 | p | | ESTs |
| 688 | 7392 | AI029185 | aa | | EST |
| 689 | 6517 | AI029264 | d, k, x | | ESTs |
| 690 | 7639 | AI029292 | b | | ESTs |
| 691 | 3874 | AI029428 | i, General | | ESTs, Highly similar to CB80_HUMAN 80 KDA NUCLEAR CAP BINDING PROTEIN [*H. sapiens*] |
| 692 | 12819 | AI029437 | f | | ESTs |
| 693 | 7452 | AI029466 | r | | ESTs |
| 694 | 7493 | AI029608 | b | | ESTs |
| 696 | 7537 | AI029829 | o, General | | ESTs |
| 697 | 2310 | AI029969 | v | | ESTs |
| 698 | 7585 | AI030023 | x | | ESTs |
| 699 | 7586 | AI030024 | b, n | | ESTs |
| 700 | 14492 | AI030091 | cc | | ESTs |
| 701 | 10673 | AI030134 | f | | ESTs, Weakly similar to ankyrin [*R. norvegicus*] |
| 702 | 7615 | AI030163 | o, r | | ESTs |
| 703 | 2370 | AI030179 | General | | ESTs |
| 704 | 7681 | AI030449 | n | | ESTs, Moderately similar to methyltransferase related protein [*M. musculus*] |
| 705 | 11559 | AI030472 | General | | ESTs |
| 706 | 7665 | AI030668 | t, bb | | *Rattus norvegicus* nucleosome assembly protein mRNA, complete cds |
| 707 | 24222 | AI030704 | k | | ESTs |
| 708 | 10740 | AI030743 | h | | EST |
| 709 | 10742 | AI030773 | e | | EST |
| 711 | 16169 | AI030932 | General | | ESTs, Moderately similar to adipophilin [*H. Sapiens*] |
| 712 | 19527 | AI030991 | f | | EST |
| 713 | 22614 | AI031004 | r | | ESTs, Highly similar to SX17 MOUSE TRANSCRIPTION FACTOR SOX-17 [*M. musculus*] |
| 714 | 3167 | AI031012 | e | | ESTs, Highly similar to CLPP MOUSE PUTATIVE ATP-DEPENDENT CLP PROTEASE PROTEOLYTIC SUBUNIT, MITOCHONDRIAL PRECURSOR [*M. musculus*] |
| 715 | 5350 | AI043611 | a | | ESTs |
| 716 | 7858 | AI043654 | t | | EST |
| 717 | 10784 | AI043678 | d | | EST |
| 718 | 9180 | AI043694 | aa | | ESTs, Weakly similar to T27134 hypothetical protein Y53C12B 2 - *Caenorhabditis elegans* [*C. elegans*] |

TABLE 1-continued

SUMMARY

Atty. Docket No. 44921-5089US
Doc. No. 1803440.1

| Sequence ID No. | Identifier | GenBank Acc/Ref. Seq ID | Model Code | Gene Name | Unigene Cluster Title |
|---|---|---|---|---|---|
| 719 | 7867 | AI043695 | aa | HHs phosphoribosyl pyrophosphate amidotransferase | *Rattus norvegicus* mRNA for amidophosphoribosyltransferase |
| 720 | 7584 | AI043724 | General | | ESTs |
| 721 | 7895 | AI043768 | e | | ESTs, Highly similar to AF151810 1 CGI-52 protein [*H. sapiens*] |
| 722 | 7903 | AI043805 | General | | ESTs |
| 723 | 7913 | AI043849 | cc | | ESTs, Weakly similar to ELL MOUSE RNA POLYMERASE II ELONGATION FACTOR ELL [*M. musculus*] |
| 724 | 3899 | AI043904 | l | | ESTs |
| 725 | 6766 | AI043914 | f | | ESTs |
| 726 | 10818 | AI043990 | g, l, m, General | | ESTs |
| 727 | 7956 | AI044018 | f | | EST |
| 728 | 5393 | AI044170 | p | | EST |
| 729 | 5398 | AI044177 | q | | EST |
| 730 | 5425 | AI044237 | a, d | | ESTs, Weakly similar to AF121893 1 sequence-specific single-stranded-DNA-binding protein [*R. norvegicus*] |
| 731 | 8692 | AI044247 | r | | ESTs, Weakly similar to putative peroxisomal 2,4-dienoyl-CoA reductase [*R. norvegicus*] |
| 732 | 5430 | AI044253 | i | | EST |
| 733 | 5461 | AI044338 | g, p, General | | ESTs |
| 734 | 5464 | AI044345 | i | | ESTs |
| 735 | 3359 | AI044347 | aa | | ESTs |
| 737 | 2695 | AI044396 | b | | Rat (clones rLG[08, 14, 25]) interleukin 6 signal transducer mRNA sequence |
| 738 | 5494 | AI044425 | General | | ESTs |
| 740 | 9882 | AI044588 | j, m | | ESTs |
| 741 | 5575 | AI044688 | g | | ESTs |
| 742 | 2348 | AI044794 | General | | ESTs |
| 743 | 18205 | AI044836 | n | | ESTs, Weakly similar to AF165892 1 RNA-binding protein SiahBP [*R. norvegicus*] |
| 744 | 5626 | AI044864 | u | | ESTs |
| 745 | 5630 | AI044869 | f | | ESTs |
| 746 | 5634 | AI044883 | General | | ESTs, Moderately similar to AF151873 1 CGI-115 protein [*H. Sapiens*] |
| 747 | 4047 | AI044947 | l, m | | ESTs, Moderately similar to dJ1183I21.1 [*H. sapiens*] |
| 748 | 5654 | AI044976 | w | | EST |
| 749 | 5684 | AI045056 | r | | ESTs |
| 750 | 19235 | AI045074 | General | | ESTs, Highly similar to BGAL MOUSE BETA-GALACTOSIDASE PRECURSOR [*M. musculus*] |
| 751 | 5689 | AI045075 | i, aa, General | | ESTs, Moderately similar to HEM45 [*H. Sapiens*] |
| 752 | 5711 | AI045151 | General | | ESTs, Moderately similar to AF118838 1 citrin [*H. sapiens*] |
| 753 | 19237 | AI045153 | c | | ESTs, Weakly similar to TVRTK6 ribosomal protein S6 kinase [*R. norvegicus*] |
| 754 | 9964 | AI045161 | f | | EST |
| 755 | 5735 | AI045223 | f | | ESTs |
| 756 | 5474 | AI045477 | a, General | | ESTs |
| 757 | 5811 | AI045502 | d, e | | ESTs |
| 758 | 5819 | AI045537 | General | | ESTs |
| 759 | 5839 | AI045594 | i | | ESTs |
| 760 | 6808 | AI045600 | s | | ESTs, Highly similar to S30034 translocating chain-associating membrane protein [*H. Sapiens*] |
| 761 | 17755 | AI045608 | y | | ESTs |
| 763 | 10020 | AI045632 | a | | ESTs |
| 764 | 5855 | AI045669 | General | | ESTs |
| 765 | 5881 | AI045789 | i | | ESTs, Weakly similar to T12540 hypothetical protein DKFZp434J214.1 [*H. sapiens*] |

TABLE 1-continued

SUMMARY

Atty. Docket No. 44921-5089US
Doc. No. 1803440.1

| Sequence ID No. | Identifier | GenBank Acc/Ref. Seq ID | Model Code | Gene Name | Unigene Cluster Title |
|---|---|---|---|---|---|
| 766 | 5897 | AI045862 | General | | ESTs, Moderately similar to S64732 scaffold attachment factor B [*H. Sapiens*] |
| 767 | 5900 | AI045866 | y, z | | ESTs |
| 768 | 7540 | AI045882 | o, t General | | ESTs, Weakly similar to B48013 proline-rich proteoglycan 2 precursor, parotid - rat [*R. norvegicus*] |
| 769 | 5329 | AI045970 | p | | ESTs |
| 770 | 15093 | AI058285 | d | | ESTs |
| 771 | 8002 | AI058304 | i | | ESTs |
| 772 | 8017 | AI058341 | c | | EST |
| 773 | 6828 | AI058359 | General | | ESTs, Weakly similar to T46465 hypothetical protein DKFZp434A0530.1 [*H. sapiens*] |
| 774 | 8177 | AI058603 | aa | | ESTs |
| 775 | 3090 | AI058730 | aa | | ESTs |
| 776 | 10093 | AI058746 | g | | ESTs |
| 777 | 8143 | AI058759 | General | | ESTs |
| 778 | 18659 | AI058762 | f | | ESTs |
| 779 | 8163 | AI058837 | aa | | ESTs |
| 780 | 4789 | AI058889 | General | | ESTs |
| 781 | 8221 | AI059061 | General | | ESTs |
| 782 | 10159 | AI059147 | d | | EST |
| 783 | 8245 | AI059154 | b | | ESTs, Weakly similar to unnamed protein product [*H. sapiens*] |
| 784 | 8283 | AI059290 | n | | ESTs |
| 785 | 8314 | AI059386 | g, General | | ESTs |
| 786 | 10200 | AI059444 | i | | ESTs |
| 787 | 8347 | AI059519 | s | | ESTs, Weakly similar to EGF RAT PRO-EPIDERMAL GROWTH FACTOR PRECURSOR [*R. norvegicus*] |
| 788 | 18359 | AI059675 | n | | *Rattus norvegicus* transitional endoplasmic reticulum ATPase mRNA, complete cds |
| 789 | 10281 | AI059947 | b, t | | EST |
| 790 | 8494 | AI059968 | aa | | ESTs |
| 791 | 8495 | AI059971 | General | | ESTs, Weakly similar to TNRC MOUSE LYMPHOTOXIN-BETA RECEPTOR PRECURSOR [*M. musculus*] |
| 792 | 8496 | AI059974 | General | | ESTs, Moderately similar to KIAA0978 protein [*H. sapiens*] |
| 793 | 10289 | AI060053 | i | | ESTs, Weakly similar to CGI-142 hypothetical protein [*H. sapiens*] |
| 794 | 8548 | AI060176 | k | | ESTs |
| 795 | 8565 | AI060236 | t | | EST |
| 796 | 18322 | AI060279 | i, y, z | | ESTs |
| 797 | 8745 | AI069939 | r | | ESTs |
| 798 | 8785 | AI070067 | o | | ESTs, Highly similar to rer [*M. musculus*] |
| 799 | 17506 | AI070068 | cc | | ESTs, Weakly similar to 2104282A Gadd45 gene [*R. norvegicus*] |
| 800 | 9067 | AI070087 | General | | ESTs, Weakly similar to NUCL RAT NUCLEOLIN [*R. norvegicus*] |
| 801 | 3551 | AI070122 | e | | ESTs, Moderately similar to CGI-97 protein [*H. sapiens*] |
| 802 | 4967 | AI070179 | k | | ESTs, Moderately similar to GLMB RAT GLIA MATURATION FACTOR BETA [*R. norvegicus*] |
| 803 | 18 | AI070195 | General | | ESTs, Moderately similar to AF132954 1 CGI-20 protein [*H. sapiens*] |
| 804 | 24197 | AI070314 | General | | ESTs, Moderately similar to ARVC_HUMAN ARMADILLO REPEAT PROTEIN DELETED IN VELO-CARDIO-FACIAL SYNDROME [*H. sapiens*] |
| 805 | 8869 | AI070330 | r | | ESTs |
| 806 | 8874 | AI070336 | b, cc | | ESTs |
| 807 | 10417 | AI070410 | m | | ESTs |

TABLE 1-continued

SUMMARY

Atty. Docket No. 44921-5089US
Doc. No. 1803440.1

| Sequence ID No. | GenBank Identifier | Acc/Ref. Seq ID | Model Code | Gene Name | Unigene Cluster Title |
|---|---|---|---|---|---|
| 808 | 8901 | AI070419 | aa | | ESTs, Moderately similar to T08664 Toll protein-like receptor DKFZp547I0610 1 [*H. sapiens*] |
| 809 | 14424 | AI070421 | l, p, General | | ESTs |
| 810 | 10434 | AI070497 | General | | ESTs |
| 811 | 8927 | AI070523 | v | | ESTs |
| 812 | 8946 | AI070611 | q | | ESTs |
| 813 | 8950 | AI070621 | w | | ESTs |
| 814 | 8972 | AI070673 | General | | ESTs |
| 815 | 8981 | AI070715 | bb | | EST |
| 816 | 26184 | AI070784 | i, l | | |
| 817 | 3007 | AI070824 | w | | ESTs, Weakly similar to hypothetical protein [*H. sapiens*] |
| 818 | 8999 | AI070839 | p | | ESTs |
| 819 | 10477 | AI070868 | e, f | bone morphogenetic protein 1 (procollagen C-proetinase) | bone morphogenetic protein 1 (procollagen C-proetinase) |
| 820 | 24301 | AI070911 | k | | ESTs |
| 821 | 8721 | AI071024 | General | | EST |
| 822 | 9212 | AI071098 | x | | ESTs |
| 823 | 1831 | AI071137 | c | | Rat mRNA for cdc25B, complete cds |
| 824 | 11005 | AI071139 | r | | EST |
| 825 | 9104 | AI071173 | j, m | | ESTs, Highly similar to HETEROGENEOUS NUCLEAR RIBONUCLEOPROTEIN G [*M. musculus*] |
| 826 | 9583 | AI071185 | General | | ESTs |
| 827 | 9644 | AI071410 | c | | ESTs |
| 828 | 16058 | AI071490 | General | HHs.serine palmitoyltransferase, long chain base subunit 2 | ESTs, Highly similar to JC5180 serine C-palmitoyltransferase [*M. musculus*] |
| 829 | 11057 | AI071509 | f, o | | ESTs |
| 831 | 5695 | AI071566 | bb | | ESTs, Weakly similar to SYBSR threonine synthase (EC 4.2.99 2) - yeast (*Saccharomyces cerevisiae*) [*S. cerevisiae*] |
| 832 | 9671 | AI071568 | w | | EST |
| 833 | 22929 | AI071578 | General | | ESTs, Moderately similar to NEURONAL PROTEIN 3.1 [*M. musculus*] |
| 834 | 9673 | AI071581 | General | | ESTs |
| 835 | 9699 | AI071646 | General | | ESTs |
| 837 | 9799 | AI072008 | q, y, z | | ESTs |
| 838 | 9808 | AI072050 | d | | ESTs |
| 839 | 22796 | AI072213 | General | | ESTs |
| 840 | 9271 | AI072405 | v | | ESTs |
| 841 | 10869 | AI072425 | w | | ESTs |
| 842 | 21797 | AI072439 | General | | ESTs, Weakly similar to S70484 RS43 protein - rat (fragment) [*R. norvegicus*] |
| 843 | 9306 | AI072521 | r | | ESTs |
| 844 | 9312 | AI072550 | j | | ESTs |
| 845 | 10893 | AI072559 | x | | EST |
| 846 | 1501 | AI072634 | cc, General | | *Rattus norvegicus* cytokeratin-18 mRNA, partial cds |
| 847 | 6548 | AI072658 | General | | ESTs |
| 848 | 9363 | AI072695 | d | | ESTs, Highly similar to JE0170 dnaJ heat shock protein MCG18 - mouse [*M. musculus*] |
| 850 | 9409 | AI072841 | n | | ESTs, Moderately similar to LMG2 MOUSE LAMININ GAMMA-2 CHAIN PRECURSOR [*M. musculus*] |
| 851 | 9410 | AI072842 | w | | ESTs |
| 852 | 9468 | AI073021 | General | | ESTs |
| 853 | 9518 | AI073223 | f | | EST |
| 854 | 11183 | AI100768 | t | HHs carbonic anhydrase VIII | ESTs, Weakly similar to CAH2 RAT CARBONIC ANHYDRASE II [*R. norvegicus*] |
| 855 | 9190 | AI100835 | e | | ESTs |
| 856 | 2029 | AI100842 | p | | ESTs |
| 857 | 5687 | AI101006 | e | | ESTs |
| 858 | 15192 | AI101099 | g, cc | | Rat metallothionein-2 and metallothionein-1 genes, complete cds |

TABLE 1-continued

SUMMARY

Atty. Docket No. 44921-5089US
Doc. No. 1803440.1

| Sequence ID No. | Identifier | GenBank Acc/Ref. Seq ID | Model Code | Gene Name | Unigene Cluster Title |
|---|---|---|---|---|---|
| 859 | 17399 | AI101157 | o | | ESTs, Highly similar to ATPK MOUSE ATP SYNTHASE F CHAIN, MITOCHONDRIAL [*M. musculus*] |
| 860 | 9339 | AI101160 | l, m, o | | ESTs, Weakly similar to S46930 teg292 protein - mouse [*M. musculus*] |
| 861 | 6321 | AI101256 | General | | ESTs, Weakly similar to AIF-C1 [*R. norvegicus*] |
| 862 | 5421 | AI101270 | c | | ESTs, Highly similar to GDIS MOUSE RHO GDP-DISSOCIATION INHIBITOR 2 [*M. musculus*] |
| 863 | 11910 | AI101323 | General | | ESTs, Highly similar to ERM_HUMAN ETS-RELATED PROTEIN ERM [*H. sapiens*] |
| 864 | 23140 | AI101608 | e | | ESTs |
| 865 | 4119 | AI101901 | General | | ESTs |
| 866 | 16324 | AI102009 | b | | ESTs, Weakly similar to TRBP MOUSE PROTAMINE-1 RNA BINDING PROTEIN [*M. musculus*] |
| 867 | 18642 | AI102023 | o | | ESTs, Moderately similar to unknown [*H. sapiens*] |
| 868 | 19373 | AI102044 | a | Drosophila polarity gene (frizzled) homologue | *Rattus norvegicus* mRNA for beta-carotene 15, 15'-dioxygenase, complete cds |
| 869 | 7051 | AI102055 | h | | *Rattus norvegicus* clone ZG52 mRNA sequence |
| 870 | 6544 | AI102064 | c | | ESTs, Weakly similar to AF147718 1 glycine decarboxylase [*R. norvegicus*] |
| 871 | 10227 | AI102248 | w | | ESTs |
| 872 | 23849 | AI102318 | e, q | | ESTs |
| 873 | 11954 | AI102505 | g, j, s | HMm.cytochrome c oxidase, subunit VIIIa | *Rattus norvegicus* liver cytochrome c oxidase subunit VIII (COX-VIII) mRNA, 3' end of cds |
| 874 | 2125 | AI102519 | c, k | | ESTs, Moderately similar to DAP12 [*M. musculus*] |
| 875 | 5967 | AI102520 | y | | ESTs, Moderately similar to AF161588 1 GABA-A receptor-associated protein [*R. norvegicus*] |
| 875 | 5969 | AI102520 | p, w | | ESTs, Moderately similar to AF161588 1 GABA-A receptor-associated protein [*R. norvegicus*] |
| 876 | 11563 | AI102560 | General | | ESTs |
| 877 | 15190 | AI102562 | b, g, n, p, v | | Rat metallothionein-i (mt-1) mrna |
| 878 | 19769 | AI102570 | bb | | EST, Weakly similar to A60716 somatotropin intron-related protein RDE.25 - rat [*R. norvegicus*] |
| 879 | 22487 | AI102578 | General | | ESTs, Highly similar to I49523 Mouse primary response gene B94 mRNA, 3'end - mouse [*M. musculus*] |
| 880 | 19011 | AI102618 | General | | ESTs |
| 881 | 23837 | AI102620 | q, t | | ESTs |
| 882 | 23538 | AI102727 | g, General | solute carrier family 20 (phosphate transporter), member 1 | solute carrier family 20 (phosphate transporter), member 1 |
| 883 | 17234 | AI102741 | c | Tissue inhibitor of metalloproteinase 3 | Tissue inhibitor of metalloproteinase 3 |
| 884 | 5891 | AI102745 | k | | ESTs |
| 885 | 6796 | AI102753 | General | | ESTs |
| 886 | 8837 | AI102849 | o, p | | ESTs |
| 887 | 15861 | AI102868 | i | | ESTs, Weakly similar to phosphoserine aminotransferase [*H. sapiens*] |
| 888 | 3533 | AI102877 | g | | ESTs |
| 889 | 13222 | AI102977 | General | | ESTs, Highly similar to PCAF associated factor 65 beta [*H. sapiens*] |
| 890 | 6806 | AI103018 | o, u | | ESTs |
| 891 | 10659 | AI103059 | w, cc, General | | ESTs |
| 892 | 17400 | AI103097 | e | | ESTs, Highly similar to ATPK MOUSE ATP SYNTHASE F CHAIN, MITOCHONDRIAL [*M. musculus*] |
| 893 | 3584 | AI103106 | x, aa | | ESTs |
| 894 | 13298 | AI103143 | r | | ESTs |

TABLE 1-continued

SUMMARY

Atty. Docket No. 44921-5089US
Doc. No. 1803440.1

| Sequence ID No. | Identifier | GenBank Acc/Ref. Seq ID | Model Code | Gene Name | Unigene Cluster Title |
|---|---|---|---|---|---|
| 895 | 15981 | AI103150 | i, x | | ESTs, Weakly similar to UBC2_HUMAN UBIQUITIN-CONJUGATING ENZYME E2-17 KD [*R. norvegicus*] |
| 896 | 3475 | AI103245 | w | | ESTs, Highly similar to AF151893 1 CGI-135 protein [*H. sapiens*] |
| 898 | 23619 | AI103314 | p | | ESTs |
| 899 | 24181 | AI103320 | e | | ESTs, Moderately similar to T26785 hypothetical protein Y40B1B.7 - *Caenorhabditis elegans* [*C. elegans*] |
| 901 | 4355 | AI103410 | General | | ESTs |
| 902 | 7622 | AI103472 | General | | ESTs |
| 903 | 20918 | AI103552 | n | | ESTs |
| 904 | 21579 | AI103572 | General | | ESTs |
| 905 | 2222 | AI103631 | o | | ESTs, Highly similar to RIE2 [*M. musculus*] |
| 906 | 2752 | AI103641 | e | | ESTs, Highly similar to sarcosine dehydrogenase [*R. norvegicus*] |
| 907 | 4856 | AI103708 | i | | ESTs |
| 908 | 8990 | AI103719 | l, m, y, z | | |
| 909 | 15942 | AI103738 | r | | ESTs |
| 910 | 22885 | AI103828 | e, General | | ESTs |
| 911 | 15853 | AI103841 | x | Complement component 4 | Complement component 4 |
| 912 | 15050 | AI103911 | j, y | HHs: ubiquinol-cytochrome c reductase, Rieske iron-sulfur polypeptide 1 | Rat Rieske iron-sulfur protein mRNA, complete cds |
| 913 | 12376 | AI103939 | u | | ESTs |
| 914 | 22271 | AI103947 | o, y | | ESTs, Weakly similar to AF151109 1 putative BRCA1-interacting protein [*H. sapiens*] |
| 915 | 20833 | AI104035 | f, q | HMm: RIKEN cDNA 2010000G05 gene | ESTs, Highly similar to COXG MOUSE CYTOCHROME C OXIDASE POLYPEPTIDE VIB [*M. musculus*] |
| 916 | 7010 | AI104099 | w | | ESTs |
| 917 | 22101 | AI104251 | General | | ESTs |
| 918 | 22833 | AI104258 | General | | ESTs |
| 919 | 22211 | AI104279 | g, m | | ESTs, Highly similar to translation initiation factor eIF6 [*M. musculus*] |
| 920 | 10720 | AI104296 | l | | ESTs |
| 921 | 15416 | AI104340 | i | | ESTs |
| 922 | 10991 | AI104342 | a | | ESTs |
| 923 | 18831 | AI104357 | p | | ESTs, Highly similar to ATRTC actin beta - rat [*R. norvegicus*] |
| 924 | 7223 | AI104373 | e | | ESTs |
| 925 | 23574 | AI104520 | e, g, s | Cytochrome c oxidase subunit VIa (liver) | Cytochrome c oxidase subunit VIa (liver) |
| 926 | 18509 | AI104528 | q | | ESTs, Weakly similar to NADH.ubiquinone oxidoreductase B17 subunit [*H. sapiens*] |
| 927 | 11680 | AI104605 | v | | ESTs |
| 928 | 12342 | AI104658 | w | | ESTs, Weakly similar to RENAL TRANSCRIPTION FACTOR KID-1 [*R. norvegicus*] |
| 929 | 23689 | AI104685 | r | | Rat mitochondrial succinyl-CoA synthetase alpha subunit (cytoplasmic precursor) mRNA, complete cds |
| 930 | 15377 | AI104821 | o, cc | | ESTs, Moderately similar to T50611 hypothetical protein DKFZp434H2035.1 [*H. sapiens*] |
| 931 | 22957 | AI104897 | General | | ESTs, Moderately similar to meningioma-expressed antigen 11 [*H. sapiens*] |
| 932 | 18451 | AI104953 | o, s | HHs: ATP synthase, H+ transporting, mitochondrial F1 complex, delta subunit | *Rattus norvegicus* delta subunit of F1F0 ATPase gene, complete cds |
| 933 | 24375 | AI104979 | n, General | | ESTs, Moderately similar to nucleolar protein p40 [*H. sapiens*] |
| 934 | 18278 | AI105080 | bb | | ESTs, Moderately similar to SCOT_HUMAN SUCCINYL-COA: 3-KETOACID-COENZYME A TRANSFERASE PRECURSOR [*H. sapiens*] |

TABLE 1-continued

SUMMARY

| Sequence ID No. | Identifier | GenBank Acc/Ref. Seq ID | Model Code | Gene Name | Unigene Cluster Title |
|---|---|---|---|---|---|
| 935 | 2196 | AI105243 | g | | ESTs |
| 936 | 5199 | AI105272 | bb, General | | ESTs, Weakly similar to T21641 hypothetical protein F32B6.2 - Caenorhabditis elegans [C. elegans] |
| 937 | 12901 | AI105301 | o, s | | ESTs |
| 938 | 7700 | AI105383 | cc, General | | ESTs, Weakly similar to T19707 hypothetical protein C34C6.5 - Caenorhabditis elegans [C. elegans] |
| 939 | 13343 | AI105398 | u | | ESTs |
| 940 | 22931 | AI105417 | e, General | | ESTs, Moderately similar to NEURONAL PROTEIN 3.1 [M. musculus] |
| 941 | 23596 | AI105435 | bb | HMm: glutaryl-Coenzyme A dehydrogenase | ESTs, Highly similar to GCDH MOUSE GLUTARYL-COA DEHYDROGENASE PRECURSOR [M. musculus] |
| 942 | 15893 | AI105465 | o | | ESTs, Moderately similar to DHSD_HUMAN SUCCINATE DEHYDROGENASE [H. sapiens] |
| 943 | 12660 | AI111492 | c | | ESTs |
| 944 | 4479 | AI111599 | General | | ESTs |
| 945 | 24211 | AI111853 | k | | ESTs, Highly similar to H33_HUMAN HISTONE H3 3 [R. norvegicus] |
| 946 | 2539 | AI111960 | r | | ESTs, Weakly similar to FKB5 MOUSE 51 KDA FK506-BINDING PROTEIN [M. musculus] |
| 947 | 5729 | AI111990 | k | | EGF-CONTAINING FIBULIN-LIKE EXTRACELLULAR MATRIX PROTEIN 1 PRECURSOR (FIBULIN-3) (FIBL-3) (T16 PROTEIN) [R. norvegicus] |
| 948 | 4049 | AI112012 | i, q, u, General | | Rattus norvegicus osteoactivin mRNA, complete cds |
| 949 | 12908 | AI112043 | i | | ESTs |
| 950 | 20041 | AI112161 | t | | ESTs |
| 951 | 12937 | AI112462 | General | | ESTs |
| 952 | 3713 | AI112571 | b | | ESTs |
| 953 | 12921 | AI112636 | General | | ESTs, Moderately similar to UDP_HUMAN URIDINE PHOSPHORYLASE [H. sapiens] |
| 954 | 12965 | AI112926 | General | | ESTs |
| 955 | 7499 | AI112986 | General | | ESTs |
| 956 | 4969 | AI113008 | r | | ESTs, Moderately similar to megakaryocyte stimulating factor [H. sapiens] |
| 957 | 11817 | AI136295 | f | | ESTs, Highly similar to BC-2 protein [H. sapiens] |
| 959 | 11165 | AI136372 | c | | ESTs, Weakly similar to JC4975 plexin 2 precursor - mouse [M. musculus] |
| 960 | 4045 | AI136460 | cc | | ESTs |
| 961 | 12782 | AI136493 | k | | ESTs |
| 962 | 6850 | AI136665 | h | ecto-apyrase | ecto-apyrase |
| 963 | 20920 | AI136891 | p, v | butyrate response factor 1 | butyrate response factor 1 |
| 964 | 6552 | AI137062 | o | | ESTs, Highly similar to 6.2 kd protein [H. sapiens] |
| 965 | 22722 | AI137211 | i | | ESTs |
| 966 | 13111 | AI137224 | o, General | | ESTs, Highly similar to oxysterol-binding protein [M. musculus] |
| 967 | 15969 | AI137302 | e | | ESTs |
| 968 | 14349 | AI137303 | d | | ESTs |
| 969 | 9166 | AI137406 | General | | ESTs |
| 970 | 9525 | AI137516 | r | | ESTs, Weakly similar to ZF37_RAT ZINC FINGER PROTEIN 37 (ZFP-37) [R. norvegicus] |
| 971 | 6638 | AI137579 | General | | ESTs |
| 972 | 7414 | AI137586 | General | | ESTs, Highly similar to IMB3_HUMAN IMPORTIN BETA-3 SUBUNIT [H. sapiens] |
| 973 | 11321 | AI137752 | z | | ESTs |
| 974 | 23473 | AI137932 | l | | ESTs |
| 975 | 13158 | AI138024 | i | | ESTs |

TABLE 1-continued

SUMMARY

Atty. Docket No. 44921-5089US
Doc. No. 1803440.1

| Sequence ID No. | Identifier | GenBank Acc/Ref. Seq ID | Model Code | Gene Name | Unigene Cluster Title |
|---|---|---|---|---|---|
| 976 | 13467 | AI138034 | cc | UDP-glucose ceramide glycosyltransferase | UDP-glucose: ceramide glycosyltransferase |
| 977 | 11377 | AI138105 | y | | ESTs |
| 978 | 6790 | AI144801 | d, h | | ESTs |
| 979 | 6506 | AI144919 | j, l, y | | ESTs |
| 980 | 8027 | AI144958 | i | | ESTs |
| 982 | 14458 | AI145095 | General | | ESTs |
| 983 | 7476 | AI145202 | g | | ESTs |
| 984 | 17545 | AI145384 | e | | ESTs, ESTs, Weakly similar to GTP-binding protein [*H. sapiens*] |
| 985 | 17479 | AI145385 | r | | ESTs |
| 986 | 4194 | AI145387 | r | | ESTs |
| 987 | 8634 | AI145722 | g | | ESTs, Weakly similar to T31511 hypothetical protein Y116A8C.9 - *Caenorhabditis elegans* [*C. elegans*] |
| 988 | 8339 | AI145761 | y, General | | ESTs, Weakly similar to T21659 hypothetical protein F32D8 4 - *Caenorhabditis elegans* [*C. elegans*] |
| 989 | 2059 | AI146005 | h, General | | ESTs, Highly similar to pseudouridine synthase 1 [*M. musculus*] |
| 990 | 23224 | AI146033 | o | | *Rattus norvegicus* small zinc finger-like protein (TIM9a) mRNA, partial cds |
| 991 | 5232 | AI168942 | bb | branched chain keto acid dehydrogenase E1, beta polypeptide | branched chain keto acid dehydrogenase E1, beta polypeptide |
| 992 | 18472 | AI168975 | u | | ESTs |
| 992 | 18473 | AI168975 | u | | ESTs |
| 993 | 13235 | AI169020 | r | | ESTs |
| 994 | 11618 | AI169115 | o, y, General | | ESTs |
| 995 | 17386 | AI169144 | o | | ESTs, Weakly similar to T23206 hypothetical protein K01H12 1 - *Caenorhabditis elegans* [*C. elegans*] |
| 996 | 10984 | AI169156 | o, u | | ESTs, Weakly similar to HP33 [*R. norvegicus*] |
| 997 | 8205 | AI169176 | e | | ESTs |
| 998 | 12979 | AI169177 | e | | ESTs, Highly similar to RADIATION-INDUCIBLE IMMEDIATE-EARLY GENE IEX-1 [*M. musculus*] |
| 999 | 2607 | AI169211 | c | | ESTs, Highly similar to A47318 RNA-binding protein Raly - mouse [*M. musculus*] |
| 1000 | 22661 | AI169265 | s, z | ATPase, H+ transporting, lysosomal (vacuolar proton pump), subun | ATPase, H+ transporting, lysosomal (vacuolar proton pump), subunit 1 |
| 1001 | 13239 | AI169278 | g, j, l, y, z | | ESTs |
| 1002 | 24162 | AI169279 | m | | ESTs |
| 1003 | 16879 | AI169284 | o | | ESTs, Highly similar to Y069_HUMAN HYPOTHETICAL PROTEIN KIAA0069 [*H. sapiens*] |
| 1004 | 24213 | AI169289 | p | | ESTs, Highly similar to H33_HUMAN HISTONE H3.3 [*R. norvegicus*] |
| 1005 | 13240 | AI169311 | cc | | ESTs |
| 1006 | 5931 | AI169324 | b | | ESTs |
| 1007 | 20891 | AI169337 | d | | ESTs, Highly similar to CGI-117 protein [*H. sapiens*] |
| 1008 | 11979 | AI169365 | cc | | ESTs |
| 1009 | 10947 | AI169372 | s | arachidonic acid epoxygenase | arachidonic acid epoxygenase |
| 1010 | 20697 | AI169494 | o, u | | ESTs |
| 1011 | 8234 | AI169517 | z | | ESTs |
| 1012 | 18343 | AI169648 | o | | ESTs |
| 1013 | 10839 | AI169655 | l, m | | ESTs |
| 1014 | 24146 | AI169668 | j, l | | ESTs, Weakly similar to hypothetical protein [*H. sapiens*] |
| 1015 | 22575 | AI169728 | r | | ESTs, Moderately similar to T47184 hypothetical protein DKFZp434F1526.1 [*H. sapiens*] |
| 1016 | 804 | AI169756 | cc | | ESTs, Highly similar to GENE 33 POLYPEPTIDE [*R. norvegicus*] |
| 1017 | 8213 | AI169883 | p | ferritin light chain 1 | ferritin light chain 1 |
| 1018 | 3916 | AI169947 | i, bb | | ESTs |

TABLE 1-continued

SUMMARY

| Sequence ID No. | Identifier | GenBank Acc/Ref. Seq ID | Model Code | Gene Name | Unigene Cluster Title |
|---|---|---|---|---|---|
| 1019 | 3733 | AI170053 | u, General | | ESTs |
| 1020 | 14179 | AI170224 | cc | | ESTs |
| 1021 | 11406 | AI170263 | r | | ESTs, Moderately similar to class II cytokine receptor 4 [*M. musculus*] |
| 1022 | 3547 | AI170279 | General | | ESTs, Weakly similar to ZNT1 RAT ZINC TRANSPORTER 1 [*R. norvegicus*] |
| 1023 | 11524 | AI170340 | j, y, z | | ESTs, Weakly similar to CL36 RAT LIM DOMAIN PROTEIN CLP-36 [*R. norvegicus*] |
| 1024 | 2729 | AI170363 | e, i | | ESTs |
| 1025 | 18811 | AI170525 | i | | ESTs |
| 1026 | 22524 | AI170542 | h | | ESTs |
| 1027 | 24048 | AI170570 | a, g | | ESTs, Highly similar to CGI-10 protein [*H. sapiens*] |
| 1028 | 5968 | AI170692 | y, aa | | ESTs, Moderately similar to AF161588 1 GABA-A receptor-associated protein [*R. norvegicus*] |
| 1029 | 9757 | AI170693 | b | | ESTs |
| 1030 | 18905 | AI170770 | e, s | | ESTs, Highly similar to NADH-ubiquinone oxidoreductase NDUFS2 subunit [*H. sapiens*] |
| 1031 | 16170 | AI170894 | i | | ESTs, Moderately similar to adipophilin [*H. sapiens*] |
| 1032 | 7089 | AI171185 | c | Hyaluronan mediated motility receptor (RHAMM) | Hyaluronan mediated motility receptor (RHAMM) |
| 1033 | 17591 | AI171354 | b | | ESTs |
| 1034 | 13285 | AI171361 | h | | ESTs, Weakly similar to AIF-C1 [*R. norvegicus*] |
| 1035 | 4428 | AI171362 | a | HHs: NADH dehydrogenase (ubiquinone) Fe-S protein 1 (75 kD) (NADH-coenzyme Q reductase) | ESTs, Moderately similar to NUAM__HUMAN NADH-UBIQUINONE OXIDOREDUCTASE 75 KD SUBUNIT PRECURSOR [*H. sapiens*] |
| 1036 | 18126 | AI171369 | w | | ESTs, Highly similar to S16788 probable reverse transcriptase - rat [*R. norvegicus*] |
| 1037 | 23253 | AI171448 | o | | ESTs, Moderately similar to 68MP MOUSE 6.8 KD MITOCHONDRIAL PROTEOLIPID [*M. musculus*] |
| 1038 | 4584 | AI171492 | m, General | | ESTs |
| 1039 | 11158 | AI171542 | r, s | | ESTs, Moderately similar to NADH: ubiquinone oxidoreductase B22 subunit [*H. sapiens*] |
| 1040 | 15345 | AI171587 | l | | ESTs |
| 1041 | 21183 | AI171676 | k | | ESTs |
| 1042 | 8215 | AI171692 | i | ferritin light chain 1 | *Rattus norvegicus* kynurenine aminotransferase/glutamine transaminase K (Kat) gene, complete cds, ferritin light chain 1 |
| 1043 | 11437 | AI171794 | i | | ESTs |
| 1044 | 2625 | AI171800 | cc | | ESTs |
| 1045 | 23579 | AI171802 | v | | ESTs |
| 1046 | 11708 | AI171807 | l, t | | ESTs |
| 1047 | 17204 | AI171844 | s, y, z | HMm: RIKEN cDNA 2410043G19 gene | *Rattus norvegicus* F1-ATPase epsilon subunit mRNA, nuclear gene encoding mitochondrial protein, complete cds |
| 1048 | 4420 | AI171916 | m | | ESTs |
| 1049 | 3266 | AI171948 | l, m | | ESTs, Highly similar to T08675 hypothetical protein DKFZp564F0522 1 [*H. sapiens*] |
| 1050 | 19012 | AI172056 | t | | ESTs |
| 1051 | 11205 | AI172057 | a, q, bb | | ESTs |
| 1052 | 6057 | AI172102 | b | | ESTs, Weakly similar to T33238 hypothetical protein T10H9 3 - *Caenorhabditis elegans* [*C. elegans*] |
| 1053 | 19128 | AI172103 | m | | ESTs |
| 1054 | 15673 | AI172107 | z | | Rat mRNA for 5E5 antigen, complete cds |
| 1055 | 6630 | AI172184 | n | | ESTs |

TABLE 1-continued

SUMMARY

Atty. Docket No. 44921-5089US
Doc. No. 1803440.1

| Sequence ID No. | GenBank Identifier | Acc/Ref. Seq ID | Model Code | Gene Name | Unigene Cluster Title |
|---|---|---|---|---|---|
| 1056 | 11968 | AI172208 | bb | | ESTs, Weakly similar to FETA RAT ALPHA-FETOPROTEIN PRECURSOR [R. norvegicus] |
| 1057 | 6974 | AI172263 | l, m | | ESTs |
| 1058 | 23313 | AI172271 | d | | ESTs |
| 1059 | 2140 | AI172272 | General | | ESTs, Moderately similar to A53004 transcription elongation factor S-II - rat [R. norvegicus] |
| 1060 | 15382 | AI172302 | l, p, General | | ESTs, Weakly similar to S43056 hypothetical protein - mouse [M. musculus] |
| 1061 | 18689 | AI172329 | l | | ESTs |
| 1062 | 17887 | AI172414 | o | | Rattus norvegicus apoptosis-regulating basic protein mRNA, complete cds |
| 1063 | 3042 | AI172447 | General | | ESTs, Highly similar to A44437 regenerating liver inhibitory factor RL/IF-1 - rat [R. norvegicus] |
| 1064 | 17291 | AI172491 | bb | HMm: isocitrate dehydrogenase 2 (NADP+), mitochondrial | ESTs, Weakly similar to IDHC RAT ISOCITRATE DEHYDROGENASE [R. norvegicus] |
| 1065 | 26222 | AI172506 | p | | |
| 1066 | 13095 | AI172595 | r | | ESTs |
| 1067 | 8795 | AI172618 | General | | ESTs |
| 1068 | 6454 | AI175342 | j, l, m, y | | ESTs, Weakly similar to T31067 BIR repeat containing ubiquitin-conjugating enzyme BRUCE - mouse [M. musculus] |
| 1070 | 4445 | AI175466 | x | | ESTs, Highly similar to RRAS MOUSE RAS-RELATED PROTEIN R-RAS [M. musculus] |
| 1071 | 3418 | AI175475 | m | | ESTs, Highly similar to NHPX RAT NHP2/RS6 FAMILY PROTEIN YEL026W HOMOLOG [R. norvegicus] |
| 1072 | 18507 | AI175551 | bb | | ESTs, Moderately similar to AF145050 1 translation elongation factor 1-delta subunit [R. norvegicus] |
| 1073 | 10217 | AI175628 | w | | ESTs |
| 1074 | 7262 | AI175833 | j, m, x | | ESTs |
| 1075 | 19004 | AI175875 | r | | ESTs |
| 1076 | 22352 | AI175959 | l, General | | ESTs |
| 1077 | 7022 | AI176041 | h, n | | ESTs, Highly similar to pirin [H. sapiens] |
| 1078 | 21467 | AI176061 | t | | ESTs, Weakly similar to tazarotene-induced gene 2 [H. sapiens] |
| 1079 | 18581 | AI176160 | General | | ESTs |
| 1080 | 14159 | AI176169 | g | | ESTs |
| 1081 | 21742 | AI176172 | w | | ESTs |
| 1082 | 10182 | AI176185 | v | | ESTs, Highly similar to P55-C-FOS PROTO-ONCOGENE PROTEIN [R. norvegicus] |
| 1083 | 22765 | AI176265 | General | | ESTs |
| 1084 | 6905 | AI176275 | a | | ESTs, Weakly similar to GSHH RAT PHOSPHOLIPID HYDROPEROXIDE GLUTATHIONE PEROXIDASE [R. norvegicus] |
| 1085 | 12999 | AI176276 | cc | | UAP1_HUMAN UDP-N-ACETYLHEXOSAMINE PYROPHOSPHORYLASE [H. sapiens] |
| 1086 | 16438 | AI176294 | e | | ESTs, Highly similar to SMD2_HUMAN SMALL NUCLEAR RIBONUCLEOPROTEIN SM D2 [H. sapiens] |
| 1087 | 21130 | AI176298 | y | | ESTs |
| 1088 | 3014 | AI176362 | e | | ESTs |
| 1089 | 15015 | AI176363 | r | | ESTs |
| 1090 | 19006 | AI176393 | x | | ESTs |
| 1091 | 20001 | AI176396 | o | | ESTs, Moderately similar to QPS1 [H. sapiens] |
| 1092 | 12174 | AI176435 | j, m | | ESTs |
| 1093 | 15191 | AI176456 | b, o, t, v, cc | | Rat metallothionein-2 and metallothionein-1 genes, complete cds |

TABLE 1-continued

SUMMARY

Atty. Docket No. 44921-5089US
Doc. No. 1803440.1

| Sequence ID No. | Identifier | GenBank Acc/Ref. Seq ID | Model Code | Gene Name | Unigene Cluster Title |
|---|---|---|---|---|---|
| 1094 | 24236 | AI176473 | d, General | | ESTs |
| 1095 | 16518 | AI176546 | v | | ESTs, Moderately similar to HS9B RAT HEAT SHOCK PROTEIN HSP 90-BETA [*R. norvegicus*] |
| 1096 | 2161 | AI176592 | General | | ESTs |
| 1097 | 12436 | AI176610 | General | | ESTs, Weakly similar to S63220 probable membrane protein YNL247w - yeast (*Saccharomyces cerevisiae*) [*S. cerevisiae*] |
| 1098 | 2536 | AI176616 | l, v, General | | ESTs |
| 1099 | 18525 | AI176792 | u | | ESTs |
| 1100 | 23449 | AI176828 | g | | ESTs |
| 1101 | 23299 | AI176839 | General | | ESTs |
| 1102 | 3580 | AI176848 | e | | ESTs |
| 1103 | 22103 | AI176849 | d, General | | ESTs |
| 1104 | 16036 | AI176855 | f | | ESTs |
| 1105 | 15588 | AI176916 | General | | ESTs, Highly similar to phosphomannomutase Sec53p homolog [*M. musculus*] |
| 1106 | 16917 | AI176951 | t | | ESTs |
| 1107 | 16124 | AI176963 | cc | | *Rattus norvegicus* transcription factor MRG1 mRNA, complete cds |
| 1108 | 15146 | AI176969 | b, General | | ESTs |
| 1109 | 5786 | AI177058 | f | | ESTs, Weakly similar to PSE-binding factor PTF delta subunit [*H. sapiens*] |
| 1110 | 2852 | AI177059 | c | | ESTs |
| 1112 | 3156 | AI177092 | g | | ESTs, Highly similar to AF139894 1 RNA-binding protein alpha-CP1 [*M. musculus*] |
| 1113 | 14384 | AI177096 | a | HMm: adenine phosphoribosyl transferase | Rat adenine phosphoribosyltransferase (APRT) gene, complete cds |
| 1114 | 13310 | AI177119 | General | | ESTs, Weakly similar to C1QB RAT COMPLEMENT C1Q SUBCOMPONENT, B CHAIN PRECURSOR [*R. norvegicus*] |
| 1115 | 24049 | AI177341 | g, p, s, u | | ESTs, Highly similar to CGI-10 protein [*H. sapiens*] |
| 1116 | 15964 | AI177360 | o, General | | ESTs |
| 1117 | 14989 | AI177366 | u | Integrin, beta 1 | Integrin, beta 1 |
| 1118 | 7975 | AI177374 | aa | | ESTs |
| 1119 | 3006 | AI177395 | k | | *Rattus norvegicus* substrate binding subunit of type II 5'-deiodinase D2p29 mRNA, complete cds |
| 1120 | 17570 | AI177683 | r | | *Rattus norvegicus* mRNA for hnRNP protein, partial |
| 1121 | 9521 | AI177706 | b | | ESTs |
| 1122 | 14425 | AI177755 | g, General | | ESTs |
| 1123 | 10611 | AI177790 | j, m | | ESTs |
| 1124 | 5356 | AI177813 | cc | | ESTs, Moderately similar to S27962 modulator recognition factor 1 [*H. sapiens*] |
| 1125 | 11791 | AI177843 | General | | ESTs, Highly similar to SAS_HUMAN SARCOMA AMPLIFIED SEQUENC [*H. sapiens*] |
| 1126 | 14484 | AI177867 | General | | ESTs, Weakly similar to putative eps protein [*R. norvegicus*] |
| 1127 | 5780 | AI177869 | General | | ESTs, Weakly similar to DRAL [*R. norvegicus*] |
| 1128 | 19184 | AI178025 | General | | ESTs, Highly similar to TGIF MOUSE 5'-TG-3' INTERACTING FACTOR [*M. musculus*] |
| 1129 | 6059 | AI178245 | c, General | | ESTs, Moderately similar to C17orf1 protein [*H. sapiens*] |
| 1130 | 23248 | AI178267 | y | | ESTs, Weakly similar to hypothetical protein [*H. sapiens*] |
| 1131 | 4073 | AI178272 | o | | ESTs, Weakly similar to YAE6_YEAST HYPOTHETICAL 13 4 KD PROTEIN IN ACS1-GCV3 INTERGENIC REGION [*S. cerevisiae*] |
| 1132 | 7838 | AI178291 | e | | ESTs |

TABLE 1-continued

SUMMARY

| Sequence ID No. | Identifier | GenBank Acc/Ref. Seq ID | Model Code | Gene Name | Unigene Cluster Title |
|---|---|---|---|---|---|
| 1133 | 18996 | AI178326 | y | | ESTs |
| 1134 | 22488 | AI178392 | b | | ESTs, Highly similar to I49523 Mouse primary response gene B94 mRNA, 3'end - mouse [*M. musculus*] |
| 1135 | 18800 | AI178504 | n, p, aa | | ESTs |
| 1136 | 22197 | AI178527 | g, General | | ESTs |
| 1137 | 3401 | AI178684 | bb | | ESTs, Highly similar to MCM3 MOUSE DNA REPLICATION LICENSING FACTOR MCM3 [*M. musculus*] |
| 1138 | 17713 | AI178700 | m | | ESTs |
| 1139 | 14874 | AI178735 | e | | ESTs |
| 1140 | 23567 | AI178746 | v, General | | ESTs |
| 1141 | 18907 | AI178971 | c | | *Rattus norvegicus* alpha-globin (GloA) gene, complete cds |
| 1142 | 20991 | AI178979 | i | | ESTs |
| 1143 | 5887 | AI179099 | q, t | | ESTs, Moderately similar to Vanin-1 [*M. musculus*] |
| 1144 | 8477 | AI179167 | b, e, General | | ESTs |
| 1145 | 3348 | AI179288 | u, v | | ESTs |
| 1146 | 13608 | AI179314 | e | | ESTs |
| 1147 | 8849 | AI179315 | g, p | | ESTs |
| 1148 | 13611 | AI179378 | v, General | | *Rattus norvegicus* mRNA for prostasin precursor, complete cds |
| 1149 | 15438 | AI179399 | m, x | collagen type V, alpha 2 | collagen type V, alpha 2 |
| 1150 | 13614 | AI179407 | e, t, General | | ESTs, Moderately similar to RB17 MOUSE RAS-RELATED PROTEIN RAB-17 [*M. musculus*] |
| 1151 | 15042 | AI179422 | b, General | | ESTs |
| 1152 | 2768 | AI179481 | i, General | | ESTs |
| 1153 | 24041 | AI179580 | b, i | | ESTs |
| 1154 | 19822 | AI179599 | o, General | | *R. norvegicus* mRNA for ras-related GTPase Rab29 |
| 1155 | 23270 | AI179601 | q, General | | ESTs |
| 1156 | 5901 | AI179605 | e | | ESTs |
| 1157 | 16081 | AI179610 | g, i, p | Heme oxygenase | Heme oxygenase |
| 1158 | 14564 | AI179717 | k | | ESTs |
| 1159 | 7918 | AI179750 | General | | ESTs |
| 1160 | 6647 | AI179795 | g | | ESTs |
| 1161 | 9097 | AI179875 | o, General | hypothetical protein LOC56728 | hypothetical protein LOC56728 |
| 1162 | 23989 | AI179953 | a | | ESTs, Highly similar to GAP JUNCTION BETA-2 PROTEIN [*R. norvegicus*] |
| 1163 | 12899 | AI179967 | b | | ESTs |
| 1164 | 1687 | AI179971 | c | Hemoglobin, alpha 1 | Hemoglobin, alpha 1 |
| 1165 | 22569 | AI179979 | General | | ESTs |
| 1166 | 23514 | AI179986 | o, General | HHs: phosphoserine phosphatase | ESTs, Highly similar to L-3-phosphoserine phosphatase [*H. sapiens*] |
| 1167 | 15892 | AI179988 | c, General | | ESTs |
| 1168 | 12402 | AI180004 | g | | ESTs, Highly similar to Unknown [*H. sapiens*] |
| 1169 | 5443 | AI180165 | General | | ESTs, Moderately similar to testis specific DNAj-homolog [*M. musculus*] |
| 1170 | 5481 | AI180170 | General | | ESTs, Highly similar to A Chain A, The Crystal Structure Of Human Eukaryotic Release Factor Erf1-Mechanism Of Stop Codon Recognition And Peptidyl-Trna Hydrolysis [*H. sapiens*] |
| 1171 | 24028 | AI180239 | l | | ESTs |
| 1172 | 17089 | AI180281 | g | | ESTs, Moderately similar to JC4978 oxidative stress protein A170 - mouse [*M. musculus*] |
| 1173 | 3701 | AI180306 | aa | | ESTs, Moderately similar to Y273_HUMAN HYPOTHETICAL PROTEIN KIAA0273 [*H. sapiens*] |
| 1174 | 3352 | AI180334 | m | | ESTs |

TABLE 1-continued

SUMMARY

| Sequence ID No. | GenBank Identifier | Acc/Ref. Seq ID | Model Code | Gene Name | Unigene Cluster Title |
|---|---|---|---|---|---|
| 1175 | 24368 | AI180392 | l, m | | ESTs, Highly similar to AF114169 1 nucleotide-binding protein short form [*M. musculus*] |
| 1176 | 14337 | AI180414 | c | | ESTs, Moderately similar to SPA1 MOUSE GTPASE-ACTIVATING PROTEIN SPA-1 [*M. musculus*] |
| 1177 | 19080 | AI227647 | j, y, z | | *Rattus norvegicus* chemokine CX3C mRNA, complete cds |
| 1178 | 22838 | AI227667 | aa | | ESTs |
| 1179 | 6765 | AI227761 | i, General | | ESTs, Highly similar to T00367 hypothetical protein KIAA0665 [*H. sapiens*] |
| 1180 | 24054 | AI227867 | General | | ESTs, Weakly similar to AF187065 1 p75NTR-associated cell death executor [*R. norvegicus*] |
| 1181 | 7324 | AI227885 | i | | ESTs |
| 1182 | 23898 | AI227987 | d | | ESTs |
| 1183 | 1651 | AI228068 | n, w | Peptidylglycine alpha-amidating monooxygenase | Peptidylglycine alpha-amidating monooxygenase |
| 1184 | 14237 | AI228128 | e | | EST |
| 1185 | 14242 | AI228197 | General | | ESTs, Weakly similar to C21L_HUMAN PUTATIVE PROTEIN C21ORF18 [*H. sapiens*] |
| 1186 | 16913 | AI228236 | o | | ESTs |
| 1187 | 22915 | AI228299 | r | | ESTs, Highly similar to p97 homologous protein [*H. sapiens*] |
| 1188 | 8917 | AI228301 | General | | ESTs |
| 1189 | 15879 | AI228313 | r, General | | ESTs |
| 1190 | 13727 | AI228326 | o, General | | ESTs, Weakly similar to AFG1_YEAST AFG1 PROTEIN [*S. cerevisiae*] |
| 1191 | 6102 | AI228335 | General | | ESTs |
| 1192 | 13730 | AI228356 | a | | ESTs, Weakly similar to S70642 ubiquitin ligase Nedd4 - rat [*R. norvegicus*] |
| 1193 | 13745 | AI228494 | b, cc | | EST |
| 1194 | 4217 | AI228587 | s | | ESTs, Weakly similar to M172_HUMAN MEMBRANE COMPONENT, CHROMOSOME 17, SURFACE MARKER 2 [*H. sapiens*] |
| 1195 | 16053 | AI228596 | cc | | ESTs, Weakly similar to T16757 hypothetical protein R144.3 - *Caenorhabditis elegans* [*C. elegans*] |
| 1196 | 3557 | AI228672 | e | | ESTs |
| 1197 | 11605 | AI228682 | e | | ESTs |
| 1198 | 13203 | AI228728 | r | | ESTs |
| 1199 | 13771 | AI228848 | g | | ESTs, Highly similar to protein inhibitor of activated STAT protein PIAS1 [*H. sapiens*] |
| 1200 | 5918 | AI229036 | r | | ESTs |
| 1201 | 8235 | AI229154 | k | | ESTs |
| 1202 | 16203 | AI229196 | r | Vesicle-associated membrane protein (synaptobrevin 2) | Vesicle-associated membrane protein (synaptobrevin 2) |
| 1203 | 13826 | AI229304 | a | | ESTs |
| 1204 | 13144 | AI229320 | g | | ESTs |
| 1205 | 4640 | AI229404 | x, aa | | ESTs |
| 1206 | 23563 | AI229421 | l | | ESTs, Moderately similar to MKK2 MOUSE MAP KINASE-ACTIVATED PROTEIN KINASE 2 [*M. musculus*] |
| 1207 | 15426 | AI229497 | s | | ESTs, Moderately similar to NADH-ubiquinone oxidoreductase PDSW subunit [*H. sapiens*] |
| 1208 | 15193 | AI229508 | bb | | ESTs |
| 1209 | 19243 | AI229638 | x | | ESTs, Highly similar to KITH RAT THYMIDINE KINASE, CYTOSOLIC [*R. norvegicus*] |
| 1210 | 23078 | AI229647 | p | | ESTs |
| 1211 | 3099 | AI229680 | o | HHs: NADH dehydrogenase (ubiquinone) Fe-S protein 3 (30 kD) (NADH-coenzyme Q reductase) | ESTs, Highly similar to NADH: ubiquinone oxidoreductase NDUFS3 subunit [*H. sapiens*] |

TABLE 1-continued

SUMMARY

| Sequence ID No. | GenBank Identifier | Acc/Ref. Seq ID | Model Code | Gene Name | Unigene Cluster Title |
|---|---|---|---|---|---|
| 1212 | 19508 | AI229698 | bb | | Sprague-Dawley D-beta-hydroxybutyrate dehydrogenase mRNA, complete cds |
| 1213 | 13977 | AI229707 | x | | *Rattus norvegicus* mRNA for class I beta-tubulin, complete cds |
| 1214 | 23983 | AI229708 | v | | ESTs, Moderately similar to NADC__HUMAN NICOTINATE-NUCLEOTIDE PYROPHOSPHORYLASE [*H. sapiens*] |
| 1215 | 2688 | AI229793 | e | | ESTs |
| 1216 | 13874 | AI229832 | g | | ESTs, Weakly similar to KIAA0859 protein [*H. sapiens*] |
| 1217 | 12587 | AI229979 | General | | ESTs, Weakly similar to MOT2 RAT MONOCARBOXYLATE TRANSPORTER 2 [*R. norvegicus*] |
| 1218 | 20591 | AI229993 | l, m | | ESTs |
| 1219 | 24042 | AI230002 | a, b, d, General | | ESTs |
| 1220 | 13880 | AI230042 | u | | *Rattus norvegicus* mRNA for voltage-gated ca channel, complete cds |
| 1221 | 17672 | AI230074 | d | HMm: NADH dehydrogenase (ubiquinone) 1 alpha subcomplex, 1 | ESTs, Highly similar to NIMM MOUSE NADH-UBIQUINONE OXIDOREDUCTASE MWFE SUBUNIT [*M. musculus*] |
| 1222 | 3652 | AI230113 | General | | *Rattus norvegicus* hfb2 mRNA, complete cds |
| 1223 | 18650 | AI230121 | aa | | ESTs, Weakly similar to HS9B RAT HEAT SHOCK PROTEIN HSP 90-BETA [*R. norvegicus*] |
| 1224 | 13025 | AI230173 | c | | ESTs, Moderately similar to CHD3__HUMAN CHROMODOMAIN HELICASE-DNA-BINDING PROTEIN 3 [*H. sapiens*] |
| 1225 | 4280 | AI230247 | z | selenoprotein P, plasma, 1 | selenoprotein P, plasma, 1 |
| 1226 | 18528 | AI230284 | General | | ESTs |
| 1227 | 7084 | AI230362 | p | | ESTs, Moderately similar to T46458 hypothetical protein DKFZp434M102 1 [*H. sapiens*] |
| 1228 | 20895 | AI230549 | b, n | | ESTs |
| 1229 | 12961 | AI230554 | General | | ESTs |
| 1230 | 15636 | AI230616 | r | | *Rattus norvegicus* mRNA for galectin-2 related protein, complete cds |
| 1231 | 4121 | AI230647 | j, m | | ESTs |
| 1232 | 14388 | AI230702 | General | | ESTs, Highly similar to HN1 [*M. musculus*] |
| 1233 | 18529 | AI230716 | x, General | | ESTs |
| 1234 | 13618 | AI230724 | General | | *Rattus norvegicus* phosphoinositide phosphatase SAC1 mRNA, complete cds |
| 1235 | 8304 | AI230746 | cc | | ESTs |
| 1236 | 4731 | AI230773 | e | | ESTs |
| 1237 | 14430 | AI230798 | c, k, x | | ESTs, Moderately similar to CDN3__HUMAN CYCLIN-DEPENDENT KINASE INHIBITOR 3 [*H. sapiens*] |
| 1238 | 16627 | AI230822 | bb | HHs: Alg5, *S. cerevisiae*, homolog of | ESTs, Highly similar to AF102850 1 dolichyl-phosphate beta-glucosyltransferase [*H. sapiens*] |
| 1239 | 3125 | AI231028 | General | | *Rattus norvegicus* mRNA for brain 4.1(S), complete cds |
| 1240 | 633 | AI231127 | k | | ESTs |
| 1241 | 20846 | AI231140 | p | | ESTs, Highly similar to RL2B__HUMAN 60S RIBOSOMAL PROTEIN L23A [*R. norvegicus*] |
| 1242 | 6743 | AI231219 | d | | ESTs |
| 1244 | 26292 | AI231391 | k | | |
| 1245 | 12343 | AI231433 | w | | ESTs |
| 1246 | 7337 | AI231465 | aa | | ESTs |
| 1247 | 16321 | AI231506 | General | | ESTs |
| 1248 | 8004 | AI231532 | j, l | | ESTs, Highly similar to Z183__HUMAN ZINC FINGER PROTEIN 183 [*H. sapiens*] |

TABLE 1-continued

SUMMARY

Atty. Docket No. 44921-5089US
Doc. No. 1803440.1

| Sequence ID No. | Identifier | GenBank Acc/Ref. Seq ID | Model Code | Gene Name | Unigene Cluster Title |
|---|---|---|---|---|---|
| 1249 | 15171 | AI231792 | g | | ESTs, Moderately similar to BAG-family molecular chaperone regulator-3 [*H. sapiens*] |
| 1250 | 6193 | AI231797 | l | | ESTs |
| 1252 | 14227 | AI231999 | u | | ESTs, Moderately similar to tumor protein D53 [*M. musculus*] |
| 1253 | 24501 | AI232006 | w, y, bb | | *Rattus norvegicus* translation elongation factor 1-delta subunit mRNA, partial cds |
| 1254 | 3434 | AI232014 | g, q, z, cc, General | | ESTs |
| 1255 | 19094 | AI232021 | n, General | | ESTs, Highly similar to Human Translation Initiation Factor Eif1, Nmr, 29 Structures [*H. sapiens*] |
| 1256 | 14020 | AI232076 | u | | ESTs |
| 1257 | 6726 | AI232157 | d | | ESTs |
| 1258 | 11549 | AI232174 | l, m | | ESTs |
| 1259 | 23125 | AI232266 | j, s | | ESTs |
| 1260 | 2085 | AI232270 | bb | | ESTs, Moderately similar to JC4914 anti-sigma cross-reacting protein homolog I beta precursor [*H. sapiens*] |
| 1261 | 2913 | AI232272 | o | | ESTs, Weakly similar to T25417 hypothetical protein T28D6.9 - *Caenorhabditis elegans* [*C elegans*] |
| 1262 | 14304 | AI232281 | g | | ESTs, Weakly similar to KIAA0971 protein [*H. sapiens*] |
| 1263 | 15955 | AI232294 | u, bb, General | | ESTs |
| 1264 | 15122 | AI232303 | y | | ESTs, Weakly similar to Sid1669p [*M. musculus*] |
| 1265 | 4716 | AI232313 | y | purinergic receptor P2X, ligand-gated ion channel 4 | purinergic receptor P2X, ligand-gated ion channel 4 |
| 1266 | 15246 | AI232332 | t, u | | ESTs |
| 1267 | 24321 | AI232340 | o | Stromal cell-derived factor 1 | Stromal cell-derived factor 1 |
| 1268 | 16172 | AI232341 | d | | ESTs, Weakly similar to YQ42_CAEEL HYPOTHETICAL 40 0 KD PROTEIN C13B9 2 IN CHROMOSOME III [*C. elegans*] |
| 1269 | 11411 | AI232346 | h | | ESTs |
| 1270 | 19287 | AI232379 | f | Platelet-derived growth factor receptor alpha | Platelet-derived growth factor receptor alpha |
| 1271 | 5601 | AI232461 | n, General | | ESTs, Weakly similar to FMO1 RAT DIMETHYLANILINE MONOOXYGENASE [*R. norvegicus*] |
| 1272 | 14051 | AI232489 | l, m | | ESTs, Weakly similar to PIR1 [*H. sapiens*] |
| 1273 | 5572 | AI232490 | i, t | | ESTs, Moderately similar to A27340 complement C7 precursor [*H. sapiens*] |
| 1274 | 11157 | AI232494 | cc | | ESTs |
| 1275 | 8709 | AI232534 | o | | ESTs, Weakly similar to DnaJ homolog 2 [*R. norvegicus*] |
| 1276 | 20350 | AI232552 | j, v, y | | EST |
| 1277 | 14069 | AI232631 | e | | ESTs |
| 1278 | 4440 | AI232643 | w | | ESTs |
| 1279 | 17695 | AI232784 | e | | ESTs, Weakly similar to putative peroxisomal 2,4-dienoyl-CoA reductase [*R. norvegicus*] |
| 1280 | 15796 | AI232874 | v | | ESTs |
| 1281 | 12467 | AI232924 | General | | ESTs |
| 1282 | 12873 | AI232984 | i | | ESTs |
| 1283 | 5355 | AI233031 | r | | ESTs |
| 1284 | 18794 | AI233121 | c | | ESTs, Moderately similar to MHC class I [*M. musculus*] |
| 1285 | 3823 | AI233147 | b, g, General | | ESTs, Weakly similar to nuclear RNA helicase [*R. norvegicus*] |
| 1286 | 11967 | AI233155 | c, k, General | | ESTs |
| 1287 | 11561 | AI233182 | d | | ESTs |
| 1288 | 3471 | AI233183 | g | | ESTs, Highly similar to PM1_HUMAN PROTEIN PM [*H. sapiens*] |

TABLE 1-continued

SUMMARY

Atty. Docket No. 44921-5089US
Doc. No. 1803440.1

| Sequence ID No. | Identifier | GenBank Acc/Ref. Seq ID | Model Code | Gene Name | Unigene Cluster Title |
|---|---|---|---|---|---|
| 1289 | 21948 | AI233191 | i | | ESTs, Weakly similar to T15919 hypothetical protein EEED8 9 - *Caenorhabditis elegans* [*C elegans*] |
| 1290 | 13598 | AI233194 | g, p, y | | ESTs |
| 1291 | 15552 | AI233195 | y | | ESTs, Highly similar to Bodenin [*M. musculus*] |
| 1292 | 17907 | AI233224 | bb | | *Rattus norvegicus* epidermal growth factor receptor related protein (Errp) mRNA, complete cds |
| 1293 | 14111 | AI233269 | cc | | ESTs |
| 1294 | 12894 | AI233365 | d | | ESTs, Weakly similar to T24956 hypothetical protein T16G1.10 - *Caenorhabditis elegans* [*C. elegans*] |
| 1295 | 7161 | AI233407 | General | | ESTs, Weakly similar to S44853 K12H4 3 protein - *Caenorhabditis elegans* [*C. elegans*] |
| 1296 | 15906 | AI233425 | q | | ESTs |
| 1297 | 14120 | AI233433 | d | | ESTs |
| 1298 | 14095 | AI233468 | a, d | | ESTs |
| 1299 | 3075 | AI233494 | u, aa | | ESTs, Weakly similar to I38079 OXA1 homolog [*H. sapiens*] |
| 1300 | 6046 | AI233530 | General | | ESTs |
| 1301 | 18900 | AI233570 | General | | PSD8_HUMAN 26S PROTEASOME REGULATORY SUBUNIT S14 [*H. sapiens*] |
| 1302 | 7888 | AI233583 | General | HHs arginyl-tRNA synthetase | ESTs, Moderately similar to SYR_HUMAN ARGINYL-TRNA SYNTHETASE [*H. sapiens*] |
| 1303 | 16709 | AI233602 | General | Adenosin kinase | Adenosin kinase |
| 1304 | 5163 | AI233712 | y | | ESTs, Highly similar to P2CD_MOUSE PROTEIN PHOSPHATASE 2C DELTA ISOFORM (PP2C-DELTA) (P53-INDUCED PROTEIN PHOSPHATASE 1) (PROTEIN PHOSPHATASE MAGNESIUM-DEPENDENT 1 DELTA) [*M. musculus*] |
| 1305 | 7243 | AI233717 | General | | ESTs, Moderately similar to ERHUAH coatomer complex alpha chain homolog [*H. sapiens*] |
| 1306 | 3816 | AI233729 | g | | ESTs, Highly similar to PSD5_HUMAN 26S PROTEASOME SUBUNIT S5B [*H. sapiens*] |
| 1307 | 13023 | AI233740 | d, h General | | ESTs, Weakly similar to ALDR RAT ALDOSE REDUCTASE [*R. norvegicus*] |
| 1308 | 14871 | AI233743 | g | | ESTs |
| 1309 | 7469 | AI233767 | cc | | ESTs, Highly similar to Gene product with similarity to KIAA0154 [*H. sapiens*] |
| 1310 | 7804 | AI233771 | b | | ESTs |
| 1311 | 13563 | AI233773 | e | | ESTs, Weakly similar to T24413 hypothetical protein T04A11.2 - *Caenorhabditis elegans* [*C. elegans*] |
| 1312 | 2154 | AI233818 | k, cc | | ESTs |
| 1313 | 16616 | AI234079 | h | | ESTs |
| 1314 | 13393 | AI234100 | a, d, General | cysteine rich protein | cysteine rich protein |
| 1315 | 7071 | AI234162 | r | | ESTs |
| 1316 | 14677 | AI234620 | General | | EST |
| 1317 | 4443 | AI234629 | m | | ESTs, Weakly similar to transcription factor C1 [*M. musculus*] |
| 1318 | 22453 | AI234678 | b | | ESTs |
| 1319 | 23964 | AI234748 | t, General | | ESTs |
| 1320 | 19581 | AI234753 | f | | EST |
| 1321 | 22152 | AI234822 | o, General | DEXRAS1 (Dexras1) | DEXRAS1 (Dexras1) |
| 1322 | 18942 | AI234865 | d | | ESTs, Weakly similar to S12207 hypothetical protein [*M. musculus*] |
| 1323 | 22662 | AI234939 | aa | ATPase, H+ transporting, lysosomal (vacuolar proton pump), subun | ATPase, H+ transporting, lysosomal (vacuolar proton pump), subunit 1 |

TABLE 1-continued

SUMMARY

Atty. Docket No. 44921-5089US
Doc. No. 1803440.1

| Sequence ID No. | Identifier | GenBank Acc/Ref. Seq ID | Model Code | Gene Name | Unigene Cluster Title |
|---|---|---|---|---|---|
| 1324 | 3875 | AI235047 | o, General | | ESTs, Highly similar to CB80__HUMAN 80 KDA NUCLEAR CAP BINDING PROTEIN [*H. sapiens*] |
| 1325 | 19479 | AI235135 | o | | EST |
| 1326 | 14906 | AI235192 | g | | ESTs, Highly similar to ABF2__HUMAN ATP-BINDING CASSETTE, SUB-FAMILY F, MEMBER 2 (IRON INHIBITED ABC TRANSPORTER 2) [*H. sapiens*] |
| 1327 | 14718 | AI235210 | e | | ESTs |
| 1328 | 15004 | AI235224 | b, General | | *Rattus norvegicus* tissue inhibitor of metalloproteinase-1 (TIMP1), mRNA, complete cds |
| 1329 | 6632 | AI235277 | v | | ESTs |
| 1330 | 14722 | AI235284 | x, z | | ESTs, Weakly similar to single-pass transmembrane protein [*R. norvegicus*] |
| 1331 | 1462 | AI235585 | u, General | | Rat mRNA for preprocathepsin D (EC 3.4.23 5) |
| 1332 | 21061 | AI235631 | l, m | | ESTs |
| 1333 | 14665 | AI235646 | m | MAD homolog 4 (Drosophila) | MAD homolog 4 (Drosophila) |
| 1334 | 19940 | AI235689 | General | | ESTs, Moderately similar to pescadillo [*H. sapiens*] |
| 1335 | 5698 | AI235692 | u | | ESTs |
| 1336 | 23745 | AI235732 | k | | ESTs, Highly similar to NID2 MOUSE NIDOGEN-2 PRECURSOR [*M. musculus*] |
| 1337 | 11164 | AI235739 | General | | ESTs, Moderately similar to A56716 aromatic ester hydrolase [*H. sapiens*] |
| 1338 | 5212 | AI235745 | d | | ESTs |
| 1339 | 14768 | AI235912 | h | | ESTs, Weakly similar to hypothetical protein [*H. sapiens*] |
| 1340 | 14776 | AI235950 | m | | ESTs |
| 1341 | 3091 | AI236027 | n, General | | ESTs |
| 1342 | 14861 | AI236045 | r | | ESTs |
| 1343 | 14862 | AI236048 | e | | EST |
| 1344 | 16943 | AI236097 | p | | ESTs, Highly similar to E25B protein [*M. musculus*] |
| 1345 | 8336 | AI236101 | l | | ESTs, Highly similar to JC7107 development related unidentified 27K protein - mouse [*M. musculus*] |
| 1346 | 23230 | AI236146 | v | | ESTs |
| 1347 | 22855 | AI236150 | e | | ESTs, Highly similar to JC7301 Down syndrome critical region protein 5 alpha [*H. sapiens*] |
| 1348 | 14594 | AI236152 | i | | ESTs |
| 1349 | 18406 | AI236168 | r | | ESTs |
| 1350 | 15051 | AI236332 | General | | ESTs, Highly similar to ATDA MOUSE DIAMINE ACETYLTRANSFERASE [*M. musculus*] |
| 1351 | 19298 | AI236338 | bb | | ESTs, Weakly similar to NHPX RAT NHP2/RS6 FAMILY PROTEIN YEL026W HOMOLOG [*R. norvegicus*] |
| 1352 | 10667 | AI236366 | b | siah binding protein 1; FBP interacting repressor, pyrimidine tr | siah binding protein 1; FBP interacting repressor, pyrimidine tract binding splicing factor, Ro ribonucleoprotein-binding protein 1 |
| 1353 | 10774 | AI236397 | f | | ESTs |
| 1354 | 9407 | AI236402 | aa | | ESTs |
| 1355 | 26335 | AI236460 | General | | *Rattus norvegicus* retinol dehydrogenase type II mRNA, complete cds |
| 1356 | 17950 | AI236590 | t, General | | ESTs |
| 1357 | 18259 | AI236601 | h, v | | ESTs |
| 1358 | 11445 | AI236613 | j, y | | ESTs |
| 1359 | 17248 | AI236635 | o, aa | | ESTs, Highly similar to SCF complex protein Skp1 [*M. musculus*] |
| 1360 | 16859 | AI236753 | t, General | | ESTs |
| 1361 | 5208 | AI236754 | g | | ESTs, Weakly similar to hT41 [*H. sapiens*] |
| 1362 | 24388 | AI236772 | e, General | | ESTs |

TABLE 1-continued

SUMMARY

Atty. Docket No. 44921-5089US
Doc. No. 1803440.1

| Sequence ID No. | Identifier | GenBank Acc/Ref. Seq ID | Model Code | Gene Name | Unigene Cluster Title |
|---|---|---|---|---|---|
| 1363 | 15850 | AI236795 | n, v, w | | ESTs, ESTs, Highly similar to HS9B RAT HEAT SHOCK PROTEIN HSP 90-BETA [R. norvegicus] |
| 1364 | 14800 | AI236856 | w | | ESTs |
| 1366 | 11404 | AI237002 | m | spermidine synthase | spermidine synthase |
| 1367 | 18151 | AI237212 | o, General | | ESTs, Highly similar to hepatitis B virus X interacting protein [H. sapiens] |
| 1368 | 21653 | AI237535 | t, General | estrogen-responsive uterine transcript | estrogen-responsive uterine transcript |
| 1369 | 11208 | AI237586 | z | | ESTs, Moderately similar to INIB RAT INTERFERON-INDUCIBLE PROTEIN [R. norvegicus] |
| 1370 | 21893 | AI237713 | i, k, aa | | ESTs, Moderately similar to Y101_HUMAN HYPOTHETICAL PROTEIN KIAA0101 [H. sapiens] |
| 1371 | 14842 | AI237724 | r | | ESTs |
| 1372 | 3467 | AI237835 | General | | ESTs, Moderately similar to MXI1 RAT MAX INTERACTING PROTEIN 1 [R. norvegicus] |
| 1373 | 25840 | AI638972 | u | | |
| 1374 | 17108 | AI639017 | n | | ESTs, Highly similar to G9A [M. musculus] |
| 1375 | 16676 | AI639082 | c, k, x | mini chromosome maintenance deficient 6 (S cerevisiae) | mini chromosome maintenance deficient 6 (S. cerevisiae) |
| 1376 | 12400 | AI639107 | k | | ESTs |
| 1377 | 19952 | AI639108 | q, v | | ESTs |
| 1379 | 25907 | AI639167 | o, w | | ESTs |
| 1381 | 18533 | AI639231 | n | | ESTs, Highly similar to T46480 hypothetical protein DKFZp434L1850 1 [H. sapiens] |
| 1382 | 18353 | AI639233 | t, aa | decorin | decorin |
| 1384 | 15330 | AI639285 | General | | ESTs |
| 1385 | 20026 | AI639354 | g | | EST |
| 1386 | 25971 | AI639365 | r | | |
| 1388 | 19152 | AI639387 | u, General | | ESTs |
| 1390 | 18338 | AI639422 | y | | ESTs, Moderately similar to CAQC RAT CALSEQUESTRIN, CARDIAC MUSCLE ISOFORM PRECURSOR [R. norvegicus] |
| 1392 | 20082 | AI639488 | i, m | | EST, Highly similar to A42772 mdm2 protein - rat [R. norvegicus] |
| 1394 | 20056 | AI639504 | a, bb, General | | ESTs, Weakly similar to T13607 hypothetical protein EG 87B1.3 - fruit fly [D melanogaster] |
| 1395 | 4713 | AI639518 | q | | ESTs, Highly similar to RPB8_HUMAN DNA-DIRECTED RNA POLYMERASES I, II, AND III 17.1 KD POLYPEPTIDE [H. sapiens] |
| 1396 | 14332 | AJ001044 | bb | protein phosphatase 1, regulatory (inhibitor) subunit 5 | protein phosphatase 1, regulatory (inhibitor) subunit 5 |
| 1397 | 7602 | AJ001929 | k | reticulocalbin | reticulocalbin |
| 1398 | 9867 | AJ005424 | u | | Rattus norvegicus mRNA for BMK1/ERK5 protein, partial |
| 1400 | 16351 | AJ011811 | General | claudin 7 | claudin 7 |
| 1401 | 20116 | AJ011969 | l, General | growth differentiation factor 15 | growth differentiation factor 15 |
| 1402 | 17635 | AJ223355 | v, w | | Rattus norvegicus mRNA for mitochondrial dicarboxylate carrier |
| 1403 | 18686 | D00729 | q | dodecenoyl-Coenzyme A delta isomerase (3,2 trans-enoyl-Coenyme A | Rat mRNA for delta3, delta2-enoyl-CoA isomerase, dodecenoyl-Coenzyme A delta isomerase (3,2 trans-enoyl-Coenyme A isomerase) |
| 1404 | 5049 | D10655 | n, w | dihydrolipoamide acetyltransferase | dihydrolipoamide acetyltransferase |
| 1405 | 25257 | D13623 | j | | |
| 1405 | 15281 | D13623 | h | | ESTs |
| 1406 | 11434 | D14014 | cc | | ESTs |
| 1407 | 1613 | D14076 | x | | Rat mRNA for testicular dynamin, complete cds |
| 1408 | 1728 | D16479 | q | HHs hydroxyacyl-Coenzyme A dehydrogenase/3-ketoacyl- | Rat mRNA for mitochondrial long-chain 3-ketoacyl-CoA thiolase beta- |

TABLE 1-continued

SUMMARY

| Sequence ID No. | Identifier | GenBank Acc/Ref. Seq ID | Model Code | Gene Name | Unigene Cluster Title |
|---|---|---|---|---|---|
| | | | | Coenzyme A thiolase/enoyl-Coenzyme A hydratase (trifunctional protein), beta subunit | subunit of mitochondrial trifunctional protein, complete dds |
| 1409 | 3015 | D16554 | c, s, v, z | | Rat mRNA for polyubiquitin (four repetitive ubiquitins in tandem), complete cds |
| 1410 | 472 | D26111 | d, s, bb | | *R. norvegicus* mRNA for chloride channel (putative) 2313bp |
| 1412 | 16233 | D29960 | j, l | | *Rattus norvegicus* mRNA for alphaB crystallin-related protein, complete cds |
| 1413 | 9029 | D30804 | n | | ESTs, Highly similar to PRC6 RAT PROTEASOME SUBUNIT RC6-1 [*R. norvegicus*] |
| 1414 | 1485 | D38222 | y, z | | *Rattus norvegicus* tyrosine phosphatase-like protein IA-2a mRNA, partial cds |
| 1415 | 9135 | D45247 | s | proteasome beta type subunit 5 | ESTs, Highly similar to PRCE RAT PROTEASOME EPSILON CHAIN PRECURSOR [*R. norvegicus*] |
| 1416 | 16354 | D50564 | u | HHs: mercaptopyruvate sulfurtransferase | *Rattus norvegicus* mRNA for mercaptopyruvate sulfurtransferase, complete cds |
| 1417 | 1884 | D50695 | l, m, bb | | *Rattus norvegicus* mRNA for proteasomal ATPase (Tat-binding protein7), complete cds |
| 1418 | 21147 | D63772 | General | Solute carrier family 1 A1 (brain glutamate transporter) | Solute carrier family 1 A1 (brain glutamate transporter) |
| 1419 | 826 | D82928 | f | HHs. CDP-diacylglycerol-inositol 3-phosphatidyltransferase (phosphatidylinositol synthase) | Rat mRNA for phosphatidylinositol synthase, complete cds |
| 1420 | 25306 | D84485 | u | | |
| 1421 | 18867 | D88250 | t | | *Rattus norvegicus* mRNA for serine protease, complete cds |
| 1423 | 22543 | H31117 | r, v, General | | |
| 1424 | 12360 | H31456 | w | | ESTs |
| 1425 | 20514 | H31489 | h, j | | ESTs |
| 1426 | 11358 | H31610 | h | | ESTs, Highly similar to mtprd [*M. musculus*] |
| 1427 | 4360 | H31813 | bb, General | | ESTs, Moderately similar to T14781 hypothetical protein DKFZp586B1621.1 [*H. sapiens*] |
| 1428 | 9343 | H32169 | l | | ESTs, Moderately similar to COF1 RAT COFILIN, NON-MUSCLE ISOFORM [*R. norvegicus*] |
| 1429 | 4386 | H33093 | h, w | | EST |
| 1430 | 4415 | H33636 | h | | ESTs |
| 1431 | 15374 | H34186 | l | | ESTs, Highly similar to IF39_HUMAN EUKARYOTIC TRANSLATION INITIATION FACTOR 3 SUBUNIT 9 [*H. sapiens*] |
| 1432 | 17159 | J00797 | u, General | alpha-tubulin | alpha-tubulin |
| 1433 | 16260 | J01878 | f | | Rat brain-specific identifier sequence RNA, clone p1b224 |
| 1434 | 17284 | J02827 | bb | Branched chain alpha-ketoacid dehydrogenase subunit E1 alpha | Branched chain alpha-ketoacid dehydrogenase subunit E1 alpha |
| 1435 | 15017 | J03752 | n | | Rat glutathione S-transferase mRNA, complete cds |
| 1436 | 44 | J03819 | p, s | Thyroid hormone receptor, beta (avian erythroblastic leukemia viral (v-erb-a) oncogene homolog 2) | Thyroid hormone receptor, beta (avian erythroblastic leukemia viral (v-erb-a) oncogene homolog 2) |
| 1437 | 21014 | J03914 | e, r, General | Glutathione-S-transferase, mu type 2 (Yb2) | Glutathione-S-transferase, mu type 2 (Yb2) |
| 1438 | 20429 | J05035 | f | Steroid-5-alpha-reductase, alpha polypeptide 1 (3-oxo-5 alpha-steroid delta 4-dehydrogenase alpha 1) | Steroid-5-alpha-reductase, alpha polypeptide 1 (3-oxo-5 alpha-steroid delta 4-dehydrogenase alpha 1) |

TABLE 1-continued

SUMMARY

Atty. Docket No. 44921-5089US
Doc. No. 1803440.1

| Sequence ID No. | Identifier | GenBank Acc/Ref. Seq ID | Model Code | Gene Name | Unigene Cluster Title |
|---|---|---|---|---|---|
| 1439 | 1247 | J05181 | j, l, m, s, y, z | Glutamylcysteine gamma synthetase light chain | Glutamylcysteine gamma synthetase light chain |
| 1440 | 10464 | J05510 | n, u, General | Inositol 1,4,5-triphosphate receptor type 1 | Rat inositol-1,4,5-triphosphate receptor mRNA, complete cds |
| 1441 | 20149 | K03243 | q | | |
| 1442 | 17758 | K03249 | q | | Rat peroxisomal enoyl-CoA hydrotase-3-hydroxyacyl-CoA bifunctional enzyme mRNA, complete cds |
| 1443 | 381 | L00124 | w | Elastase 2, pancreatic | Elastase 2, pancreatic |
| 1444 | 2048 | L00382 | k, x | | |
| 1445 | 10500 | L04619 | s | | |
| 1447 | 108 | L14002 | p | | *Rattus norvegicus* clone 15 polymeric immunoglobulin receptor mRNA, 3'UTR microsatellite repeats |
| 1448 | 25366 | L14003 | t | | |
| 1449 | 109 | L14004 | c, p | | *Rattus norvegicus* clone 15 polymeric immunoglobulin receptor mRNA, 3'UTR microsatellite repeats |
| 1450 | 20414 | L14323 | General | Phospholipase C-beta1 | Phospholipase C-beta1 |
| 1451 | 25369 | L14937 | y | | |
| 1452 | 16119 | L16532 | k | 2',3'-Cyclic nucleotide 3'-phosphodiesterase | 2',3'-Cyclic nucleotide 3'-phosphodiesterase |
| 1453 | 25377 | L25387 | h | | |
| 1453 | 12058 | L25387 | h | | ESTs, Highly similar to A53047 6-phosphofructokinase [*R. norvegicus*] |
| 1455 | 21146 | L35558 | General | Solute carrier family 1 A1 (brain glutamate transporter) | Solute carrier family 1 A1 (brain glutamate transporter) |
| 1456 | 106 | L37203 | w | | *Rattus norvegicus* guanylyl cyclase (GC-D) mRNA, complete cds |
| 1458 | 13682 | L38482 | f, j, k, m, z | | *Rattus norvegicus* serine protease gene, complete cds |
| 1459 | 6405 | L38615 | p | Glutathione synthetase gene | Glutathione synthetase gene |
| 1461 | 15189 | M11794 | n, v | | |
| 1462 | 17086 | M13011 | j | | Rat c-ras-H-1 gene, complete cds |
| 1464 | 21053 | M15481 | o | | Rat insulin-like growth factor-I mRNA, 3' end |
| 1465 | 25405 | M18330 | j, l | | |
| 1466 | 25415 | M19648 | a | | |
| 1468 | 14967 | M22366 | w | | |
| 1469 | 20481 | M22631 | bb | Propionyl Coenzyme A carboxylase, alpha polypeptide | |
| 1471 | 15048 | M24542 | q | HHs ubiquinol-cytochrome c reductase, Rieske iron-sulfur polypeptide 1 | Rat Rieske iron-sulfur protein mRNA, complete cds |
| 1472 | 20921 | M29853 | m | | Rat cytochrome P-450 isozyme 5 (P450 IVB2) mRNA, complete cds |
| 1473 | 1224 | M31931 | u | Cytochrome P450, an olfactory-specific steroid hydroxylase | Cytochrome P450, an olfactory-specific steroid hydroxylase |
| 1474 | 15579 | M33648 | q | | Rat mitochondrial 3-hydroxy-3-methylglutaryl-CoA synthase mRNA, complete cds |
| 1474 | 15580 | M33648 | q | | Rat mitochondrial 3-hydroxy-3-methylglutaryl-CoA synthase mRNA, complete cds |
| 1475 | 17211 | M34331 | g, n, q, v | | ESTs, Weakly similar to KRAB-zinc finger protein KZF-1 [*R. norvegicus*] |
| 1476 | 20699 | M35601 | b, x, bb | | Rat alpha-fibrinogen mRNA, 3' end |
| 1476 | 20700 | M35601 | b, t, bb | | Rat alpha-fibrinogen mRNA, 3' end |
| 1477 | 9223 | M36151 | o | | Rat mRNA for MHC class II antigen RT1.B-1 beta-chain, *Rattus norvegicus* MHC class II antigen RT1 B beta chain mRNA, partial cds |
| 1479 | 1585 | M57728 | j, m, y | | Rat general mitochondrial matrix processing protease (MPP) mRNA, 3' end |
| 1480 | 24844 | M58040 | c | transferrin receptor | transferrin receptor |
| 1481 | 25057 | M58495 | h | | |
| 1482 | 457 | M60666 | d, General | Tropomyosin 1 (alpha) | Tropomyosin 1 (alpha) |

TABLE 1-continued

SUMMARY

| Sequence ID No. | Identifier | GenBank Acc/Ref. Seq ID | Model Code | Gene Name | Unigene Cluster Title |
|---|---|---|---|---|---|
| 1483 | 1223 | M75281 | f | | Rat cystatin S (CysS) gene, complete cds |
| 1484 | 5733 | M81855 | i, k, aa | P-glycoprotein/multidrug resistance 1 | P-glycoprotein/multidrug resistance 1 |
| 1485 | 4198 | M83143 | m | | Rat beta-galactoside-alpha 2, 6-sialyltransferase mRNA |
| 1485 | 4199 | M83143 | m | | Rat beta-galactoside-alpha 2, 6-sialyltransferase mRNA |
| 1486 | 24651 | M83678 | k, x, z | RAB13 | RAB13 |
| 1487 | 1430 | M84648 | General | Dopa decarboxylase (aromatic L-amino acid decarboxylase) | Dopa decarboxylase (aromatic L-amino acid decarboxylase) |
| 1488 | 25467 | M93297 | c | ornithine aminotransferase | ornithine aminotransferase |
| 1489 | 729 | M95762 | a, y | | *Rattus norvegicus* GABA transporter GAT-2 mRNA, complete cds |
| 1490 | 23698 | NM_012489 | q | *Rattus norvegicus* Acetyl-CoA acyltransferase, 3-oxo acyl-CoA thiolase A, peroxisomal (Acaa), mRNA. Length = 1619 | Acetyl-CoA acyltransferase, 3-oxo acyl-CoA thiolase A, peroxisomal |
| 1490 | 23699 | NM_012489 | q | *Rattus norvegicus* Acetyl-CoA acyltransferase, 3-oxo acyl-CoA thiolase A, peroxisomal (Acaa), mRNA. Length = 1619 | Acetyl-CoA acyltransferase, 3-oxo acyl-CoA thiolase A, peroxisomal |
| 1491 | 7062 | NM_012495 | q | *Rattus norvegicus* Aldolase A, fructose-bisphosphate (Aldoa), mRNA. Length = 1442 | Aldolase A, fructose-bisphosphate |
| 1492 | 15511 | NM_012498 | u | *Rattus norvegicus* Aldehyde reductase 1 (low Km aldose reductase) (5 8 kb PstI fragment, probably the functional gene) (Akr1b1), mRNA. Length = 1339 | Aldehyde reductase 1 (low Km aldose reductase) (5.8 kb PstI fragment, probably the functional gene) |
| 1494 | 7427 | NM_012515 | General | *Rattus norvegicus* Benzodiazepin receptor (peripheral) (Bzrp), mRNA. Length = 781 | Benzodiazepin receptor (peripheral) |
| 1495 | 24433 | NM_012527 | l | *Rattus norvegicus* Cholinergic receptor, muscarinic 3 (Chrm3), mRNA. Length = 3578 | Cholinergic receptor, muscarinic 3 |
| 1496 | 4467 | NM_012529 | d | *Rattus norvegicus* Creatine kinase, brain (Ckb), mRNA. Length = 1146 | Creatine kinase, brain |
| 1497 | 16520 | NM_012532 | General | *Rattus norvegicus* Ceruloplasmin (ferroxidase) (Cp), mRNA. Length = 3700 | Ceruloplasmin (ferroxidase) |
| 1498 | 225 | NM_012544 | x, z | *Rattus norvegicus* Angiotensin I-converting enzyme (Dipeptidyl carboxypeptidase 1) (Ace), mRNA. Length = 4142 | Dipeptidyl carboxypeptidase 1 (Angiotensin I-converting enzyme) |
| 1499 | 1431 | NM_012545 | General | *Rattus norvegicus* Dopa decarboxylase (aromatic L-amino acid decarboxylase) (Ddc), mRNA. Length = 1954 | Dopa decarboxylase (aromatic L-amino acid decarboxylase) |
| 1500 | 23868 | NM_012551 | l, m, v, General | *Rattus norvegicus* Early growth response 1 (Egr1), mRNA. Length = 3112 | Early growth response 1 |
| 1500 | 23872 | NM_012551 | l, v, cc, General | *Rattus norvegicus* Early growth response 1 (Egr1), mRNA. Length = 3112 | Early growth response 1 |
| 1500 | 23869 | NM_012551 | v, General | *Rattus norvegicus* Early growth response 1 (Egr1), mRNA. Length = 3112 | Early growth response 1 |
| 1501 | 19407 | NM_012554 | z | *Rattus norvegicus* Enolase 1, alpha (Eno1), mRNA. Length = 1725 | Enolase 1, alpha |
| 1501 | 19408 | NM_012554 | n, s, y, z | *Rattus norvegicus* Enolase 1, alpha (Eno1), mRNA. Length = 1725 | Enolase 1, alpha |

TABLE 1-continued

SUMMARY

Atty. Docket No. 44921-5089US
Doc. No. 1803440.1

| Sequence ID No. | Identifier | GenBank Acc/Ref. Seq ID | Model Code | Gene Name | Unigene Cluster Title |
|---|---|---|---|---|---|
| 1502 | 21836 | NM_012555 | k | *Rattus norvegicus* Ets avian erythroblastosis virus E2 oncogene homolog 1 (tumor progression locus 1) (Ets1), mRNA. Length = 4991 | Ets avian erythroblastosis virus E2 oncogene homolog 1 (tumor progression locus 1) |
| 1503 | 16895 | NM_012558 | g, s | *Rattus norvegicus* Fructose-1,6-biphosphatase (Fbp1), mRNA. Length = 1357 | Fructose-1,6-biphosphatase |
| 1504 | 25317 | NM_012559 | bb | *Rattus norvegicus* Fibrinogen, gamma polypeptide (Fgg), mRNA. Length = 1358 | |
| 1504 | 6477 | NM_012559 | b, bb | *Rattus norvegicus* Fibrinogen, gamma polypeptide (Fgg), mRNA. Length = 1358 | Fibrinogen, gamma polypeptide |
| 1504 | 6478 | NM_012559 | bb | *Rattus norvegicus* Fibrinogen, gamma polypeptide (Fgg), mRNA. Length = 1358 | Fibrinogen, gamma polypeptide |
| 1505 | 11731 | NM_012561 | k | *Rattus norvegicus* Follistatin (Fst), mRNA. Length = 1035 | Follistatin |
| 1507 | 4254 | NM_012564 | a | *Rattus norvegicus* Group-specific component (vitamin D-binding protein) (Gc), mRNA. Length = 1676 | Group-specific component (vitamin D-binding protein) |
| 1508 | 16026 | NM_012578 | r | *Rattus norvegicus* Histone H1-0 (H1f0), mRNA. Length = 1779 | Histone H1-0 |
| 1508 | 16024 | NM_012578 | r | *Rattus norvegicus* Histone H1-0 (H1f0), mRNA. Length = 1779 | Histone H1-0 |
| 1508 | 16025 | NM_012578 | r | *Rattus norvegicus* Histone H1-0 (H1f0), mRNA. Length = 1779 | Histone H1-0 |
| 1509 | 16080 | NM_012580 | g, m | *Rattus norvegicus* Heme oxygenase (Hmox1), mRNA. Length = 870 | Heme oxygenase |
| 1510 | 15098 | NM_012588 | bb | *Rattus norvegicus* Insulin-like growth factor-binding protein (IGF-BP3) (Igfbp3), mRNA. Length = 2352 | Insulin-like growth factor-binding protein (IGF-BP3) |
| 1511 | 4450 | NM_012592 | bb | *Rattus norvegicus* Isovaleryl Coenzyme A dehydrogenase (Ivd), mRNA. Length = 2104 | Isovaleryl Coenzyme A dehydrogenase |
| 1511 | 4451 | NM_012592 | i, bb | *Rattus norvegicus* Isovaleryl Coenzyme A dehydrogenase (Ivd), mRNA. Length = 2104 | Isovaleryl Coenzyme A dehydrogenase |
| 1511 | 4452 | NM_012592 | bb | *Rattus norvegicus* Isovaleryl Coenzyme A dehydrogenase (Ivd), mRNA. Length = 2104 | Isovaleryl Coenzyme A dehydrogenase |
| 1512 | 17198 | NM_012593 | a, x | *Rattus norvegicus* Kallikrein 1, renal/pancreas/salivary (Klk1), mRNA. Length = 786 | Kallikrein 1, renal/pancreas/salivary |
| 1512 | 17197 | NM_012593 | x | *Rattus norvegicus* Kallikrein 1, renal/pancreas/salivary (Klk1), mRNA. Length = 786 | Kallikrein 1, renal/pancreas/salivary |
| 1513 | 18749 | NM_012600 | a, h | *Rattus norvegicus* Malic enzyme 1, soluble (Me1), mRNA. Length = 1761 | Malic enzyme 1, soluble |
| 1514 | 2628 | NM_012603 | General | *Rattus norvegicus* Avian myelocytomatosis viral (v-myc) oncogene homolog (Myc), mRNA. Length = 2168 | Avian myelocytomatosis viral (v-myc) oncogene homolog |
| 1514 | 2629 | NM_012603 | x, General | *Rattus norvegicus* Avian myelocytomatosis viral (v-myc) oncogene homolog (Myc), mRNA. Length = 2168 | Avian myelocytomatosis viral (v-myc) oncogene homolog |
| 1515 | 16849 | NM_012608 | n, o, q | *Rattus norvegicus* Membrane metallo-endopeptidase (neutral endopeptidase/enkephalinase) (Mme), mRNA. Length = 3243 | Membrane metallo-endopeptidase (neutral endopeptidase/enkephalinase) |
| 1517 | 15540 | NM_012620 | General | *Rattus norvegicus* serine (or cysteine) proteinase | Plasminogen activator inhibitor |

TABLE 1-continued

SUMMARY

Atty. Docket No. 44921-5089US
Doc. No. 1803440.1

| Sequence ID No. | Identifier | GenBank Acc/Ref. Seq ID | Model Code | Gene Name | Unigene Cluster Title |
|---|---|---|---|---|---|
| | | | | inhibitor, clade E (nexin, plasminogen activator inhibitor type 1), member 1 (Serpine1), mRNA. Length = 3053 | |
| 1518 | 24568 | NM_012630 | General | *Rattus norvegicus* Prolactin receptor (Prlr), mRNA. Length = 1635 | Prolactin receptor |
| 1518 | 24566 | NM_012630 | General | *Rattus norvegicus* Prolactin receptor (Prlr), mRNA. Length = 1635 | Prolactin receptor |
| 1519 | 18553 | NM_012631 | k | *Rattus norvegicus* Prion protein, structural (Prnp). mRNA. Length = 765 | Prion protein, structural |
| 1520 | 1844 | NM_012637 | General | *Rattus norvegicus* protein tyrosine phosphatase, non-receptor type 1 (Ptpn1), mRNA. Length = 4127 | ESTs, Protein-tyrosine phosphatase |
| 1521 | 24668 | NM_012642 | f | *Rattus norvegicus* Renin (Ren), mRNA. Length = 1059 | Renin |
| 1522 | 18632 | NM_012645 | a | *Rattus norvegicus* RT1 class lb gene (RT1Aw2), mRNA. Length = 1540 | RT1 class lb gene |
| 1523 | 25435 | NM_012647 | g | *Rattus norvegicus* Sodium channel, voltage-gated, type II, alpha polypeptide (Scn2a1), mRNA. Length = 8553 | |
| 1524 | 9423 | NM_012649 | b, cc | *Rattus norvegicus* Ryudocan/syndecan 4 (Sdc4), mRNA. Length = 2462 | Ryudocan/syndecan 4 |
| 1525 | 24496 | NM_012654 | n | *Rattus norvegicus* Solute carrier family 9 (sodium/hydrogen exchanger 3), antiporter 3, Na+/H+ (amiloride insensitive) (Slc9a3), mRNA. Length = 5153 | Solute carrier family 9 (sodium/hydrogen exchanger 3), antiporter 3, Na+/H+ (amiloride insensitive) |
| 1526 | 7101 | NM_012679 | x, bb, General | *Rattus norvegicus* Clusterin (Clu), mRNA. Length = 1638 | Testostrone-repressed prostate message 2 |
| 1527 | 24707 | NM_012693 | i | *Rattus norvegicus* Cytochrome P450 IIA2 (Cyp2a2), mRNA. Length = 2259 | Cytochrome P450 IIA2 |
| 1528 | 1850 | NM_012696 | t | *Rattus norvegicus* T-kininogen, see also D11Elh1 and D11Mit8 (Kng), mRNA. Length = 1417 | T-kininogen |
| 1528 | 1854 | NM_012696 | t | *Rattus norvegicus* T-kininogen, see also D11Elh1 and D11Mit8 (Kng), mRNA. Length = 1417 | K-kininogen, differential splicing leads to HMW Kngk, T-kininogen |
| 1529 | 1603 | NM_012697 | General | *Rattus norvegicus* Organic cation transporter (Slc22a1), mRNA. Length = 1882 | Organic cation transporter |
| 1530 | 1372 | NM_012734 | u | *Rattus norvegicus* Hexokinase 1 (Hk1), mRNA. Length = 3653 | Hexokinase 1 |
| 1531 | 1478 | NM_012744 | bb, General General | *Rattus norvegicus* Pyruvate carboxylase (Pc), mRNA. Length = 3945 | Pyruvate carboxylase |
| 1532 | 343 | NM_012747 | h, t | *Rattus norvegicus* Signal transducer and activator of transcription 3 (Stat3), mRNA. Length = 2924 | Signal transducer and activator of transcription 3 |
| 1533 | 8829 | NM_012749 | General | *Rattus norvegicus* Nucleolin (Ncl), mRNA. Length = 2142 | Nucleolin |
| 1534 | 20828 | NM_012752 | General | *Rattus norvegicus* CD24 antigen (Cd24), mRNA. Length = 1703 | CD24 antigen |
| 1534 | 20829 | NM_012752 | i, General | *Rattus norvegicus* CD24 antigen (Cd24), mRNA. Length = 1703 | CD24 antigen |
| 1534 | 20830 | NM_012752 | i, General | *Rattus norvegicus* CD24 antigen (Cd24), mRNA. Length = 1703 | CD24 antigen |

TABLE 1-continued

SUMMARY

| Sequence ID No. | Identifier | GenBank Acc/Ref. Seq ID | Model Code | Gene Name | Unigene Cluster Title |
|---|---|---|---|---|---|
| 1535 | 15174 | NM_012756 | b | *Rattus norvegicus* Insulin-like growth factor 2 receptor (Igf2r), mRNA. Length = 8810 | Insulin-like growth factor 2 receptor |
| 1536 | 21685 | NM_012760 | j, m, n | *Rattus norvegicus* Lost on transformation 1 (Lot1), mRNA. Length = 5028 | Lost on transformation 1 |
| 1537 | 18068 | NM_012762 | t | *Rattus norvegicus* Interleukin 1beta converting enzyme (Casp1), mRNA. Length = 1209 | Interleukin 1beta converting enzyme |
| 1538 | 1246 | NM_012770 | a, General | *Rattus norvegicus* Guanylate cyclase, soluble, beta 2 (GTP pyrophosphate - lyase) (Gucy1b2), mRNA. Length = 2335 | Guanylate cyclase, soluble beta 2 (GTP pyrophosphate - lyase) |
| 1539 | 1348 | NM_012776 | f | *Rattus norvegicus* adrenergic receptor kinase, beta 1 (Adrbk1), mRNA. Length = 2683 | G-protein-linked receptor kinase (beta adrenergic receptor kinase 1) |
| 1540 | 18135 | NM_012791 | w | *Rattus norvegicus* dual-specificity tyrosine-(Y)-phosphorylation regulated kinase 1a (Dyrk1a), mRNA. Length = 2840 | Dual Specificity Yak1-related kinase, ESTs |
| 1541 | 16947 | NM_012793 | p, bb | *Rattus norvegicus* Guanidinoacetate methyltransferase (Gamt), mRNA. Length = 924 | Guanidinoacetate methyltransferase |
| 1542 | 960 | NM_012796 | u | *Rattus norvegicus* glutathione S-transferase, theta 2 (Gstt2), mRNA. Length = 1258 | glutathione S-transferase, theta 2 |
| 1543 | 260 | NM_012798 | f, u | *Rattus norvegicus* MAL protein gene (Mal), mRNA. Length = 2268 | MAL protein gene |
| 1544 | 556 | NM_012803 | d | *Rattus norvegicus* Protein C (Proc), mRNA. Length = 1543 | Protein C |
| 1545 | 21729 | NM_012804 | q | *Rattus norvegicus* ATP-binding cassette, sub-family D (ALD), member 3 (Abcd3), mRNA. Length = 3324 | ATP-binding cassette, sub-family D (ALD), member 3 |
| 1546 | 15032 | NM_012816 | General | *Rattus norvegicus* alpha-methylacyl-CoA racemase (Amacr), mRNA. Length = 1504 | Methylacyl-CoA racemase alpha |
| 1547 | 24895 | NM_012817 | General | *Rattus norvegicus* Insulin-like growth factor-binding protein 5 (Igfbp5), mRNA. Length = 1630 | Insulin-like growth factor-binding protein 5 |
| 1548 | 18109 | NM_012823 | u, General | *Rattus norvegicus* Annexin A3 (Anx3), mRNA. Length = 1454 | ESTs, Weakly similar to LURT3 annexin III - rat [*R. norvegicus*] |
| 1549 | 373 | NM_012833 | h, l, q, General | *Rattus norvegicus* ATP-binding cassette, sub-family C (CFTR/MRP), member 2 (Abcc2), mRNA. Length = 4918 | Canalicular multispecific organic anion transporter |
| 1550 | 2855 | NM_012838 | e | *Rattus norvegicus* Cystatin beta (Cstb), mRNA. Length = 590 | Cystatin beta |
| 1551 | 11136 | NM_012839 | s | *Rattus norvegicus* Cytochrome C, expressed in somatic tissues (Cycs), mRNA. Length = 318 | Cytochrome C, expressed in somatic tissues |
| 1552 | 20885 | NM_012842 | a | *Rattus norvegicus* Epidermal growth factor (Egf), mRNA. Length = 4801 | Epidermal growth factor |
| 1552 | 20884 | NM_012842 | a, bb | *Rattus norvegicus* Epidermal growth factor (Egf), mRNA. Length = 4801 | Epidermal growth factor |
| 1553 | 18770 | NM_012857 | e | *Rattus norvegicus* Lysosomal associated membrane protein 1 (120 kDa) (Lamp1), mRNA. Length = 2006 | Lysosomal associated membrane protein 1 (120 kDa) |
| 1554 | 20674 | NM_012861 | i | *Rattus norvegicus* O6-methylguanine-DNA | ESTs, Weakly similar to S21348 probable pol polyprotein-related |

TABLE 1-continued

SUMMARY

Atty. Docket No. 44921-5089US
Doc. No. 1803440.1

| Sequence ID No. | Identifier | GenBank Acc/Ref. Seq ID | Model Code | Gene Name | Unigene Cluster Title |
|---|---|---|---|---|---|
| | | | | methyltranferase (Mgmt), mRNA. Length = 812 | protein 4 - rat [*R. norvegicus*], O6-methylguanine-DNA methyltranferase |
| 1555 | 13151 | NM_012862 | a, r, General | *Rattus norvegicus* Matrix Gla protein (Mgp), mRNA. Length = 521 | Matrix Gla protein |
| 1556 | 24617 | NM_012870 | General | *Rattus norvegicus* tumor necrosis factor receptor superfamily, member 11b (osteoprotegerin) (Tnfrsf11b), mRNA. Length = 2432 | Osteoprotegerin |
| 1557 | 20945 | NM_012875 | a, v | Ribosomal protein L39 (Rpl39), mRNA. Length = 324 | Ribosomal protein L39 |
| 1558 | 15872 | NM_012879 | o, r | *Rattus norvegicus* Solute carrier family 2 A2 (gkucose transporter, type 2) (Slc2a2), mRNA. Length = 2573 | Solute carrier family 2 A2 (gkucose transporter, type 2) |
| 1559 | 495 | NM_012880 | z | *Rattus norvegicus* Superoxide dismutase 3 (Sod3), mRNA. Length = 1729 | Superoxide dimutase 3 |
| 1559 | 494 | NM_012880 | c | *Rattus norvegicus* Superoxide dismutase 3 (Sod3), mRNA. Length = 1729 | Superoxide dimutase 3 |
| 1560 | 23651 | NM_012881 | d, u, General | *Rattus norvegicus* Sialoprotein (osteopontin) (Spp1), mRNA. Length = 1457 | Sialoprotein (osteopontin) |
| 1562 | 19477 | NM_012891 | q | *Rattus norvegicus* Acyl-Coa dehydrogenase, Very long chain (Acadvl), mRNA. Length = 2117 | EST, Moderately similar to ACDV RAT ACYL-COA DEHYDROGENASE, VERY-LONG-CHAIN SPECIFIC, MITOCHONDRIAL PRECURSOR [*R. norvegicus*] |
| 1563 | 18564 | NM_012899 | v, General | *Rattus norvegicus* aminolevulinate, delta-, dehydratase (Alad), mRNA. Length = 1116 | Delta - aminolevulinic acid dehydratase |
| 1564 | 7197 | NM_012904 | f, r, cc, General | *Rattus norvegicus* Annexin 1 (p35) (Lipocortin 1) (Anxa1), mRNA. Length = 1402 | Annexin 1 (p35) (Lipocortin 1) |
| 1564 | 7196 | NM_012904 | v, cc, General | *Rattus norvegicus* Annexin 1 (p35) (Lipocortin 1) (Anxa1), mRNA. Length = 1402 | Annexin 1 (p35) (Lipocortin 1) |
| 1565 | 20202 | NM_012909 | b, r | *Rattus norvegicus* Aquaporin 2 (Aqp2), mRNA. Length = 939 | Aquaporin 2 |
| 1566 | 16581 | NM_012911 | c, j | *Rattus norvegicus* Arrestin, beta 2 (Arrb2), mRNA. Length = 1758 | Arrestin, beta 2 |
| 1566 | 16582 | NM_012911 | c | *Rattus norvegicus* Arrestin, beta 2 (Arrb2), mRNA. Length = 1758 | Arrestin, beta 2 |
| 1567 | 24431 | NM_012912 | General | *Rattus norvegicus* Activating transcription factor 3 (Atf3), mRNA. Length = 1893 | Activating transcription factor 3 |
| 1568 | 18118 | NM_012913 | p | *Rattus norvegicus* ATPase, Na+K+ transporting, beta polypeptide 3 (Atp1b3), mRNA. Length = 1818 | ATPase, Na+K+ transporting, beta polypeptide 3 |
| 1569 | 6108 | NM_012915 | n | *Rattus norvegicus* ATPase inhibitor (rat mitochondrial IF1 protein) (Atpi), mRNA. Length = 833 | ATPase inhibitor (rat mitochondrial IF1 protein) |
| 1570 | 20757 | NM_012923 | c, i, aa | *Rattus norvegicus* Cyclin G1 (Ccng1), mRNA. Length = 3169 | Cyclin G1 |
| 1570 | 20755 | NM_012923 | i | *Rattus norvegicus* Cyclin G1 (Ccng1), mRNA. Length = 3169 | Cyclin G1 |
| 1571 | 2830 | NM_012925 | f | *Rattus norvegicus* CD59 antigen (Cd59), mRNA. Length = 1523 | CD59 antigen |
| 1571 | 2831 | NM_012925 | f | *Rattus norvegicus* CD59 antigen (Cd59), mRNA. Length = 1523 | CD59 antigen |
| 1572 | 1977 | NM_012930 | q | *Rattus norvegicus* Carnitine palmitoyltransferase 2 (Cpt2), mRNA. Length = 2296 | Carnitine palmitoyltransferase 2 |

TABLE 1-continued

SUMMARY

Atty. Docket No. 44921-5089US
Doc. No. 1803440.1

| Sequence ID No. | Identifier | GenBank Acc/Ref. Seq ID | Model Code | Gene Name | Unigene Cluster Title |
|---|---|---|---|---|---|
| 1573 | 18694 | NM_012931 | j, l, m, z | *Rattus norvegicus* v-crk-associated tyrosine kinase substrate (Crkas), mRNA. Length = 3335 | v-crk-associated tyrosine kinase substrate |
| 1574 | 13723 | NM_012935 | n | *Rattus norvegicus* Crystallin, alpha polypeptide 2 (Cryab), mRNA. Length = 528 | Crystallin, alpha polypeptide 2, ESTs |
| 1575 | 9109 | NM_012939 | j, y, z | *Rattus norvegicus* Cathepsin H (Ctsh), mRNA. Length = 1362 | Cathepsin H |
| 1575 | 19398 | NM_012939 | aa | *Rattus norvegicus* Cathepsin H (Ctsh), mRNA. Length = 1362 | EST |
| 1576 | 223 | NM_012945 | b, cc | *Rattus norvegicus* Diphtheria toxin receptor (heparin binding epidermal growth factor - like growth factor) (Dtr), mRNA. Length = 1550 | Diphtheria toxin receptor (heparin binding epidermal growth factor - like growth factor) |
| 1577 | 15058 | NM_012950 | cc | *Rattus norvegicus* Thrombin receptor (F2r), mRNA. Length = 3418 | Thrombin receptor |
| 1579 | 19111 | NM_012963 | g | *Rattus norvegicus* High mobility group 1 (Hmg1), mRNA. Length = 1225 | High mobility group 1 |
| 1580 | 19374 | NM_012964 | x | *Rattus norvegicus* Hyaluronan mediated motility receptor (RHAMM) (Hmmr), mRNA. Length = 2049 | Hyaluronan mediated motility receptor (RHAMM) |
| 1581 | 2554 | NM_012967 | t | *Rattus norvegicus* Intercellular adhesion molecule 1 (Icam1), mRNA. Length = 2602 | Intercellular adhesion molecule 1 |
| 1581 | 2555 | NM_012967 | t, cc, General | *Rattus norvegicus* Intercellular adhesion molecule 1 (Icam1), mRNA. Length = 2602 | Intercellular adhesion molecule 1 |
| 1582 | 24528 | NM_012973 | c | *Rattus norvegicus* Potassium (K+) channel protein, slowly activating (lsk) (Kcne1), mRNA. Length = 585 | Potassium (K+) channel protein, slowly activating (lsk) |
| 1583 | 956 | NM_012976 | c | *Rattus norvegicus* Lectin, galactose binding, soluble 5 (Galectin-5) (Lgals5), mRNA. Length = 872 | Lectin, galactose binding, soluble 9 (Galectin-9) |
| 1584 | 16417 | NM_012991 | g | *Rattus norvegicus* Nucleoprotein 50 kD (Nup50), mRNA. Length = 3027 | Nuclear pore associated protein |
| 1585 | 17393 | NM_012992 | d | *Rattus norvegicus* Nucleoplasmin-related protein (Nuclear protein B23 (Npm1), mRNA. Length = 1232 | Nucleoplasmin-related protein (Nuclear protein B23 |
| 1586 | 23544 | NM_013013 | s | *Rattus norvegicus* Prosaposin (sulfated glycoprotein, sphingolipid hydrolase activator) (Psap), mRNA. Length = 2175 | Prosaposin (sulfated glycoprotein, sphingolipid hydrolase activator) |
| 1587 | 1588 | NM_013026 | k | *Rattus norvegicus* Syndecan 1 (Sdc1), mRNA. Length = 2410 | Syndecan 1 |
| 1588 | 17894 | NM_013027 | m | *Rattus norvegicus* Selenoprotein W muscle 1 (Sepw1), mRNA. Length = 664 | Selenoprotein W muscle 1 |
| 1589 | 18300 | NM_013030 | s, v, General | *Rattus norvegicus* Solute carrier family 17 (sodium/hydrogen exchanger), member 2 (Slc34a1), mRNA. Length = 2440 | *Rattus norvegicus* mRNA for NaPi-2 alpha, complete cds |
| 1589 | 18076 | NM_013030 | g, s, z | *Rattus norvegicus* Solute carrier family 17 (sodium/hydrogen exchanger), member 2 (Slc34a1), mRNA. Length = 2440 | Solute carrier family 17 (sodium/hydrogen exchanger), member 2 |
| 1589 | 18078 | NM_013030 | s | *Rattus norvegicus* Solute carrier family 17 (sodium/hydrogen | *Rattus norvegicus* mRNA for NaPi-2 alpha, complete cds, Solute carrier family 17 (sodium/hydrogen |

TABLE 1-continued

SUMMARY

Atty. Docket No. 44921-5089US
Doc. No. 1803440.1

| Sequence ID No. | Identifier | GenBank Acc/Ref. Seq ID | Model Code | Gene Name | Unigene Cluster Title |
|---|---|---|---|---|---|
| | | | | exchanger), member 2 (Slc34a1), mRNA. Length = 2440 | exchanger), member 2 |
| 1589 | 18077 | NM_013030 | e, s, z | Rattus norvegicus Solute carrier family 17 (sodium/hydrogen exchanger), member 2 (Slc34a1), mRNA. Length = 2440 | Solute carrier family 17 (sodium/hydrogen exchanger), member 2 |
| 1591 | 730 | NM_013040 | w | Rattus norvegicus ATP-binding cassette, sub-family C (CFTR/MRP), member 9 (Abcc9), mRNA. Length = 5000 | Sulfonylurea receptor 2 |
| 1592 | 17401 | NM_013043 | i, o, General | Rattus norvegicus Transforming growth factor beta stimulated clone 22 (Tgfb1i4), mRNA. Length = 1666 | Transforming growth factor beta stimulated clone 22 |
| 1593 | 16684 | NM_013052 | General | Rattus norvegicus Tyrosine 3 monooxygenase/tryptophan 5-monooxygenase activation protein, eta polypeptide (Ywhah), mRNA. Length = 1689 | Tyrosine 3-monooxygenase/tryptophan 5-monooxygenase activation protein, eta polypeptide |
| 1594 | 14421 | NM_013053 | u | Rattus norvegicus Tyrosine 3 monooxygenase/tryptophan 5-monooxygenase activation protein, theta polypeptide (Ywhaq), mRNA. Length = 2099 | Tyrosine 3-monooxygenase/tryptophan 5-monooxygenase activation protein, theta polypeptide |
| 1595 | 15254 | NM_013058 | k | Rattus norvegicus Inhibitor of DNA binding 3, dominant negative helix-loop-helix protein (Id3), mRNA. Length = 568 | Inhibitor of DNA binding 3, dominant negative helix-loop-helix protein |
| 1596 | 14997 | NM_013059 | s, z | Rattus norvegicus Tissue-nonspecific ALP alkaline phosphatase (Alpl), mRNA. Length = 2415 | Tissue-nonspecific ALP alkaline phosphatase |
| 1596 | 14996 | NM_013059 | General | Rattus norvegicus Tissue-nonspecific ALP alkaline phosphatase (Alpl), mRNA. Length = 2415 | Tissue-nonspecific ALP alkaline phosphatase |
| 1597 | 25676 | NM_013069 | aa | Rattus norvegicus CD74 antigen (invariant polpypeptide of major histocompatibility class II antigen-associated) (Cd74), mRNA. Length = 1150 | |
| 1597 | 16924 | NM_013069 | o | Rattus norvegicus CD74 antigen (invariant polpypeptide of major histocompatibility class II antigen-associated) (Cd74), mRNA Length = 1150 | CD74 antigen (invariant polpypeptide of major histocompatibility class II antigen-associated) |
| 1598 | 24748 | NM_013070 | h, q | Rattus norvegicus Utrophin (Utrn), mRNA. Length = 10,705 | Utrophin |
| 1599 | 1529 | NM_013082 | d, General | Rattus norvegicus Ryudocan/syndecan 2 (Sdc2), mRNA. Length = 2153 | Ryudocan/syndecan 2 |
| 1600 | 1521 | NM_013091 | j, l, z, General | Rattus norvegicus Tumor necrosis factor receptor superfamily, member 1a (Tnfr1), mRNA. Length = 2130 | Tumor necrosis factor receptor |
| 1601 | 1685 | NM_013096 | c, aa | Rattus norvegicus Hemoglobin, alpha 1 (Hba1), mRNA. Length = 556 | Hemoglobin, alpha 1 |
| 1601 | 26150 | NM_013096 | c, i | Rattus norvegicus Hemoglobin, alpha 1 (Hba1), mRNA. Length = 556 | |
| 1601 | 1688 | NM_013096 | p | Rattus norvegicus Hemoglobin, alpha 1 (Hba1), mRNA. Length = 556 | Hemoglobin, alpha 1 |
| 1601 | 1689 | NM_013096 | c, p | Rattus norvegicus Hemoglobin, alpha 1 (Hba1), mRNA. Length = 556 | Hemoglobin, alpha 1 |

TABLE 1-continued

SUMMARY

Atty. Docket No. 44921-5089US
Doc. No. 1803440.1

| Sequence ID No. | Identifier | GenBank Acc/Ref. Seq ID | Model Code | Gene Name | Unigene Cluster Title |
|---|---|---|---|---|---|
| 1601 | 1684 | NM_013096 | c, s, aa | *Rattus norvegicus* Hemoglobin, alpha 1 (Hba1), mRNA. Length = 556 | Hemoglobin, alpha 1 |
| 1602 | 20886 | NM_013097 | u, x, bb | *Rattus norvegicus* Deoxyribonuclease I (Dnase1), mRNA. Length = 1143 | Deoxyribonuclease I |
| 1602 | 20887 | NM_013097 | u, x, bb | *Rattus norvegicus* Deoxyribonuclease I (Dnase1), mRNA. Length = 1143 | Deoxyribonuclease I |
| 1603 | 1321 | NM_013098 | c | *Rattus norvegicus* Glucose-6-phosphatase (G6pc), mRNA. Length = 2237 | Glucose-6-phosphatase |
| 1604 | 15296 | NM_013102 | l, m | *Rattus norvegicus* FK506-binding protein 1 (12 kD) (Fkbp1a), mRNA. Length = 554 | FK506-binding protein 1 (12 kD) |
| 1606 | 23709 | NM_013113 | o, s, z, aa | *Rattus norvegicus* ATPase Na+/K+ transporting beta 1 polypeptide (Atp1b1), mRNA. Length = 2528 | ATPase Na+/K+ transporting beta 1 polypeptide |
| 1606 | 23711 | NM_013113 | p | *Rattus norvegicus* ATPase Na+/K+ transporting beta 1 polypeptide (Atp1b1), mRNA Length = 2528 | ATPase Na+/K+ transporting beta 1 polypeptide |
| 1606 | 23710 | NM_013113 | s | *Rattus norvegicus* ATPase Na+/K+ transporting beta 1 polypeptide (Atp1b1), mRNA. Length = 2528 | ATPase Na+/K+ transporting beta 1 polypeptide |
| 1607 | 1976 | NM_013118 | u | *Rattus norvegicus* Guanylate cyclase activator 2 (guanylin) (Guca2a), mRNA. Length = 567 | Guanylate cyclase activator 2 (guanylin) |
| 1609 | 870 | NM_013130 | h | *Rattus norvegicus* MAD (mothers against decapentaplegic, Drosophila) homolog 1 (Madh1), mRNA Length = 2002 | MAD (mothers against decapentaplegic, Drosophila) homolog 1 |
| 1610 | 16650 | NM_013132 | u, General | *Rattus norvegicus* Annexin V (Anx5), mRNA. Length = 1417 | Annexin V |
| 1611 | 650 | NM_013134 | h | *Rattus norvegicus* 3-hydroxy-3-methylglutaryl-Coenzyme A reductase (Hmgcr), mRNA. Length = 2664 | 3-hydroxy-3-methylglutaryl-Coenzyme A reductase |
| 1611 | 651 | NM_013134 | h, j, l | *Rattus norvegicus* 3-hydroxy-3-methylglutaryl-Coenzyme A reductase (Hmgcr), mRNA. Length = 2664 | 3-hydroxy-3-methylglutaryl-Coenzyme A reductase |
| 1612 | 1712 | NM_013138 | General | *Rattus norvegicus* Inositol 1, 4, 5-triphosphate receptor 3 (Itpr3), mRNA Length = 8806 | Inositol 1, 4, 5-triphosphate receptor 3 |
| 1613 | 16982 | NM_013144 | o, v, General | *Rattus norvegicus* Insulin-like growth factor binding protein 1 (Igfbp1), mRNA. Length = 1500 | Insulin-like growth factor binding protein 1 |
| 1614 | 21683 | NM_013154 | t, cc, General | *Rattus norvegicus* CCAAT/enhancerbinding, protein (C/EBP) delta (Cebpd), mRNA. Length = 1200 | CCAAT/enhancerbinding, protein (C/EBP) delta |
| 1614 | 21682 | NM_013154 | cc | *Rattus norvegicus* CCAAT/enhancerbinding, protein (C/EBP) delta (Cebpd), mRNA Length = 1200 | CCAAT/enhancerbinding, protein (C/EBP) delta |
| 1615 | 3431 | NM_013156 | b, g, n | *Rattus norvegicus* Cathepsin L (Ctsl), mRNA Length = 1386 | Cathepsin L |
| 1615 | 25567 | NM_013156 | v, General | *Rattus norvegicus* Cathepsin L (Ctsl), mRNA. Length = 1386 | |
| 1615 | 3430 | NM_013156 | General | *Rattus norvegicus* Cathepsin L (Ctsl), mRNA. Length = 1386 | Cathepsin L |
| 1616 | 1309 | NM_013159 | w | *Rattus norvegicus* Insulin degrading enzyme (Ide), mRNA. Length = 4276 | Insulin degrading enzyme |
| 1616 | 1310 | NM_013159 | w | *Rattus norvegicus* Insulin degrading enzyme (Ide), mRNA Length = 4276 | Insulin degrading enzyme |

TABLE 1-continued

SUMMARY

Atty. Docket No. 44921-5089US
Doc. No. 1803440.1

| Sequence ID No. | Identifier | GenBank Acc/Ref. Seq ID | Model Code | Gene Name | Unigene Cluster Title |
|---|---|---|---|---|---|
| 1617 | 21723 | NM_013174 | w | *Rattus norvegicus* Transforming growth factor, beta 3 (Tgfb3), mRNA. Length = 2633 | Transforming growth factor, beta 3 |
| 1618 | 1314 | NM_013181 | m | *Rattus norvegicus* Protein kinase, cAMP dependent, regulatory, type 1 (Prkar1a), mRNA. Length = 1433 | Protein kinase, cAMP dependent, regulatory, type 1 |
| 1619 | 17357 | NM_013183 | p, bb, General | *Rattus norvegicus* Meprin 1 beta (Mep1b), mRNA Length = 2290 | Meprin 1 beta |
| 1620 | 1300 | NM_013190 | y | *Rattus norvegicus* Phosphofructokinase, liver, B-type (Pfkl), mRNA. Length = 2740 | Phosphofructokinase, liver, B-type |
| 1621 | 16448 | NM_013197 | c | *Rattus norvegicus* Aminolevulinate synthase 2, delta (Alas2), mRNA. Length = 1899 | Aminolevulinate synthase 2, delta |
| 1622 | 20856 | NM_013200 | b | *Rattus norvegicus* Carnitine palmitoyltransferase 1 beta, muscle isoform (Cpt1b), mRNA Length = 2826 | Carnitine palmitoyltransferase 1 beta, muscle isoform |
| 1623 | 397 | NM_013214 | f | *Rattus norvegicus* acyl-CoA hydrolase (RBACH), mRNA Length = 1523 | *Rattus norvegicus* brain cytosolic acyl coenzyme A thioester hydrolase mRNA, complete cds, acyl-CoA hydrolase |
| 1624 | 20864 | NM_013215 | g, n, y | *Rattus norvegicus* aflatoxin B1 aldehyde reductase (AFAR), mRNA. Length = 1272 | aflatoxin B1 aldehyde reductase |
| 1625 | 20728 | NM_013217 | v | *Rattus norvegicus* afadin (AF 6), mRNA. Length = 5957 | afadin |
| 1626 | 1396 | NM_013222 | j | *Rattus norvegicus* augmenter of liver regeneration (ALR), mRNA. Length = 1226 | augmenter of liver regeneration |
| 1627 | 815 | NM_013224 | w | *Rattus norvegicus* ribosomal protein S26 (Rps26), mRNA. Length = 435 | ribosomal protein S26 |
| 1628 | 18305 | NM_013226 | v | *Rattus norvegicus* ribosomal protein L32 (Rpl32), mRNA. Length = 465 | |
| 1629 | 21078 | NM_016986 | d | *Rattus norvegicus* Acyl-Coenzyme A dehydrogenase, C-4 to C-12 straight-chain (Acadm), mRNA Length = 1866 | Acyl-Coenzyme A dehydrogenase, C-4 to C-12 straight-chain |
| 1630 | 24649 | NM_016988 | v | *Rattus norvegicus* Acid phosphatase 2, lysozymal (Acp2), mRNA. Length = 2009 | Acid phosphatase 2, lysozymal |
| 1631 | 15239 | NM_016989 | q, w | *Rattus norvegicus* adenylate cyclase activating polypeptide 1 (Adcyap1), mRNA. Length = 2681 | *R. norvegicus* (Sprague Dawley) ribosomal protein L15 mRNA |
| 1632 | 45 | NM_016996 | General | *Rattus norvegicus* Calcium-sensing receptor (hypocalciuric hypercalcemia 1, severe neonatal hyperparathyroidism) (Casr), mRNA. Length = 4113 | Calcium-sensing receptor (hypocalciuric hypercalcemia 1, severe neonatal hyperparathyroidism) |
| 1633 | 20714 | NM_016999 | t | *Rattus norvegicus* Cytochrome P450, subfamily IVB, polypeptide 1 (Cyp4b1), mRNA. Length = 2462 | Cytochrome P450, subfamily IVB, polypeptide 1 |
| 1633 | 20713 | NM_016999 | t | *Rattus norvegicus* Cytochrome P450, subfamily IVB, polypeptide 1 (Cyp4b1), mRNA. Length = 2462 | Cytochrome P450, subfamily IVB, polypeptide 1 |
| 1633 | 20711 | NM_016999 | q, t | *Rattus norvegicus* Cytochrome P450, subfamily IVB, polypeptide 1 (Cyp4b1), mRNA. Length = 2462 | Cytochrome P450, subfamily IVB, polypeptide 1 |
| 1633 | 20715 | NM_016999 | q, t | *Rattus norvegicus* Cytochrome P450, subfamily | Cytochrome P450, subfamily IVB, polypeptide 1 |

TABLE 1-continued

SUMMARY

Atty. Docket No. 44921-5089US
Doc. No. 1803440.1

| Sequence ID No. | Identifier | GenBank Acc/Ref. Seq ID | Model Code | Gene Name | Unigene Cluster Title |
|---|---|---|---|---|---|
| | | | | IVB, polypeptide 1 (Cyp4b1), mRNA. Length = 2462 | |
| 1634 | 1698 | NM_017000 | e, n, p, General | *Rattus norvegicus* Diaphorase (NADH/NADPH) (Dia4), mRNA. Length = 1396 | Diaphorase (NADH/NADPH) |
| 1635 | 1399 | NM_017006 | h, n, General | *Rattus norvegicus* Glucose-6-phosphate dehydrogenase (G6pd), mRNA. Length = 2324 | Glucose-6-phosphate dehydrogenase |
| 1637 | 18989 | NM_017013 | n | *Rattus norvegicus* Glutathione-S-transferase, alpha type (Yc?) (Gsta2), mRNA. Length = 830 | Glutathione-S-transferase, alpha type (Yc?) |
| 1638 | 21013 | NM_017014 | e, f | *Rattus norvegicus* Glutathione-S-transferase, mu type 2 (Yb2) (Gstm2), mRNA Length = 1055 | Glutathione-S-transferase, mu type 2 (Yb2) |
| 1638 | 21015 | NM_017014 | e, General | *Rattus norvegicus* Glutathione-S-transferase, mu type 2 (Yb2) (Gstm2), mRNA. Length = 1055 | Glutathione-S-transferase, mu type 2 (Yb2) |
| 1639 | 11836 | NM_017023 | b | *Rattus norvegicus* Potassium inwardly-rectifying channel, subfamily J (Kcnj1), mRNA Length = 2069 | Potassium inwardly-rectifying channel, subfamily J |
| 1639 | 5475 | NM_017023 | b | *Rattus norvegicus* Potassium inwardly-rectifying channel, subfamily J (Kcnj1), mRNA. Length = 2069 | ESTs, Potassium inwardly-rectifying channel, subfamily J |
| 1639 | 25546 | NM_017023 | b, bb | *Rattus norvegicus* Potassium inwardly-rectifying channel, subfamily J (Kcnj1), mRNA. Length = 2069 | |
| 1640 | 17807 | NM_017025 | i, General | *Rattus norvegicus* Lactate dehydrogenase A (Ldha), mRNA Length = 1609 | Lactate dehydrogenase A |
| 1641 | 24597 | NM_017040 | u | *Rattus norvegicus* Protein phosphatase 2 (formerly 2A), catalytic subunit, beta isoform (Ppp2cb), mRNA Length = 1843 | Protein phosphatase 2 (formerly 2A), catalytic subunit, beta isoform |
| 1642 | 24696 | NM_017048 | f, j, z | *Rattus norvegicus* Solute carrier family 4, member 2, anion exchange protein 2 (Slc4a2), mRNA Length = 4057 | Solute carrier family 4, member 2, anion exchange protein 2 |
| 1643 | 24695 | NM_017049 | u | *Rattus norvegicus* Solute carrier family 4, member 3, anion exchange protein 3 (Slc4a3), mRNA. Length = 3877 | Solute carrier family 4, member 3, anion exchange protein 3 |
| 1644 | 20876 | NM_017050 | j, n, z | *Rattus norvegicus* Superoxide dismutase 1, soluble (Sod1), mRNA. Length = 650 | Superoxide dimutase 1, soluble |
| 1645 | 910 | NM_017059 | f, l, m | *Rattus norvegicus* Bcl2-associated X protein (Bax), mRNA. Length = 579 | Bcl2-associated X protein |
| 1645 | 912 | NM_017059 | i | *Rattus norvegicus* Bcl2-associated X protein (Bax), mRNA Length = 579 | Bcl2-associated X protein |
| 1646 | 1946 | NM_017061 | h | *Rattus norvegicus* Lysyl oxidase (Lox), mRNA Length = 4557 | Lysyl oxidase |
| 1646 | 1942 | NM_017061 | t, General | *Rattus norvegicus* Lysyl oxidase (Lox), mRNA. Length = 4557 | Lysyl oxidase |
| 1646 | 1943 | NM_017061 | t | *Rattus norvegicus* Lysyl oxidase (Lox), mRNA. Length = 4557 | Lysyl oxidase |
| 1647 | 6062 | NM_017066 | d | *Rattus norvegicus* Pleiotrophin (Heparine binding factor, Hbnf, in the mouse) (Ptn), mRNA. Length = 1246 | Pleiotrophin (Heparine binding factor, Hbnf, in the mouse) |

TABLE 1-continued

SUMMARY

| Sequence ID No. | Identifier | GenBank Acc/Ref. Seq ID | Model Code | Gene Name | Unigene Cluster Title |
|---|---|---|---|---|---|
| 1648 | 6654 | NM_017068 | w | *Rattus norvegicus* Lysosomal-associated membrane protein 2 (Lamp2), mRNA. Length = 1548 | Lysosomal-associated membrane protein 2 |
| 1649 | 11153 | NM_017073 | s | *Rattus norvegicus* Glutamine synthetase (glutamate-ammonia ligase) (Glul), mRNA Length = 2793 | Glutamine synthetase (glutamate-ammonia ligase) |
| 1650 | 923 | NM_017076 | General | *Rattus norvegicus* Tumor-associated glycoprotein pE4 (Tage4), mRNA. Length = 2171 | Tumor-associated glycoprotein pE4 |
| 1651 | 1523 | NM_017079 | s | *Rattus norvegicus* CD1D antigen (Cd1d), mRNA Length = 1835 | CD1D antigen |
| 1652 | 23660 | NM_017080 | s | *Rattus norvegicus* Hydroxysteroid dehydrogenase, 11 beta type 1 (Hsd11b1), mRNA Length = 1265 | Hydroxysteroid dehydrogenase, 11 beta type 1 |
| 1653 | 275 | NM_017081 | b, d, General | *Rattus norvegicus* Hydroxysteroid dehydrogenase, 11 beta type 2 (Hsd11b2), mRNA. Length = 1864 | Hydroxysteroid dehydrogenase, 11 beta type 2 |
| 1654 | 16211 | NM_017082 | j, s, z | *Rattus norvegicus* Urmodulin (Tamm-Horsfall protein) (Umod), mRNA Length = 2227 | Urmodulin (Tamm-Horsfall protein) |
| 1655 | 1552 | NM_017084 | j | *Rattus norvegicus* Glycine methyltransferase (Gnmt), mRNA Length = 988 | Glycine methyltransferase |
| 1655 | 1550 | NM_017084 | y | *Rattus norvegicus* Glycine methyltransferase (Gnmt), mRNA. Length = 988 | Glycine methyltransferase |
| 1656 | 22552 | NM_017087 | a, k, x | *Rattus norvegicus* Small proteoglycan I (biglycan), bone (BSPG1) (bone/cartilage proteclycan 1 precursor) (Bgn), mRNA Length = 2446 | Small proteoglycan I (biglycan), bone (BSPG1) (bone/cartilage proteclycan 1 precursor) |
| 1657 | 8888 | NM_017090 | m | *Rattus norvegicus* guanylate cyclase 1, soluble, alpha 3 (Gucy1a3), mRNA Length = 4775 | Guanylate cyclase, soluble, alpha 1 (GTP pyrophosphate - lyase) |
| 1658 | 10887 | NM_017094 | a, General | *Rattus norvegicus* Growth hormone receptor (Ghr), mRNA Length = 2950 | Growth hormone receptor |
| 1659 | 4393 | NM_017101 | a, y | *Rattus norvegicus* Peptidylprolyl isomerase A (cyclophilin A) (Ppia), mRNA Length = 743 | Peptidylprolyl isomerase A (cyclophilin A) |
| 1660 | 24770 | NM_017111 | d | *Rattus norvegicus* solute carrier family (organic anion transporter) member 1 (Slc21a1), mRNA. Length = 2758 | solute carrier family (organic anion transporter) member 1 |
| 1661 | 20745 | NM_017113 | e | *Rattus norvegicus* granulin (Grn), mRNA. Length = 2113 | granulin |
| 1661 | 20746 | NM_017113 | a | *Rattus norvegicus* granulin (Grn), mRNA. Length = 2113 | granulin |
| 1662 | 1375 | NM_017122 | w | *Rattus norvegicus* hippocalcin (Hpca), mRNA. Length = 1561 | hippocalcin |
| 1663 | 12903 | NM_017124 | k | *Rattus norvegicus* CD37 antigen (Cd37), mRNA. Length = 1158 | CD37 antigen |
| 1664 | 24885 | NM_017138 | r | *Rattus norvegicus* laminin receptor 1 (Lamr1), mRNA Length = 1018 | laminin receptor 1 |
| 1664 | 24886 | NM_017138 | d, q | *Rattus norvegicus* laminin receptor 1 (Lamr1), mRNA. Length = 1018 | laminin receptor 1 |
| 1665 | 15363 | NM_017147 | n, u | *Rattus norvegicus* cofilin 1, non-muscle (Cfl1), mRNA. Length = 1039 | cofilin 1, non-muscle |

TABLE 1-continued

SUMMARY

Atty. Docket No. 44921-5089US
Doc. No. 1803440.1

| Sequence ID No. | Identifier | GenBank Acc/Ref. Seq ID | Model Code | Gene Name | Unigene Cluster Title |
|---|---|---|---|---|---|
| 1666 | 13392 | NM_017148 | u, General | Rattus norvegicus cysteine rich protein 1 (Csrp 1), mRNA. Length = 1403 | cysteine rich protein |
| 1667 | 5351 | NM_017150 | q | Rattus norvegicus ribosomal protein L29 (Rpl29), mRNA Length = 630 | ribosomal protein L29 |
| 1668 | 16954 | NM_017151 | a, n | Rattus norvegicus ribosomal protein S15 (Rps15), mRNA. Length = 487 | ribosomal protein S15 |
| 1669 | 21643 | NM_017152 | g | Rattus norvegicus ribosomal protein S17 (Rps17), mRNA. Length = 466 | ribosomal protein S17 |
| 1670 | 1694 | NM_017153 | a, q | Rattus norvegicus ribosomal protein S3a (Rps3a), mRNA. Length = 880 | ribosomal protein S3a |
| 1671 | 17104 | NM_017160 | bb, General | Rattus norvegicus ribosomal protein S6 (Rps6), mRNA. Length = 801 | ribosomal protein S6 |
| 1671 | 17106 | NM_017160 | u | Rattus norvegicus ribosomal protein S6 (Rps6), mRNA. Length = 801 | ribosomal protein S6 |
| 1671 | 17107 | NM_017160 | d, e | Rattus norvegicus ribosomal protein S6 (Rps6), mRNA. Length = 801 | ribosomal protein S6 |
| 1672 | 17686 | NM_017165 | n, q | Rattus norvegicus glutathione peroxidase 4 (Gpx4), mRNA. Length = 872 | glutathione peroxidase 4 |
| 1673 | 20702 | NM_017166 | c | Rattus norvegicus Leukemia-associatedcytosolic phosphoprotein stathmin (Lap18), mRNA. Length = 1054 | Leukemia-associated cytosolic phosphoprotein stathmin |
| 1674 | 3513 | NM_017177 | r | Rattus norvegicus choline/ethanolamine kinase (Chetk), mRNA. Length = 1679 | choline/ethanolamine kinase |
| 1675 | 19031 | NM_017180 | v, General | Rattus norvegicus T-cell death associated gene (Tdag), mRNA. Length = 1353 | T-cell death associated gene |
| 1676 | 15437 | NM_017187 | x, z | Rattus norvegicus high mobility group box 2 (Hmgb2), mRNA. Length = 1072 | high mobility group protein 2 |
| 1676 | 15433 | NM_017187 | y | Rattus norvegicus high mobility group box 2 (Hmgb2), mRNA. Length = 1072 | high mobility group protein 2 |
| 1676 | 15434 | NM_017187 | x, z | Rattus norvegicus high mobility group box 2 (Hmgb2), mRNA. Length = 1072 | high mobility group protein 2 |
| 1677 | 24437 | NM_017190 | p | Rattus norvegicus Myelin-associated glycoprotein (Mag), mRNA. Length = 2474 | Myelin-associated glycoprotein |
| 1678 | 1542 | NM_017193 | j, l, m, z | Rattus norvegicus kynurenine aminotransferase II (Kat2), mRNA. Length = 1828 | kynurenine aminotransferase II |
| 1679 | 14695 | NM_017202 | q, s | Rattus norvegicus cytochrome c oxidase, subunit IVa (Cox4a), mRNA. Length = 696 | cytochrome c oxidase, subunit IV |
| 1679 | 14694 | NM_017202 | s, z | Rattus norvegicus cytochrome c oxidase, subunit IVa (Cox4a), mRNA. Length = 696 | cytochrome c oxidase, subunit IV |
| 1680 | 1428 | NM_017213 | m | Rattus norvegicus outer dense fiber of sperm tails 2 (Odf2), mRNA. Length = 2451 | outer dense fiber of sperm tails 2 |
| 1681 | 1622 | NM_017216 | g, j, s, z | Rattus norvegicus solute carrier family 3, member 1 (Slc3a1), mRNA. Length = 2305 | solute carrier family 3, member 1 |
| 1682 | 13642 | NM_017220 | v | Rattus norvegicus 6-pyruvoyl tetrahydropterin synthase (Pts), mRNA. Length = 1176 | ESTs |
| 1682 | 19976 | NM_017220 | w | Rattus norvegicus 6-pyruvoyl tetrahydropterin synthase (Pts), mRNA. Length = 1176 | ESTs |

TABLE 1-continued

SUMMARY

Atty. Docket No. 44921-5089US
Doc. No. 1803440.1

| Sequence ID No. | Identifier | GenBank Acc/Ref. Seq ID | Model Code | Gene Name | Unigene Cluster Title |
|---|---|---|---|---|---|
| 1683 | 1510 | NM_017224 | General | *Rattus norvegicus* organic cationic transporter-like 1 (Orctl1), mRNA. Length = 2227 | organic cationic transporter-like 1 |
| 1684 | 1811 | NM_017228 | j, l, m, z | *Rattus norvegicus* dentatorubral pallidoluysian atrophy (Drpla), mRNA. Length = 4387 | dentatorubral pallidoluysian atrophy |
| 1686 | 17563 | NM_017245 | a, c, e, q | *Rattus norvegicus* eukaryotic translation elongation factor 2 (Eef2), mRNA. Length = 2626 | eukaryotic translation elongation factor 2 |
| 1687 | 17502 | NM_017248 | r | *Rattus norvegicus* heterogeneous nuclear ribonucleoprotein A1 (Hnrpa1), mRNA. Length = 1696 | heterogeneous nuclear ribonucleoprotein A1 |
| 1687 | 17501 | NM_017248 | x | *Rattus norvegicus* heterogeneous nuclear ribonucleoprotein A1 (Hnrpa1), mRNA. Length = 1696 | heterogeneous nuclear ribonucleoprotein A1 |
| 1688 | 19 | NM_017258 | v, General | *Rattus norvegicus* B-cell translocation gene 1, anti-proliferative (Btg1), mRNA. Length = 1464 | B-cell translocation gene 1, anti-proliferative |
| 1689 | 15300 | NM_017259 | i, v, cc, General | *Rattus norvegicus* B-cell translocation gene 2, anti-proliferative (Btg2), mRNA. Length = 2519 | B-cell translocation gene 2, anti-proliferative |
| 1689 | 15301 | NM_017259 | l, m, v, aa, cc, General | *Rattus norvegicus* B-cell translocation gene 2, anti-proliferative (Btg2), mRNA. Length = 2519 | B-cell translocation gene 2, anti-proliferative |
| 1689 | 15299 | NM_017259 | l, y, cc, General | *Rattus norvegicus* B-cell translocation gene 2, anti-proliferative (Btg2), mRNA Length = 2519 | B-cell translocation gene 2, anti-proliferative |
| 1690 | 15224 | NM_017264 | d | *Rattus norvegicus* protease (prosome, macropain) 28 subunit, alpha (Psme1), mRNA. Length = 921 | protease (prosome, macropain) 28 subunit, alpha |
| 1691 | 3987 | NM_017280 | bb | *Rattus norvegicus* proteasome (prosome, macropain) subunit, alpha type 3 (Psma3), mRNA. Length = 897 | proteasome (prosome, macropain) subunit, alpha type 3 |
| 1692 | 1447 | NM_017281 | l | *Rattus norvegicus* proteasome (prosome, macropain) subunit, alpha type 4 (Psma4), mRNA. Length = 1121 | proteasome (prosome, macropain) subunit, alpha type 4 |
| 1693 | 15535 | NM_017283 | s, bb | *Rattus norvegicus* proteasome (prosome, macropain) subunit, alpha type 6 (Psma6), mRNA Length = 932 | proteasome (prosome, macropain) subunit, alpha type 6 |
| 1694 | 12349 | NM_017290 | General | *Rattus norvegicus* ATPase, Ca++ transporting, cardiac muscle, slow twitch 2 (Atp2a2), mRNA. Length = 5648 | ATPase, Ca++ transporting, cardiac muscle, slow twitch 2 |
| 1695 | 15819 | NM_017298 | p | *Rattus norvegicus* calcium channel, voltage-dependent, L type, alpha 1D subunit (Cacna1d), mRNA. Length = 7986 | calcium channel, voltage-dependent, L type, alpha 1D subunit |
| 1696 | 23825 | NM_017299 | v | *Rattus norvegicus* solute carrier family 19 (sodium/hydrogen exchanger), member 1 (Slc19a1), mRNA. Length = 2402 | solute carrier family 19 (sodium/hydrogen exchanger), member 1 |
| 1696 | 23826 | NM_017299 | v | *Rattus norvegicus* solute carrier family 19 (sodium/hydrogen exchanger), member 1 (Slc19a1), mRNA. Length = 2402 | solute carrier family 19 (sodium/hydrogen exchanger), member 1 |

TABLE 1-continued

SUMMARY

| Sequence ID No. | Identifier | GenBank Acc/Ref. Seq ID | Model Code | Gene Name | Unigene Cluster Title |
|---|---|---|---|---|---|
| 1697 | 14003 | NM_017305 | j, l, m, y, z | *Rattus norvegicus* glutamate-cysteine ligase, modifier subunit (Gclm), mRNA. Length = 1382 | Glutamate-cysteine ligase (gamma-glutamylcysteine synthetase), regulatory |
| 1698 | 26109 | NM_017306 | q, s | *Rattus norvegicus* dodecenoyl-Coenzyme A delta isomerase (3,2 trans-enoyl-Coenyme A isomerase) (DCI), mRNA. Length = 972 | EST |
| 1698 | 18687 | NM_017306 | q, t | *Rattus norvegicus* dodecenoyl-Coenzyme A delta isomerase (3,2 trans-enoyl-Coenyme A isomerase) (DCI), mRNA. Length = 972 | Rat mRNA for delta3, delta2-enoyl-CoA isomerase, dodecenoyl-Coenzyme A delta isomerase (3,2 trans-enoyl-Coenyme A isomerase) |
| 1699 | 18142 | NM_017314 | g, s, aa | *Rattus norvegicus* ubiquitin C (Ubc), mRNA. Length = 2545 | ubiquitin C |
| 1700 | 1894 | NM_017320 | t | *Rattus norvegicus* cathepsin S (Ctss), mRNA. Length = 1330 | cathepsin S |
| 1701 | 20809 | NM_017326 | u | *Rattus norvegicus* calmodulin (RCM3), mRNA Length = 1112 | calmodulin |
| 1702 | 355 | NM_017334 | cc | *Rattus norvegicus* transcriptional repressor CREM (CREM), mRNA. Length = 436 | |
| 1703 | 16148 | NM_017340 | q, s | *Rattus norvegicus* acyl-coA oxidase (RATACOA1), mRNA. Length = 3741 | acyl-coA oxidase |
| 1703 | 16150 | NM_017340 | a | *Rattus norvegicus* acyl-coA oxidase (RATACOA1), mRNA. Length = 3741 | acyl-coA oxidase |
| 1704 | 20849 | NM_017343 | r, u, General | *Rattus norvegicus* myosin regulatory light chain (MRLCB), mRNA. Length = 1139 | Rat mRNA for myosin regulatory light chain (RLC) |
| 1704 | 20848 | NM_017343 | b, General | *Rattus norvegicus* myosin regulatory light chain (MRLCB), mRNA. Length = 1139 | Rat mRNA for myosin regulatory light chain (RLC) |
| 1705 | 606 | NM_017350 | b | *Rattus norvegicus* urinary plasminogen activator receptor 2 (uPAR-2), mRNA. Length = 1272 | urinary plasminogen activator receptor 2 |
| 1706 | 1581 | NM_017365 | General | *Rattus norvegicus* PDZ and LIM domain 1 (elfin) (Pdlim1), mRNA. Length = 1392 | LIM protein |
| 1707 | 455 | NM_019131 | x | *Rattus norvegicus* Tropomyosin 1 (alpha) (Tpm1), mRNA. Length = 1004 | Tropomyosin 1 (alpha) |
| 1707 | 456 | NM_019131 | y, z | *Rattus norvegicus* Tropomyosin 1 (alpha) (Tpm1), mRNA. Length = 1004 | Tropomyosin 1 (alpha) |
| 1708 | 4532 | NM_019134 | b | *Rattus norvegicus* Solute carrier family 12, member 1 (bumetanide-sensitive sodium-[potassium]-chloride cotransporter) (Slc12a1), mRNA. Length = 4595 | Solute carrier family 12, member 1 (bumetanide-sensitive sodium-[potassium]-chloride cotransporter) |
| 1709 | 1608 | NM_019166 | j, y, z | *Rattus norvegicus* synaptogyrin 1 (Syngr1), mRNA. Length = 879 | ESTs, Moderately similar to synaptogyrin [*R. norvegicus*], synaptogyrin 1 |
| 1710 | 7489 | NM_019169 | c, General | *Rattus norvegicus* synuclein, alpha (Snca), mRNA. Length = 1018 | synuclein, alpha |
| 1711 | 17066 | NM_019170 | p | *Rattus norvegicus* carbonyl reductase (Cbr), mRNA. Length = 1018 | carbonyl reductase |
| 1712 | 23924 | NM_019174 | bb | *Rattus norvegicus* carbonic anhydrase 4 (Ca4), mRNA. Length = 1205 | ESTs, Highly similar to CARBONIC ANHYDRASE IV PRECURSOR [*R. norvegicus*] |
| 1713 | 24019 | NM_019186 | t | *Rattus norvegicus* ADP-ribosylation-like 4 (Arl4), mRNA. Length = 1067 | ADP-ribosylation-like 4 |

TABLE 1-continued

SUMMARY

| Sequence ID No. | Identifier | GenBank Acc/Ref. Seq ID | Model Code | Gene Name | Unigene Cluster Title |
|---|---|---|---|---|---|
| 1714 | 22063 | NM_019195 | d | *Rattus norvegicus* integrin-associated protein (Cd47), mRNA. Length = 1053 | integrin-associated protein |
| 1715 | 2079 | NM_019220 | j, k, z | *Rattus norvegicus* amino-terminal enhancer of split (Aes), mRNA. Length = 1356 | related to Drosophila groucho gene |
| 1716 | 16284 | NM_019229 | l, m | *Rattus norvegicus* solute carrier family 12, member 4 (Slc12a4), mRNA. Length = 3726 | solute carrier family 12, member 4 |
| 1717 | 985 | NM_019233 | b, cc | *Rattus norvegicus* small inducible cytokine subfamily A20 (Scya20), mRNA. Length = 816 | small inducible cytokine subfamily A20 |
| 1718 | 15503 | NM_019237 | k, x | *Rattus norvegicus* procollagen C-proteinase enhancer protein (Pcolce), mRNA. Length = 1547 | procollagen C-proteinase enhancer protein |
| 1718 | 15504 | NM_019237 | k, x | *Rattus norvegicus* procollagen C-proteinase enhancer protein (Pcolce), mRNA. Length = 1547 | procollagen C-proteinase enhancer protein |
| 1719 | 17908 | NM_019242 | l, v, cc, General | *Rattus norvegicus* interferon-related developmental regulator 1 (Ifrd1), mRNA. Length = 1736 | interferon-related developmental regulator 1 |
| 1720 | 11218 | NM_019247 | c | *Rattus norvegicus* paired-like homeodomain transcription factor 3 (Pitx3), mRNA. Length= 1253 | paired-like homeodomain transcription factor 3 |
| 1721 | 15259 | NM_019259 | d, f | *Rattus norvegicus* complement component 1, q subcomponent binding protein (C1qbp), mRNA. Length = 1124 | complement component 1, q subcomponent binding protein |
| 1722 | 21443 | NM_019262 | aa, General | *Rattus norvegicus* complement component 1, q subcomponent, beta polypeptide (C1qb), mRNA. Length = 1136 | complement component 1, q subcomponent, beta polypeptide |
| 1722 | 21444 | NM_019262 | t, General | *Rattus norvegicus* complement component 1, q subcomponent, beta polypeptide (C1qb), mRNA Length = 1136 | complement component 1, q subcomponent, beta polypeptide |
| 1723 | 117 | NM_019266 | o, bb | *Rattus norvegicus* sodium channel, voltage-gated, type VIII, alpha polypeptide (Scn8a), mRNA. Length = 6586 | sodium channel, voltage-gated, type VIII, alpha polypeptide |
| 1724 | 1145 | NM_019280 | w | *Rattus norvegicus* gap junction membrane channel protein alpha 5 (Gja5), mRNA. Length = 3115 | gap junction membrane channel protein alpha 5 |
| 1725 | 22220 | NM_019286 | c | *Rattus norvegicus* Alcohol dehydrogenase 3 (Adh3), mRNA. Length = 1131 | Alcohol dehydrogenase (class I), alpha polypeptide |
| 1726 | 10015 | NM_019289 | l, m, t, x, General | *Rattus norvegicus* Actin-related protein complex 1b (Arpc1b), mRNA. Length = 1430 | Actin-related protein complex 1b |
| 1726 | 10016 | NM_019289 | bb, General | *Rattus norvegicus* Actin-related protein complex 1b (Arpc1b), mRNA Length = 1430 | Actin-related protein complex 1b |
| 1727 | 21651 | NM_019296 | c, f, x | *Rattus norvegicus* Cell division cycle control protein 2 (Cdc2a), mRNA. Length = 1184 | Cell division cycle control protein 2 |
| 1728 | 20751 | NM_019301 | s | *Rattus norvegicus* Complement receptor related protein (Cr1), mRNA. Length = 1811 | Complement receptor related protein |
| 1729 | 645 | NM_019345 | bb | *Rattus norvegicus* solute carrier family 12, member 3 (Slc12a3), mRNA. Length = 4361 | solute carrier family 12, member 3 |

TABLE 1-continued

SUMMARY

Atty. Docket No. 44921-5089US
Doc. No. 1803440.1

| Sequence ID No. | Identifier | GenBank Acc/Ref. Seq ID | Model Code | Gene Name | Unigene Cluster Title |
|---|---|---|---|---|---|
| 1730 | 1301 | NM_019349 | c | *Rattus norvegicus* Serine/threonine kinase 2 (Stk2), mRNA. Length = 4194 | Rat liver stearyl-CoA desaturase mRNA, complete cds |
| 1731 | 3776 | NM_019354 | a, u | *Rattus norvegicus* Uncoupling protein 2, mitochondrial (Ucp2), mRNA Length = 1575 | Uncoupling protein 2, mitochondrial |
| 1732 | 4592 | NM_019356 | General | *Rattus norvegicus* eukaryotic translation initiation factor 2, subunit 1 (alpha) (Eif2s1), mRNA. Length = 1377 | eukaryotic translation initiation factor 2, subunit 1 (alpha) |
| 1733 | 1324 | NM_019371 | w | *Rattus norvegicus* factor-responsive smooth muscle protein (SM-20), mRNA Length = 2825 | factor-responsive smooth muscle protein |
| 1734 | 19577 | NM_019377 | e | *Rattus norvegicus* 14-3-3 protein beta-subtype (Ywhab), mRNA. Length = 2756 | ESTs, Moderately similar to S12207 hypothetical protein [*M. musculus*] |
| 1735 | 24626 | NM_019381 | s | *Rattus norvegicus* Testis enhanced gene transcript (Tegt), mRNA. Length = 940 | Testis enhanced gene transcript |
| 1736 | 744 | NM_019622 | p | *Rattus norvegicus* espin (Espn), mRNA Length = 2786 | espin |
| 1737 | 20716 | NM_019623 | c | *Rattus norvegicus* cytochrome P450 4F1 (Cyp4f1), mRNA. Length = 1977 | cytochrome P450 4F1 |
| 1738 | 20709 | NM_019904 | x | *Rattus norvegicus* beta-galactoside-binding lectin (Lgals1), mRNA. Length = 519 | beta-galactoside-binding lectin |
| 1739 | 574 | NM_019905 | u, General | *Rattus norvegicus* calpactin I heavy chain (Anxa2), mRNA length = 1395 | *Rattus norvegicus* clone BB.1.4.1 unknown Glu-Pro dipeptide repeat Protein mRNA, complete cds, calpactin I heavy chain, hydrixyacid oxidase 3 (medium-chain) |
| 1740 | 9096 | NM_019908 | j | *Rattus norvegicus* hypothetical protein LOC56728 (LOC56728), mRNA. Length = 858 | hypothetical protein LOC56728 |
| 1741 | 20457 | NM_020073 | i, General | *Rattus norvegicus* parathyroid hormone receptor (LOC56813), mRNA. Length = 2065 | parathyroid hormone receptor |
| 1741 | 20458 | NM_020073 | General | *Rattus norvegicus* parathyroid hormone receptor (LOC56813), mRNA Length = 2065 | parathyroid hormone receptor |
| 1741 | 20460 | NM_020073 | General | *Rattus norvegicus* parathyroid hormone receptor (LOC56813), mRNA Length = 2065 | parathyroid hormone receptor |
| 1742 | 18713 | NM_020075 | r | *Rattus norvegicus* eukaryotic initiation factor 5 (eIF-5) (Eif5), mRNA Length = 3504 | eukaryotic initiation factor 5 (eIF-5) |
| 1742 | 18715 | NM_020075 | r | *Rattus norvegicus* eukaryotic initiation factor 5 (eIF-5) (Eif5), mRNA. Length = 3504 | eukaryotic initiation factor 5 (eIF-5) |
| 1743 | 20493 | NM_020076 | p | *Rattus norvegicus* 3-hydroxyanthranilate 3,4-dioxygenase (Haao), mRNA. Length = 1254 | 3-hydroxyanthranilate 3,4-dioxygenase |
| 1744 | 16375 | NM_020976 | g | *Rattus norvegicus* kidney-specific membrane protein (NX-17), mRNA. Length = 1181 | kidney-specific membrane protein |
| 1745 | 20816 | NM_021261 | k, General | *Rattus norvegicus* thymosin, beta 10 (Tmsb10), mRNA. Length = 539 | thymosin beta-10 |
| 1746 | 15335 | NM_021264 | a | *Rattus norvegicus* ribosomal protein L35a (Rpl35), mRNA. Length = 348 | ribosomal protein L35a |
| 1747 | 18729 | NM_021578 | k, z | *Rattus norvegicus* transforming growth factor | transforming growth factor beta-1 gene |

TABLE 1-continued

SUMMARY

| Sequence ID No. | GenBank Identifier | GenBank Acc/Ref. Seq ID | Model Code | Gene Name | Unigene Cluster Title |
|---|---|---|---|---|---|
| | | | | beta-1 gene (Tgfb1), mRNA Length = 1585 | |
| 1748 | 19060 | NM_021587 | cc | *Rattus norvegicus* transforming growth factor-beta (TGF-beta) masking protein large subunit (Ltbp1), mRNA. Length = 6244 | transforming growth factor-beta (TGF-beta) masking protein large subunit |
| 1749 | 17324 | NM_021593 | o, General | *Rattus norvegicus* kynurenine 3-hydroxylase (Kmo), mRNA. Length = 1733 | kynurenine 3-hydroxylase |
| 1750 | 19679 | NM_021653 | General | *Rattus norvegicus* Thyroxine deiodinase, type I (Dio1), mRNA. Length = 2106 | Thyroxine deiodinase, type I |
| 1750 | 19678 | NM_021653 | a, v General | *Rattus norvegicus* Thyroxine deiodinase, type I (Dio1), mRNA Length = 2106 | Thyroxine deiodinase, type I |
| 1751 | 19665 | NM_021688 | u, General | *Rattus norvegicus* putative potassium channel TWIK (Kcnk1), mRNA. Length = 1582 | putative potassium channel TWIK |
| 1752 | 19667 | NM_021690 | m | *Rattus norvegicus* cAMP-regulated guanine nucleotide exchange factor I (cAMP-GEFI) (Epac), mRNA. Length = 3373 | cAMP-regulated guanine nucleotide exchange factor I (cAMP-GEFI) |
| 1754 | 22916 | NM_021740 | a | *Rattus norvegicus* prothymosin alpha(Ptma), mRNA Length = 1182 | prothymosin alpha |
| 1755 | 19710 | NM_021744 | t | *Rattus norvegicus* CD14 antigen (Cd14), mRNA. Length = 1591 | CD14 antigen |
| 1755 | 19711 | NM_021744 | t | *Rattus norvegicus* CD14 antigen (Cd14), mRNA Length = 1591 | CD14 antigen |
| 1756 | 19712 | NM_021745 | r | *Rattus norvegicus* farnesoid X activated receptor (LOC60351), mRNA. Length = 2070 | farnesoid X activated receptor |
| 1757 | 1962 | NM_021750 | j, k, y, z | *Rattus norvegicus* cysteine-sulfinate decarboxylase (Csad), mRNA Length = 2413 | *Rattus norvegicus* cca2 mRNA, complete cds |
| 1757 | 19824 | NM_021750 | a, bb | *Rattus norvegicus* cysteine-sulfinate decarboxylase (Csad), mRNA. Length = 2413 | cysteine-sulfinate decarboxylase |
| 1758 | 25198 | NM_021754 | h | *Rattus norvegicus* Nopp 140 associated protein (Nap65), mRNA. Length = 1980 | Nopp140 associated protein |
| 1758 | 20035 | NM_021754 | b, n, s, v, General | *Rattus norvegicus* Nopp 140 associated protein (Nap65), mRNA Length = 1980 | Nopp140 associated protein |
| 1759 | 20090 | NM_021757 | m | *Rattus norvegicus* pleiotropic regulator 1 (Plrg1), mRNA. Length = 1545 | pleiotropic regulator 1 |
| 1760 | 17885 | NM_021765 | aa | *Rattus norvegicus* beta prime COP (Copb), mRNA. Length = 3025 | beta prime COP |
| 1762 | 20161 | NM_021836 | cc, General | *Rattus norvegicus* jun B proto-oncogene (Junb), mRNA. Length = 1035 | jun B proto-oncogene |
| 1764 | 1203 | NM_021997 | k, z | *Rattus norvegicus* cytoplasmic linker 2 (Cyln2), mRNA Length = 4847 | cytoplasmic linker 2 |
| 1765 | 23151 | NM_022005 | b | *Rattus norvegicus* FXYD domain-containing ion transport regulator 6 (Fxyd6), mRNA. Length = 1711 | FXYD domain-containing ion transport regulator 6 |
| 1767 | 17101 | NM_022179 | bb | *Rattus norvegicus* Hexokinase 3 (Hk3), mRNA Length = 3692 | Hexokinase 3 |
| 1767 | 17100 | NM_022179 | bb | *Rattus norvegicus* Hexokinase 3 (Hk3), mRNA. Length = 3692 | Hexokinase 3 |
| 1768 | 20257 | NM_022180 | w, General | *Rattus norvegicus* Hepatic nuclear factor 4(alpha | Hepatic nuclear factor 4 (alpha transcription factor 4) |

TABLE 1-continued

SUMMARY

Atty. Docket No. 44921-5089US
Doc. No. 1803440.1

| Sequence ID No. | GenBank Identifier | Acc/Ref. Seq ID | Model Code | Gene Name | Unigene Cluster Title |
|---|---|---|---|---|---|
| 1768 | 25699 | NM_022180 | i | transcription factor 4 (Hnf4a), mRNA. Length = 1446 *Rattus norvegicus* Hepatic nuclear factor 4(alpha transcription factor 4) (Hnf4a), mRNA. Length = 1446 | Hepatic nuclear factor 4 (alpha transcription factor 4) |
| 1768 | 10860 | NM_022180 | p | *Rattus norvegicus* Hepatic nuclear factor 4(alpha transcription factor 4) (Hnf4a), mRNA. Length = 1446 | ESTs |
| 1769 | 23780 | NM_022183 | k, x | *Rattus norvegicus* topoisomerase (DNA) II alpha (Top2a), mRNA Length = 6052 | topoisomerase (DNA) II alpha |
| 1770 | 20312 | NM_022224 | o | *Rattus norvegicus* resiniferatoxin-binding, phosphotriesterase-related protein (Rpr1), mRNA Length = 1050 | resiniferatoxin-binding, phosphotriesterase-related protein |
| 1771 | 6585 | NM_022266 | d, p, cc | *Rattus norvegicus* connective tissue growth factor (Ctgf), mRNA Length = 2345 | connective tissue growth factor |
| 1772 | 17161 | NM_022298 | i, v, cc, General | *Rattus norvegicus* alpha-tubulin (Tuba 1), mRNA. Length = 1617 | alpha-tubulin |
| 1772 | 17162 | NM_022298 | u | *Rattus norvegicus* alpha-tubulin (Tuba1), mRNA. Length = 1617 | alpha-tubulin |
| 1772 | 17160 | NM_022298 | u | *Rattus norvegicus* alpha-tubulin (Tuba1), mRNA. Length = 1617 | alpha-tubulin |
| 1772 | 17158 | NM_022298 | q | *Rattus norvegicus* alpha-tubulin (Tuba 1), mRNA. Length = 1617 | alpha-tubulin |
| 1773 | 11454 | NM_022381 | i, aa, General | *Rattus norvegicus* Proliferating cell nuclear antigen (Pcna), mRNA. Length = 1160 | Proliferating cell nuclear antigen |
| 1773 | 11455 | NM_022381 | l, General | *Rattus norvegicus* Proliferating cell nuclear antigen (Pcna), mRNA. Length = 1160 | Proliferating cell nuclear antigen |
| 1774 | 13480 | NM_022390 | s | *Rattus norvegicus* quinoid dihydropteridine reductase (Qdpr), mRNA Length = 1307 | quinoid dihydropteridine reductase |
| 1775 | 15184 | NM_022391 | z | *Rattus norvegicus* pituitary tumor-transforming 1 (Pttg1), mRNA Length = 974 | pituitary tumor transforming gene |
| 1776 | 22413 | NM_022392 | h | *Rattus norvegicus* growth response protein (CL-6) (LOC64194), mRNA. Length = 2410 | growth response protein (CL-6) |
| 1776 | 22414 | NM_022392 | n | *Rattus norvegicus* growth response protein (CL-6) (LOC64194), mRNA. Length = 2410 | growth response protein (CL-6) |
| 1777 | 22499 | NM_022393 | t | *Rattus norvegicus* macrophage galactose N-acetyl-galactosamine specific lectin (Mgl), mRNA. Length = 1358 | Gal/GalNAc-specific lectin |
| 1779 | 24537 | NM_022399 | e | *Rattus norvegicus* calreticulin (Calr), mRNA. Length = 1882 | calreticulin |
| 1779 | 24539 | NM_022399 | y | *Rattus norvegicus* calreticulin (Calr), mRNA. Length = 1882 | calreticulin |
| 1780 | 1141 | NM_022401 | o, General | *Rattus norvegicus* plectin (Plec1), mRNA Length = 15,231 | plectin |
| 1781 | 1069 | NM_022402 | g | *Rattus norvegicus* acidic ribosomal protein P0 (Arbp), mRNA Length = 1046 | acidic ribosomal protein P0 |
| 1782 | 8211 | NM_022500 | j, n, s | *Rattus norvegicus* ferritin light chain 1 (Ftl1), mRNA. Length = 552 | ferritin light chain 1 |

TABLE 1-continued

SUMMARY

Atty. Docket No. 44921-5089US
Doc. No. 1803440.1

| Sequence ID No. | Identifier | GenBank Acc/Ref. Seq ID | Model Code | Gene Name | Unigene Cluster Title |
|---|---|---|---|---|---|
| 1782 | 8212 | NM_022500 | n, s | *Rattus norvegicus* ferritin light chain 1 (Ftl1), mRNA. Length = 552 | ferritin light chain 1 |
| 1783 | 6815 | NM_022503 | s | *Rattus norvegicus* cytochrome c oxidase subunit VIIa 3 (Cox7a3), mRNA. Length = 460 | cytochrome c oxidase subunit VIIa 3 |
| 1784 | 4259 | NM_022504 | q, w | *Rattus norvegicus* ribosomal protein L36 (Rpl36), mRNA. Length = 364 | ribosomal protein L36 |
| 1785 | 1611 | NM_022509 | j | *Rattus norvegicus* survival motor neuron (Smn), mRNA. Length = 1243 | survival motor neuron |
| 1786 | 2236 | NM_022512 | y, z | *Rattus norvegicus* short chain acyl-coenzyme A dehydrogenase (Acads), mRNA Length = 1749 | short chain acyl-coenzyme A dehydrogenase |
| 1787 | 3026 | NM_022514 | a | *Rattus norvegicus* ribosomal protein L27 (Rpl27), mRNA. Length = 463 | ribosomal protein L27 |
| 1787 | 3027 | NM_022514 | a, q, r, aa | *Rattus norvegicus* ribosomal protein L27 (Rpl27), mRNA. Length = 463 | ribosomal protein L27 |
| 1788 | 2696 | NM_022515 | a, d | *Rattus norvegicus* ribosomal protein L24 (Rpl24), mRNA. Length = 541 | ribosomal protein L24 |
| 1788 | 2697 | NM_022515 | n, w, aa | *Rattus norvegicus* ribosomal protein L24 (Rpl24), mRNA. Length = 541 | ribosomal protein L24 |
| 1789 | 3900 | NM_022516 | h | *Rattus norvegicus* polypyrimidine tract binding protein (Ptb), mRNA Length = 2697 | polypyrimidine tract binding protein |
| 1790 | 4151 | NM_022518 | o | *Rattus norvegicus* ADP-ribosylation factor 1 (Arf1), mRNA. Length = 900 | ADP-ribosylation factor 1 |
| 1791 | 4242 | NM_022521 | c | *Rattus norvegicus* ornithine aminotransferase (Oat), mRNA. Length = 1938 | ornithine aminotransferase |
| 1792 | 4412 | NM_022523 | o | *Rattus norvegicus* platelet endothelial tetraspan antigen-3 (Cd151), mRNA Length = 1668 | platelet endothelial tetraspan antigen-3 |
| 1793 | 6641 | NM_022533 | General | *Rattus norvegicus* plasmolipin (Z49858), mRNA. Length = 1475 | plasmolipin |
| 1794 | 8097 | NM_022536 | a | *Rattus norvegicus* cyclophilin B (Ppib), mRNA Length = 840 | cyclophilin B |
| 1795 | 8597 | NM_022538 | c, r, u | *Rattus norvegicus* phosphatidate phosphohydrolase type 2 (Ppap2), mRNA Length = 871 | phosphatidate phosphohydrolase type 2 |
| 1795 | 8598 | NM_022538 | u | *Rattus norvegicus* phosphatidate phosphohydrolase type 2 (Ppap2), mRNA. Length = 871 | phosphatidate phosphohydrolase type 2 |
| 1796 | 9296 | NM_022541 | o | *Rattus norvegicus* small zinc finger-like protein DDP2 (Ddp2), mRNA. Length = 494 | small zinc finger-like protein DDP2 |
| 1797 | 21063 | NM_022585 | h | *Rattus norvegicus* ornithine decarboxylase antizyme inhibitor (Oazi), mRNA. Length = 4269 | ornithine decarboxylase antizyme inhibitor |
| 1799 | 20781 | NM_022591 | z | *Rattus norvegicus* telomerase protein component 1 (Tlp1), mRNA Length = 8216 | telomerase protein component 1 |
| 1800 | 20803 | NM_022592 | n | *Rattus norvegicus* transketolase (Tkt), mRNA. Length = 2098 | transketolase |
| 1801 | 20925 | NM_022594 | q | *Rattus norvegicus* enoyl hydratase-like protein, peroxisomal (Ech1), mRNA Length = 1097 | enoyl hydratase-like protein, peroxisomal |

TABLE 1-continued

SUMMARY

| Sequence ID No. | Identifier | GenBank Acc/Ref. Seq ID | Model Code | Gene Name | Unigene Cluster Title |
|---|---|---|---|---|---|
| 1802 | 20944 | NM_022597 | aa | *Rattus norvegicus* cathepsin B (Ctsb), mRNA. Length = 1904 | cathepsin B |
| 1803 | 21024 | NM_022599 | o, General | *Rattus norvegicus* synaptojanin 2 binding protein (Synj2bp), mRNA. Length = 5215 | outer membrane protein |
| 1804 | 2250 | NM_022643 | General | *Rattus norvegicus* Testis-specific histone 2b (Th2b), mRNA. Length = 470 | ESTs, Highly similar to 0506206A histone H2B [*R. norvegicus*] |
| 1805 | 17567 | NM_022672 | a, y | *Rattus norvegicus* ribosomal protein S14 (Rps14), mRNA. Length = 492 | ribosomal protein S14 |
| 1806 | 17661 | NM_022674 | bb | *Rattus norvegicus* H2A histone family, member Z (H2afz), mRNA. Length = 811 | H2A histone family, member Z |
| 1807 | 24563 | NM_022676 | b | *Rattus norvegicus* protein phosphatase 1, regulatory (inhibitor) subunit 1A (Ppp1r1a), mRNA. Length = 619 | protein phosphatase 1, regulatory (inhibitor) subunit 1A |
| 1807 | 24564 | NM_022676 | b, x | *Rattus norvegicus* protein phosphatase 1, regulatory (inhibitor) subunit 1A (Ppp1r1a), mRNA. Length = 619 | protein phosphatase 1, regulatory (inhibitor) subunit 1A |
| 1808 | 20506 | NM_022686 | l | *Rattus norvegicus* germinal histone H4 gene (Hist4), mRNA. Length = 377 | germinal histone H4 gene |
| 1809 | 20508 | NM_022688 | g | *Rattus norvegicus* preoptic regulatory factor-1 (Porf1), mRNA. Length = 689 | preoptic regulatory factor-1 |
| 1810 | 17586 | NM_022694 | k | *Rattus norvegicus* p105 coactivator (U83883), mRNA Length = 3166 | p105 coactivator |
| 1811 | 17730 | NM_022697 | a | *Rattus norvegicus* ribosomal protein L28 (Rpl28), mRNA. Length = 466 | ribosomal protein L28 |
| 1811 | 17729 | NM_022697 | q | *Rattus norvegicus* ribosomal protein L28 (Rpl28), mRNA. Length = 466 | ribosomal protein L28 |
| 1812 | 154 | NM_022849 | t | *Rattus norvegicus* crp-ductin (Crpd), mRNA. Length = 4344 | crp-ductin |
| 1813 | 127 | NM_022855 | h | *Rattus norvegicus* casein kinase 1 gamma 3 isoform (Csnk1g3), mRNA Length = 2547 | casein kinase 1 gamma 3 isoform |
| 1814 | 152 | NM_022858 | j | *Rattus norvegicus* HNF-3/forkhead homolog-1 (Hfh1), mRNA. Length = 1760 | HNF-3/forkhead homolog-1 |
| 1816 | 18101 | NM_022948 | z | *Rattus norvegicus* tricarboxylate carrier-like protein (Loc65042), mRNA. Length = 2699 | tricarboxylate carrier-like protein |
| 1816 | 18103 | NM_022948 | u | *Rattus norvegicus* tricarboxylate carrier-like protein (Loc65042), mRNA. Length = 2699 | tricarboxylate carrier-like protein |
| 1817 | 21491 | NM_022951 | w | *Rattus norvegicus* putative protein phosphatase 1 nuclear targeting subunit (Ppp1r10), mRNA. Length = 4131 | putative protein phosphatase 1 nuclear targeting subunit |
| 1818 | 15742 | NM_022958 | y | *Rattus norvegicus* phosphatidylinositol 3-kinase (Pik3c3), mRNA Length = 2752 | phosphatidylinositol 3-kinase |
| 1819 | 9286 | NM_023027 | t, w | *Rattus norvegicus* tRNA selenocysteine associated protein (Secp43), mRNA. Length = 864 | tRNA selenocysteine associated protein |
| 1820 | 23215 | NM_023102 | z | *Rattus norvegicus* casein kinase 1 gamma 2 isoform (Csnk1g2), mRNA Length = 1572 | casein kinase 1 gamma 2 isoform |
| 1821 | 21238 | NM_024125 | cc, General | *Rattus norvegicus* Liver activating protein (LAP, also NF-IL6, nuclear factor-IL6, | Liver activating protein (LAP, also NF-IL6, nuclear factor-IL6, previously designated TCF5) |

TABLE 1-continued

SUMMARY

Atty. Docket No. 44921-5089US
Doc. No. 1803440.1

| Sequence ID No. | Identifier | GenBank Acc/Ref. Seq ID | Model Code | Gene Name | Unigene Cluster Title |
|---|---|---|---|---|---|
| | | | | previously designated TCF5) (Cebpb), mRNA. Length = 1408 | |
| 1821 | 21239 | NM_024125 | cc, General | *Rattus norvegicus* Liver activating protein (LAP, also NF-IL6, nuclear factor-IL6, previously designated TCF5) (Cebpb), mRNA. Length = 1408 | Liver activating protein (LAP, also NF-IL6, nuclear factor-IL6, previously designated TCF5) |
| 1822 | 353 | NM_024127 | i, n, General | *Rattus norvegicus* DNA-damage-inducible transcript 1 (Gadd45a), mRNA. Length = 711 | DNA-damage-inducible transcript 1 |
| 1822 | 354 | NM_024127 | i, n, General | *Rattus norvegicus* DNA-damage-inducible transcript 1 (Gadd45a), mRNA. Length = 711 | DNA-damage-inducible transcript 1 |
| 1822 | 352 | NM_024127 | h, General | *Rattus norvegicus* DNA-damage-inducible transcript 1 (Gadd45a), mRNA Length = 711 | DNA-damage-inducible transcript 1 |
| 1823 | 17227 | NM_024131 | x | *Rattus norvegicus* D-dopachrome tautomerase (Ddt), mRNA Length = 628 | D-dopachrome tautomerase |
| 1824 | 1598 | NM_024134 | l | *Rattus norvegicus* DNA-damage inducible transcript 3 (Ddit3), mRNA. Length = 806 | DNA-damage inducible transcript 3 |
| 1825 | 1162 | NM_024153 | d | *Rattus norvegicus* adrenodoxin reductase (Fdxr), mRNA. Length = 1786 | adrenodoxin reductase |
| 1826 | 7863 | NM_024156 | c | *Rattus norvegicus* annexin VI (Anxa6), mRNA Length = 2739 | *Rattus norvegicus* mRNA for H(+)-transporting ATPase, complete cds |
| 1827 | 22079 | NM_024157 | x | *Rattus norvegicus* complement factor I (Cfi), mRNA. Length = 2021 | complement factor I |
| 1828 | 16476 | NM_024162 | General | *Rattus norvegicus* heart fatty acid binding protein (Fabp3), mRNA Length = 666 | heart fatty acid binding protein |
| 1829 | 17765 | NM_024351 | b, s, v | *Rattus norvegicus* heat shock 70 kD protein 8 (Hspa8), mRNA Length = 2073 | Heat shock cognate protein 70 |
| 1830 | 8879 | NM_024360 | h | *Rattus norvegicus* hairy and enhancer of split 1, (Drosophila) (Hes 1), mRNA Length = 1453 | hairy and enhancer of split 1, (Drosophila) |
| 1831 | 20772 | NM_024363 | x | *Rattus norvegicus* heterogeneous nuclear ribonucleoproteins methyltransferase-like 2 (*S. cerevisiae*) (Hrmt1l2), mRNA Length = 1201 | heterogeneous nuclear ribonucleoproteins methyltransferase-like 2 (*S. cerevisiae*) |
| 1832 | 2812 | NM_024386 | c | *Rattus norvegicus* 3-hydroxy-3-methylglutaryl CoA lyase (Hmgcl), mRNA. Length = 1390 | 3-hydroxy-3-methylglutaryl CoA lyase |
| 1833 | 335 | NM_024387 | j, y | *Rattus norvegicus* heme oxygenase-2 non-reducing isoform (Hmox2), mRNA. Length = 1815 | heme oxygenase-2 non-reducing isoform |
| 1834 | 21 | NM_024388 | cc | *Rattus norvegicus* immediate early gene transcription factor NGFI-B (Nr4a1), mRNA Length = 2488 | immediate early gene transcription factor NGFI-B |
| 1834 | 22 | NM_024388 | cc | *Rattus norvegicus* immediate early gene transcription factor NGFI-B (Nr4a1), mRNA. Length = 2488 | immediate early gene transcription factor NGFI-B |
| 1836 | 9929 | NM_024392 | f | *Rattus norvegicus* peroxisomal multifunctional enzyme type II (Hsd17b4), mRNA. Length = 2535 | peroxisomal multifunctional enzyme type II |
| 1837 | 3582 | NM_024396 | aa | *Rattus norvegicus* ATP-binding cassette, sub-family A (ABC1), member 2 (Abca2), mRNA. Length = 8040 | ATP-binding cassette, sub-family A (ABC1), member 2 |
| 1838 | 19993 | NM_024398 | e, p, s, aa | *Rattus norvegicus* mitochondrial aconitase (nuclear aco2 gene) (Aco2), mRNA. Length = 2744 | mitochondrial aconitase (nuclear aco2 gene) |

TABLE 1-continued

SUMMARY

Atty. Docket No. 44921-5089US
Doc. No. 1803440.1

| Sequence ID No. | Identifier | GenBank Acc/Ref. Seq ID | Model Code | Gene Name | Unigene Cluster Title |
|---|---|---|---|---|---|
| 1839 | 10789 | NM_024399 | o | *Rattus norvegicus* aspartoacylase (Aspa), mRNA. Length = 1552 | aspartoacylase |
| 1840 | 22626 | NM_024400 | cc, General | *Rattus norvegicus* a disintegrin and metalloproteinase with thrombospondin motifs 1 (ADAMTS-1) (Adamts1), mRNA Length = 4878 | a disintegrin and metalloproteinase with thrombospondin motifs 1 (ADAMTS-1) |
| 1841 | 13633 | NM_024403 | g, General | *Rattus norvegicus* activating transcription factor ATF-4 (Atf4), mRNA. Length = 1173 | activating transcription factor ATF-4 |
| 1841 | 13634 | NM_024403 | g, General | *Rattus norvegicus* activating transcription factor ATF-4 (Atf4), mRNA. Length = 1173 | activating transcription factor ATF-4 |
| 1842 | 23387 | NM_024404 | b, General | *Rattus norvegicus* RNA binding protein p45AUF1 (Hnrpd), mRNA. Length = 1240 | RNA binding protein p45AUF1 |
| 1843 | 21038 | NM_024484 | h | *Rattus norvegicus* aminolevulinic acid synthase 1 (Alas 1), mRNA. Length = 2052 | aminolevulinic acid synthase 1 |
| 1844 | 1853 | NM_030826 | s | *Rattus norvegicus* Glutathione peroxidase 1 (Gpx1), mRNA. Length = 1539 | ESTs, Glutathione peroxidase 1 |
| 1845 | 15111 | NM_030827 | e, General | *Rattus norvegicus* glycoprotein 330 (Lrp2), mRNA. Length = 15,438 | glycoprotein 330 |
| 1845 | 15112 | NM_030827 | y, z | *Rattus norvegicus* glycoprotein 330 (Lrp2), mRNA Length = 15,438 | glycoprotein 330 |
| 1845 | 15110 | NM_030827 | General | *Rattus norvegicus* glycoprotein 330 (Lrp2), mRNA. Length = 15,438 | glycoprotein 330 |
| 1846 | 808 | NM_030837 | k, m | *Rattus norvegicus* kidney specific organic anion transporter (Slc21a4), mRNA Length = 2772 | kidney specific organic anion transporter |
| 1847 | 4057 | NM_030844 | k | *Rattus norvegicus* islet cell autoantigen 1, 69 kDa (Ica1), mRNA Length = 2094 | islet cell autoantigen 1, 69 kDa |
| 1848 | 1221 | NM_030845 | t | *Rattus norvegicus* gro (Gro1), mRNA. Length = 929 | gro |
| 1849 | 21509 | NM_030847 | x | *Rattus norvegicus* epithelial membrane protein 3 (Emp3), mRNA Length = 737 | epithelial membrane protein 3 |
| 1850 | 1928 | NM_030872 | v | *Rattus norvegicus* pyruvate dehydrogenase kinase 2 subunit p45 (PDK2) (Pdk2), mRNA Length = 2207 | pyruvate dehydrogenase kinase 2 subunit p45 (PDK2) |
| 1851 | 17342 | NM_030873 | u | *Rattus norvegicus* profilin II (Pfn2), mRNA. Length = 1966 | profilin II |
| 1852 | 24648 | NM_030985 | u | *Rattus norvegicus* Angiotensin II receptor, type 1 (AT1A) (Agtr1a), mRNA. Length = 1450 | Angiotensin II receptor, type 1 (AT1A) |
| 1852 | 25453 | NM_030985 | General | *Rattus norvegicus* Angiotensin II receptor, type 1 (AT1A) (Agtr1a), mRNA. Length = 1450 | |
| 1853 | 21802 | NM_030987 | h | *Rattus norvegicus* Guanine nucleotide-binding protein beta 1 (Gnb1), mRNA. Length = 2837 | Guanine nucleotide-binding protein beta 1 |
| 1854 | 23109 | NM_031000 | f, s, z | *Rattus norvegicus* aldo-keto reductase family 1, member A1 (aldehyde reductase) (Akr1a1), mRNA. Length = 1124 | aldo-keto reductase family 1, member A1 (aldehyde reductase) |
| 1855 | 134 | NM_031003 | a, u | *Rattus norvegicus* 4-aminobutyrate aminotransferase (Abat), mRNA. Length = 1726 | 4-aminobutyrate aminotransferase |

TABLE 1-continued

SUMMARY

Atty. Docket No. 44921-5089US
Doc. No. 1803440.1

| Sequence ID No. | Identifier | GenBank Acc/Ref. Seq ID | Model Code | Gene Name | Unigene Cluster Title |
|---|---|---|---|---|---|
| 1856 | 25461 | NM_031009 | o | *Rattus norvegicus* angiotensin II type-1 receptor (Agtr1), mRNA Length = 2156 | angiotensin II type-1 receptor |
| 1857 | 1845 | NM_031010 | t | *Rattus norvegicus* arachidonate 12-lipoxygenase (Alox12), mRNA. Length = 2048 | arachidonate 12-lipoxygenase |
| 1857 | 25517 | NM_031010 | c, t | *Rattus norvegicus* arachidonate 12-lipoxygenase (Alox12), mRNA Length = 2048 | arachidonate 12-lipoxygenase |
| 1858 | 16562 | NM_031020 | f | *Rattus norvegicus* p38 mitogen activated protein kinase (Mapk14), mRNA. Length = 3132 | p38 mitogen activated protein kinase |
| 1859 | 1480 | NM_031021 | f | *Rattus norvegicus* casein kinase II beta subunit (Csnk2b), mRNA. Length = 1964 | casein kinase II beta subunit |
| 1860 | 1719 | NM_031024 | n | *Rattus norvegicus* drebrin A (Dbn1), mRNA. Length = 2697 | drebrin A |
| 1861 | 1350 | NM_031030 | h | *Rattus norvegicus* cyclin G-associated kinase (Gak), mRNA Length = 4454 | cyclin G-associated kinase |
| 1862 | 16775 | NM_031031 | General | *Rattus norvegicus* L-arginine glycine amidinotransferase (Gatm), mRNA. Length = 2260 | L-arginine, glycine amidinotransferase |
| 1863 | 691 | NM_031034 | w | *Rattus norvegicus* guanine nucleotide binding protein (G protein) alpha 12 (Gna12), mRNA Length = 1423 | guanine nucleotide binding protein (G protein) alpha 12 |
| 1864 | 15886 | NM_031035 | z | *Rattus norvegicus* GTP-binding protein (G-alpha-i2) (Gnai2), mRNA. Length = 1748 | GTP-binding protein (G-alpha-i2) |
| 1866 | 3608 | NM_031044 | k, General | *Rattus norvegicus* histamine N-methyltransferase (Hnmt), mRNA Length = 1225 | histamine N-methyltransferase |
| 1866 | 3610 | NM_031044 | d, General | *Rattus norvegicus* histamine N-methyltransferase (Hnmt), mRNA Length = 1225 | histamine N-methyltransferase |
| 1867 | 15137 | NM_031051 | s | *Rattus norvegicus* macrophage migration inhibitory factor (Mif), mRNA Length = 551 | macrophage migration inhibitory factor |
| 1868 | 514 | NM_031056 | General | *Rattus norvegicus* matrix metalloproteinase 14, membrane-inserted (Mmp14), mRNA. Length = 2448 | matrix metalloproteinase 14, membrane-inserted |
| 1869 | 17269 | NM_031057 | General | *Rattus norvegicus* methylmalonate semialdehyde dehydrogenase gene (Mmsdh), mRNA. Length = 2059 | methylmalonate semialdehyde dehydrogenase gene |
| 1870 | 11849 | NM_031065 | a | *Rattus norvegicus* ribosomal protein L10a (Rpl10a), mRNA Length = 710 | ribosomal protein L10a |
| 1871 | 1855 | NM_031074 | h | *Rattus norvegicus* nucleoporin 98 (Nup98), mRNA Length = 3237 | nucleoporin 98 |
| 1872 | 4683 | NM_031083 | d | *Rattus norvegicus* phosphatidylinositol 4-kinase (Pik4cb), mRNA. Length = 3205 | phosphatidylinositol 4-kinase |
| 1873 | 15202 | NM_031093 | a | *Rattus norvegicus* -ral simian leukemia viral oncogene homolog A (ras related) (Rala), mRNA. Length = 952 | #NAME? |
| 1873 | 15201 | NM_031093 | a, n | *Rattus norvegicus* -ral simian leukemia viral oncogene homolog A (ras related) (Rala), mRNA. Length = 952 | #NAME? |

TABLE 1-continued

SUMMARY

Atty. Docket No. 44921-5089US
Doc. No. 1803440.1

| Sequence ID No. | Identifier | GenBank Acc/Ref. Seq ID | Model Code | Gene Name | Unigene Cluster Title |
|---|---|---|---|---|---|
| 1874 | 12639 | NM_031099 | aa | *Rattus norvegicus* ribosomal protein L5 (Rpl5), mRNA Length = 1069 | ribosomal protein L5 |
| 1875 | 20812 | NM_031100 | a | *Rattus norvegicus* ribosomal protein L10 (Rpl10), mRNA. Length = 769 | ribosomal protein L10 |
| 1876 | 16938 | NM_031103 | w | *Rattus norvegicus* ribosomal protein L19 (Rpl19), mRNA Length = 703 | ribosomal protein L19 |
| 1877 | 19268 | NM_031104 | q | *Rattus norvegicus* ribosomal protein L22 (Rpl22), mRNA Length = 465 | ribosomal protein L22 |
| 1878 | 16929 | NM_031108 | q | *Rattus norvegicus* mRNA for ribosomal protein S9 (Rps9), mRNA Length = 688 | mRNA for ribosomal protein S9 |
| 1879 | 10878 | NM_031110 | q, bb | *Rattus norvegicus* ribosomal protein S11 (Rps11), mRNA. Length = 534 | ribosomal protein S11 |
| 1880 | 19162 | NM_031111 | aa | *Rattus norvegicus* ribosomal protein S21 (Rps21), mRNA. Length = 359 | ribosomal protein S21 |
| 1880 | 19161 | NM_031111 | a, bb | *Rattus norvegicus* ribosomal protein S21 (Rps21), mRNA Length = 359 | ribosomal protein S21 |
| 1881 | 24615 | NM_031112 | a, y | *Rattus norvegicus* ribosomal protein S24 (Rps24), mRNA. Length = 466 | ribosomal protein S24 |
| 1882 | 20839 | NM_031113 | a, q | *Rattus norvegicus* ribosomal protein S27a (Rps27a), mRNA Length = 552 | ribosomal protein S27a |
| 1883 | 19040 | NM_031114 | l, m, General | Rattus norveglcus S-100 related protein, clone 42C (S100A10), mRNA Length = 573 | S-100 related protein, clone 42C |
| 1884 | 16349 | NM_031115 | u | *Rattus norvegicus* secretin receptor (Sctr), mRNA. Length = 1796 | secretin receptor |
| 1885 | 14970 | NM_031127 | General | *Rattus norvegicus* sulfite oxidase (Suox), mRNA. Length = 1777 | sulfite oxidase |
| 1886 | 1814 | NM_031134 | n, q | *Rattus norvegicus* thyroid hormone receptor alpha (Thra1), mRNA. Length = 2460 | thyroid hormone receptor |
| 1887 | 13359 | NM_031135 | General | *Rattus norvegicus* TGFB inducible early growth response (Tieg), mRNA. Length = 3115 | TGFB inducible early growth response |
| 1888 | 15052 | NM_031136 | a | *Rattus norvegicus* thymosin beta-4 (Tmsb4x), mRNA. Length = 686 | thymosin beta-4 |
| 1888 | 19359 | NM_031136 | a | *Rattus norvegicus* thymosin beta-4 (Tmsb4x), mRNA Length = 686 | EST |
| 1889 | 15185 | NM_031140 | General | *Rattus norvegicus* vimentin (Vim), mRNA. Length = 1796 | vimentin |
| 1890 | 21625 | NM_031144 | a, e | *Rattus norvegicus* cytoplasmic beta-actin (Actx), mRNA. Length = 1128 | cytoplasmic beta-actin |
| 1891 | 238 | NM_031152 | bb | *Rattus norvegicus* RAB11a, member RAS oncogene family (Rab11a), mRNA. Length = 895 | RAB11a, member RAS oncogene family |
| 1891 | 240 | NM_031152 | bb | *Rattus norvegicus* RAB11a, member RAS oncogene family (Rab11a), mRNA. Length = 895 | RAB11a, member RAS oncogene family |
| 1892 | 15277 | NM_031237 | g | *Rattus norvegicus* ubiquitin-conjugating enzyme E2D 3 (homologous to yeast UBC4/5) (Ube2d3), mRNA Length = 1531 | ubiquitin-conjugating enzyme E2D 3 (homologous to yeast UBC4/5) |

TABLE 1-continued

SUMMARY

Atty. Docket No. 44921-5089US
Doc. No. 1803440.1

| Sequence ID No. | Identifier | GenBank Acc/Ref. Seq ID | Model Code | Gene Name | Unigene Cluster Title |
|---|---|---|---|---|---|
| 1893 | 18083 | NM_031315 | q | *Rattus norvegicus* acyl-CoA thioesterase 1, cytosolic (Cte1), mRNA Length = 1591 | *R. norvegicus* mRNA for mitochondrial very-long-chain acyl-CoA thioesterase |
| 1893 | 1858 | NM_031315 | q | *Rattus norvegicus* acyl-CoA thioesterase 1, cytosolic (Cte1), mRNA Length = 1591 | *R. norvegicus* mRNA for mitochondrial very-long-chain acyl-CoA thioesterase, acyl-CoA thioesterase 1, cytosolic |
| 1894 | 15663 | NM_031318 | General | *Rattus norvegicus* t-complex testis expressed 1 (Tctex1), mRNA. Length = 698 | t-complex testis expressed 1 |
| 1895 | 1422 | NM_031324 | bb, General | *Rattus norvegicus* prolyl endopeptidase (Prep), mRNA Length = 2743 | prolyl endopeptidase |
| 1896 | 18597 | NM_031325 | g, bb | *Rattus norvegicus* UDP-glucose dehydrogeanse (Ugdh), mRNA Length = 2318 | UDP-glucose dehydrogeanse |
| 1897 | 11259 | NM_031327 | i, cc General | *Rattus norvegicus* cysteine rich protein 61 (Cyr61), mRNA. Length = 1871 | cysteine rich protein 61 |
| 1898 | 4235 | NM_031330 | General | *Rattus norvegicus* heterogeneous nuclear ribonucleoprotein A/B (Hnrpab), mRNA Length = 3061 | heterogeneous nuclear ribonucleoprotein A/B |
| 1899 | 18375 | NM_031331 | l, m | *Rattus norvegicus* proteasome (prosome, macropain) 26S subunit, non-ATPase, 4 (Psmd4), mRNA. Length = 1334 | proteasome (prosome, macropain) 26S subunit, non-ATPase, 4 |
| 1900 | 3519 | NM_031334 | cc | *Rattus norvegicus* E-cadherin (Cdh1), mRNA Length = 4396 | E-cadherin |
| 1901 | 20698 | NM_031357 | b | *Rattus norvegicus* ceroid-lipofuscinosis, neuronal 2 (Cln2), mRNA. Length = 2485 | |
| 1903 | 634 | NM_031509 | n | *Rattus norvegicus* Glutathione-S-transferase, alpha type (Ya) (Gsta1), mRNA. Length = 1178 | Glutathione-S-transferase, alpha type (Ya) |
| 1903 | 25525 | NM_031509 | n | *Rattus norvegicus* Glutathione-S-transferase, alpha type (Ya) (Gsta1), mRNA. Length = 1178 | Glutathione-S-transferase, alpha type (Ya) |
| 1903 | 25069 | NM_031509 | b, n, w | *Rattus norvegicus* Glutathione-S-transferase, alpha type (Ya) (Gsta1), mRNA. Length = 1178 | |
| 1903 | 635 | NM_031509 | z | *Rattus norvegicus* Glutathione-S-transferase, alpha type (Ya) (Gsta1), mRNA. Length = 1178 | Glutathione-S-transferase, alpha type (Ya) |
| 1904 | 848 | NM_031517 | t | *Rattus norvegicus* Met proto-oncogene (Met), mRNA. Length = 4189 | Met proto-oncogene |
| 1905 | 1872 | NM_031523 | a | *Rattus norvegicus* Nerve growth factor, gamma polypeptide (Ngfg), mRNA. Length = 873 | Nerve growth factor, gamma polypeptide |
| 1905 | 16245 | NM_031523 | a, d, u, | *Rattus norvegicus* Nerve growth factor, gamma polypeptide (Ngfg), mRNA. Length = 873 | *Rattus norvegicus* (clone RSKG50) kallikrein mRNA, 3' end |
| 1905 | 16244 | NM_031523 | a | *Rattus norvegicus* Nerve growth factor, gamma polypeptide (Ngfg), mRNA. Length = 873 | *Rattus norvegicus* (clone RSKG50) kallikrein mRNA, 3' end |
| 1906 | 9370 | NM_031527 | w | *Rattus norvegicus* Protein phosphatase type 1 alpha, catalytic subunit (Ppp1ca), mRNA Length = 1392 | Protein phosphatase type 1 alpha, catalytic subunit |
| 1907 | 20448 | NM_031530 | General | *Rattus norvegicus* Small inducible gene JE (Scya2), mRNA. Length = 780 | Small inducible gene JE |

TABLE 1-continued

SUMMARY

Atty. Docket No. 44921-5089US
Doc. No. 1803440.1

| Sequence ID No. | Identifier | GenBank Acc/Ref. Seq ID | Model Code | Gene Name | Unigene Cluster Title |
|---|---|---|---|---|---|
| 1907 | 20449 | NM_031530 | General | *Rattus norvegicus* Small inducible gene JE (Scya2), mRNA Length = 780 | Small inducible gene JE |
| 1908 | 14633 | NM_031533 | u | *Rattus norvegicus* Androsterone UDP-glucuronosyltransferase (Ugt2b2), mRNA. Length = 1593 | Androsterone UDP-glucuronosyltransferase |
| 1909 | 16048 | NM_031541 | f | *Rattus norvegicus* CD36 antigen (collagen type I receptor, thrombospondin receptor)-like 1 (scavenger receptor class B type 1) (Cd36l1), mRNA. Length = 2497 | CD36 antigen (collagen type I receptor, thrombospondin receptor)-like 1 (scavenger receptor class B type 1) |
| 1910 | 4011 | NM_031543 | c, q | *Rattus norvegicus* Cytochrome P450, subfamily 2e1 (ethanol-inducible) (Cyp2e1), mRNA. Length = 1624 | Cytochrome P450, subfamily 2e1 (ethanol-inducible) |
| 1910 | 4010 | NM_031543 | c, q | *Rattus norvegicus* Cytochrome P450, subfamily 2e1 (ethanol-inducible) (Cyp2e1), mRNA. Length = 1624 | Cytochrome P450, subfamily 2e1 (ethanol-inducible) |
| 1910 | 4012 | NM_031543 | q | *Rattus norvegicus* Cytochrome P450, subfamily 2e1 (ethanol-inducible) (Cyp2e1), mRNA. Length = 1624 | Cytochrome P450, subfamily 2e1 (ethanol-inducible) |
| 1911 | 28 | NM_031546 | General | *Rattus norvegicus* Regucalcin (Rgn), mRNA Length = 1605 | Regucalcin |
| 1912 | 24640 | NM_031548 | h, cc | *Rattus norvegicus* Sodium channel, nonvoltage-gated 1, alpha (epithelial) (Scnn1a), mRNA. Length = 3081 | Sodium channel, nonvoltage-gated 1, alpha (epithelial) |
| 1913 | 17149 | NM_031549 | x | *Rattus norvegicus* Transgelin (Smooth muscle 22 protein) (Tagln), mRNA. Length = 1186 | Transgelin (Smooth muscle 22 protein) |
| 1913 | 17151 | NM_031549 | x | *Rattus norvegicus* Transgelin (Smooth muscle 22 protein) (Tagln), mRNA Length = 1186 | Transgelin (Smooth muscle 22 protein) |
| 1914 | 13105 | NM_031552 | w | *Rattus norvegicus* Adducin 3, gamma (Add3), mRNA. Length = 2246 | Adducin 3, gamma |
| 1915 | 15411 | NM_031559 | d, r | *Rattus norvegicus* Carnitine palmitoyltransferase 1 alpha, liver isoform (Cpt1a), mRNA Length = 4377 | Carnitine palmitoyltransferase 1 alpha, liver isoform |
| 1916 | 16164 | NM_031563 | a, y | *Rattus norvegicus* Y box protein 1 (Ybx1), mRNA. Length = 1489 | Y box protein 1 |
| 1917 | 9621 | NM_031570 | bb | *Rattus norvegicus* ribosomal protein S7 (Rps7), mRNA Length = 650 | ribosomal protein S7 |
| 1917 | 9620 | NM_031570 | w, bb | *Rattus norvegicus* ribosomal protein S7 (Rps7), mRNA. Length = 650 | ribosomal protein S7 |
| 1918 | 546 | NM_031573 | f | *Rattus norvegicus* Phosphorylase kinase, gamma 1 (Phkg1), mRNA Length = 1388 | phosphorylase kinase gamma |
| 1919 | 1921 | NM_031576 | f | *Rattus norvegicus* P450 (cytochrome) oxidoreductase (Por), mRNA Length = 2441 | P450 (cytochrome) oxidoreductase |
| 1919 | 1920 | NM_031576 | r | *Rattus norvegicus* P450 (cytochrome) oxidoreductase (Por), mRNA. Length = 2441 | P450 (cytochrome) oxidoreductase |
| 1920 | 24219 | NM_031579 | i, General | *Rattus norvegicus* protein tyrosine phosphatase 4a1 (Ptp4a1), mRNA. Length = 2638 | protein tyrosine phosphatase 4a1 |
| 1921 | 770 | NM_031584 | k, x | *Rattus norvegicus* solute carrier family 22, member 2 (Slc22a2), mRNA. Length = 2152 | solute carrier family 22, member 2 |
| 1922 | 18008 | NM_031588 | cc | *Rattus norvegicus* neuregulin 1 (Nrg1), mRNA. Length = 3272 | potassium channel, subfamily K, member 3 |

TABLE 1-continued

SUMMARY

Atty. Docket No. 44921-5089US
Doc. No. 1803440.1

| Sequence ID No. | Identifier | GenBank Acc/Ref. Seq ID | Model Code | Gene Name | Unigene Cluster Title |
|---|---|---|---|---|---|
| 1922 | 18005 | NM_031588 | h | *Rattus norvegicus* neuregulin 1 (Nrg1), mRNA. Length = 3272 | potassium channel, subfamily K, member 3 |
| 1922 | 18011 | NM_031588 | cc, General | *Rattus norvegicus* neuregulin 1 (Nrg1), mRNA Length = 3272 | potassium channel, subfamily K, member 3 |
| 1923 | 1584 | NM_031595 | k | *Rattus norvegicus* proteasome (prosome, macropain) 26S subunit, ATPase 3 (Psmc3), mRNA. Length = 1627 | proteasome (prosome, macropain) 26S subunit, ATPase 3 |
| 1924 | 24235 | NM_031614 | v | *Rattus norvegicus* thioredoxin reductase 1 (Txnrd1), mRNA. Length = 3360 | thioredoxin reductase 1 |
| 1924 | 24234 | NM_031614 | General | *Rattus norvegicus* thioredoxin reductase 1 (Txnrd1), mRNA Length = 3360 | thioredoxin reductase 1 |
| 1925 | 1639 | NM_031627 | j, l, v | *Rattus norvegicus* nuclear receptor subfamily 1, group H, member 3 (Nr1h3), mRNA. Length = 1723 | nuclear receptor subfamily 1, group H, member 3 |
| 1926 | 1727 | NM_031642 | m, General | *Rattus norvegicus* core promoter element binding protein (Copeb), mRNA. Length = 1356 | core promoter element binding protein |
| 1927 | 20766 | NM_031643 | y | *Rattus norvegicus* mitogen activated protein kinase kinase 2 (Map2k2), mRNA Length = 1182 | mitogen activated protein kinase kinase 2 |
| 1929 | 1993 | NM_031655 | k, l, m, General | *Rattus norvegicus* latexin (Lxn), mRNA Length = 1087 | latexin |
| 1930 | 2057 | NM_031660 | e | *Rattus norvegicus* cyclic AMP phosphoprotein, 19 kD (Arpp19-pending), mRNA Length = 339 | cyclic AMP phosphoprotein, 19 kD |
| 1931 | 15039 | NM_031672 | k, General | *Rattus norvegicus* solute carrier family 15 (H+/peptide transporter), member 2 (Slc15a2), mRNA. Length = 3923 | solute carrier family 15 (H+/peptide transporter), member 2 |
| 1932 | 15175 | NM_031682 | bb | *Rattus norvegicus* hydroxyacyl-Coenzyme A dehydrogenase, type II (Hadh2), mRNA Length = 917 | hydroxyacyl-Coenzyme A dehydrogenase, type II |
| 1933 | 1004 | NM_031685 | v | *Rattus norvegicus* golgi SNAP receptor complex member 2 (Gosr2), mRNA. Length = 683 | golgi SNAP receptor complex member 2 |
| 1934 | 19727 | NM_031687 | a, q, s | *Rattus norvegicus* ubiquitin A 52 residue ribosomal protein fusion product 1 (Uba52), mRNA. Length = 467 | ubiquitin A-52 residue ribosomal protein fusion product 1 |
| 1935 | 20404 | NM_031700 | j, r, y | *Rattus norvegicus* claudin 3 (Cldn3), mRNA Length = 1192 | claudin 3 |
| 1935 | 20405 | NM_031700 | o, r | *Rattus norvegicus* claudin 3 (Cldn3), mRNA. Length = 1192 | claudin 3 |
| 1936 | 811 | NM_031705 | General | *Rattus norvegicus* dihydropyrimidinase (Dpys), mRNA. Length = 2091 | dihydropyrimidinase |
| 1936 | 812 | NM_031705 | o, v, bb, General | *Rattus norvegicus* dihydropyrimidinase (Dpys), mRNA. Length = 2091 | dihydropyrimidinase |
| 1937 | 16204 | NM_031706 | q, bb | *Rattus norvegicus* ribosomal protein S8 (Rps8), mRNA Length = 696 | ribosomal protein S8 |
| 1937 | 16205 | NM_031706 | a, y | *Rattus norvegicus* ribosomal protein S8 (Rps8), mRNA. Length = 696 | ribosomal protein S8 |
| 1938 | 24081 | NM_031708 | m | *Rattus norvegicus* glycoprotein 110 (Gp110-pending), mRNA. Length = 1444 | glycoprotein 110 |
| 1939 | 16918 | NM_031709 | a, q | *Rattus norvegicus* ribosomal protein S12 (Rps12), mRNA. Length = 499 | ribosomal protein S12 |

TABLE 1-continued

SUMMARY

Atty. Docket No. 44921-5089US
Doc. No. 1803440.1

| Sequence ID No. | GenBank Identifier | Acc/Ref. Seq ID | Model Code | Gene Name | Unigene Cluster Title |
|---|---|---|---|---|---|
| 1940 | 1081 | NM_031712 | General | *Rattus norvegicus* PDZ domain containing 1 (Pdzk1), mRNA. Length = 2005 | PDZ domain containing 1 |
| 1941 | 1340 | NM_031715 | b, n, u, cc, General | *Rattus norvegicus* phosphofructokinase, muscle (Pfkm), mRNA Length = 2757 | phosphofructokinase, muscle |
| 1942 | 23884 | NM_031731 | j, s | *Rattus norvegicus* alcohol dehydrogenase family 3, subfamily A2 (Aldh3a2), mRNA. Length = 2977 | alcohol dehydrogenase family 3, subfamily A2 |
| 1943 | 10241 | NM_031740 | d | *Rattus norvegicus* UDP-Gal: betaGlcNAc beta 1, 4-galactosyltransferase, polypeptide 6 (B4galt6), mRNA. Length = 5729 | UDP-Gal.betaGlcNAc beta 1, 4-galactosyltransferase, polypeptide 6 |
| 1944 | 1214 | NM_031741 | r | *Rattus norvegicus* solute carrier family 2 (facilitated glucose transporter), member 5 (Slc2a5), mRNA. Length = 2169 | solute carrier family 2 (facilitated glucose transporter), member 5 |
| 1944 | 1215 | NM_031741 | r | *Rattus norvegicus* solute carrier family 2 (facilitated glucose transporter), member 5 (Slc2a5), mRNA. Length = 2169 | solute carrier family 2 (facilitated glucose transporter), member 5 |
| 1945 | 20724 | NM_031753 | h | *Rattus norvegicus* activated leukocyte cell adhesion molecule (Alcam), mRNA. Length = 2866 | activated leukocyte cell adhesion molecule |
| 1946 | 20753 | NM_031763 | h | *Rattus norvegicus* platelet-activating factor acetylhydrolase beta subunit (PAF-AH beta) (Pafah1b1), mRNA. Length = 1233 | platelet-activating factor acetylhydrolase beta subunit (PAF-AH beta) |
| 1946 | 20752 | NM_031763 | y | *Rattus norvegicus* platelet-activating factor acetylhydrolase beta subunit (PAF-AH beta) (Pafah1b1), mRNA. Length = 1233 | platelet-activating factor acetylhydrolase beta subunit (PAF-AH beta) |
| 1947 | 14953 | NM_031774 | p | *Rattus norvegicus* rab acceptor 1 (prenylated) (Rabac1), mRNA. Length = 861 | rab acceptor 1 (prenylated) |
| 1948 | 14184 | NM_031776 | t, General | *Rattus norvegicus* guanine deaminase (Gda), mRNA. Length = 1568 | guanine deaminase |
| 1948 | 14185 | NM_031776 | d, o, t, General | *Rattus norvegicus* guanine deaminase (Gda), mRNA. Length = 1568 | guanine deaminase |
| 1949 | 1169 | NM_031789 | c | *Rattus norvegicus* NF-E2-related factor 2 (Nfe2l2), mRNA. Length = 2307 | NF-E2-related factor 2 |
| 1950 | 16155 | NM_031810 | d, z | *Rattus norvegicus* defensin beta 1 (Defb1), mRNA. Length = 416 | defensin beta 1 |
| 1950 | 16156 | NM_031810 | d | *Rattus norvegicus* defensin beta 1 (Defb1), mRNA. Length = 416 | defensin beta 1 |
| 1951 | 17194 | NM_031814 | z | *Rattus norvegicus* G protein-coupled receptor kinase-associated ADP ribosylation factor GTPase-activating protein (GIT1) (Git1), mRNA. Length = 3236 | G protein-coupled receptor kinase-associated ADP ribosylation factor GTPase-activating protein (GIT1) |
| 1952 | 17535 | NM_031816 | bb | *Rattus norvegicus* retinoblastoma binding protein 7 (Rbbp7), mRNA. Length = 1947 | retinoblastoma binding protein 7 |
| 1953 | 2655 | NM_031821 | i, l, m, aa | *Rattus norvegicus* serum-inducible kinase (Snk), mRNA Length = 2781 | serum-inducible kinase |
| 1954 | 10167 | NM_031830 | i | *Rattus norvegicus* reggie1-1 (Flot2), mRNA. Length = 2629 | reggie1-1 |

TABLE 1-continued

SUMMARY

Atty. Docket No. 44921-5089US
Doc. No. 1803440.1

| Sequence ID No. | Identifier | GenBank Acc/Ref. Seq ID | Model Code | Gene Name | Unigene Cluster Title |
|---|---|---|---|---|---|
| 1955 | 22321 | NM_031832 | o, t, u, General | *Rattus norvegicus* IgE binding protein (Lgals3), mRNA Length = 948 | IgE binding protein |
| 1956 | 4748 | NM_031834 | e, t | *Rattus norvegicus* sulfotransferase family 1A, phenol-preferring, member 1 (Sult1a1), mRNA Length = 1227 | minoxidil sulfotransferase |
| 1956 | 4749 | NM_031834 | e, t | *Rattus norvegicus* sulfotransferase family 1A, phenol-preferring, member 1 (Sult1a1), mRNA. Length = 1227 | minoxidil sulfotransferase |
| 1957 | 7914 | NM_031835 | e | *Rattus norvegicus* beta-alanine-pyruvate aminotransferase (AGT2), mRNA. Length = 2151 | beta-alanine-pyruvate aminotransferase |
| 1958 | 8385 | NM_031836 | h | *Rattus norvegicus* vascular endothelial growth factor (Vegf), mRNA. Length = 645 | vascular endothelial growth factor |
| 1958 | 8384 | NM_031836 | h | *Rattus norvegicus* vascular endothelial growth factor (Vegf), mRNA. Length = 645 | vascular endothelial growth factor |
| 1959 | 10268 | NM_031838 | a | *Rattus norvegicus* ribosomal protein S2 (Rps2), mRNA. Length = 819 | ribosomal protein S2 |
| 1959 | 10269 | NM_031838 | aa | *Rattus norvegicus* ribosomal protein S2 (Rps2), mRNA Length = 819 | ribosomal protein S2 |
| 1959 | 10267 | NM_031838 | n, aa | *Rattus norvegicus* ribosomal protein S2 (Rps2), mRNA Length = 819 | ribosomal protein S2 |
| 1960 | 15077 | NM_031841 | b | *Rattus norvegicus* stearoyl-CoA desaturase 2 (Scd2), mRNA. Length = 5055 | stearoyl-CoA desaturase 2 |
| 1961 | 16726 | NM_031855 | x | *Rattus norvegicus* Ketohexokinase (Khk), mRNA. Length = 1342 | Ketohexokinase |
| 1962 | 25802 | NM_031969 | a | *Rattus norvegicus* Calmodulin 1 (phosphorylase kinase, delta) (Calm1), mRNA. Length = 3513 | Calmodulin 1 (phosphorylase kinase, delta) |
| 1962 | 19191 | NM_031969 | c | *Rattus norvegicus* Calmodulin 1 (phosphorylase kinase, delta) (Calm1), mRNA. Length = 3513 | Calmodulin 1 (phosphorylase kinase, delta) |
| 1962 | 19195 | NM_031969 | r | *Rattus norvegicus* Calmodulin 1 (phosphorylase kinase, delta) (Calm1), mRNA Length = 3513 | Calmodulin 1 (phosphorylase kinase, delta) |
| 1962 | 19190 | NM_031969 | p | *Rattus norvegicus* Calmodulin 1 (phosphorylase kinase, delta) (Calm1), mRNA. Length = 3513 | Calmodulin 1 (phosphorylase kinase, delta) |
| 1963 | 17734 | NM_031970 | v, General | *Rattus norvegicus* Heat shock 27 kDa protein (Hsp27), mRNA Length = 787 | ESTs, Heat shock 27 kDa protein |
| 1964 | 1475 | NM_031971 | v | *Rattus norvegicus* Heat shock protein 70-1 (Hspa1a), mRNA. Length = 2455 | ESTs, Highly similar to S10A RAT S-100 PROTEIN, ALPHA CHAIN [*R. norvegicus*], Heat shock protein 70-1 |
| 1965 | 15470 | NM_031978 | f | *Rattus norvegicus* 26S proteasome, subunit p112 (PSMD1), mRNA. Length = 3089 | 26S proteasome, subunit p112 |
| 1966 | 18502 | NM_031984 | c | *Rattus norvegicus* cerebellar Ca-binding protein, spot 35 protein (Calb1), mRNA. Length = 2280 | cerebellar Ca-binding protein, spot 35 protein |
| 1967 | 19768 | NM_031986 | v, aa, General | *Rattus norvegicus* syntenin (Sdcbp), mRNA. Length = 2077 | syntenin |
| 1968 | 723 | NM_032084 | n | *Rattus norvegicus* chimerin (chimaerin) 2 (Chn2), mRNA. Length = 1118 | chimerin (chimaerin) 2 |
| 1969 | 17935 | NM_032615 | a | *Rattus norvegicus* membrane interacting | membrane interacting protein of RGS16 |

TABLE 1-continued

SUMMARY

| Sequence ID No. | Identifier | GenBank Acc/Ref. Seq ID | Model Code | Gene Name | Unigene Cluster Title |
|---|---|---|---|---|---|
| | | | | protein of RGS16 (Mir16), mRNA. Length = 1203 | |
| 1970 | 16831 | NM_033095 | n | *Rattus norvegicus* Crystallin, gamma polypeptide 4 (Crygd), mRNA. Length = 634 | |
| 1971 | 25468 | NM_033234 | c, z | *Rattus norvegicus* Hemoglobin, beta (Hbb), mRNA. Length = 620 | |
| 1971 | 25469 | NM_033234 | c | *Rattus norvegicus* Hemoglobin, beta (Hbb), mRNA Length = 620 | |
| 1971 | 17832 | NM_033234 | c, p | *Rattus norvegicus* Hemoglobin, beta (Hbb), mRNA. Length = 620 | Rat major beta-globin mRNA, complete cds |
| 1971 | 17829 | NM_033234 | c, z | *Rattus norvegicus* Hemoglobin, beta (Hbb), mRNA Length = 620 | Rat major beta-globin mRNA, complete cds |
| 1972 | 4723 | NM_033235 | z | *Rattus norvegicus* Malate dehydrogenase-like enzyme (Mdhl), mRNA. Length = 1266 | *Rattus norvegicus* cytosolic malate dehydrogenase (Mdh) mRNA, complete cds |
| 1973 | 1409 | NM_033349 | p, General | *Rattus norvegicus* Hydroxyacyl glutathione hydrolase (Hagh), mRNA. Length = 783 | *Rattus norvegicus* round spermatid protein RSP29 gene, complete cds |
| 1974 | 19998 | NM_033352 | General | *Rattus norvegicus* ATP-binding cassette, sub-family D (ALD), member 2 (Abcd2), mRNA. Length = 5531 | PDZ domain containing 1 |
| 1975 | 1410 | NM_052798 | d | *Rattus norvegicus* Kidney 1 (Kid1), mRNA. Length = 2563 | Rat zinc finger protein (kid-1) mRNA, complete cds |
| 1976 | 15028 | NM_052809 | f | *Rattus norvegicus* cytosolic cysteine dioxygenase 1 (Cdo1), mRNA. Length = 1458 | Rat cysteine dioxygenase mRNA, complete cds |
| 1977 | 5176 | NM_053297 | u | *Rattus norvegicus* Pyruvate kinase 3 (Pkm2), mRNA. Length = 1973 | Rat mRNA for pituitary pyruvate kinase |
| 1978 | 7660 | NM_053299 | i | *Rattus norvegicus* ubiquitin D (Ubd), mRNA. Length = 684 | ESTs, Weakly similar to polyubiquitin [*R. norvegicus*] |
| 1979 | 5117 | NM_053310 | p | *Rattus norvegicus* homer, neuronal immediate early gene, 3 (Homer3), mRNA. Length = 1207 | *Rattus norvegicus* mRNA for Vesl-3, complete cds |
| 1981 | 17473 | NM_053319 | a, v | *Rattus norvegicus* dynein, cytoplasmic, light chain 1 (Pin), mRNA. Length = 505 | *Rattus norvegicus* protein inhibitor of neuronal nitric oxide synthase (PIN) mRNA, complete cds |
| 1982 | 25480 | NM_053329 | g | *Rattus norvegicus* insulin-like growth factor binding protein, acid labile subunit (Igfals), mRNA. Length = 1812 | |
| 1982 | 21977 | NM_053329 | y | *Rattus norvegicus* insulin-like growth factor binding protein, acid labile subunit (Igfals), mRNA. Length = 1812 | *Rattus norvegicus* insulin-like growth factor binding protein complex acid-labile subunit gene, complete cds |
| 1983 | 14926 | NM_053330 | f | *Rattus norvegicus* ribosomal protein L21 (Rpl21), mRNA Length = 554 | *Rattus norvegicus* ribosomal protein L21 mRNA, complete cds |
| 1983 | 14929 | NM_053330 | e, General | *Rattus norvegicus* ribosomal protein L21 (Rpl21), mRNA. Length = 554 | *Rattus norvegicus* ribosomal protein L21 mRNA, complete cds |
| 1984 | 16407 | NM_053332 | c, e | *Rattus norvegicus* cubilin (intrinsic factor-cobalamin receptor) (Cubn), mRNA. Length = 10,872 | *Rattus norvegicus* intrinsic factor-B12 receptor precursor (CUBILIN) mRNA, complete cds |
| 1985 | 15790 | NM_053341 | j, x | *Rattus norvegicus* regulator of G-protein signaling 19 (Rgs19), mRNA. Length = 1607 | regulator of G-protein signaling 19 |
| 1986 | 6154 | NM_053356 | p | *Rattus norvegicus* procollagen, type I, alpha 2 (Col1a2), mRNA Length = 4474 | procollagen, type I, alpha 2 |
| 1987 | 9215 | NM_053374 | i | *Rattus norvegicus* interferon gamma inducing factor | interferon gamma inducing factor binding protein |

TABLE 1-continued

SUMMARY

Atty. Docket No. 44921-5089US
Doc. No. 1803440.1

| Sequence ID No. | GenBank Identifier | Acc/Ref. Seq ID | Model Code | Gene Name | Unigene Cluster Title |
|---|---|---|---|---|---|
| | | | | binding protein (Igifbp), mRNA. Length = 626 | |
| 1988 | 6416 | NM_053380 | General | *Rattus norvegicus* solute carrier family 34 (sodium phosphate), member 2 (Slc34a2), mRNA. Length = 3950 | solute carrier family 34 (sodium phosphate), member 2 |
| 1989 | 19113 | NM_053395 | a | *Rattus norvegicus* small muscle protein, X-linked (Smpx), mRNA. Length = 892 | *Rattus norvegicus* SMPX protein (Smpx) mRNA, complete cds |
| 1990 | 2242 | NM_053433 | n, General | *Rattus norvegicus* flavin-containing monooxygenase 3 (Fmo3), mRNA. Length = 2037 | flavin-containing monooxygenase 3 |
| 1991 | 5561 | NM_053438 | y | *Rattus norvegicus* zinc finger protein 103 (Zfp103), mRNA. Length = 3258 | zinc finger protein 103 |
| 1992 | 14670 | NM_053439 | n, General | *Rattus norvegicus* RAN, member RAS oncogene family (Ran), mRNA Length = 1084 | RAN, member RAS oncogene family |
| 1993 | 17102 | NM_053440 | w | *Rattus norvegicus* superiorcervical ganglia, neural specific 10 (Scgn10), mRNA. Length = 1654 | superiorcervical ganglia, neural specific 10 |
| 1994 | 24762 | NM_053442 | General | *Rattus norvegicus* solute carrier family 8 (cationic amino acid transporter, $y^+$ system), member 7 (Lat4), mRNA. Length = 4117 | solute carrier family 8 (cationic amino acid transporter, $y^+$ system), member 7 |
| 1995 | 8085 | NM_053453 | General | *Rattus norvegicus* regulator of G-protein signaling protein 2 (Rgs2), mRNA. Length = 1629 | regulator of G-protein signaling protein 2 |
| 1996 | 4622 | NM_053463 | d | *Rattus norvegicus* nucleobindin (Nucb), mRNA. Length = 2303 | nucleobindin |
| 1997 | 21866 | NM_053472 | p | *Rattus norvegicus* cytochrome c oxidase subunit IV isoform 2 precursor (CoxIV-2), mRNA. Length = 704 | cytochrome c oxidase subunit IV isoform 2 precursor |
| 1998 | 9573 | NM_053475 | h | *Rattus norvegicus* protein tyrosine phosphatase type IVA, member 2 (Ptp4a2), mRNA. Length = 1095 | protein tyrosine phosphatase type IVA, member 2 |
| 1999 | 16137 | NM_053480 | k | *Rattus norvegicus* DNA polymerase alpha subunit II (Pola2), mRNA. Length = 1836 | DNA polymerase alpha subunit II |
| 2000 | 15556 | NM_053483 | y | *Rattus norvegicus* karyopherin (importin) alpha 2 (Kpna2), mRNA. Length = 1886 | karyopherin (importin) alpha 2 |
| 2001 | 16394 | NM_053485 | General | *Rattus norvegicus* calcium binding protein A6 (calcyclin) (S100a6), mRNA. Length = 291 | calcium binding protein A6 (calcyclin) |
| 2002 | 4290 | NM_053487 | j, y | *Rattus norvegicus* peroxisomal membrane protein Pmp26p (Peroxin-11) (Pex11a), mRNA. Length = 1194 | peroxisomal membrane protein Pmp26p (Peroxin-11) |
| 2004 | 18826 | NM_053523 | d | *Rattus norvegicus* homocysteine-inducible, endoplasmic reticulum stress inducible, ubiquitin-like domain member 1 (Herpud1), mRNA. Length = 1857 | *Rattus norvegicus* SUP mRNA, complete cds |
| 2005 | 7764 | NM_053525 | aa | *Rattus norvegicus* ATP-dependent, RNA helicase (Rok1), mRNA. Length = 2175 | *Rattus norvegicus* rROK1L mRNA for ROK1-like protein, complete cds |
| 2006 | 14199 | NM_053538 | c | *Rattus norvegicus* lysosomal-associated protein transmembrane 5 (Laptm5), mRNA. Length = 1309 | *Rattus norvegicus* gcd-10S mRNA, complete cds |
| 2007 | 1058 | NM_053539 | c, d | *Rattus norvegicus* isopentenyl-diphosphate delta isomerase (Idi1), mRNA. Length = 1182 | *Rattus norvegicus* isopentenyl diphosphate: dimethylallyl diphosphate isomerase mRNA, complete cds |

TABLE 1-continued

SUMMARY

Atty. Docket No. 44921-5089US
Doc. No. 1803440.1

| Sequence ID No. | Identifier | GenBank Acc/Ref. Seq ID | Model Code | Gene Name | Unigene Cluster Title |
|---|---|---|---|---|---|
| 2008 | 4327 | NM_053563 | General | *Rattus norvegicus* nuclear RNA helicase, DECD variant of DEAD box family (Ddxl), mRNA. Length = 1511 | *Rattus norvegicus* nuclear RNA helicase mRNA, complete cds |
| 2009 | 1342 | NM_053573 | h | *Rattus norvegicus* neuronal olfactomedin related ER localized protein (Olfm1), mRNA. Length = 2759 | *Rattus norvegicus* neuronal olfactomedin-related ER localized protein (D2Sut1e) mRNA, complete cds |
| 2010 | 19254 | NM_053576 | h, s | *Rattus norvegicus* thiol-specific antioxidant protein (Prdx5), mRNA. Length = 1414 | *Rattus norvegicus* mRNA for thiol-specific antioxidant protein (1-Cys peroxiredoxin) |
| 2010 | 19253 | NM_053576 | h | *Rattus norvegicus* thiol-specific antioxidant protein (Prdx5), mRNA. Length = 1414 | *Rattus norvegicus* mRNA for thiol-specific antioxidant protein (1-Cys peroxiredoxin) |
| 2011 | 3049 | NM_053582 | p, cc, General | *Rattus norvegicus* glucocorticoid-inducible protein (gis5), mRNA. Length = 1869 | *Rattus norvegicus* gis5 mRNA for glucocorticoid-inducible protein, complete cds |
| 2011 | 3050 | NM_053582 | o, General | *Rattus norvegicus* glucocorticoid-inducible protein (gis5), mRNA. Length = 1869 | *Rattus norvegicus* gis5 mRNA for glucocorticoid-inducible protein, complete cds |
| 2012 | 21423 | NM_053586 | s, y | *Rattus norvegicus* cytochrome c oxidase subunit Vb (Cox5b), mRNA Length = 485 | Rat mRNA for cytochrome c oxidase subunit VIa |
| 2013 | 21445 | NM_053587 | t, v | *Rattus norvegicus* S100 calcium-binding protein A9 (calgranulin B) (S100a9), mRNA Length = 494 | *Rattus norvegicus* intracellular calcium binding protein (MRP14) mRNA, complete cds |
| 2014 | 20871 | NM_053591 | j, l | *Rattus norvegicus* dipeptidase 1 (Dpep1), mRNA. Length = 2179 | Rat dipeptidase (dpep1) mRNA, complete cds |
| 2014 | 20870 | NM_053591 | l | *Rattus norvegicus* dipeptidase 1 (Dpep1), mRNA. Length = 2179 | Rat dipeptidase (dpep1) mRNA, complete cds |
| 2015 | 21044 | NM_053594 | d | *Rattus norvegicus* protein tyrosine phosphatase, receptor type, R (Ptprr), mRNA Length = 3565 | *Rattus norvegicus* mRNA for tyrosine phosphatase CBPTP, complete cds |
| 2016 | 21709 | NM_053596 | k | *Rattus norvegicus* endothelin converting enzyme 1 (Ece1), mRNA. Length = 4469 | Rat mRNA for endothelin-converting enzyme, complete cds |
| 2016 | 21708 | NM_053596 | z | *Rattus norvegicus* endothelin converting enzyme 1 (Ece1), mRNA. Length = 4469 | Rat mRNA for endothelin-converting enzyme, complete cds |
| 2017 | 1597 | NM_053611 | t | *Rattus norvegicus* nuclear proten 1 (Nupr1), mRNA. Length = 602 | *Rattus norvegicus* p8 mRNA, complete cds |
| 2018 | 5565 | NM_053618 | General | *Rattus norvegicus* Bardet-Biedl syndrome 2 (human) (Bbs2), mRNA Length = 2573 | *Rattus norvegicus* BBS2 (Bbs2) mRNA, complete cds |
| 2019 | 13004 | NM_053623 | t | *Rattus norvegicus* fatty acid-Coenzyme A ligase, long chain 4 (Facl4), mRNA. Length = 4862 | *Rattus norvegicus* mRNA for Acyl-CoA synthetase, complete cds |
| 2020 | 1127 | NM_053626 | g | *Rattus norvegicus* D-amino acid oxidase (Dao1), mRNA. Length = 1646 | *Rattus norvegicus* mRNA for D-amino-acid oxidase, complete cds |
| 2021 | 18644 | NM_053648 | n | *Rattus norvegicus* beta-carotene 15, 15'-dioxygenase (Bcdo), mRNA. Length = 2207 | *Rattus norvegicus* mRNA for beta-carotene 15, 15'-dioxygenase, complete cds |
| 2022 | 21637 | NM_053653 | p | *Rattus norvegicus* vascular endothelial growth factor C (Vegfc), mRNA. Length = 1596 | ESTs, Highly similar to VEGC MOUSE VASCULAR ENDOTHELIAL GROWTH FACTOR C PRECURSOR [*M. musculus*] |
| 2023 | 3454 | NM_053662 | cc | *Rattus norvegicus* cyclin L (Ccnl), mRNA Length = 2092 | *Rattus norvegicus* cyclin ania-6a mRNA, complete cds |
| 2024 | 16121 | NM_053698 | h, j, z | *Rattus norvegicus* Cbp/p300-interacting transactivator, with Glu/Asp-rich carboxy-terminal domain, 2 (Cited2), mRNA Length = 1155 | *Rattus norvegicus* transcription factor MRG1 mRNA, complete cds |

TABLE 1-continued

SUMMARY

Atty. Docket No. 44921-5089US
Doc. No. 1803440.1

| Sequence ID No. | Identifier | GenBank Acc/Ref. Seq ID | Model Code | Gene Name | Unigene Cluster Title |
|---|---|---|---|---|---|
| 2024 | 16122 | NM_053698 | h, j, z | *Rattus norvegicus* Cbp/p300-interacting transactivator, with Glu/Asp-rich carboxy-terminal domain, 2 (Cited2), mRNA Length = 1155 | *Rattus norvegicus* transcription factor MRG1 mRNA, complete cds |
| 2025 | 25379 | NM_053713 | General | *Rattus norvegicus* Kruppel-like factor 4 (gut) (Klf4), mRNA Length = 2393 | |
| 2025 | 13622 | NM_053713 | General | *Rattus norvegicus* Kruppel-like factor 4 (gut) (Klf4), mRNA. Length = 2393 | ESTs, Moderately similar to zinc finger protein [*R. norvegicus*] |
| 2026 | 15376 | NM_053747 | h | *Rattus norvegicus* ubiquilin 1 (Ubqln1), mRNA. Length = 2131 | *Rattus norvegicus* mRNA for DA41, complete cds |
| 2027 | 1218 | NM_053748 | b | *Rattus norvegicus* dipeptidylpeptidase III (Dpp3), mRNA Length = 2632 | *Rattus norvegicus* mRNA for dipeptidyl peptidase III, complete cds |
| 2028 | 1137 | NM_053763 | y | *Rattus norvegicus* cytochrome P450, 40 (25-hydroxyvitamin D3 1 alpha-hydroxylase) (Cyp40), mRNA. Length = 2426 | *Rattus norvegicus* 25-hydroxyvitamin D 1-hydroxylase (CYP1) mRNA, complete cds |
| 2029 | 15996 | NM_053769 | cc | *Rattus norvegicus* protein tyrosine phosphatase, non-receptor type 16 (Ptpn16), mRNA Length = 1104 | *Rattus norvegicus* protein tyrosine phosphatase mRNA, complete cds |
| 2030 | 8652 | NM_053774 | g | *Rattus norvegicus* ubiquitin specific protease 2 (Usp2), mRNA Length = 1857 | *Rattus norvegicus* deubiquitinating enzyme Ubp69 (ubp69) mRNA, complete cds |
| 2031 | 14664 | NM_053806 | General | *Rattus norvegicus* potassium channel, subfamily K, member 6 (TWIK-2) (Kcnk6), mRNA Length = 2243 | ESTs |
| 2032 | 4361 | NM_053812 | k | *Rattus norvegicus* BCL2-antagonist/killer 1 (Bak1), mRNA Length = 1923 | *Rattus norvegicus* BAK protein (Bak) mRNA, complete cds |
| 2034 | 15002 | NM_053819 | b, x, bb, General | *Rattus norvegicus* tissue inhibitor of metalloproteinase 1 (Timp1), mRNA Length = 740 | *Rattus norvegicus* tissue inhibitor of metalloproteinase-1 (TIMP1), mRNA, complete cds |
| 2034 | 15003 | NM_053819 | b, l, x, bb, General | *Rattus norvegicus* tissue inhibitor of metalloproteinase 1 (Timp1), mRNA. Length = 740 | *Rattus norvegicus* tissue inhibitor of metalloproteinase-1 (TIMP1), mRNA, complete cds |
| 2035 | 16173 | NM_053822 | t | *Rattus norvegicus* S100 calcium-binding protein A8 (calgranulin A) (S100a8), mRNA. Length = 361 | *Rattus norvegicus* intercellular calcium binding protein (MRP8) mRNA, complete cds |
| 2036 | 17154 | NM_053835 | j, z | *Rattus norvegicus* clathrin, light polypeptide (Lcb) (Cltb), mRNA Length = 982 | Rat clathrin light chain (LCB2) mRNA, complete cds, Rat clathrin light chain (LCB3) mRNA, complete cds |
| 2037 | 20868 | NM_053843 | t | *Rattus norvegicus* Fc receptor, IgG, low affinity III (Fcgr3), mRNA Length = 1318 | Rat Fc-gamma receptor mRNA, complete cds |
| 2037 | 20869 | NM_053843 | t | *Rattus norvegicus* Fc receptor, IgG, low affinity III (Fcgr3), mRNA. Length = 1318 | Rat Fc-gamma receptor mRNA, complete cds |
| 2040 | 714 | NM_053863 | y | *Rattus norvegicus* solute carrier family 28 (sodium-coupled nucleoside transporter), member 1 (Slc28a1), mRNA. Length = 2401 | *Rattus norvegicus* Sprague-Dawley sodium-dependent nucleoside transporter (rCNT1) mRNA, complete cds |
| 2041 | 19781 | NM_053883 | b | *Rattus norvegicus* dual specificity phosphatase 6 (Dusp6), mRNA Length = 2104 | *Rattus norvegicus* dual-specificity protein tyrosine phosphatase (rVH6) mRNA, complete cds |
| 2041 | 19780 | NM_053883 | b | *Rattus norvegicus* dual specificity phosphatase 6 (Dusp6), mRNA Length = 2104 | *Rattus norvegicus* dual-specificity protein tyrosine phosphatase (rVH6) mRNA, complete cds |
| 2042 | 1454 | NM_053887 | General | *Rattus norvegicus* mitogen activated protein kinase kinase kinase 1 (Map3k1), mRNA Length = 5180 | *Rattus norvegicus* MAP kinase kinase kinase 1 (MEKK1) mRNA, complete cds |
| 2043 | 1660 | NM_053891 | g | *Rattus norvegicus* cyclin-dependent kinase 5, | *Rattus norvegicus* P35 mRNA, complete cds |

TABLE 1-continued

SUMMARY

Atty. Docket No. 44921-5089US
Doc. No. 1803440.1

| Sequence ID No. | Identifier | GenBank Acc/Ref. Seq ID | Model Code | Gene Name | Unigene Cluster Title |
|---|---|---|---|---|---|
| 2044 | 712 | NM_053896 | k | regulatory subunit 1 (p35) (Cdk5r), mRNA. Length = 1208 *Rattus norvegicus* aldehyde dehydrogenase family 1, subfamily A2 (Aldh1a2), mRNA Length = 2240 | *Rattus norvegicus* aldehyde dehydrogenase mRNA, complete cds |
| 2045 | 753 | NM_053897 | k | *Rattus norvegicus* coagulation factor II (thrombin) receptor-like 1 (F2rl1), mRNA. Length = 1428 | *Rattus norvegicus* proteinase-activated receptor-2 mRNA, complete cds |
| 2046 | 794 | NM_053902 | General | *Rattus norvegicus* kynureninase (L-kynurenine hydrolase) (Kynu), mRNA Length = 1765 | *Rattus norvegicus* L-kynurenine hydrolase mRNA, complete cds |
| 2047 | 17937 | NM_053911 | f | *Rattus norvegicus* pleckstrin homology, Sec7 and coiled/coil domains 2 (Pscd2), mRNA. Length = 1561 | *Rattus norvegicus* sec7B mRNA, complete cds |
| 2048 | 8188 | NM_053927 | General | *Rattus norvegicus* erythrocyte membrane protein band 4.1-like 3 (Epb4113), mRNA. Length = 4543 | *Rattus norvegicus* mRNA for type II brain 4.1, complete cds |
| 2050 | 1628 | NM_053936 | h | *Rattus norvegicus* endothelial differentiation, lysophosphatidic acid G-protein-coupled receptor, 2 (Edg2), mRNA Length = 1543 | *Rattus norvegicus* putative G-protein coupled receptor GPCR91 (Gpcr91) mRNA, complete cds |
| 2051 | 13954 | NM_053955 | General | *Rattus norvegicus* crystallin, mu (Crym), mRNA. Length = 1227 | *Rattus norvegicus* CDK108 mRNA |
| 2052 | 408 | NM_053961 | General | *Rattus norvegicus* endoplasmic retuclum protein 29 (Erp29), mRNA. Length = 4529 | *R. norvegicus* mRNA encoding 45 kDa protein which binds to heymann nephritis antigen gp330 |
| 2052 | 19991 | NM_053961 | a | *Rattus norvegicus* endoplasmic retuclum protein 29 (Erp29), mRNA. Length = 4529 | mitochondrial aconitase (nuclear aco2 gene) |
| 2052 | 16190 | NM_053961 | q | *Rattus norvegicus* endoplasmic retuclum protein 29 (Erp29), mRNA. Length = 4529 | ESTs, Weakly similar to ECHM RAT ENOYL-COA HYDRATASE, MITOCHONDRIAL PRECURSOR [*R. norvegicus*] |
| 2052 | 21355 | NM_053961 | j, l, y, z | *Rattus norvegicus* endoplasmic retuclum protein 29 (Erp29), mRNA. Length = 4529 | ESTs |
| 2055 | 15136 | NM_053971 | aa | *Rattus norvegicus* ribosomal protein L6 (Rpl6), mRNA. Length = 963 | *R. norvegicus* mRNA for ribosomal protein L6 |
| 2055 | 15135 | NM_053971 | d | *Rattus norvegicus* ribosomal protein L6 (Rpl6), mRNA. Length = 963 | *R. norvegicus* mRNA for ribosomal protein L6 |
| 2056 | 1764 | NM_053974 | h | *Rattus norvegicus* eukaryotic translation initiation factor 4E (Eif4e), mRNA. Length = 1647 | *R. norvegicus* mRNA eIF-4E |
| 2057 | 1292 | NM_053980 | l | *Rattus norvegicus* ADP-ribosylation factor related protein 1 (Arfrp1), mRNA Length = 943 | *R. norvegicus* (Sprague Dawley) ARP1 mRNA for ARF-related protein |
| 2058 | 15468 | NM_053982 | q | *Rattus norvegicus* ribosomal protein S15a (Rps15a), mRNA. Length = 449 | *R. norvegicus* mRNA for ribosomal protein S15a |
| 2059 | 15642 | NM_053985 | General | *Rattus norvegicus* H3 histone, family 3B (H3f3b), mRNA. Length = 1107 | *R. norvegicus* mRNA for histone H3.3 |
| 2060 | 21066 | NM_054001 | t | *Rattus norvegicus* CD36 antigen (collagen type I receptor, thrombospondin receptor)-like 2 (Cd36l2), mRNA Length = 1938 | Rat lysosomal membrane protein (LIMPII) mRNA, complete cds |
| 2061 | 17326 | NM_054008 | o | *Rattus norvegicus* Rgc32 protein (Rgc32), mRNA. Length = 889 | *Rattus norvegicus* RGC-32 (RGC-32) mRNA, complete cds |

TABLE 1-continued

SUMMARY

Atty. Docket No. 44921-5089US
Doc. No. 1803440.1

| Sequence ID No. | Identifier | GenBank Acc/Ref. Seq ID | Model Code | Gene Name | Unigene Cluster Title |
|---|---|---|---|---|---|
| 2061 | 17327 | NM_054008 | cc | *Rattus norvegicus* Rgc32 protein (Rgc32), mRNA. Length = 889 | *Rattus norvegicus* RGC-32 (RGC-32) mRNA, complete cds |
| 2061 | 17329 | NM_054008 | g, o, cc | *Rattus norvegicus* Rgc32 protein (Rgc32), mRNA. Length = 889 | *Rattus norvegicus* RGC-32 (RGC-32) mRNA, complete cds |
| 2062 | 25253 | NM_057099 | j, l, m, p, z | *Rattus norvegicus* proteasome (prosome, macropain) subunit, beta type 6 (Psmb6), mRNA. Length = 760 | |
| 2062 | 22849 | NM_057099 | j, l | *Rattus norvegicus* proteasome (prosome, macropain) subunit, beta type 6 (Psmb6), mRNA. Length = 760 | ESTs, Highly similar to PROTEASOME DELTA CHAIN PRECURSOR [*R. norvegicus*] |
| 2063 | 19657 | NM_057103 | b, cc | *Rattus norvegicus* A kinase (PRKA) anchor protein (gravin) 12 (Akap12), mRNA Length = 5236 | *Rattus norvegicus* PKC binding protein and substrate mRNA, complete cds |
| 2064 | 5492 | NM_057105 | w | *Rattus norvegicus* UDP glycosyltransferase 1 family, polypeptide A6 (Ugt1a6), mRNA. Length = 1593 | ESTs, UDP-glucuronosyltransferase 1 family, member 1 |
| 2064 | 15126 | NM_057105 | r | *Rattus norvegicus* UDP glycosyltransferase 1 family, polypeptide A6 (Ugt1a6), mRNA. Length = 1593 | *Rattus norvegicus* UDP-glucuronosyltransferase UGT1A7 mRNA, complete cds, UDP-glucuronosyltransferase 1 family, member 1 |
| 2064 | 15125 | NM_057105 | s | *Rattus norvegicus* UDP glycosyltransferase 1 family, polypeptide A6 (Ugt1a6), mRNA Length = 1593 | *Rattus norvegicus* UDP-glucuronosyltransferase UGT1A7 mRNA, complete cds, UDP-glucuronosyltransferase 1 family, member 1 |
| 2066 | 15391 | NM_057114 | n | *Rattus norvegicus* peroxiredoxin 1 (Prdx1), mRNA Length = 882 | Rat mRNA for HBP23 (heme-binding protein 23 kDa), complete cds |
| 2067 | 727 | NM_057123 | m | *Rattus norvegicus* protease (prosome, macropain) 26S subunit, ATPase 1 (Psmc1), mRNA. Length = 1556 | *Rattus norvegicus* mRNA for proteasomal ATPase (S4), complete cds |
| 2068 | 915 | NM_057124 | s | *Rattus norvegicus* pyrimidinergic receptor P2Y, G-protein coupled, 6 (P2ry6), mRNA. Length = 1922 | Rat mRNA for novel G protein-coupled P2 receptor, complete cds |
| 2069 | 15151 | NM_057131 | k | *Rattus norvegicus* phosphoribosyl pyrophosphate synthetase-associated protein 2 (Prpsap2), mRNA. Length = 1612 | *Rattus norvegicus* mRNA for 41-kDa phosphoribosylpyrophosphate synthetase-associated protein, complete cds |
| 2070 | 1892 | NM_057144 | b | *Rattus norvegicus* cysteine-rich protein 3 (Csrp3), mRNA Length = 853 | *R. norvegicus* mRNA for muscle LIM protein |
| 2071 | 12333 | NM_057155 | f | *Rattus norvegicus* X-prolyl aminopeptidase (aminopeptidase P) 2, membrane-bound (Xpnpep2), mRNA. Length = 2828 | *Rattus norvegicus* membrane-bound aminopeptidase P mRNA, complete cds |
| 2071 | 12331 | NM_057155 | v, General | *Rattus norvegicus* X-prolyl aminopeptidase (aminopeptidase P) 2, membrane-bound (Xpnpep2), mRNA. Length = 2828 | *Rattus norvegicus* membrane-bound aminopeptidase P mRNA, complete cds |
| 2071 | 12332 | NM_057155 | f, General | *Rattus norvegicus* X-prolyl aminopeptidase (aminopeptidase P) 2, membrane-bound (Xpnpep2), mRNA Length = 2828 | *Rattus norvegicus* membrane-bound aminopeptidase P mRNA, complete cds |
| 2072 | 17477 | NM_057194 | a, General | *Rattus norvegicus* phospholipid scramblase 1 (Plscr1), mRNA. Length = 1569 | *Rattus norvegicus* phospholipid scramblase PLSCR mRNA, complete cds |

TABLE 1-continued

SUMMARY

Atty. Docket No. 44921-5089US
Doc. No. 1803440.1

| Sequence ID No. | Identifier | GenBank Acc/Ref. Seq ID | Model Code | Gene Name | Unigene Cluster Title |
|---|---|---|---|---|---|
| 2073 | 15408 | NM_057197 | p, t | *Rattus norvegicus* 2,4-dienoyl CoA reductase 1, mitochondrial (Decr1), mRNA Length = 1109 | *Rattus norvegicus* mRNA for 2,4-dienoyl-CoA reductase precursor, complete cds |
| 2073 | 15409 | NM_057197 | t | *Rattus norvegicus* 2,4-dienoyl CoA reductase 1, mitochondrial (Decr1), mRNA Length = 1109 | *Rattus norvegicus* mRNA for 2,4-dienoyl-CoA reductase precursor, complete cds |
| 2074 | 7866 | NM_057198 | h | *Rattus norvegicus* phosphoribosyl pyrophosphate amidotransferase (Ppat), mRNA Length = 2934 | *Rattus norvegicus* mRNA for amidophosphoribosyltransferase |
| 2075 | 14125 | NM_057208 | h, j, y, z | *Rattus norvegicus* tropomyosin 3, gamma (Tpm3), mRNA Length = 1101 | *Rattus norvegicus* tropomyosin non-muscle isoform NM1 (TPM-gamma) mRNA, complete cds, Rattus norvegicus tropomyosin non-muscle isoform NM3 (TPM-gamma) mRNA, complete cds |
| 2076 | 1743 | NM_057210 | k, s | *Rattus norvegicus* synaptic vesicle glycoprotein 2 a (Sv2a), mRNA. Length = 3844 | *Rattus norvegicus* synaptic vesicle protein (SV2) mRNA, complete cds |
| 2077 | 10498 | NM_078617 | a | *Rattus norvegicus* ribosomal protein S23 (Rps23), mRNA. Length = 432 | *R. norvegicus* (Sprague-Dawley) ribosomal protein S23 mRNA |
| 2078 | 8820 | NM_080399 | n | *Rattus norvegicus* Smhs 1 protein (Smhs 1), mRNA Length = 1107 | ESTs |
| 2079 | 15701 | NM_080581 | j, m, y, z | *Rattus norvegicus* ATP-binding cassette, sub-family C (CFTR/MRP), member 3 (Abcc3), mRNA. Length = 5174 | *Rattus norvegicus* mRNA for multidrug resistance-associated protein (MRP)-like protein-2 (MLP-2), complete cds |
| 2079 | 20105 | NM_080581 | aa | *Rattus norvegicus* ATP-binding cassette, sub-family C (CFTR/MRP), member 3 (Abcc3), mRNA. Length = 5174 | ESTs |
| 2080 | 16109 | NM_080585 | c | *Rattus norvegicus* N-ethylmaleimide sensitive fusion protein attachment protein alpha (Napa), mRNA. Length = 1505 | *Rattus norvegicus* mRNA for alpha-soluble NSF attachment protein |
| 2081 | 1757 | NM_080766 | d | *Rattus norvegicus* Neuroblastoma RAS viral (vras) oncogene homolog (Nras), mRNA Length = 3350 | *R. norvegicus* N-ras gene for p21 protein |
| 2082 | 7108 | NM_080778 | y | *Rattus norvegicus* nuclear receptor subfamily 2, group F, member 2 (Nr2f2), mRNA Length = 1572 | *Rattus norvegicus* ovalbumin upstream promoter beta nuclear receptor rCOUPb mRNA, complete cds |
| 2083 | 132 | NM_080782 | k | *Rattus norvegicus* cyclin-dependent kinase inhibitor 1A (P21) (Cdkn1a), mRNA. Length = 495 | *Rattus norvegicus* p21 (WAF1) mRNA, complete cds |
| 2083 | 133 | NM_080782 | l | *Rattus norvegicus* cyclin-dependent kinase inhibitor 1A (P21) (Cdkn1a), mRNA Length = 495 | *Rattus norvegicus* p21 (WAF1) mRNA, complete cds |
| 2084 | 20122 | NM_080887 | General | *Rattus norvegicus* thioredoxin-like (32 kD) (Txnl), mRNA Length = 1061 | ESTs, Highly similar to thioredoxin-related protein [*M. musculus*] |
| 2085 | 6143 | NM_080892 | e | *Rattus norvegicus* selenium binding protein 2 (Selenbp2), mRNA. Length = 1685 | ESTs, Moderately similar to selenium-binding protein [*H. sapiens*] |
| 2086 | 9952 | NM_080902 | h | *Rattus norvegicus* hypoxia induced gene 1 (Hig1), mRNA Length = 355 | ESTs, Moderately similar to AF077034 1 HSPC010 [*H. sapiens*] |
| 2087 | 17546 | NM_130401 | b | *Rattus norvegicus* membrane-associated protein 17 (Map17), mRNA. Length = 816 | ESTs, Moderately similar to DD96 homolog [*R. norvegicus*] |

TABLE 1-continued

SUMMARY

| Sequence ID No. | Identifier | GenBank Acc/Ref. Seq ID | Model Code | Gene Name | Unigene Cluster Title |
|---|---|---|---|---|---|
| 2088 | 21695 | NM_130411 | c, x | *Rattus norvegicus* coronin, actin binding protein 1A (Coro 1a), mRNA. Length = 1386 | ESTs, Weakly similar to coronin-like protein [*R. norvegicus*] |
| 2089 | 21391 | NM_130416 | x, General | *Rattus norvegicus* annexin A7 (Anxa7), mRNA Length = 2912 | ESTs, Weakly similar to ANX4 RAT ANNEXIN IV [*R. norvegicus*] |
| 2090 | 20694 | NM_130430 | General | *Rattus norvegicus* proteasome (prosome, macropain) 26S subunit, non-ATPase, 9 (Psmd9), mRNA Length = 1448 | EST |
| 2090 | 19818 | NM_130430 | cc | *Rattus norvegicus* proteasome (prosome, macropain) 26S subunit, non-ATPase, 9 (Psmd9), mRNA. Length = 1448 | EST |
| 2090 | 18810 | NM_130430 | e, s | *Rattus norvegicus* proteasome (prosome, macropain) 26S subunit, non-ATPase, 9 (Psmd9), mRNA. Length = 1448 | mitochondrial H+-ATP synthase alpha subunit |
| 2091 | 18293 | NM_130433 | q | *Rattus norvegicus* acetyl-Coenzyme A acyltransferase 2 (mitochondrial 3-oxoacyl-Coenzyme A thiolase) (Acaa2), mRNA. Length = 1619 | Rat mRNA for 3-oxoacyl-CoA thiolase |
| 2092 | 25064 | S45392 | a, n | | |
| 2093 | 3244 | S63519 | u | | ESTs |
| 2094 | 25501 | S63521 | q | | |
| 2095 | 16248 | S68135 | h | | Rat brain glucose-transporter protein mRNA, complete cds |
| 2096 | 18647 | S69316 | q | | ESTs, Weakly similar to HS9B RAT HEAT SHOCK PROTEIN HSP 90-BETA [*R. norvegicus*] |
| 2097 | 24351 | S74257 | v | | ESTs, Weakly similar to ABD4 MOUSE ATP-BINDING CASSETTE, SUB-FAMILY D, MEMBER 4 [*M. musculus*] |
| 2098 | 25066 | S75280 | d | | |
| 2099 | 1460 | S76054 | j, l, m, x, y, General | | ESTs, Highly similar to K2C8 RAT KERATIN, TYPE II CYTOSKELETAL 8 [*R. norvegicus*] |
| 2100 | 25539 | S76742 | v | | |
| 2101 | 16400 | S76779 | c | | Rat apolipoprotein e mrna |
| 2102 | 24469 | S77858 | n | | ESTs, Highly similar to MLES RAT MYOSIN LIGHT CHAIN ALKALI, SMOOTH-MUSCLE ISOFORM [*R. norvegicus*] |
| 2103 | 25545 | S77900 | k, s | | |
| 2103 | 21583 | S77900 | k | | ESTs |
| 2104 | 10260 | S81497 | s | | ESTs |
| 2105 | 3609 | S82579 | k | histamine N-methyltransferase | histamine N-methyltransferase |
| 2106 | 111 | U02506 | u | | *Rattus norvegicus* clone 15 polymeric immunoglobulin receptor mRNA, 3'UTR microsatellite repeats |
| 2107 | 14959 | U03390 | a, q, General | | *Rattus norvegicus* Sprague Dawley protein kinase C receptor mRNA, complete cds |
| 2109 | 2010 | U05675 | b, x, bb | | *Rattus norvegicus* Sprague-Dawley fibrinogen B beta chain mRNA, complete cds |
| 2110 | 15462 | U06230 | d | protein S | protein S |
| 2112 | 1583 | U07201 | s, General | Asparagine synthetase | Asparagine synthetase |
| 2113 | 627 | U09229 | h | | *Rattus norvegicus* New England Deaconess transcription factor mRNA, partial cds |
| 2114 | 809 | U17035 | General | | *Rattus norvegicus* interferon inducible protein 10 (IP-10) mRNA, complete cds |
| 2115 | 16675 | U17565 | k, x, bb | mini chromosome maintenance deficient 6 (*S. cerevisiae*) | mini chromosome maintenance deficient 6 (*S. cerevisiae*) |

TABLE 1-continued

SUMMARY

| Sequence ID No. | Identifier | GenBank Acc/Ref. Seq ID | Model Code | Gene Name | Unigene Cluster Title |
|---|---|---|---|---|---|
| 2116 | 25587 | U20110 | r | | |
| 2117 | 90 | U20796 | r | | *Rattus norvegicus* nuclear receptor Rev-ErbA-beta mRNA, partial cds |
| 2118 | 25589 | U21718 | h, aa | | |
| 2119 | 22196 | U21719 | h | | ESTs |
| 2120 | 17118 | U25746 | s | | *Rattus norvegicus* RNA helicase with arginine-serine-rich domain mRNA, complete cds |
| 2121 | 1537 | U27518 | g, h, n | | *Rattus norvegicus* UDP-glucuronosyltransferase mRNA, complete cds |
| 2122 | 1558 | U28504 | bb | | *Rattus norvegicus* Na+/Pi cotransporter-1 mRNA, complete cds |
| 2123 | 16193 | U30831 | n | | *Rattus norvegicus* B/K protein mRNA, complete cds |
| 2124 | 17480 | U31598 | z | | *R. norvegicus* mRNA for RT1 Ma |
| 2125 | 18302 | U33500 | General | | *Rattus norvegicus* retinol dehydrogenase type II mRNA, complete cds |
| 2126 | 25599 | U34897 | y | | |
| 2127 | 1394 | U37099 | h | | *Rattus norvegicus* GTP-binding protein (rab 3C) mRNA, complete cds |
| 2128 | 244 | U38376 | n | | EST, Weakly similar to actin-filament binding protein Frabin [*R. norvegicus*], *Rattus norvegicus* cytosolic phospholipase A2 mRNA, complete cds |
| 2129 | 1623 | U41164 | h | | *Rattus norvegicus* Cys2/His2 zinc finger protein (rKr1) mRNA, complete cds |
| 2130 | 15851 | U42719 | f, t, x, General | Complement component 4 | Complement component 4 |
| 2131 | 17886 | U47315 | s, z | | *Rattus norvegicus* apoptosis-regulating basic protein mRNA, complete cds |
| 2132 | 21654 | U53184 | l, t, General | estrogen-responsive uterine transcript | estrogen-responsive uterine transcript |
| 2133 | 1439 | U57391 | w | | *Rattus norvegicus* FceRI gamma-chain interacting protein SH2-B (SH2-B) mRNA, complete cds |
| 2134 | 725 | U62316 | bb | solute carrier family 16 (monocarboxylic acid transporters), mem | solute carrier family 16 (monocarboxylic acid transporters), member 7 |
| 2137 | 2153 | U75404 | b, cc, General | | ESTs |
| 2139 | 4956 | U76714 | j, y | | *Rattus norvegicus* cell adhesion regulator (CAR1) mRNA, complete cds |
| 2140 | 4477 | U77829 | l, m | | ESTs |
| 2141 | 21703 | U82591 | z | | *Rattus norvegicus* RCL (Rcl) mRNA, complete cds |
| 2142 | 977 | U89744 | s | | *Rattus norvegicus* putative cell surface antigen mRNA, complete cds |
| 2143 | 23282 | U90725 | h | lipoprotein-binding protein | lipoprotein-binding protein |
| 2144 | 22005 | U96490 | m | | *Rattus norvegicus* liver mRNA, complete cds |
| 2146 | 819 | X02284 | j, z | Aldolase B, fructose-biphosphate | Aldolase B, fructose-biphosphate |
| 2147 | 818 | X02291 | e, j, z | Aldolase B, fructose-biphosphate | Aldolase B, fructose-biphosphate |
| 2148 | 20818 | X02904 | n, q | glutathione S-transferase, pi 2 | glutathione S-transferase, pi 2 |
| 2149 | 16401 | X04979 | c | | Rat apolipoprotein e mrna |
| 2150 | 20513 | X05684 | o, r | Pyruvate kinase, liver and RBC | Pyruvate kinase, liver and RBC |
| 2151 | 25084 | X06769 | cc | | |
| 2152 | 672 | X13722 | h | | Rat mRNA for LDL-receptor |
| 2153 | 25675 | X14181 | n | | |
| 2153 | 20810 | X14181 | n, q, w | | ESTs, Highly similar to 60S RIBOSOMAL PROTEIN L18A [*R. norvegicus*] |

TABLE 1-continued

SUMMARY

Atty. Docket No. 44921-5089US
Doc. No. 1803440.1

| Sequence ID No. | Identifier | GenBank Acc/Ref. Seq ID | Model Code | Gene Name | Unigene Cluster Title |
|---|---|---|---|---|---|
| 2154 | 18541 | X14671 | y | | ESTs, Highly similar to RL26 RAT 60S RIBOSOMAL PROTEIN L26 [*R. norvegicus*] |
| 2155 | 25679 | X15013 | q | | |
| 2155 | 19244 | X15013 | c, q, w | | ESTs, Highly similar to RL7A_HUMAN 60S RIBOSOMAL PROTEIN L7A [*R. norvegicus*] |
| 2156 | 15626 | X17665 | a | | ESTs, Highly similar to RS16_HUMAN 40S RIBOSOMAL PROTEIN S1 [*R. norvegicus*] |
| 2157 | 1893 | X51529 | t | phospholipase A2, group IIA (platelets, synovial fluid) | phospholipase A2, group IIA (platelets, synovial fluid) |
| 2158 | 25686 | X51536 | bb | | |
| 2158 | 10819 | X51536 | aa, bb | | ESTs, Highly similar to RS3 MOUSE 40S RIBOSOMAL PROTEIN S3 [*R. norvegicus*] |
| 2159 | 18250 | X51706 | a, q, w | ribosomal protein L9 | ESTs, Highly similar to RL9 RAT 60S RIBOSOMAL PROTEIN L9 [*R. norvegicus*] |
| 2160 | 20872 | X51707 | a | ribosomal protein S19 | ESTs, Highly similar to RS19 RAT 40S RIBOSOMAL PROTEIN S19 [*R. norvegicus*] |
| 2161 | 516 | X52711 | c | | Rat mRNA for Mx1 protein |
| 2162 | 25689 | X52815 | g | | |
| 2163 | 20427 | X53378 | w | | *Rattus norvegicus* ribosomal protein S13 (RPS13) mRNA, 3' end |
| 2164 | 18606 | X53504 | General | | ESTs, Highly similar to 60S RIBOSOMAL PROTEIN L12 [*R. norvegicus*] |
| 2165 | 1463 | X54467 | d, u, General | | Rat mRNA for preprocathepsin D (EC 3.4.23 5) |
| 2166 | 24577 | X55153 | a, v | | ESTs, Highly similar to 60S ACIDIC RIBOSOMAL PROTEIN P2 [*R. norvegicus*] |
| 2167 | 10344 | X57405 | j, m | Drosophila Notch homolog 1 | LOCUS NOTCH HOMOLOG PROTEIN 1 PRECURSOR [*R. norvegicus*] |
| 2168 | 15106 | X57529 | g, n, q | | ESTs, Highly similar to RS18_HUMAN 40S RIBOSOMAL PROTEIN S18 [*R. norvegicus*] |
| 2169 | 5667 | X58200 | q, bb | ribosomal protein L23 | |
| 2169 | 18611 | X58200 | a, v | ribosomal protein L23 | ESTs, Highly similar to RL23_HUMAN 60S RIBOSOMAL PROTEIN L23 [*R. norvegicus*] |
| 2170 | 17175 | X58389 | w | | *R. norvegicus* ASI mRNA for mammalian equivalent of bacterial large ribosomal subunit protein L22 |
| 2171 | 25702 | X58465 | w | | |
| 2171 | 10109 | X58465 | c, q | Ribosomal protein S5 | Ribosomal protein S5 |
| 2172 | 25705 | X59375 | c, i, aa, General | | |
| 2173 | 25709 | X59737 | u | | |
| 2174 | 18354 | X59859 | General | decorin | decorin |
| 2174 | 18355 | X59859 | t | decorin | decorin |
| 2175 | 21657 | X61381 | General | | *Rattus norvegicus* interferon-inducible protein variant 10 mRNA, complete cds |
| 2176 | 25718 | X62145 | bb, General | ribosomal protein L8 | |
| 2176 | 15875 | X62145 | a, q, v | ribosomal protein L8 | ESTs, Highly similar to RL8_HUMAN 60S RIBOSOMAL PROTEIN L [*R. norvegicus*] |
| 2177 | 13646 | X62166 | bb | | ESTs, Highly similar to RL3 RAT 60S RIBOSOMAL PROTEIN L3 [*R. norvegicus*] |
| 2178 | 25721 | X62325 | p | | |
| 2179 | 16012 | X62875 | m, s, z | | ESTs, Highly similar to HIGH MOBILITY GROUP PROTEIN HMG-Y [*M. musculus*] |
| 2180 | 25730 | X63369 | cc | | |
| 2181 | 25089 | X63594 | General | | |

TABLE 1-continued

SUMMARY

Atty. Docket No. 44921-5089US
Doc. No. 1803440.1

| Sequence ID No. | Identifier | GenBank Acc/Ref. Seq ID | Model Code | Gene Name | Unigene Cluster Title |
|---|---|---|---|---|---|
| 2181 | 25090 | X63594 | cc, General | | |
| 2182 | 20844 | X65228 | n, w | | ESTs, Highly similar to RL2B_HUMAN 60S RIBOSOMAL PROTEIN L23A [*R. norvegicus*] |
| 2183 | 20879 | X65296 | j, y | carboxylesterase 1 | carboxylesterase 1 |
| 2184 | 25736 | X68782 | c | | |
| 2185 | 16426 | X70369 | c | procollagen, type III, alpha 1 | procollagen, type III, alpha 1 |
| 2186 | 16300 | X70706 | u | plastin 3 (T-isoform) | plastin 3 (T-isoform) |
| 2187 | 24232 | X75207 | c | cyclin D1 | cyclin D1 |
| 2188 | 16272 | X76456 | n, p | | *R. norvegicus* (Sprague Dawley) alpha albumin gene |
| 2189 | 25741 | X76489 | u | | |
| 2190 | 23302 | X78949 | h | prolyl 4-hydroxylase alpha subunit | prolyl 4-hydroxylase alpha subunit |
| 2191 | 25747 | X81448 | General | | |
| 2192 | 24115 | X81449 | u | | ESTs, Highly similar to K1CS RAT KERATIN, TYPE I CYTOSKELETAL 19 [*R. norvegicus*] |
| 2193 | 25754 | X89696 | g | | |
| 2194 | 25097 | X90642 | y, z | | |
| 2195 | 12978 | X96437 | cc, General | | ESTs, Highly similar to RADIATION-INDUCIBLE IMMEDIATE-EARLY GENE IEX-1 [*M. musculus*] |
| 2197 | 4594 | Y07704 | c | | *Rattus norvegicus* mRNA Best5 protein |
| 2198 | 25777 | Y08355 | g, p, General | oxidative stress induced | oxidative stress induced |
| 2199 | 15986 | Y09945 | bb, General | | *Rattus norvegicus* mRNA for putative integral membrane transport protein (UST1r) |
| 2200 | 20890 | Y13275 | k | | *Rattus norvegicus* mRNA for D6 1A protein |
| 2201 | 21914 | Y13336 | d | | *Rattus norvegicus* DAD-1 gene |
| 2202 | 406 | Z11995 | o, General | | *R. norvegicus* mRNA encoding 45 kDa protein which binds to heymann nephritis antigen gp330 |
| 2203 | 18352 | Z12298 | t | decorin | decorin |
| 2204 | 17481 | Z49761 | k | | *R. norvegicus* mRNA for RT1 Ma |
| 2205 | 8664 | Z75029 | r, v | Heat shock protein 70-1 | ESTs, Moderately similar to T17342 hypothetical protein DKFZp586K1924 1 [*H. sapiens*], Heat shock protein 70-1 |
| 2206 | 2459 | AA964755 | cc | | ESTs |
| 2207 | 23830 | AA956638 | aa | | ESTs |
| 2208 | 6100 | X73524 | x | desmin | desmin |
| 2209 | 439 | Z22607 | w | Bone morphogenetic protein 4 | Bone morphogenetic protein 4 |
| 2210 | 8665 | AI071965 | v | Heat shock protein 70-1 | ESTs, Moderately similar to T17342 hypothetical protein DKFZp586K1924.1 [*H. sapiens*], Heat shock protein 70-1 |
| 2211 | 155 | U32681 | t | crp-ductin | crp-ductin |
| 2212 | 19252 | AA892041 | s | HMm peroxiredoxin 5 | *Rattus norvegicus* mRNA for thiol-specific antioxidant protein (1-Cys peroxiredoxin) |
| 2213 | 15582 | AI232320 | q | | Rat mitochondrial 3-hydroxy-3-methylglutaryl-CoA synthase mRNA, complete cds |
| 2214 | 17541 | M26125 | n | Epoxide hydrolase 1 (microsomal xenobiotic hydrolase) | Epoxide hydrolase 1 (microsomal xenobiotic hydrolase) |
| 2215 | 18609 | M30689 | l | | Rat Ly6-B antigen mRNA, complete cds |
| 2216 | 6262 | AI177125 | g | | ESTs |
| 2217 | 23859 | AI072161 | f | | ESTs |
| 2218 | 21011 | H32189 | e | Glutathione-S-transferase, mu type 2 (Yb2) | Glutathione-S-transferase, mu type 2 (Yb2) |
| 2220 | 2572 | AI177143 | b | | ESTs |
| 2221 | 25419 | M22922 | a | | |

TABLE 2

Atty. Docket No. 44921-5089US
Doc. No. 1803440.1

PATHWAYS

| Sequence ID No. | Identifier | GenBank Acc/ Ref. Seq. ID No. | Model Code | Pathways |
|---|---|---|---|---|
| 1 | 6949 | AA012785 | q | |
| 2 | 25098 | AA108277 | h, v | |
| 3 | 17312 | AA108308 | r | |
| 4 | 16882 | AA684537 | o | |
| 5 | 6049 | AA685178 | y | |
| 6 | 4426 | AA685974 | l, m | |
| 7 | 21815 | AA686423 | g | |
| 8 | 1600 | AA686470 | i | |
| 8 | 1599 | AA686470 | i | |
| 9 | 21997 | AA799325 | u | |
| 10 | 18396 | AA799330 | v | |
| 11 | 6581 | AA799412 | f, l | |
| 12 | 16538 | AA799449 | k | |
| 13 | 23294 | AA799472 | u | |
| 14 | 18290 | AA799497 | r | |
| 15 | 18981 | AA799523 | e | |
| 16 | 20843 | AA799545 | h | |
| 17 | 16993 | AA799560 | b | |
| 18 | 16576 | AA799570 | d | |
| 19 | 18361 | AA799591 | i | |
| 20 | 17712 | AA799598 | z | |
| 22 | 18346 | AA799718 | f | |
| 23 | 8768 | AA799726 | l | |
| 24 | 11687 | AA799732 | w | |
| 25 | 18349 | AA799744 | u | |
| 26 | 17494 | AA799751 | n | |
| 27 | 18360 | AA799771 | General | |
| 28 | 18880 | AA799801 | w | |
| 29 | 20998 | AA799803 | z | |
| 30 | 21006 | AA799861 | c | |
| 31 | 15011 | AA799893 | General | |
| 32 | 20811 | AA799899 | a | |
| 33 | 23202 | AA799971 | General | |
| 34 | 4832 | AA800190 | b | |
| 35 | 21656 | AA800202 | d | |
| 36 | 18433 | AA800218 | j, y, z | |
| 37 | 6386 | AA800235 | u | |
| 38 | 18442 | AA800258 | h, k | |
| 39 | 21092 | AA800380 | y | |
| 40 | 17325 | AA800587 | General | |
| 41 | 13930 | AA800613 | cc, General | |
| 42 | 21372 | AA800693 | v | |
| 42 | 21373 | AA800693 | s | |
| 43 | 18161 | AA800701 | k | |
| 44 | 6595 | AA800753 | w | |
| 45 | 13348 | AA800928 | General | |
| 46 | 23115 | AA801165 | o, y | |
| 47 | 12399 | AA801307 | General | |
| 48 | 7543 | AA801395 | General | |
| 49 | 24237 | AA817726 | t, General | |
| 50 | 11215 | AA817921 | o | |
| 51 | 5985 | AA818005 | g | |
| 52 | 11338 | AA818016 | x | |
| 53 | 2845 | AA818026 | k, General | |
| 54 | 16756 | AA818089 | i, k, General | |
| 55 | 17771 | AA818224 | e, g, p, General | |
| 56 | 6522 | AA818261 | g, m | |
| 57 | 5924 | AA818359 | y | |
| 58 | 7806 | AA818421 | b, aa | |
| 59 | 8237 | AA818512 | v | |
| 60 | 17434 | AA818574 | h | |
| 61 | 8728 | AA818615 | General | |
| 62 | 6054 | AA818658 | b, v, cc, General | |
| 63 | 11590 | AA818721 | d | |
| 64 | 4291 | AA818741 | q, General | |
| 65 | 4330 | AA818747 | o, General | |
| 66 | 19723 | AA818761 | v, General | |
| 67 | 13684 | AA818770 | h, j, l, m | |
| 68 | 6322 | AA818801 | k | |
| 69 | 7690 | AA818875 | General | |
| 70 | 4952 | AA818907 | q, General | |
| 71 | 6094 | AA818911 | t | |

TABLE 2-continued

PATHWAYS

| Sequence ID No. | Identifier | GenBank Acc/ Ref. Seq. ID No. | Model Code | Pathways |
|---|---|---|---|---|
| 72 | 10985 | AA818998 | o, General | |
| 73 | 6120 | AA819008 | t | |
| 74 | 2586 | AA819081 | c | |
| 76 | 6438 | AA819269 | o | |
| 77 | 24721 | AA819306 | d, w | |
| 78 | 6250 | AA819376 | o, y | |
| 80 | 6281 | AA819517 | j | |
| 81 | 10141 | AA819526 | j | |
| 82 | 6551 | AA819558 | t | |
| 83 | 6723 | AA819653 | r | |
| 84 | 14958 | AA819744 | aa | |
| 85 | 19433 | AA819776 | v | |
| 86 | 6204 | AA819889 | aa | |
| 87 | 22820 | AA848315 | General | Purine metabolism |
| 88 | 6614 | AA848389 | bb | |
| 89 | 21125 | AA848437 | General | |
| 90 | 23504 | AA848496 | q | |
| 91 | 18532 | AA848675 | g | |
| 92 | 21140 | AA848738 | c | |
| 93 | 16128 | AA848807 | o | |
| 94 | 22923 | AA848929 | g | |
| 95 | 17339 | AA849497 | General | |
| 96 | 11727 | AA849518 | l | |
| 97 | 21275 | AA849796 | i, l, m, General | |
| 98 | 16678 | AA849827 | aa | |
| 99 | 8515 | AA849917 | e | |
| 100 | 18447 | AA849939 | General | |
| 101 | 12130 | AA850037 | p | |
| 102 | 23981 | AA850040 | x, aa | |
| 103 | 13615 | AA850364 | t | |
| 105 | 2637 | AA850893 | x | |
| 106 | 22093 | AA850909 | d | |
| 107 | 21766 | AA850916 | c | |
| 108 | 2847 | AA850919 | w | |
| 109 | 12162 | AA850975 | h | |
| 110 | 9514 | AA850978 | General | |
| 111 | 3924 | AA851017 | e, q | |
| 111 | 3925 | AA851017 | o, General | |
| 112 | 4490 | AA851184 | a, k | |
| 113 | 19187 | AA851230 | General | |
| 114 | 19189 | AA851237 | c | |
| 115 | 15386 | AA851241 | m | |
| 116 | 21462 | AA851261 | g, l, General | |
| 117 | 21471 | AA851343 | General | |
| 118 | 16902 | AA851379 | p | Oxidative phosphorylation, Ubiquinone biosynthesis |
| 119 | 23376 | AA851392 | i, x | |
| 119 | 23377 | AA851392 | x | |
| 120 | 13349 | AA851417 | General | |
| 121 | 21527 | AA851733 | r, u | |
| 122 | 4048 | AA851814 | i, o, u, General | |
| 123 | 10561 | AA851871 | bb | |
| 124 | 17411 | AA858621 | j, y | |
| 125 | 1801 | AA858636 | k, s, x, bb | |
| 126 | 18350 | AA858674 | p | |
| 127 | 19484 | AA858693 | e | |
| 128 | 6360 | AA858696 | d | |
| 129 | 17334 | AA858704 | p | |
| 130 | 6380 | AA858758 | q | |
| 131 | 13219 | AA858759 | a | |
| 132 | 6384 | AA858788 | l, m, General | |
| 134 | 13412 | AA858830 | p | |
| 135 | 7279 | AA858892 | f | |
| 136 | 18217 | AA858930 | t | |
| 137 | 5867 | AA858953 | v, General | Alanine and aspartate metabolism, Aminoacyl-tRNA biosynthesis |
| 138 | 14479 | AA858969 | r | |
| 139 | 6431 | AA859085 | t | |
| 140 | 17361 | AA859114 | o, General | |
| 141 | 21025 | AA859241 | General | |
| 142 | 10076 | AA859271 | c | |
| 143 | 21791 | AA859333 | k | |

TABLE 2-continued

PATHWAYS

| Sequence ID No. | Identifier | GenBank Acc/ Ref. Seq. ID No. | Model Code | Pathways |
|---|---|---|---|---|
| 144 | 16314 | AA859348 | cc, General | |
| 145 | 18862 | AA859520 | f | |
| 146 | 15059 | AA859545 | r | |
| 147 | 19894 | AA859581 | s | |
| 148 | 14353 | AA859585 | h | |
| 149 | 16318 | AA859648 | h | |
| 150 | 17316 | AA859652 | General | |
| 151 | 19067 | AA859663 | n, q | |
| 152 | 22406 | AA859680 | n | |
| 153 | 20599 | AA859690 | x | |
| 154 | 14261 | AA859693 | u | |
| 155 | 14138 | AA859700 | v | Porphyrin and chlorophyll metabolism |
| 155 | 14139 | AA859700 | v | Porphyrin and chlorophyll metabolism |
| 157 | 22374 | AA859804 | l | |
| 158 | 22385 | AA859805 | b, k | |
| 159 | 22773 | AA859885 | n | |
| 160 | 22816 | AA859898 | k, x, z | |
| 161 | 11891 | AA859926 | x | |
| 162 | 23070 | AA859942 | k | |
| 163 | 23121 | AA859948 | k | |
| 164 | 23166 | AA859954 | cc, General | |
| 165 | 18468 | AA859966 | aa | |
| 166 | 23336 | AA859981 | q | Inositol phosphate metabolism |
| 167 | 4222 | AA860024 | a, bb | |
| 168 | 13974 | AA860030 | u, x, General | |
| 169 | 7090 | AA860039 | x | |
| 170 | 23769 | AA860055 | k, x | |
| 171 | 16323 | AA866240 | w | |
| 172 | 4462 | AA866264 | General | |
| 173 | 15884 | AA866276 | k | |
| 174 | 17742 | AA866302 | c, y | Phenylalanine metabolism, Tyrosine metabolism |
| 175 | 16333 | AA866414 | a, h | |
| 176 | 18918 | AA866444 | p, q | |
| 177 | 16853 | AA866454 | j, l, m, y, z | |
| 178 | 18995 | AA866459 | h, m | |
| 179 | 16013 | AA866482 | s | |
| 180 | 26036 | AA874849 | r | |
| 181 | 16059 | AA874857 | h | |
| 182 | 16069 | AA874873 | r | |
| 183 | 21633 | AA874951 | f | |
| 184 | 16192 | AA874995 | w | |
| 185 | 16254 | AA875025 | j | |
| 186 | 16312 | AA875032 | cc, General | |
| 187 | 20701 | AA875097 | b | |
| 188 | 16416 | AA875098 | bb | |
| 189 | 16419 | AA875102 | bb | |
| 190 | 15313 | AA875126 | l, m, General | |
| 191 | 10936 | AA875146 | w | |
| 192 | 18084 | AA875186 | h | |
| 193 | 15371 | AA875205 | u | |
| 194 | 15401 | AA875257 | x, z | |
| 195 | 15410 | AA875268 | p, s | Oxidative phosphorylation, Ubiquinone biosynthesis |
| 196 | 15420 | AA875286 | f | |
| 197 | 15446 | AA875327 | s, w | |
| 198 | 7936 | AA875495 | b, General | |
| 199 | 17314 | AA875509 | i, l, m | |
| 200 | 24472 | AA875523 | k | |
| 201 | 15587 | AA875577 | j | |
| 202 | 15617 | AA875620 | General | |
| 202 | 15618 | AA875620 | General | |
| 203 | 5384 | AA891041 | f, cc, General | |
| 204 | 24814 | AA891209 | f, p | |
| 205 | 21930 | AA891322 | d | |
| 206 | 17225 | AA891553 | h | |
| 207 | 7522 | AA891571 | j, m | |
| 208 | 9071 | AA891578 | b | |
| 209 | 19321 | AA891666 | u | |
| 210 | 17693 | AA891737 | j, l, m, n, y, z | |
| 211 | 17256 | AA891739 | General | |
| 213 | 18269 | AA891769 | General | |

TABLE 2-continued

PATHWAYS

| Sequence ID No. | Identifier | GenBank Acc/ Ref. Seq. ID No. | Model Code | Pathways |
|---|---|---|---|---|
| 214 | 9905 | AA891774 | s, bb, General | |
| 215 | 17061 | AA891812 | d | |
| 216 | 7050 | AA891824 | h | |
| 217 | 4463 | AA891831 | General | |
| 218 | 14289 | AA891838 | i | |
| 219 | 20523 | AA891842 | r, cc | |
| 220 | 17779 | AA891914 | g, s, z | |
| 221 | 17438 | AA891943 | General | |
| 222 | 22862 | AA891944 | p | |
| 223 | 1159 | AA891949 | e, z | |
| 224 | 4473 | AA891965 | General | |
| 225 | 6362 | AA892053 | f, j, l, m | |
| 226 | 9037 | AA892066 | y | |
| 227 | 19469 | AA892112 | General | |
| 228 | 14595 | AA892128 | o, t, v | |
| 229 | 16527 | AA892154 | cc | |
| 230 | 4482 | AA892173 | bb | |
| 231 | 20917 | AA892238 | h | |
| 232 | 2357 | AA892268 | d | |
| 233 | 18183 | AA892271 | h | |
| 234 | 6523 | AA892299 | d | |
| 236 | 13647 | AA892367 | a | |
| 237 | 3473 | AA892378 | v | |
| 238 | 17682 | AA892382 | j, p, s, x, General | |
| 239 | 820 | AA892395 | g, s | Carbon fixation, Fructose and mannose metabolism, Glycolysis/Gluconeogenesis, Inositol metabolism, Pentose phosphate cycle |
| 240 | 14754 | AA892414 | u | |
| 241 | 17439 | AA892446 | f | |
| 242 | 16469 | AA892462 | p | |
| 243 | 13609 | AA892468 | i, General | |
| 243 | 13610 | AA892468 | n, v, General | |
| 244 | 9254 | AA892470 | n, u | |
| 245 | 11991 | AA892483 | s | |
| 246 | 1522 | AA892486 | f | |
| 247 | 11994 | AA892507 | aa | |
| 248 | 23888 | AA892520 | w | |
| 248 | 23889 | AA892520 | h | |
| 249 | 8599 | AA892522 | p | |
| 250 | 15154 | AA892532 | p | |
| 251 | 17468 | AA892545 | r | |
| 252 | 11203 | AA892554 | f, h | |
| 253 | 18906 | AA892561 | a, bb, General | |
| 254 | 19327 | AA892562 | f, j, y, z | |
| 255 | 18274 | AA892572 | p | |
| 256 | 4512 | AA892578 | cc | |
| 257 | 15876 | AA892582 | w | |
| 258 | 19085 | AA892598 | General | |
| 258 | 19086 | AA892598 | General | |
| 259 | 20065 | AA892647 | l | |
| 260 | 20088 | AA892666 | a, n | |
| 261 | 23783 | AA892773 | n | |
| 262 | 17549 | AA892776 | f, z | |
| 263 | 13542 | AA892798 | b | |
| 264 | 22537 | AA892799 | General | Glyoxylate and dicarboxylate metabolism, Pyruvate metabolism |
| 264 | 22539 | AA892799 | v | Glyoxylate and dicarboxylate metabolism, Pyruvate metabolism |
| 264 | 22538 | AA892799 | General | Glyoxylate and dicarboxylate metabolism, Pyruvate metabolism |
| 265 | 6951 | AA892820 | h | |
| 266 | 23322 | AA892821 | j, z | |
| 267 | 17923 | AA892843 | f | |
| 268 | 22871 | AA892859 | m | |
| 269 | 9053 | AA892861 | p, v, General | |
| 270 | 16482 | AA892940 | w | |
| 271 | 12020 | AA893035 | j, y | |
| 272 | 3863 | AA893060 | General | |
| 273 | 13332 | AA893080 | i, General | |
| 274 | 21305 | AA893082 | General | |
| 275 | 16591 | AA893191 | j, z | |

TABLE 2-continued

PATHWAYS

| Sequence ID No. | Identifier | GenBank Acc/ Ref. Seq. ID No. | Model Code | Pathways |
|---|---|---|---|---|
| 276 | 17447 | AA893192 | General | |
| 277 | 3876 | AA893205 | n | |
| 278 | 3878 | AA893230 | General | |
| 279 | 20986 | AA893242 | q | Fatty acid metabolism |
| 280 | 16168 | AA893280 | i, z, General | |
| 281 | 3886 | AA893289 | j, m, y | |
| 282 | 15209 | AA893327 | y | |
| 283 | 17800 | AA893436 | cc | |
| 284 | 17836 | AA893626 | h | |
| 285 | 9084 | AA893717 | x | |
| 286 | 22731 | AA893743 | d | |
| 287 | 12031 | AA893860 | v | Aminoacyl-tRNA biosynthesis, Glycine, serine and threonine metabolism |
| 288 | 17897 | AA893905 | k | |
| 289 | 3447 | AA893982 | d | |
| 290 | 22583 | AA894009 | n | |
| 291 | 10540 | AA894027 | j | |
| 292 | 4569 | AA894059 | x | |
| 293 | 18419 | AA894130 | d | |
| 294 | 17336 | AA894297 | j | |
| 295 | 19120 | AA894318 | f, j | |
| 296 | 19762 | AA899113 | i | |
| 297 | 18286 | AA899219 | u | |
| 298 | 22051 | AA899498 | w | |
| 298 | 22052 | AA899498 | q | |
| 299 | 21628 | AA899563 | aa | |
| 300 | 4262 | AA899590 | i | |
| 301 | 4661 | AA899709 | t, General | |
| 302 | 21354 | AA899721 | q | |
| 303 | 17905 | AA899762 | General | |
| 304 | 15231 | AA899840 | r | |
| 305 | 23778 | AA899854 | c, k, x | |
| 306 | 22060 | AA899898 | b | |
| 307 | 9114 | AA899951 | v, General | |
| 308 | 8988 | AA900148 | f | |
| 309 | 11841 | AA900247 | v | |
| 310 | 4725 | AA900290 | cc | |
| 311 | 4747 | AA900465 | General | |
| 312 | 20988 | AA900562 | o | |
| 313 | 3822 | AA900863 | b, g, General | |
| 315 | 12420 | AA901017 | b | |
| 316 | 4849 | AA901155 | s | |
| 317 | 3959 | AA901338 | General | |
| 318 | 22846 | AA923982 | a, d | |
| 319 | 4895 | AA923999 | k | |
| 320 | 21546 | AA924188 | cc, General | |
| 321 | 24192 | AA924210 | n, General | |
| 322 | 4933 | AA924301 | g, l, General | |
| 323 | 4944 | AA924405 | l, General | |
| 324 | 4948 | AA924428 | r | |
| 325 | 4949 | AA924432 | General | |
| 326 | 18891 | AA924598 | e | |
| 327 | 22540 | AA924630 | v, General | Glyoxylate and dicarboxylate metabolism, Pyruvate metabolism |
| 327 | 22541 | AA924630 | General | Glyoxylate and dicarboxylate metabolism, Pyruvate metabolism |
| 328 | 14759 | AA924766 | k | |
| 329 | 23123 | AA924794 | x | |
| 330 | 4067 | AA924813 | g, p | |
| 331 | 2888 | AA924902 | r, General | |
| 332 | 18130 | AA924964 | d | |
| 333 | 23141 | AA925019 | r | |
| 334 | 23195 | AA925026 | General | |
| 335 | 21458 | AA925049 | f, aa, General | |
| 336 | 5073 | AA925061 | m | |
| 337 | 14790 | AA925087 | o, General | |
| 338 | 5089 | AA925126 | g | |
| 339 | 23261 | AA925145 | k, General | |
| 340 | 17363 | AA925150 | a | |
| 341 | 23448 | AA925167 | l | |
| 342 | 23159 | AA925318 | e | |
| 343 | 21500 | AA925353 | k | |

TABLE 2-continued

PATHWAYS

| Sequence ID No. | Identifier | GenBank Acc/ Ref. Seq. ID No. | Model Code | Pathways |
|---|---|---|---|---|
| 344 | 22479 | AA925418 | t | |
| 345 | 21151 | AA925539 | b | |
| 346 | 16944 | AA925541 | f | |
| 346 | 16945 | AA925541 | t | |
| 347 | 17514 | AA925554 | bb | Oxidative phosphorylation |
| 348 | 5183 | AA925662 | i, General | |
| 349 | 23189 | AA925844 | r | |
| 350 | 23190 | AA925863 | aa | |
| 351 | 5252 | AA926051 | General | |
| 352 | 22967 | AA926080 | h, cc | |
| 353 | 17157 | AA926129 | b | |
| 354 | 13411 | AA926196 | u, General | |
| 355 | 5295 | AA926247 | General | |
| 356 | 22928 | AA926262 | General | |
| 357 | 8948 | AA926316 | r | |
| 358 | 21798 | AA926365 | aa | |
| 359 | 9942 | AA942697 | s | |
| 360 | 6039 | AA942716 | x, General | |
| 361 | 11174 | AA942745 | g, o, w | |
| 362 | 23005 | AA942770 | g | |
| 363 | 21318 | AA942774 | General | |
| 364 | 6615 | AA942889 | v | |
| 365 | 6691 | AA943028 | c | |
| 366 | 22142 | AA943066 | p | |
| 367 | 21993 | AA943149 | v, General | |
| 368 | 9061 | AA943508 | General | |
| 369 | 24390 | AA943531 | b, j, n, y | |
| 370 | 13976 | AA943532 | f, s, x | |
| 371 | 22248 | AA943537 | cc, General | |
| 372 | 22257 | AA943558 | m | |
| 373 | 12673 | AA943773 | u, cc, General | |
| 374 | 13641 | AA944154 | u | |
| 375 | 2658 | AA944155 | f | |
| 376 | 12770 | AA944161 | d | |
| 377 | 20903 | AA944180 | l, x | |
| 378 | 13507 | AA944244 | v | |
| 379 | 15596 | AA944353 | General | |
| 380 | 22681 | AA944413 | i, v, cc, General | |
| 381 | 6711 | AA944439 | General | |
| 382 | 14763 | AA944481 | i, q, General | |
| 383 | 22466 | AA944605 | h | |
| 384 | 12301 | AA944727 | b | |
| 385 | 7023 | AA944792 | d, m, aa | Purine metabolism, Pyrimidine metabolism, RNA polymerase |
| 386 | 22536 | AA944803 | bb | |
| 387 | 22501 | AA944811 | g, l | |
| 388 | 23967 | AA944831 | s | |
| 389 | 26084 | AA944922 | i | |
| 390 | 11974 | AA944958 | General | |
| 391 | 22547 | AA944970 | aa | |
| 392 | 22554 | AA945076 | z, General | |
| 393 | 14352 | AA945181 | General | |
| 395 | 1798 | AA945569 | General | |
| 396 | 22050 | AA945604 | i, aa | |
| 397 | 19731 | AA945615 | d, o | |
| 398 | 22612 | AA945624 | a, General | |
| 399 | 22618 | AA945656 | aa | |
| 400 | 11871 | AA945679 | v | |
| 401 | 22656 | AA945818 | General | |
| 402 | 6720 | AA945828 | p | |
| 403 | 22351 | AA945867 | m | |
| 404 | 22665 | AA945877 | f | |
| 405 | 24243 | AA945950 | b | |
| 406 | 22689 | AA945962 | General | |
| 407 | 22692 | AA945986 | d | |
| 408 | 22696 | AA945996 | c, General | |
| 408 | 22697 | AA945996 | c, o | |
| 409 | 22658 | AA945998 | w | |
| 410 | 20832 | AA946040 | s | Oxidative phosphorylation |
| 411 | 18337 | AA946046 | General | |
| 412 | 825 | AA946108 | General | |
| 413 | 8639 | AA946221 | e, cc, General | |

TABLE 2-continued

PATHWAYS

Atty. Docket No. 44921-5089US
Doc. No. 1803440.1

| Sequence ID No. | Identifier | GenBank Acc/ Ref. Seq. ID No. | Model Code | Pathways |
|---|---|---|---|---|
| 414 | 23237 | AA946224 | f | |
| 415 | 15600 | AA946250 | o, aa | |
| 416 | 19387 | AA946275 | t | |
| 417 | 6351 | AA946344 | d | |
| 418 | 22057 | AA946348 | e | |
| 419 | 22069 | AA946349 | aa | |
| 420 | 13962 | AA946351 | General | |
| 421 | 18280 | AA946361 | g | |
| 422 | 18944 | AA946391 | v | |
| 424 | 21410 | AA946408 | t | |
| 425 | 643 | AA946439 | o, y | |
| 426 | 20736 | AA946443 | x | |
| 427 | 21878 | AA946448 | r | |
| 428 | 21947 | AA946451 | bb | |
| 429 | 17499 | AA946467 | General | |
| 430 | 1809 | AA946503 | x, General | |
| 431 | 23360 | AA955104 | f | |
| 432 | 23471 | AA955162 | General | |
| 433 | 9452 | AA955206 | b, General | |
| 434 | 23512 | AA955282 | General | |
| 435 | 22596 | AA955298 | General | |
| 436 | 23283 | AA955391 | h | |
| 437 | 23546 | AA955393 | General | |
| 438 | 12404 | AA955408 | b | |
| 439 | 23626 | AA955540 | aa | |
| 441 | 17540 | AA955914 | bb | |
| 442 | 24277 | AA955962 | General | |
| 443 | 19939 | AA955980 | General | |
| 444 | 24000 | AA956005 | i | |
| 445 | 11050 | AA956164 | s, v | |
| 446 | 498 | AA956278 | a, General | |
| 447 | 23409 | AA956294 | q | |
| 449 | 23773 | AA956476 | f, x | |
| 450 | 23799 | AA956530 | d | |
| 451 | 23800 | AA956534 | aa | |
| 452 | 23834 | AA956659 | cc, General | |
| 453 | 16425 | AA956688 | f, x | |
| 454 | 23847 | AA956723 | s | |
| 455 | 23852 | AA956746 | j, l, m, z | |
| 456 | 5989 | AA956907 | g, s | |
| 456 | 5990 | AA956907 | General | |
| 457 | 23957 | AA957123 | u, General | |
| 458 | 22357 | AA957264 | General | |
| 459 | 23314 | AA957270 | g, l, m, p, v, cc, General | |
| 460 | 23995 | AA957292 | a, b | |
| 461 | 2702 | AA957307 | General | Aminoacyl-tRNA biosynthesis, Glycine, serine and threonine metabolism |
| 462 | 24040 | AA957422 | c | |
| 463 | 12478 | AA957554 | m | |
| 464 | 21306 | AA957811 | v | |
| 465 | 24183 | AA957889 | t | |
| 466 | 24178 | AA957905 | d | |
| 467 | 17034 | AA963071 | e | |
| 468 | 24053 | AA963092 | General | |
| 469 | 2767 | AA963201 | o | |
| 470 | 2022 | AA963259 | g | |
| 471 | 2126 | AA963488 | d | |
| 472 | 24246 | AA963703 | b | |
| 473 | 2195 | AA963746 | General | |
| 474 | 19370 | AA963797 | i | |
| 475 | 2282 | AA964147 | e | |
| 476 | 2284 | AA964152 | x | |
| 478 | 2350 | AA964368 | g, General | |
| 479 | 18830 | AA964496 | aa | |
| 480 | 2392 | AA964541 | b | |
| 481 | 2395 | AA964554 | General | |
| 482 | 2410 | AA964589 | i, aa | |
| 483 | 19145 | AA964613 | t | |
| 484 | 2424 | AA964617 | g | |
| 485 | 3107 | AA964687 | General | |
| 486 | 2457 | AA964752 | q, t | |

TABLE 2-continued

PATHWAYS

Atty. Docket No. 44921-5089US
Doc. No. 1803440.1

| Sequence ID No. | Identifier | GenBank Acc/ Ref. Seq. ID No. | Model Code | Pathways |
|---|---|---|---|---|
| 487 | 6778 | AA964763 | b | |
| 489 | 2468 | AA964807 | l | |
| 490 | 2469 | AA964814 | w | Glutamate metabolism, Glutathione metabolism |
| 491 | 12561 | AA964815 | General | |
| 492 | 2326 | AA964892 | aa | |
| 493 | 21339 | AA964962 | General | |
| 494 | 21390 | AA964988 | General | |
| 495 | 12569 | AA965023 | g | |
| 496 | 2583 | AA965166 | bb | |
| 497 | 15885 | AA965207 | r | |
| 499 | 2905 | AA996727 | b, l, m, u, General | |
| 500 | 2915 | AA996782 | u, bb | |
| 501 | 2920 | AA996813 | d | |
| 502 | 19525 | AA996856 | aa, General | |
| 503 | 2984 | AA997015 | c | |
| 504 | 2986 | AA997028 | General | |
| 505 | 3145 | AA997237 | General | |
| 506 | 19249 | AA997342 | m | |
| 507 | 16883 | AA997345 | General | |
| 508 | 12598 | AA997362 | s | |
| 509 | 3470 | AA997374 | p | |
| 510 | 3180 | AA997425 | t | |
| 511 | 3245 | AA997608 | General | |
| 512 | 3020 | AA997656 | t | |
| 513 | 3269 | AA997800 | x, aa | |
| 514 | 3288 | AA997877 | f | |
| 515 | 23992 | AA998164 | k, x | |
| 516 | 17470 | AA998264 | b | |
| 517 | 3773 | AA998356 | General | |
| 518 | 19623 | AA998422 | General | |
| 519 | 3572 | AA998516 | x | |
| 520 | 2782 | AA998565 | c | |
| 521 | 26119 | AA998576 | i, r, w, General | |
| 522 | 22737 | AA998660 | aa | |
| 523 | 3696 | AA999030 | e | |
| 524 | 3079 | AA999169 | k, x, General | |
| 525 | 3081 | AA999171 | e, p, r | |
| 526 | 3082 | AA999172 | General | Glutamate metabolism, Purine metabolism |
| 527 | 17337 | AB000717 | k | |
| 528 | 1535 | AB000778 | a | |
| 529 | 1382 | AB002406 | k | |
| 530 | 20184 | AB003753 | d | |
| 531 | 4312 | AB010635 | c, i, j, k, y, z | |
| 532 | 21666 | AB012214 | k | Methionine metabolism |
| 533 | 15772 | AB015645 | g | |
| 534 | 1183 | AF013144 | h | |
| 535 | 1582 | AF015911 | h, z | |
| 536 | 11483 | AF020618 | u, cc, General | |
| 537 | 20295 | AF024712 | aa | |
| 538 | 19077 | AF030358 | y, z | |
| 539 | 23044 | AF034218 | General | |
| 540 | 25178 | AF035955 | d | |
| 541 | 1564 | AF035963 | x, bb, General | |
| 542 | 8426 | AF036335 | f | |
| 543 | 21817 | AF036537 | k | |
| 544 | 21145 | AF038571 | General | |
| 545 | 22602 | AF044574 | General | |
| 546 | 13464 | AF047707 | h | |
| 547 | 24024 | AF052695 | x | |
| 548 | 12259 | AF061266 | h | |
| 549 | 4589 | AF062389 | y, z | |
| 550 | 16007 | AF062594 | t | |
| 551 | 15761 | AF062741 | u | |
| 552 | 17426 | AF073839 | p | |
| 553 | 18615 | AF074608 | s | |
| 554 | 15797 | AF084205 | f | |
| 555 | 12932 | AF102552 | s | |
| 556 | 18603 | AI007649 | x | |
| 557 | 22733 | AI007668 | r | |
| 558 | 22746 | AI007672 | r | |
| 559 | 24109 | AI007725 | General | |

TABLE 2-continued

PATHWAYS

Atty. Docket No. 44921-5089US
Doc. No. 1803440.1

| Sequence ID No. | Identifier | GenBank Acc/ Ref. Seq. ID No. | Model Code | Pathways |
|---|---|---|---|---|
| 560 | 15848 | AI007820 | n, v | |
| 561 | 10108 | AI007857 | f | |
| 562 | 6804 | AI007877 | General | |
| 563 | 20099 | AI007893 | f, u | |
| 564 | 11368 | AI007948 | d | |
| 565 | 15849 | AI008074 | h | |
| 566 | 3121 | AI008160 | General | |
| 567 | 16646 | AI008190 | t | |
| 568 | 12683 | AI008203 | x | |
| 569 | 22018 | AI008309 | b | |
| 570 | 23917 | AI008441 | n | |
| 571 | 22599 | AI008458 | General | |
| 572 | 22698 | AI008578 | p, General | |
| 573 | 14405 | AI008579 | r, x | |
| 574 | 4086 | AI008629 | x | |
| 575 | 3808 | AI008643 | i, v, General | |
| 576 | 3931 | AI008697 | l | |
| 577 | 7785 | AI008758 | aa | |
| 578 | 16701 | AI008838 | q | |
| 579 | 21789 | AI008930 | k | |
| 580 | 21895 | AI008971 | General | |
| 581 | 410 | AI008974 | i, aa, General | |
| 582 | 21632 | AI009167 | General | |
| 583 | 21596 | AI009168 | General | |
| 584 | 22801 | AI009197 | General | |
| 585 | 11876 | AI009321 | cc, General | |
| 586 | 2506 | AI009341 | General | |
| 587 | 6382 | AI009362 | General | |
| 588 | 14370 | AI009427 | k | |
| 589 | 19275 | AI009460 | x | |
| 590 | 4154 | AI009467 | g | |
| 591 | 3464 | AI009589 | cc | |
| 592 | 3926 | AI009592 | e | |
| 593 | 19358 | AI009675 | c | |
| 594 | 22545 | AI009747 | g | |
| 595 | 15089 | AI009752 | cc, General | |
| 596 | 5458 | AI009756 | h | |
| 597 | 6844 | AI009770 | e, r, cc | |
| 598 | 15627 | AI009810 | aa | |
| 599 | 22619 | AI009825 | d | |
| 600 | 7857 | AI009898 | j, l, m, z | |
| 601 | 13259 | AI009946 | r | |
| 602 | 21105 | AI010067 | General | |
| 603 | 24627 | AI010102 | aa | |
| 604 | 12716 | AI010178 | General | |
| 605 | 18757 | AI010216 | aa | |
| 606 | 2912 | AI010220 | aa, General | |
| 607 | 3316 | AI010237 | t | |
| 608 | 15644 | AI010256 | General | |
| 609 | 657 | AI010262 | b | |
| 610 | 3271 | AI010303 | b | |
| 611 | 11081 | AI010407 | bb | |
| 612 | 16521 | AI010470 | c, s, t, General | Porphyrin and chlorophyll metabolism |
| 613 | 6927 | AI010542 | General | |
| 614 | 17524 | AI010568 | a, j, y, General | |
| 615 | 6946 | AI010642 | n | |
| 616 | 23509 | AI010962 | aa | |
| 617 | 6044 | AI011285 | t | |
| 618 | 13855 | AI011361 | o | |
| 619 | 21779 | AI011380 | cc | |
| 621 | 12534 | AI011460 | cc | |
| 622 | 12629 | AI011492 | e, f | |
| 623 | 735 | AI011560 | f | |
| 624 | 3941 | AI011598 | General | |
| 625 | 17550 | AI011607 | j, General | |
| 626 | 10636 | AI011634 | e | |
| 627 | 3995 | AI011678 | General | |
| 628 | 16112 | AI011706 | h | |
| 629 | 13354 | AI011757 | c | |
| 630 | 12745 | AI011799 | cc | |
| 631 | 18684 | AI011812 | t | |
| 632 | 4205 | AI011982 | b | |

TABLE 2-continued

PATHWAYS

| Sequence ID No. | Identifier | GenBank Acc/ Ref. Seq. ID No. | Model Code | Pathways |
|---|---|---|---|---|
| 633 | 6518 | AI012114 | General | |
| 634 | 17407 | AI012145 | General | |
| 635 | 13093 | AI012177 | r | |
| 636 | 15395 | AI012216 | f | |
| 637 | 21796 | AI012221 | d, General | |
| 638 | 3981 | AI012235 | i, General | |
| 639 | 6606 | AI012308 | i, r | |
| 640 | 3417 | AI012337 | w | |
| 641 | 24200 | AI012356 | b, t, General | |
| 642 | 7471 | AI012379 | cc | |
| 643 | 7247 | AI012438 | g | |
| 644 | 7127 | AI012464 | p, General | |
| 645 | 3304 | AI012471 | b | |
| 646 | 2311 | AI012485 | aa | |
| 647 | 20817 | AI012589 | g, n, q | Glutathione metabolism |
| 648 | 3493 | AI012590 | v, General | |
| 649 | 8975 | AI012613 | General | |
| 650 | 11335 | AI012619 | j | |
| 651 | 21409 | AI012637 | General | |
| 652 | 8015 | AI012638 | aa | |
| 653 | 8476 | AI012647 | w | |
| 654 | 4232 | AI012958 | e, p, General | |
| 655 | 23128 | AI013011 | General | |
| 656 | 20086 | AI013260 | General | |
| 657 | 11969 | AI013273 | k | |
| 658 | 26147 | AI013387 | aa | |
| 659 | 8815 | AI013437 | p | |
| 660 | 19722 | AI013508 | k | |
| 661 | 6674 | AI013568 | General | |
| 662 | 23145 | AI013647 | o, t | |
| 663 | 15130 | AI013676 | w | |
| 664 | 7274 | AI013715 | aa | |
| 665 | 7276 | AI013730 | e | |
| 666 | 7278 | AI013738 | y, z, aa | |
| 667 | 22592 | AI013740 | s, x, bb, General | |
| 668 | 16584 | AI013765 | w | |
| 669 | 24143 | AI013804 | j, l | |
| 670 | 15928 | AI013829 | a, General | |
| 671 | 21950 | AI013861 | j | Valine, leucine and isoleucine degradation |
| 672 | 3260 | AI013875 | t | |
| 673 | 2708 | AI013882 | d, q | |
| 674 | 8585 | AI013886 | i | |
| 675 | 7299 | AI013911 | p, r, t, General | |
| 676 | 15904 | AI013971 | General | |
| 677 | 12781 | AI014023 | w | |
| 678 | 19372 | AI014135 | aa | |
| 679 | 4241 | AI014140 | w | |
| 680 | 15247 | AI014169 | c, u | |
| 681 | 7315 | AI028831 | n | |
| 682 | 16631 | AI028856 | General | |
| 683 | 23297 | AI028953 | x | |
| 684 | 11326 | AI029015 | b | |
| 685 | 2866 | AI029058 | n, y | |
| 686 | 12812 | AI029126 | General | |
| 687 | 17602 | AI029156 | p | |
| 688 | 7392 | AI029185 | aa | |
| 689 | 6517 | AI029264 | d, k, x | |
| 690 | 7639 | AI029292 | b | |
| 691 | 3874 | AI029428 | i, General | |
| 692 | 12819 | AI029437 | f | |
| 693 | 7452 | AI029466 | r | |
| 694 | 7493 | AI029608 | b | |
| 696 | 7537 | AI029829 | o, General | |
| 697 | 2310 | AI029969 | v | |
| 698 | 7585 | AI030023 | x | |
| 699 | 7586 | AI030024 | b, n | |
| 700 | 14492 | AI030091 | cc | |
| 701 | 10673 | AI030134 | f | |
| 702 | 7615 | AI030163 | o, r | |
| 703 | 2370 | AI030179 | General | |
| 704 | 7681 | AI030449 | n | |
| 705 | 11559 | AI030472 | General | |

TABLE 2-continued

PATHWAYS

| Sequence ID No. | Identifier | GenBank Acc/ Ref. Seq. ID No. | Model Code | Pathways |
|---|---|---|---|---|
| 706 | 7665 | AI030668 | t, bb | |
| 707 | 24222 | AI030704 | k | |
| 708 | 10740 | AI030743 | h | |
| 709 | 10742 | AI030773 | e | |
| 711 | 16169 | AI030932 | General | |
| 712 | 19527 | AI030991 | f | |
| 713 | 22614 | AI031004 | r | |
| 714 | 3167 | AI031012 | e | |
| 715 | 5350 | AI043611 | a | |
| 716 | 7858 | AI043654 | t | |
| 717 | 10784 | AI043678 | d | |
| 718 | 9180 | AI043694 | aa | |
| 719 | 7867 | AI043695 | aa | Glutamate metabolism, Purine metabolism |
| 720 | 7584 | AI043724 | General | |
| 721 | 7895 | AI043768 | e | |
| 722 | 7903 | AI043805 | General | |
| 723 | 7913 | AI043849 | cc | |
| 724 | 3899 | AI043904 | l | |
| 725 | 6766 | AI043914 | f | |
| 726 | 10818 | AI043990 | g, l, m, General | |
| 727 | 7956 | AI044018 | f | |
| 728 | 5393 | AI044170 | p | |
| 729 | 5398 | AI044177 | q | |
| 730 | 5425 | AI044237 | a, d | |
| 731 | 8692 | AI044247 | r | |
| 732 | 5430 | AI044253 | i | |
| 733 | 5461 | AI044338 | g, p, General | |
| 734 | 5464 | AI044345 | i | |
| 735 | 3359 | AI044347 | aa | |
| 737 | 2695 | AI044396 | b | |
| 738 | 5494 | AI044425 | General | |
| 740 | 9882 | AI044588 | j, m | |
| 741 | 5575 | AI044688 | g | |
| 742 | 2348 | AI044794 | General | |
| 743 | 18205 | AI044836 | n | |
| 744 | 5626 | AI044864 | u | |
| 745 | 5630 | AI044869 | f | |
| 746 | 5634 | AI044883 | General | |
| 747 | 4047 | AI044947 | l, m | |
| 748 | 5654 | AI044976 | w | |
| 749 | 5684 | AI045056 | r | |
| 750 | 19235 | AI045074 | General | |
| 751 | 5689 | AI045075 | i, aa, General | |
| 752 | 5711 | AI045151 | General | |
| 753 | 19237 | AI045153 | c | |
| 754 | 9964 | AI045161 | f | |
| 755 | 5735 | AI045223 | f | |
| 756 | 5474 | AI045477 | a, General | |
| 757 | 5811 | AI045502 | d, e | |
| 758 | 5819 | AI045537 | General | |
| 759 | 5839 | AI045594 | l | |
| 760 | 6808 | AI045600 | s | |
| 761 | 17755 | AI045608 | y | |
| 763 | 10020 | AI045632 | a | |
| 764 | 5855 | AI045669 | General | |
| 765 | 5881 | AI045789 | i | |
| 766 | 5897 | AI045862 | General | |
| 767 | 5900 | AI045866 | y, z | |
| 768 | 7540 | AI045882 | o, t, General | |
| 769 | 5329 | AI045970 | p | |
| 770 | 15093 | AI058285 | d | |
| 771 | 8002 | AI058304 | i | |
| 772 | 8017 | AI058341 | c | |
| 773 | 6828 | AI058359 | General | |
| 774 | 8177 | AI058603 | aa | |
| 775 | 3090 | AI058730 | aa | |
| 776 | 10093 | AI058746 | g | |
| 777 | 8143 | AI058759 | General | |
| 778 | 18659 | AI058762 | f | |
| 779 | 8163 | AI058837 | aa | |
| 780 | 4789 | AI058889 | General | |
| 781 | 8221 | AI059061 | General | |

TABLE 2-continued

PATHWAYS

| Sequence ID No. | Identifier | GenBank Acc/ Ref. Seq. ID No. | Model Code | Pathways |
|---|---|---|---|---|
| 782 | 10159 | AI059147 | d | |
| 783 | 8245 | AI059154 | b | |
| 784 | 8283 | AI059290 | n | |
| 785 | 8314 | AI059386 | g, General | |
| 786 | 10200 | AI059444 | i | |
| 787 | 8347 | AI059519 | s | |
| 788 | 18359 | AI059675 | n | |
| 789 | 10281 | AI059947 | b, t | |
| 790 | 8494 | AI059968 | aa | |
| 791 | 8495 | AI059971 | General | |
| 792 | 8496 | AI059974 | General | |
| 793 | 10289 | AI060053 | l | |
| 794 | 8548 | AI060176 | k | |
| 795 | 8565 | AI060236 | t | |
| 796 | 18322 | AI060279 | i, y, z | |
| 797 | 8745 | AI069939 | r | |
| 798 | 8785 | AI070067 | o | |
| 799 | 17506 | AI070068 | cc | |
| 800 | 9067 | AI070087 | General | |
| 801 | 3551 | AI070122 | e | |
| 802 | 4967 | AI070179 | k | |
| 803 | 18 | AI070195 | General | |
| 804 | 24197 | AI070314 | General | |
| 805 | 8869 | AI070330 | r | |
| 806 | 8874 | AI070336 | b, cc | |
| 807 | 10417 | AI070410 | m | |
| 808 | 8901 | AI070419 | aa | |
| 809 | 14424 | AI070421 | l, p, General | |
| 810 | 10434 | AI070497 | General | |
| 811 | 8927 | AI070523 | v | |
| 812 | 8946 | AI070611 | q | |
| 813 | 8950 | AI070621 | w | |
| 814 | 8972 | AI070673 | General | |
| 815 | 8981 | AI070715 | bb | |
| 816 | 26184 | AI070784 | i, l | |
| 817 | 3007 | AI070824 | w | |
| 818 | 8999 | AI070839 | p | |
| 819 | 10477 | AI070868 | e, f | |
| 820 | 24301 | AI070911 | k | |
| 821 | 8721 | AI071024 | General | |
| 822 | 9212 | AI071098 | x | |
| 823 | 1831 | AI071137 | c | |
| 824 | 11005 | AI071139 | r | |
| 825 | 9104 | AI071173 | j, m | |
| 826 | 9583 | AI071185 | General | |
| 827 | 9644 | AI071410 | c | |
| 828 | 16058 | AI071490 | General | Sphingoglycolipid metabolism |
| 829 | 11057 | AI071509 | f, o | |
| 831 | 5695 | AI071566 | bb | |
| 832 | 9671 | AI071568 | w | |
| 833 | 22929 | AI071578 | General | |
| 834 | 9673 | AI071581 | General | |
| 835 | 9699 | AI071646 | General | |
| 837 | 9799 | AI072008 | q, y, z | |
| 838 | 9808 | AI072050 | d | |
| 839 | 22796 | AI072213 | General | |
| 840 | 9271 | AI072405 | v | |
| 841 | 10869 | AI072425 | w | |
| 842 | 21797 | AI072439 | General | |
| 843 | 9306 | AI072521 | r | |
| 844 | 9312 | AI072550 | j | |
| 845 | 10893 | AI072559 | x | |
| 846 | 1501 | AI072634 | cc, General | |
| 847 | 6548 | AI072658 | General | |
| 848 | 9363 | AI072695 | d | |
| 850 | 9409 | AI072841 | n | |
| 851 | 9410 | AI072842 | w | |
| 852 | 9468 | AI073021 | General | |
| 853 | 9518 | AI073223 | f | |
| 854 | 11183 | AI100768 | t | Nitrogen metabolism |
| 855 | 9190 | AI100835 | e | |
| 856 | 2029 | AI100842 | p | |

TABLE 2-continued

PATHWAYS

| Sequence ID No. | Identifier | GenBank Acc/ Ref. Seq. ID No. | Model Code | Pathways |
|---|---|---|---|---|
| 857 | 5687 | AI101006 | e | |
| 858 | 15192 | AI101099 | g, cc | |
| 859 | 17399 | AI101157 | o | |
| 860 | 9339 | AI101160 | l, m, o | |
| 861 | 6321 | AI101256 | General | |
| 862 | 5421 | AI101270 | c | |
| 863 | 11910 | AI101323 | General | |
| 864 | 23140 | AI101608 | e | |
| 865 | 4119 | AI101901 | General | |
| 866 | 16324 | AI102009 | b | |
| 867 | 18642 | AI102023 | o | |
| 868 | 19373 | AI102044 | a | |
| 869 | 7051 | AI102055 | h | |
| 870 | 6544 | AI102064 | c | |
| 871 | 10227 | AI102248 | w | |
| 872 | 23849 | AI102318 | e, q | |
| 873 | 11954 | AI102505 | g, j, s | Oxidative phosphorylation |
| 874 | 2125 | AI102519 | c, k | |
| 875 | 5967 | AI102520 | y | |
| 875 | 5969 | AI102520 | p, w | |
| 876 | 11563 | AI102560 | General | |
| 877 | 15190 | AI102562 | b, g, n, p, v | |
| 878 | 19769 | AI102570 | bb | |
| 879 | 22487 | AI102578 | General | |
| 880 | 19011 | AI102618 | General | |
| 881 | 23837 | AI102620 | q, t | |
| 882 | 23538 | AI102727 | g, General | |
| 883 | 17234 | AI102741 | c | |
| 884 | 5891 | AI102745 | k | |
| 885 | 6796 | AI102753 | General | |
| 886 | 8837 | AI102849 | o, p | |
| 887 | 15861 | AI102868 | i | |
| 888 | 3533 | AI102877 | g | |
| 889 | 13222 | AI102977 | General | |
| 890 | 6806 | AI103018 | o, u | |
| 891 | 10659 | AI103059 | w, cc, General | |
| 892 | 17400 | AI103097 | e | |
| 893 | 3584 | AI103106 | x, aa | |
| 894 | 13298 | AI103143 | r | |
| 895 | 15981 | AI103150 | i, x | |
| 896 | 3475 | AI103245 | w | |
| 898 | 23619 | AI103314 | p | |
| 899 | 24181 | AI103320 | e | |
| 901 | 4355 | AI103410 | General | |
| 902 | 7622 | AI103472 | General | |
| 903 | 20918 | AI103552 | n | |
| 904 | 21579 | AI103572 | General | |
| 905 | 2222 | AI103631 | o | |
| 906 | 2752 | AI103641 | e | |
| 907 | 4856 | AI103708 | i | |
| 908 | 8990 | AI103719 | l, m, y, z | |
| 909 | 15942 | AI103738 | r | |
| 910 | 22885 | AI103828 | e, General | |
| 911 | 15853 | AI103841 | x | |
| 912 | 15050 | AI103911 | j, y | Oxidative phosphorylation |
| 913 | 12376 | AI103939 | u | |
| 914 | 22271 | AI103947 | o, y | |
| 915 | 20833 | AI104035 | f, q | Oxidative phosphorylation |
| 916 | 7010 | AI104099 | w | |
| 917 | 22101 | AI104251 | General | |
| 918 | 22833 | AI104258 | General | |
| 919 | 22211 | AI104279 | g, m | |
| 920 | 10720 | AI104296 | l | |
| 921 | 15416 | AI104340 | i | |
| 922 | 10991 | AI104342 | a | |
| 923 | 18831 | AI104357 | p | |
| 924 | 7223 | AI104373 | e | |
| 925 | 23574 | AI104520 | e, g, s | Oxidative phosphorylation |
| 926 | 18509 | AI104528 | q | |
| 927 | 11680 | AI104605 | v | |
| 928 | 12342 | AI104658 | w | |
| 929 | 23689 | AI104685 | r | |

TABLE 2-continued

Atty. Docket No. 44921-5089US
Doc. No. 1803440.1

PATHWAYS

| Sequence ID No. | Identifier | GenBank Acc/ Ref. Seq. ID No. | Model Code | Pathways |
|---|---|---|---|---|
| 930 | 15377 | AI104821 | o, cc | |
| 931 | 22957 | AI104897 | General | |
| 932 | 18451 | AI104953 | o, s | Oxidative phosphorylation, Type III protein secretion system |
| 933 | 24375 | AI104979 | n, General | |
| 934 | 18278 | AI105080 | bb | |
| 935 | 2196 | AI105243 | g | |
| 936 | 5199 | AI105272 | bb, General | |
| 937 | 12901 | AI105301 | o, s | |
| 938 | 7700 | AI105383 | cc, General | |
| 939 | 13343 | AI105398 | u | |
| 940 | 22931 | AI105417 | e, General | |
| 941 | 23596 | AI105435 | bb | Fatty acid metabolism, Lysine degradation, Tryptophan metabolism |
| 942 | 15893 | AI105465 | o | |
| 943 | 12660 | AI111492 | c | |
| 944 | 4479 | AI111599 | General | |
| 945 | 24211 | AI111853 | k | |
| 946 | 2539 | AI111960 | r | |
| 947 | 5729 | AI111990 | k | |
| 948 | 4049 | AI112012 | i, q, u, General | |
| 949 | 12908 | AI112043 | i | |
| 950 | 20041 | AI112161 | t | |
| 951 | 12937 | AI112462 | General | |
| 952 | 3713 | AI112571 | b | |
| 953 | 12921 | AI112636 | General | |
| 954 | 12965 | AI112926 | General | |
| 955 | 7499 | AI112986 | General | |
| 956 | 4969 | AI113008 | r | |
| 957 | 11817 | AI136295 | f | |
| 959 | 11165 | AI136372 | c | |
| 960 | 4045 | AI136460 | cc | |
| 961 | 12782 | AI136493 | k | |
| 962 | 6850 | AI136665 | h | Purine metabolism, Pyrimidine metabolism |
| 963 | 20920 | AI136891 | p, v | |
| 964 | 6552 | AI137062 | o | |
| 965 | 22722 | AI137211 | i | |
| 966 | 13111 | AI137224 | o, General | |
| 967 | 15969 | AI137302 | e | |
| 968 | 14349 | AI137303 | d | |
| 969 | 9166 | AI137406 | General | |
| 970 | 9525 | AI137516 | r | |
| 971 | 6638 | AI137579 | General | |
| 972 | 7414 | AI137586 | General | |
| 973 | 11321 | AI137752 | z | |
| 974 | 23473 | AI137932 | l | |
| 975 | 13158 | AI138024 | i | |
| 976 | 13467 | AI138034 | cc | |
| 977 | 11377 | AI138105 | y | |
| 978 | 6790 | AI144801 | d, h | |
| 979 | 6506 | AI144919 | j, l, y | |
| 980 | 8027 | AI144958 | i | |
| 982 | 14458 | AI145095 | General | |
| 983 | 7476 | AI145202 | g | |
| 984 | 17545 | AI145384 | e | |
| 985 | 17479 | AI145385 | r | |
| 986 | 4194 | AI145387 | r | |
| 987 | 8634 | AI145722 | g | |
| 988 | 8339 | AI145761 | y, General | |
| 989 | 2059 | AI146005 | h, General | |
| 990 | 23224 | AI146033 | o | |
| 991 | 5232 | AI168942 | bb | Valine, leucine and isoleucine degradation |
| 992 | 18472 | AI168975 | u | |
| 992 | 18473 | AI168975 | u | |
| 993 | 13235 | AI169020 | r | |
| 994 | 11618 | AI169115 | o, y, General | |
| 995 | 17386 | AI169144 | o | |
| 996 | 10984 | AI169156 | o, u | |
| 997 | 8205 | AI169176 | e | |
| 998 | 12979 | AI169177 | e | |
| 999 | 2607 | AI169211 | c | |

TABLE 2-continued

PATHWAYS

| Sequence ID No. | Identifier | GenBank Acc/ Ref. Seq. ID No. | Model Code | Pathways |
|---|---|---|---|---|
| 1000 | 22661 | AI169265 | s, z | Oxidative phosphorylation, Type III protein secretion system |
| 1001 | 13239 | AI169278 | g, j, l, y, z | |
| 1002 | 24162 | AI169279 | m | |
| 1003 | 16879 | AI169284 | o | |
| 1004 | 24213 | AI169289 | p | |
| 1005 | 13240 | AI169311 | cc | |
| 1006 | 5931 | AI169324 | b | |
| 1007 | 20891 | AI169337 | d | |
| 1008 | 11979 | AI169365 | cc | |
| 1009 | 10947 | AI169372 | s | |
| 1010 | 20697 | AI169494 | o, u | |
| 1011 | 8234 | AI169517 | z | |
| 1012 | 18343 | AI169648 | o | |
| 1013 | 10839 | AI169655 | l, m | |
| 1014 | 24146 | AI169668 | j, l | |
| 1015 | 22575 | AI169728 | r | |
| 1016 | 804 | AI169756 | cc | |
| 1017 | 8213 | AI169883 | p | |
| 1018 | 3916 | AI169947 | i, bb | |
| 1019 | 3733 | AI170053 | u, General | |
| 1020 | 14179 | AI170224 | cc | |
| 1021 | 11406 | AI170263 | r | |
| 1022 | 3547 | AI170279 | General | |
| 1023 | 11524 | AI170340 | j, y, z | |
| 1024 | 2729 | AI170363 | e, i | |
| 1025 | 18811 | AI170525 | i | |
| 1026 | 22524 | AI170542 | h | |
| 1027 | 24048 | AI170570 | a, g | |
| 1028 | 5968 | AI170692 | y, aa | |
| 1029 | 9757 | AI170693 | b | |
| 1030 | 18905 | AI170770 | e, s | |
| 1031 | 16170 | AI170894 | i | |
| 1032 | 7089 | AI171185 | c | |
| 1033 | 17591 | AI171354 | b | |
| 1034 | 13285 | AI171361 | h | |
| 1035 | 4428 | AI171362 | a | Oxidative phosphorylation, Ubiquinone biosynthesis |
| 1036 | 18126 | AI171369 | w | |
| 1037 | 23253 | AI171448 | o | |
| 1038 | 4584 | AI171492 | m, General | |
| 1039 | 11158 | AI171542 | r, s | |
| 1040 | 15345 | AI171587 | l | |
| 1041 | 21183 | AI171676 | k | |
| 1042 | 8215 | AI171692 | i | |
| 1043 | 11437 | AI171794 | i | |
| 1044 | 2625 | AI171800 | cc | |
| 1045 | 23579 | AI171802 | v | |
| 1046 | 11708 | AI171807 | l, t | |
| 1047 | 17204 | AI171844 | s, y, z | Oxidative phosphorylation, Type III protein secretion system |
| 1048 | 4420 | AI171916 | m | |
| 1049 | 3266 | AI171948 | l, m | |
| 1050 | 19012 | AI172056 | t | |
| 1051 | 11205 | AI172057 | a, q, bb | |
| 1052 | 6057 | AI172102 | b | |
| 1053 | 19128 | AI172103 | m | |
| 1054 | 15673 | AI172107 | z | |
| 1055 | 6630 | AI172184 | n | |
| 1056 | 11968 | AI172208 | bb | |
| 1057 | 6974 | AI172263 | l, m | |
| 1058 | 23313 | AI172271 | d | |
| 1059 | 2140 | AI172272 | General | |
| 1060 | 15382 | AI172302 | l, p, General | |
| 1061 | 18689 | AI172329 | l | |
| 1062 | 17887 | AI172414 | o | |
| 1063 | 3042 | AI172447 | General | |
| 1064 | 17291 | AI172491 | bb | Citrate cycle (TCA cycle), Glutathione metabolism, Reductive carboxylate cycle (CO2 fixation) |
| 1065 | 26222 | AI172506 | p | |
| 1066 | 13095 | AI172595 | r | |

TABLE 2-continued

PATHWAYS

| Sequence ID No. | Identifier | GenBank Acc/ Ref. Seq. ID No. | Model Code | Pathways |
|---|---|---|---|---|
| 1067 | 8795 | AI172618 | General | |
| 1068 | 6454 | AI175342 | j, l, m, y | |
| 1070 | 4445 | AI175466 | x | |
| 1071 | 3418 | AI175475 | m | |
| 1072 | 18507 | AI175551 | bb | |
| 1073 | 10217 | AI175628 | w | |
| 1074 | 7262 | AI175833 | j, m, x | |
| 1075 | 19004 | AI175875 | r | |
| 1076 | 22352 | AI175959 | l, General | |
| 1077 | 7022 | AI176041 | h, n | |
| 1078 | 21467 | AI176061 | t | |
| 1079 | 18581 | AI176160 | General | |
| 1080 | 14159 | AI176169 | g | |
| 1081 | 21742 | AI176172 | w | |
| 1082 | 10182 | AI176185 | v | |
| 1083 | 22765 | AI176265 | General | |
| 1084 | 6905 | AI176275 | a | |
| 1085 | 12999 | AI176276 | cc | |
| 1086 | 16438 | AI176294 | e | |
| 1087 | 21130 | AI176298 | y | |
| 1088 | 3014 | AI176362 | e | |
| 1089 | 15015 | AI176363 | r | |
| 1090 | 19006 | AI176393 | x | |
| 1091 | 20001 | AI176396 | o | |
| 1092 | 12174 | AI176435 | j, m | |
| 1093 | 15191 | AI176456 | b, o, t, v, cc | |
| 1094 | 24236 | AI176473 | d, General | |
| 1095 | 16518 | AI176546 | v | |
| 1096 | 2161 | AI176592 | General | |
| 1097 | 12436 | AI176610 | General | |
| 1098 | 2536 | AI176616 | l, v, General | |
| 1099 | 18525 | AI176792 | u | |
| 1100 | 23449 | AI176828 | g | |
| 1101 | 23299 | AI176839 | General | |
| 1102 | 3580 | AI176848 | e | |
| 1103 | 22103 | AI176849 | d, General | |
| 1104 | 16036 | AI176855 | f | |
| 1105 | 15588 | AI176916 | General | |
| 1106 | 16917 | AI176951 | t | |
| 1107 | 16124 | AI176963 | cc | |
| 1108 | 15146 | AI176969 | b, General | |
| 1109 | 5786 | AI177058 | f | |
| 1110 | 2852 | AI177059 | c | |
| 1112 | 3156 | AI177092 | g | |
| 1113 | 14384 | AI177096 | a | Purine metabolism |
| 1114 | 13310 | AI177119 | General | |
| 1115 | 24049 | AI177341 | g, p, s, u | |
| 1116 | 15964 | AI177360 | o, General | |
| 1117 | 14989 | AI177366 | u | |
| 1118 | 7975 | AI177374 | aa | |
| 1119 | 3006 | AI177395 | k | |
| 1120 | 17570 | AI177683 | r | |
| 1121 | 9521 | AI177706 | b | |
| 1122 | 14425 | AI177755 | g, General | |
| 1123 | 10611 | AI177790 | j, m | |
| 1124 | 5356 | AI177813 | cc | |
| 1125 | 11791 | AI177843 | General | |
| 1126 | 14484 | AI177867 | General | |
| 1127 | 5780 | AI177869 | General | |
| 1128 | 19184 | AI178025 | General | |
| 1129 | 6059 | AI178245 | c, General | |
| 1130 | 23248 | AI178267 | y | |
| 1131 | 4073 | AI178272 | o | |
| 1132 | 7838 | AI178291 | e | |
| 1133 | 18996 | AI178326 | y | |
| 1134 | 22488 | AI178392 | b | |
| 1135 | 18800 | AI178504 | n, p, aa | |
| 1136 | 22197 | AI178527 | g, General | |
| 1137 | 3401 | AI178684 | bb | |
| 1138 | 17713 | AI178700 | m | |
| 1139 | 14874 | AI178735 | e | |
| 1140 | 23567 | AI178746 | v, General | |

TABLE 2-continued

PATHWAYS

| Sequence ID No. | Identifier | GenBank Acc/ Ref. Seq. ID No. | Model Code | Pathways |
|---|---|---|---|---|
| 1141 | 18907 | AI178971 | c | |
| 1142 | 20991 | AI178979 | i | |
| 1143 | 5887 | AI179099 | q, t | |
| 1144 | 8477 | AI179167 | b, e, General | |
| 1145 | 3348 | AI179288 | u, v | |
| 1146 | 13608 | AI179314 | e | |
| 1147 | 8849 | AI179315 | g, p | |
| 1148 | 13611 | AI179378 | v, General | |
| 1149 | 15438 | AI179399 | m, x | |
| 1150 | 13614 | AI179407 | e, t, General | |
| 1151 | 15042 | AI179422 | b, General | |
| 1152 | 2768 | AI179481 | i, General | |
| 1153 | 24041 | AI179580 | b, i | |
| 1154 | 19822 | AI179599 | o, General | |
| 1155 | 23270 | AI179601 | q, General | |
| 1156 | 5901 | AI179605 | e | |
| 1157 | 16081 | AI179610 | g, i, p | Porphyrin and chlorophyll metabolism |
| 1158 | 14564 | AI179717 | k | |
| 1159 | 7918 | AI179750 | General | |
| 1160 | 6647 | AI179795 | g | |
| 1161 | 9097 | AI179875 | o, General | |
| 1162 | 23989 | AI179953 | a | |
| 1163 | 12899 | AI179967 | b | |
| 1164 | 1687 | AI179971 | c | |
| 1165 | 22569 | AI179979 | General | |
| 1166 | 23514 | AI179986 | o, General | Glycine, serine and threonine metabolism |
| 1167 | 15892 | AI179988 | c, General | |
| 1168 | 12402 | AI180004 | g | |
| 1169 | 5443 | AI180165 | General | |
| 1170 | 5481 | AI180170 | General | |
| 1171 | 24028 | AI180239 | l | |
| 1172 | 17089 | AI180281 | g | |
| 1173 | 3701 | AI180306 | aa | |
| 1174 | 3352 | AI180334 | m | |
| 1175 | 24368 | AI180392 | l, m | |
| 1176 | 14337 | AI180414 | c | |
| 1177 | 19080 | AI227647 | j, y, z | |
| 1178 | 22838 | AI227667 | aa | |
| 1179 | 6765 | AI227761 | i, General | |
| 1180 | 24054 | AI227867 | General | |
| 1181 | 7324 | AI227885 | i | |
| 1182 | 23898 | AI227987 | d | |
| 1183 | 1651 | AI228068 | n, w | |
| 1184 | 14237 | AI228128 | e | |
| 1185 | 14242 | AI228197 | General | |
| 1186 | 16913 | AI228236 | o | |
| 1187 | 22915 | AI228299 | r | |
| 1188 | 8917 | AI228301 | General | |
| 1189 | 15879 | AI228313 | r, General | |
| 1190 | 13727 | AI228326 | o, General | |
| 1191 | 6102 | AI228335 | General | |
| 1192 | 13730 | AI228356 | a | |
| 1193 | 13745 | AI228494 | b, cc | |
| 1194 | 4217 | AI228587 | s | |
| 1195 | 16053 | AI228596 | cc | |
| 1196 | 3557 | AI228672 | e | |
| 1197 | 11605 | AI228682 | e | |
| 1198 | 13203 | AI228728 | r | |
| 1199 | 13771 | AI228848 | g | |
| 1200 | 5918 | AI229036 | r | |
| 1201 | 8235 | AI229154 | k | |
| 1202 | 16203 | AI229196 | r | |
| 1203 | 13826 | AI229304 | a | |
| 1204 | 13144 | AI229320 | g | |
| 1205 | 4640 | AI229404 | x, aa | |
| 1206 | 23563 | AI229421 | l | |
| 1207 | 15426 | AI229497 | s | |
| 1208 | 15193 | AI229508 | bb | |
| 1209 | 19243 | AI229638 | x | |
| 1210 | 23078 | AI229647 | p | |
| 1211 | 3099 | AI229680 | o | Oxidative phosphorylation, Ubiquinone biosynthesis |

TABLE 2-continued

PATHWAYS

| Sequence ID No. | Identifier | GenBank Acc/ Ref. Seq. ID No. | Model Code | Pathways |
|---|---|---|---|---|
| 1212 | 19508 | AI229698 | bb | |
| 1213 | 13977 | AI229707 | x | |
| 1214 | 23983 | AI229708 | v | |
| 1215 | 2688 | AI229793 | e | |
| 1216 | 13874 | AI229832 | g | |
| 1217 | 12587 | AI229979 | General | |
| 1218 | 20591 | AI229993 | l, m | |
| 1219 | 24042 | AI230002 | a, b, d, General | |
| 1220 | 13880 | AI230042 | u | |
| 1221 | 17672 | AI230074 | d | Oxidative phosphorylation, Ubiquinone biosynthesis |
| 1222 | 3652 | AI230113 | General | |
| 1223 | 18650 | AI230121 | aa | |
| 1224 | 13025 | AI230173 | c | |
| 1225 | 4280 | AI230247 | z | |
| 1226 | 18528 | AI230284 | General | |
| 1227 | 7084 | AI230362 | p | |
| 1228 | 20895 | AI230549 | b, n | |
| 1229 | 12961 | AI230554 | General | |
| 1230 | 15636 | AI230616 | r | |
| 1231 | 4121 | AI230647 | j, m | |
| 1232 | 14388 | AI230702 | General | |
| 1233 | 18529 | AI230716 | x, General | |
| 1234 | 13618 | AI230724 | General | |
| 1235 | 8304 | AI230746 | cc | |
| 1236 | 4731 | AI230773 | e | |
| 1237 | 14430 | AI230798 | c, k, x | |
| 1238 | 16627 | AI230822 | bb | Glycoprotein biosynthesis |
| 1239 | 3125 | AI231028 | General | |
| 1240 | 633 | AI231127 | k | |
| 1241 | 20846 | AI231140 | p | |
| 1242 | 6743 | AI231219 | d | |
| 1244 | 26292 | AI231391 | k | |
| 1245 | 12343 | AI231433 | w | |
| 1246 | 7337 | AI231465 | aa | |
| 1247 | 16321 | AI231506 | General | |
| 1248 | 8004 | AI231532 | j, l | |
| 1249 | 15171 | AI231792 | g | |
| 1250 | 6193 | AI231797 | i | |
| 1252 | 14227 | AI231999 | u | |
| 1253 | 24501 | AI232006 | w, y, bb | |
| 1254 | 3434 | AI232014 | g, q, z, cc, General | |
| 1255 | 19094 | AI232021 | n, General | |
| 1256 | 14020 | AI232076 | u | |
| 1257 | 6726 | AI232157 | d | |
| 1258 | 11549 | AI232174 | l, m | |
| 1259 | 23125 | AI232266 | j, s | |
| 1260 | 2085 | AI232270 | bb | |
| 1261 | 2913 | AI232272 | o | |
| 1262 | 14304 | AI232281 | g | |
| 1263 | 15955 | AI232294 | u, bb, General | |
| 1264 | 15122 | AI232303 | y | |
| 1265 | 4716 | AI232313 | y | |
| 1266 | 15246 | AI232332 | t, u | |
| 1267 | 24321 | AI232340 | o | |
| 1268 | 16172 | AI232341 | d | |
| 1269 | 11411 | AI232346 | h | |
| 1270 | 19287 | AI232379 | f | pdgf |
| 1271 | 5601 | AI232461 | n, General | |
| 1272 | 14051 | AI232489 | l, m | |
| 1273 | 5572 | AI232490 | i, t | |
| 1274 | 11157 | AI232494 | cc | |
| 1275 | 8709 | AI232534 | o | |
| 1276 | 20350 | AI232552 | j, v, y | |
| 1277 | 14069 | AI232631 | e | |
| 1278 | 4440 | AI232643 | w | |
| 1279 | 17695 | AI232784 | e | |
| 1280 | 15796 | AI232874 | v | |
| 1281 | 12467 | AI232924 | General | |
| 1282 | 12873 | AI232984 | i | |
| 1283 | 5355 | AI233031 | r | |

TABLE 2-continued

PATHWAYS

| Sequence ID No. | Identifier | GenBank Acc/ Ref. Seq. ID No. | Model Code | Pathways |
|---|---|---|---|---|
| 1284 | 18794 | AI233121 | c | |
| 1285 | 3823 | AI233147 | b, g, General | |
| 1286 | 11967 | AI233155 | c, k, General | |
| 1287 | 11561 | AI233182 | d | |
| 1288 | 3471 | AI233183 | g | |
| 1289 | 21948 | AI233191 | i | |
| 1290 | 13598 | AI233194 | g, p, y | |
| 1291 | 15552 | AI233195 | y | |
| 1292 | 17907 | AI233224 | bb | |
| 1293 | 14111 | AI233269 | cc | |
| 1294 | 12894 | AI233365 | d | |
| 1295 | 7161 | AI233407 | General | |
| 1296 | 15906 | AI233425 | q | |
| 1297 | 14120 | AI233433 | d | |
| 1298 | 14095 | AI233468 | a, d | |
| 1299 | 3075 | AI233494 | u, aa | |
| 1300 | 6046 | AI233530 | General | |
| 1301 | 18900 | AI233570 | General | |
| 1302 | 7888 | AI233583 | General | Aminoacyl-tRNA biosynthesis, Arginine and proline metabolism |
| 1303 | 16709 | AI233602 | General | Purine metabolism |
| 1304 | 5163 | AI233712 | y | |
| 1305 | 7243 | AI233717 | General | |
| 1306 | 3816 | AI233729 | g | |
| 1307 | 13023 | AI233740 | d, h, General | |
| 1308 | 14871 | AI233743 | g | |
| 1309 | 7469 | AI233767 | cc | |
| 1310 | 7804 | AI233771 | b | |
| 1311 | 13563 | AI233773 | e | |
| 1312 | 2154 | AI233818 | k, cc | |
| 1313 | 16616 | AI234079 | h | |
| 1314 | 13393 | AI234100 | a, d, General | |
| 1315 | 7071 | AI234162 | r | |
| 1316 | 14677 | AI234620 | General | |
| 1317 | 4443 | AI234629 | m | |
| 1318 | 22453 | AI234678 | b | |
| 1319 | 23964 | AI234748 | t, General | |
| 1320 | 19581 | AI234753 | f | |
| 1321 | 22152 | AI234822 | o, General | |
| 1322 | 18942 | AI234865 | d | |
| 1323 | 22662 | AI234939 | aa | Oxidative phosphorylation, Type III protein secretion system |
| 1324 | 3875 | AI235047 | o, General | |
| 1325 | 19479 | AI235135 | o | |
| 1326 | 14906 | AI235192 | g | |
| 1327 | 14718 | AI235210 | e | |
| 1328 | 15004 | AI235224 | b, General | |
| 1329 | 6632 | AI235277 | v | |
| 1330 | 14722 | AI235284 | x, z | |
| 1331 | 1462 | AI235585 | u, General | |
| 1332 | 21061 | AI235631 | l, m | |
| 1333 | 14665 | AI235646 | m | tgf-beta |
| 1334 | 19940 | AI235689 | General | |
| 1335 | 5698 | AI235692 | u | |
| 1336 | 23745 | AI235732 | k | |
| 1337 | 11164 | AI235739 | General | |
| 1338 | 5212 | AI235745 | d | |
| 1339 | 14768 | AI235912 | h | |
| 1340 | 14776 | AI235950 | m | |
| 1341 | 3091 | AI236027 | n, General | |
| 1342 | 14861 | AI236045 | r | |
| 1343 | 14862 | AI236048 | e | |
| 1344 | 16943 | AI236097 | p | |
| 1345 | 8336 | AI236101 | l | |
| 1346 | 23230 | AI236146 | v | |
| 1347 | 22855 | AI236150 | e | |
| 1348 | 14594 | AI236152 | i | |
| 1349 | 18406 | AI236168 | r | |
| 1350 | 15051 | AI236332 | General | |
| 1351 | 19298 | AI236338 | bb | |
| 1352 | 10667 | AI236366 | b | |
| 1353 | 10774 | AI236397 | f | |

TABLE 2-continued

PATHWAYS

| Sequence ID No. | Identifier | GenBank Acc/ Ref. Seq. ID No. | Model Code | Pathways |
|---|---|---|---|---|
| 1354 | 9407 | AI236402 | aa | |
| 1355 | 26335 | AI236460 | General | |
| 1356 | 17950 | AI236590 | t, General | |
| 1357 | 18259 | AI236601 | h, v | |
| 1358 | 11445 | AI236613 | j, y | |
| 1359 | 17248 | AI236635 | o, aa | |
| 1360 | 16859 | AI236753 | t, General | |
| 1361 | 5208 | AI236754 | g | |
| 1362 | 24388 | AI236772 | e, General | |
| 1363 | 15850 | AI236795 | n, v, w | |
| 1364 | 14800 | AI236856 | w | |
| 1366 | 11404 | AI237002 | m | |
| 1367 | 18151 | AI237212 | o, General | |
| 1368 | 21653 | AI237535 | t, General | |
| 1369 | 11208 | AI237586 | z | |
| 1370 | 21893 | AI237713 | i, k, aa | |
| 1371 | 14842 | AI237724 | r | |
| 1372 | 3467 | AI237835 | General | |
| 1373 | 25840 | AI638972 | u | |
| 1374 | 17108 | AI639017 | n | |
| 1375 | 16676 | AI639082 | c, k, x | |
| 1376 | 12400 | AI639107 | k | |
| 1377 | 19952 | AI639108 | q, v | |
| 1379 | 25907 | AI639167 | o, w | |
| 1381 | 18533 | AI639231 | n | |
| 1382 | 18353 | AI639233 | t, aa | |
| 1384 | 15330 | AI639285 | General | |
| 1385 | 20026 | AI639354 | g | |
| 1386 | 25971 | AI639365 | r | |
| 1388 | 19152 | AI639387 | u, General | |
| 1390 | 18338 | AI639422 | y | |
| 1392 | 20082 | AI639488 | i, m | |
| 1394 | 20056 | AI639504 | a, bb, General | |
| 1395 | 4713 | AI639518 | q | |
| 1396 | 14332 | AJ001044 | bb | |
| 1397 | 7602 | AJ001929 | k | |
| 1398 | 9867 | AJ005424 | u | |
| 1400 | 16351 | AJ011811 | General | |
| 1401 | 20116 | AJ011969 | l, General | |
| 1402 | 17635 | AJ223355 | v, w | |
| 1403 | 18686 | D00729 | q | Fatty acid metabolism |
| 1404 | 5049 | D10655 | n, w | |
| 1405 | 25257 | D13623 | j | |
| 1405 | 15281 | D13623 | h | |
| 1406 | 11434 | D14014 | cc | |
| 1407 | 1613 | D14076 | x | |
| 1408 | 1728 | D16479 | q | Bile acid biosynthesis, Fatty acid biosynthesis (path 2), Fatty acid metabolism, Phenylalanine metabolism, Valine, leucine and isoleucine degradation |
| 1409 | 3015 | D16554 | c, s, v, z | |
| 1410 | 472 | D26111 | d, s, bb | |
| 1412 | 16233 | D29960 | j, l | |
| 1413 | 9029 | D30804 | n | |
| 1414 | 1485 | D38222 | y, z | |
| 1415 | 9135 | D45247 | s | Proteasome |
| 1416 | 16354 | D50564 | u | Cysteine metabolism |
| 1417 | 1884 | D50695 | l, m, bb | |
| 1418 | 21147 | D63772 | General | |
| 1419 | 826 | D82928 | f | Glycerolipid metabolism |
| 1420 | 25306 | D84485 | u | |
| 1421 | 18867 | D88250 | t | |
| 1423 | 22543 | H31117 | r, v, General | |
| 1424 | 12360 | H31456 | w | |
| 1425 | 20514 | H31489 | h, j | |
| 1426 | 11358 | H31610 | h | |
| 1427 | 4360 | H31813 | bb, General | |
| 1428 | 9343 | H32169 | l | |
| 1429 | 4386 | H33093 | h, w | |
| 1430 | 4415 | H33636 | h | |
| 1431 | 15374 | H34186 | l | |

TABLE 2-continued

PATHWAYS

| Sequence ID No. | Identifier | GenBank Acc/ Ref. Seq. ID No. | Model Code | Pathways |
|---|---|---|---|---|
| 1432 | 17159 | J00797 | u, General | |
| 1433 | 16260 | J01878 | f | |
| 1434 | 17284 | J02827 | bb | Valine, leucine and isoleucine degradation |
| 1435 | 15017 | J03752 | n | |
| 1436 | 44 | J03819 | p, s | |
| 1437 | 21014 | J03914 | e, r, General | Glutathione metabolism |
| 1438 | 20429 | J05035 | f | Androgen and estrogen metabolism, Bile acid biosynthesis |
| 1439 | 1247 | J05181 | j, l, m, s, y, z | Glutamate metabolism, Glutathione metabolism |
| 1440 | 10464 | J05510 | n, u, General | |
| 1441 | 20149 | K03243 | q | |
| 1442 | 17758 | K03249 | q | |
| 1443 | 381 | L00124 | w | |
| 1444 | 2048 | L00382 | k, x | |
| 1445 | 10500 | L04619 | s | |
| 1447 | 108 | L14002 | p | |
| 1448 | 25366 | L14003 | t | |
| 1449 | 109 | L14004 | c, p | |
| 1450 | 20414 | L14323 | General | |
| 1451 | 25369 | L14937 | y | |
| 1452 | 16119 | L16532 | k | |
| 1453 | 25377 | L25387 | h | |
| 1453 | 12058 | L25387 | h | |
| 1455 | 21146 | L35558 | General | |
| 1456 | 106 | L37203 | w | |
| 1458 | 13682 | L38482 | f, j, k, m, z | |
| 1459 | 6405 | L38615 | p | Glutamate metabolism, Glutathione metabolism |
| 1461 | 15189 | M11794 | n, v | |
| 1462 | 17086 | M13011 | j | |
| 1464 | 21053 | M15481 | o | |
| 1465 | 25405 | M18330 | j, l | |
| 1466 | 25415 | M19648 | a | |
| 1468 | 14967 | M22366 | w | |
| 1469 | 20481 | M22631 | bb | |
| 1471 | 15048 | M24542 | q | Oxidative phosphorylation |
| 1472 | 20921 | M29853 | m | |
| 1473 | 1224 | M31931 | u | |
| 1474 | 15579 | M33648 | q | |
| 1474 | 15580 | M33648 | q | |
| 1475 | 17211 | M34331 | g, n, q, v | |
| 1476 | 20699 | M35601 | b, x, bb | |
| 1476 | 20700 | M35601 | b, t, bb | |
| 1477 | 9223 | M36151 | o | |
| 1479 | 1585 | M57728 | j, m, y | |
| 1480 | 24844 | M58040 | c | |
| 1481 | 25057 | M58495 | h | |
| 1482 | 457 | M60666 | d, General | |
| 1483 | 1223 | M75281 | f | |
| 1484 | 5733 | M81855 | i, k, aa | |
| 1485 | 4198 | M83143 | m | |
| 1485 | 4199 | M83143 | m | |
| 1486 | 24651 | M83678 | k, x, z | |
| 1487 | 1430 | M84648 | General | Histidine metabolism, Phenylalanine metabolism, Tryptophan metabolism, Tyrosine metabolism |
| 1488 | 25467 | M93297 | c | Arginine and proline metabolism, Urea cycle and metabolism of amino groups |
| 1489 | 729 | M95762 | a, y | |
| 1490 | 23698 | NM_012489 | q | Bile acid biosynthesis, Fatty acid biosynthesis (path 2), Fatty acid metabolism, Phenylalanine metabolism, Valine, leucine and isoleucine degradation |
| 1490 | 23699 | NM_012489 | q | Bile acid biosynthesis, Fatty acid biosynthesis (path 2), Fatty acid metabolism, Phenylalanine metabolism, Valine, leucine and isoleucine degradation |
| 1491 | 7062 | NM_012495 | q | Carbon fixation, Fructose and mannose metabolism, Glycolysis/ |

TABLE 2-continued

PATHWAYS

| Sequence ID No. | Identifier | GenBank Acc/ Ref. Seq. ID No. | Model Code | Pathways |
|---|---|---|---|---|
| 1492 | 15511 | NM_012498 | u | Gluconeogenesis, Inositol metabolism, Pentose phosphate cycle Fructose and mannose metabolism, Galactose metabolism, Glycerolipid metabolism, Pentose and glucuronate interconversions, Pyruvate metabolism |
| 1494 | 7427 | NM_012515 | General | |
| 1495 | 24433 | NM_012527 | i | |
| 1496 | 4467 | NM_012529 | d | Arginine and proline metabolism, Urea cycle and metabolism of amino groups |
| 1497 | 16520 | NM_012532 | General | Porphyrin and chlorophyll metabolism |
| 1498 | 225 | NM_012544 | x, z | |
| 1499 | 1431 | NM_012545 | General | Histidine metabolism, Phenylalanine metabolism, Tryptophan metabolism, Tyrosine metabolism |
| 1500 | 23868 | NM_012551 | l, m, v, General | |
| 1500 | 23872 | NM_012551 | l, v, cc, General | |
| 1500 | 23869 | NM_012551 | v, General | |
| 1501 | 19407 | NM_012554 | z | Glycolysis/Gluconeogenesis, Phenylalanine, tyrosine and tryptophan biosynthesis |
| 1501 | 19408 | NM_012554 | n, s, y, z | Glycolysis/Gluconeogenesis, Phenylalanine, tyrosine and tryptophan biosynthesis |
| 1502 | 21836 | NM_012555 | k | |
| 1503 | 16895 | NM_012558 | g, s | Carbon fixation, Fructose and mannose metabolism, Glycolysis/Gluconeogenesis, Pentose phosphate cycle |
| 1504 | 25317 | NM_012559 | bb | |
| 1504 | 6477 | NM_012559 | b, bb | |
| 1504 | 6478 | NM_012559 | bb | |
| 1505 | 11731 | NM_012561 | k | |
| 1507 | 4254 | NM_012564 | a | |
| 1508 | 16026 | NM_012578 | r | |
| 1508 | 16024 | NM_012578 | r | |
| 1508 | 16025 | NM_012578 | r | |
| 1509 | 16080 | NM_012580 | g, m | Porphyrin and chlorophyll metabolism |
| 1510 | 15098 | NM_012588 | bb | |
| 1511 | 4450 | NM_012592 | bb | Valine, leucine and isoleucine degradation |
| 1511 | 4451 | NM_012592 | i, bb | Valine, leucine and isoleucine degradation |
| 1511 | 4452 | NM_012592 | bb | Valine, leucine and isoleucine degradation |
| 1512 | 17198 | NM_012593 | a, x | |
| 1512 | 17197 | NM_012593 | x | |
| 1513 | 18749 | NM_012600 | a, h | Carbon fixation, Pyruvate metabolism |
| 1514 | 2628 | NM_012603 | General | |
| 1514 | 2629 | NM_012603 | x, General | |
| 1515 | 16849 | NM_012608 | n, o, q | |
| 1517 | 15540 | NM_012620 | General | |
| 1518 | 24568 | NM_012630 | General | |
| 1518 | 24566 | NM_012630 | General | |
| 1519 | 18553 | NM_012631 | k | |
| 1520 | 1844 | NM_012637 | General | |
| 1521 | 24668 | NM_012642 | f | |
| 1522 | 18632 | NM_012645 | a | |
| 1523 | 25435 | NM_012647 | g | |
| 1524 | 9423 | NM_012649 | b, cc | |
| 1525 | 24496 | NM_012654 | n | |
| 1526 | 7101 | NM_012679 | x, bb, General | |
| 1527 | 24707 | NM_012693 | i | Fatty acid metabolism, Tryptophan metabolism |
| 1528 | 1850 | NM_012696 | t | |
| 1528 | 1854 | NM_012696 | t | |
| 1529 | 1603 | NM_012697 | General | |
| 1530 | 1372 | NM_012734 | u | Aminosugars metabolism, Fructose and mannose metabolism, Galactose metabolism, Glycolysis/Gluconeogenesis, Starch and sucrose metabolism |
| 1531 | 1478 | NM_012744 | bb, General | Alanine and aspartate metabolism, Citrate cycle (TCA cycle), Pyruvate metabolism |
| 1532 | 343 | NM_012747 | h, t | |

TABLE 2-continued

PATHWAYS

| Sequence ID No. | Identifier | GenBank Acc/ Ref. Seq. ID No. | Model Code | Pathways |
|---|---|---|---|---|
| 1533 | 8829 | NM_012749 | General | |
| 1534 | 20828 | NM_012752 | General | |
| 1534 | 20829 | NM_012752 | i, General | |
| 1534 | 20830 | NM_012752 | i, General | |
| 1535 | 15174 | NM_012756 | b | |
| 1536 | 21685 | NM_012760 | j, m, n | |
| 1537 | 18068 | NM_012762 | t | |
| 1538 | 1246 | NM_012770 | a, General | Purine metabolism |
| 1539 | 1348 | NM_012776 | f | |
| 1540 | 18135 | NM_012791 | w | |
| 1541 | 16947 | NM_012793 | p, bb | Arginine and proline metabolism, Glycine, serine and threonine metabolism, Urea cycle and metabolism of amino groups |
| 1542 | 960 | NM_012796 | u | Glutathione metabolism |
| 1543 | 260 | NM_012798 | f, u | |
| 1544 | 556 | NM_012803 | d | |
| 1545 | 21729 | NM_012804 | q | |
| 1546 | 15032 | NM_012816 | General | |
| 1547 | 24895 | NM_012817 | General | |
| 1548 | 18109 | NM_012823 | u, General | |
| 1549 | 373 | NM_012833 | h, l, q, General | |
| 1550 | 2855 | NM_012838 | e | |
| 1551 | 11136 | NM_012839 | s | |
| 1552 | 20885 | NM_012842 | a | egf |
| 1552 | 20884 | NM_012842 | a, bb | egf |
| 1553 | 18770 | NM_012857 | e | |
| 1554 | 20674 | NM_012861 | i | |
| 1555 | 13151 | NM_012862 | a, r, General | |
| 1556 | 24617 | NM_012870 | General | |
| 1557 | 20945 | NM_012875 | a, v | |
| 1558 | 15872 | NM_012879 | o, r | |
| 1559 | 495 | NM_012880 | z | |
| 1559 | 494 | NM_012880 | c | |
| 1560 | 23651 | NM_012881 | d, u, General | |
| 1562 | 19477 | NM_012891 | q | |
| 1563 | 18564 | NM_012899 | v, General | Porphyrin and chlorophyll metabolism |
| 1564 | 7197 | NM_012904 | f, r, cc, General | |
| 1564 | 7196 | NM_012904 | v, cc, General | |
| 1565 | 20202 | NM_012909 | b, r | |
| 1566 | 16581 | NM_012911 | c, j | |
| 1566 | 16582 | NM_012911 | c | |
| 1567 | 24431 | NM_012912 | General | |
| 1568 | 18118 | NM_012913 | p | Oxidative phosphorylation |
| 1569 | 6108 | NM_012915 | n | |
| 1570 | 20757 | NM_012923 | c, i, aa | |
| 1570 | 20755 | NM_012923 | i | |
| 1571 | 2830 | NM_012925 | f | |
| 1571 | 2831 | NM_012925 | f | |
| 1572 | 1977 | NM_012930 | q | Fatty acid metabolism, Glycerolipid metabolism |
| 1573 | 18694 | NM_012931 | j, l, m, z | |
| 1574 | 13723 | NM_012935 | n | |
| 1575 | 9109 | NM_012939 | j, y, z | |
| 1575 | 19398 | NM_012939 | aa | |
| 1576 | 223 | NM_012945 | b, cc | |
| 1577 | 15058 | NM_012950 | cc | |
| 1579 | 19111 | NM_012963 | g | |
| 1580 | 19374 | NM_012964 | x | |
| 1581 | 2554 | NM_012967 | t | |
| 1581 | 2555 | NM_012967 | t, cc, General | |
| 1582 | 24528 | NM_012973 | c | |
| 1583 | 956 | NM_012976 | c | |
| 1584 | 16417 | NM_012991 | g | |
| 1585 | 17393 | NM_012992 | d | |
| 1586 | 23544 | NM_013013 | s | |
| 1587 | 1588 | NM_013026 | k | |
| 1588 | 17894 | NM_013027 | m | |
| 1589 | 18300 | NM_013030 | s, v, General | |
| 1589 | 18076 | NM_013030 | g, s, z | |
| 1589 | 18078 | NM_013030 | s | |
| 1589 | 18077 | NM_013030 | e, s, z | |
| 1591 | 730 | NM_013040 | w | |

TABLE 2-continued

PATHWAYS

| Sequence ID No. | Identifier | GenBank Acc/ Ref. Seq. ID No. | Model Code | Pathways |
|---|---|---|---|---|
| 1592 | 17401 | NM_013043 | i, o, General | |
| 1593 | 16684 | NM_013052 | General | |
| 1594 | 14421 | NM_013053 | u | |
| 1595 | 15254 | NM_013058 | k | |
| 1596 | 14997 | NM_013059 | s, z | Folate biosynthesis, Glycerolipid metabolism |
| 1596 | 14996 | NM_013059 | General | Folate biosynthesis, Glycerolipid metabolism |
| 1597 | 25676 | NM_013069 | aa | |
| 1597 | 16924 | NM_013069 | o | |
| 1598 | 24748 | NM_013070 | h, q | |
| 1599 | 1529 | NM_013082 | d, General | |
| 1600 | 1521 | NM_013091 | j, l, z, General | |
| 1601 | 1685 | NM_013096 | c, aa | |
| 1601 | 26150 | NM_013096 | c, i | |
| 1601 | 1688 | NM_013096 | p | |
| 1601 | 1689 | NM_013096 | c, p | |
| 1601 | 1684 | NM_013096 | c, s, aa | |
| 1602 | 20886 | NM_013097 | u, x, bb | |
| 1602 | 20887 | NM_013097 | u, x, bb | |
| 1603 | 1321 | NM_013098 | c | Galactose metabolism, Glycolysis/ Gluconeogenesis, Starch and sucrose metabolism |
| 1604 | 15296 | NM_013102 | l, m | |
| 1606 | 23709 | NM_013113 | o, s, z, aa | |
| 1606 | 23711 | NM_013113 | p | |
| 1606 | 23710 | NM_013113 | s | |
| 1607 | 1976 | NM_013118 | u | |
| 1609 | 870 | NM_013130 | h | |
| 1610 | 16650 | NM_013132 | u, General | |
| 1611 | 650 | NM_013134 | h | Sterol biosynthesis |
| 1611 | 651 | NM_013134 | h, j, l | Sterol biosynthesis |
| 1612 | 1712 | NM_013138 | General | |
| 1613 | 16982 | NM_013144 | o, v, General | |
| 1614 | 21683 | NM_013154 | t, cc, General | |
| 1614 | 21682 | NM_013154 | cc | |
| 1615 | 3431 | NM_013156 | b, g, n | |
| 1615 | 25567 | NM_013156 | v, General | |
| 1615 | 3430 | NM_013156 | General | |
| 1616 | 1309 | NM_013159 | w | |
| 1616 | 1310 | NM_013159 | w | |
| 1617 | 21723 | NM_013174 | w | |
| 1618 | 1314 | NM_013181 | m | |
| 1619 | 17357 | NM_013183 | p, bb, General | |
| 1620 | 1300 | NM_013190 | y | Fructose and mannose metabolism, Galactose metabolism, Glycolysis/ Gluconeogenesis, Pentose phosphate cycle |
| 1621 | 16448 | NM_013197 | c | Glycine, serine and threonine metabolism |
| 1622 | 20856 | NM_013200 | b | Fatty acid metabolism, Glycerolipid metabolism |
| 1623 | 397 | NM_013214 | f | |
| 1624 | 20864 | NM_013215 | g, n, y | |
| 1625 | 20728 | NM_013217 | v | |
| 1626 | 1396 | NM_013222 | j | |
| 1627 | 815 | NM_013224 | w | |
| 1628 | 18305 | NM_013226 | v | |
| 1629 | 21078 | NM_016986 | d | Fatty acid metabolism, Propanoate metabolism, Valine, leucine and isoleucine degradation, beta-Alanine metabolism |
| 1630 | 24649 | NM_016988 | v | Riboflavin metabolism |
| 1631 | 15239 | NM_016989 | q, w | |
| 1632 | 45 | NM_016996 | General | |
| 1633 | 20714 | NM_016999 | t | Fatty acid metabolism, Tryptophan metabolism |
| 1633 | 20713 | NM_016999 | t | Fatty acid metabolism, Tryptophan metabolism |
| 1633 | 20711 | NM_016999 | q, t | Fatty acid metabolism, Tryptophan metabolism |
| 1633 | 20715 | NM_016999 | q, t | Fatty acid metabolism, Tryptophan metabolism |
| 1634 | 1698 | NM_017000 | e, n, p, General | Sterol biosynthesis |
| 1635 | 1399 | NM_017006 | h, n, General | Glutathione metabolism, Pentose phosphate cycle |

TABLE 2-continued

PATHWAYS

| Sequence ID No. | Identifier | GenBank Acc/ Ref. Seq. ID No. | Model Code | Pathways |
|---|---|---|---|---|
| 1637 | 18989 | NM_017013 | n | Glutathione metabolism |
| 1638 | 21013 | NM_017014 | e, f | Glutathione metabolism |
| 1638 | 21015 | NM_017014 | e, General | Glutathione metabolism |
| 1639 | 11836 | NM_017023 | b | |
| 1639 | 5475 | NM_017023 | b | |
| 1639 | 25546 | NM_017023 | b, bb | |
| 1640 | 17807 | NM_017025 | i, General | Cysteine metabolism, Glycolysis/ Gluconeogenesis, Propanoate metabolism, Pyruvate metabolism |
| 1641 | 24597 | NM_017040 | u | |
| 1642 | 24696 | NM_017048 | f, j, z | |
| 1643 | 24695 | NM_017049 | u | |
| 1644 | 20876 | NM_017050 | j, n, z | |
| 1645 | 910 | NM_017059 | f, l, m | |
| 1645 | 912 | NM_017059 | i | |
| 1646 | 1946 | NM_017061 | h | |
| 1646 | 1942 | NM_017061 | t, General | |
| 1646 | 1943 | NM_017061 | t | |
| 1647 | 6062 | NM_017066 | d | |
| 1648 | 6654 | NM_017068 | w | |
| 1649 | 11153 | NM_017073 | s | Glutamate metabolism, Nitrogen metabolism |
| 1650 | 923 | NM_017076 | General | |
| 1651 | 1523 | NM_017079 | s | |
| 1652 | 23660 | NM_017080 | s | Androgen and estrogen metabolism, C21-Steroid hormone metabolism |
| 1653 | 275 | NM_017081 | b, d, General | Androgen and estrogen metabolism, C21-Steroid hormone metabolism |
| 1654 | 16211 | NM_017082 | j, s, z | |
| 1655 | 1552 | NM_017084 | j | Glycine, serine and threonine metabolism |
| 1655 | 1550 | NM_017084 | y | Glycine, serine and threonine metabolism |
| 1656 | 22552 | NM_017087 | a, k, x | |
| 1657 | 8888 | NM_017090 | m | Purine metabolism |
| 1658 | 10887 | NM_017094 | a, General | |
| 1659 | 4393 | NM_017101 | a, y | |
| 1660 | 24770 | NM_017111 | d | |
| 1661 | 20745 | NM_017113 | e | |
| 1661 | 20746 | NM_017113 | a | |
| 1662 | 1375 | NM_017122 | w | |
| 1663 | 12903 | NM_017124 | k | |
| 1664 | 24885 | NM_017138 | r | |
| 1664 | 24886 | NM_017138 | d, q | |
| 1665 | 15363 | NM_017147 | n, u | |
| 1666 | 13392 | NM_017148 | u, General | |
| 1667 | 5351 | NM_017150 | q | |
| 1668 | 16954 | NM_017151 | a, n | |
| 1669 | 21643 | NM_017152 | g | |
| 1670 | 1694 | NM_017153 | a, q | |
| 1671 | 17104 | NM_017160 | bb, General | |
| 1671 | 17106 | NM_017160 | u | |
| 1671 | 17107 | NM_017160 | d, e | |
| 1672 | 17686 | NM_017165 | n, q | Glutathione metabolism |
| 1673 | 20702 | NM_017166 | c | |
| 1674 | 3513 | NM_017177 | r | Glycerolipid metabolism |
| 1675 | 19031 | NM_017180 | v, General | |
| 1676 | 15437 | NM_017187 | x, z | |
| 1676 | 15433 | NM_017187 | y | |
| 1676 | 15434 | NM_017187 | x, z | |
| 1677 | 24437 | NM_017190 | p | |
| 1678 | 1542 | NM_017193 | j, l, m, z | |
| 1679 | 14695 | NM_017202 | q, s | Oxidative phosphorylation |
| 1679 | 14694 | NM_017202 | s, z | Oxidative phosphorylation |
| 1680 | 1428 | NM_017213 | m | |
| 1681 | 1622 | NM_017216 | g, j, s, z | |
| 1682 | 13642 | NM_017220 | v | |
| 1682 | 19976 | NM_017220 | w | |
| 1683 | 1510 | NM_017224 | General | |
| 1684 | 1811 | NM_017228 | j, l, m, z | |
| 1686 | 17563 | NM_017245 | a, c, e, q | |
| 1687 | 17502 | NM_017248 | r | |
| 1687 | 17501 | NM_017248 | x | |
| 1688 | 19 | NM_017258 | v, General | |
| 1689 | 15300 | NM_017259 | i, v, cc, General | |

TABLE 2-continued

PATHWAYS

| Sequence ID No. | Identifier | GenBank Acc/ Ref. Seq. ID No. | Model Code | Pathways |
|---|---|---|---|---|
| 1689 | 15301 | NM_017259 | l, m, v, aa, cc, General | |
| 1689 | 15299 | NM_017259 | l, y, cc, General | |
| 1690 | 15224 | NM_017264 | d | |
| 1691 | 3987 | NM_017280 | bb | Proteasome |
| 1692 | 1447 | NM_017281 | l | Proteasome |
| 1693 | 15535 | NM_017283 | s, bb | Proteasome |
| 1694 | 12349 | NM_017290 | General | Oxidative phosphorylation |
| 1695 | 15819 | NM_017298 | p | |
| 1696 | 23825 | NM_017299 | v | |
| 1696 | 23826 | NM_017299 | v | |
| 1697 | 14003 | NM_017305 | j, l, m, y, z | Glutamate metabolism, Glutathione metabolism |
| 1698 | 26109 | NM_017306 | q, s | |
| 1698 | 18687 | NM_017306 | q, t | Fatty acid metabolism |
| 1699 | 18142 | NM_017314 | g, s, aa | |
| 1700 | 1894 | NM_017320 | t | |
| 1701 | 20809 | NM_017326 | u | |
| 1702 | 355 | NM_017334 | cc | |
| 1703 | 16148 | NM_017340 | q, s | Fatty acid metabolism |
| 1703 | 16150 | NM_017340 | a | Fatty acid metabolism |
| 1704 | 20849 | NM_017343 | r, u, General | |
| 1704 | 20848 | NM_017343 | b, General | |
| 1705 | 606 | NM_017350 | b | |
| 1706 | 1581 | NM_017365 | General | |
| 1707 | 455 | NM_019131 | x | |
| 1707 | 456 | NM_019131 | y, z | |
| 1708 | 4532 | NM_019134 | b | |
| 1709 | 1608 | NM_019166 | j, y, z | |
| 1710 | 7489 | NM_019169 | c, General | |
| 1711 | 17066 | NM_019170 | p | Prostaglandin and leukotriene metabolism |
| 1712 | 23924 | NM_019174 | bb | Nitrogen metabolism |
| 1713 | 24019 | NM_019186 | t | |
| 1714 | 22063 | NM_019195 | d | |
| 1715 | 2079 | NM_019220 | j, k, z | |
| 1716 | 16284 | NM_019229 | l, m | |
| 1717 | 985 | NM_019233 | b, cc | |
| 1718 | 15503 | NM_019237 | k, x | |
| 1718 | 15504 | NM_019237 | k, x | |
| 1719 | 17908 | NM_019242 | l, v, cc, General | |
| 1720 | 11218 | NM_019247 | c | |
| 1721 | 15259 | NM_019259 | d, f | |
| 1722 | 21443 | NM_019262 | aa, General | |
| 1722 | 21444 | NM_019262 | t, General | |
| 1723 | 117 | NM_019266 | o, bb | |
| 1724 | 1145 | NM_019280 | w | |
| 1725 | 22220 | NM_019286 | c | Bile acid biosynthesis, Fatty acid metabolism, Glycerolipid metabolism, Glycolysis/ Gluconeogenesis, Tyrosine metabolism |
| 1726 | 10015 | NM_019289 | l, m, t, x, General | |
| 1726 | 10016 | NM_019289 | bb, General | |
| 1727 | 21651 | NM_019296 | c, f, x | |
| 1728 | 20751 | NM_019301 | s | |
| 1729 | 645 | NM_019345 | bb | |
| 1730 | 1301 | NM_019349 | c | |
| 1731 | 3776 | NM_019354 | a, u | |
| 1732 | 4592 | NM_019356 | General | |
| 1733 | 1324 | NM_019371 | w | |
| 1734 | 19577 | NM_019377 | e | |
| 1735 | 24626 | NM_019381 | s | |
| 1736 | 744 | NM_019622 | p | |
| 1737 | 20716 | NM_019623 | c | Fatty acid metabolism, Tryptophan metabolism |
| 1738 | 20709 | NM_019904 | x | |
| 1739 | 574 | NM_019905 | u, General | Glyoxylate and dicarboxylate metabolism |
| 1740 | 9096 | NM_019908 | j | |
| 1741 | 20457 | NM_020073 | i, General | |
| 1741 | 20458 | NM_020073 | General | |
| 1741 | 20460 | NM_020073 | General | |
| 1742 | 18713 | NM_020075 | r | |
| 1742 | 18715 | NM_020075 | r | |

TABLE 2-continued

PATHWAYS

| Sequence ID No. | Identifier | GenBank Acc/ Ref. Seq. ID No. | Model Code | Pathways |
|---|---|---|---|---|
| 1743 | 20493 | NM_020076 | p | Tryptophan metabolism |
| 1744 | 16375 | NM_020976 | g | |
| 1745 | 20816 | NM_021261 | k, General | |
| 1746 | 15335 | NM_021264 | a | |
| 1747 | 18729 | NM_021578 | k, z | |
| 1748 | 19060 | NM_021587 | cc | |
| 1749 | 17324 | NM_021593 | o, General | |
| 1750 | 19679 | NM_021653 | General | |
| 1750 | 19678 | NM_021653 | a, v, General | |
| 1751 | 19665 | NM_021688 | u, General | |
| 1752 | 19667 | NM_021690 | m | |
| 1754 | 22916 | NM_021740 | a | |
| 1755 | 19710 | NM_021744 | t | |
| 1755 | 19711 | NM_021744 | t | |
| 1756 | 19712 | NM_021745 | r | |
| 1757 | 1962 | NM_021750 | j, k, y, z | |
| 1757 | 19824 | NM_021750 | a, bb | Taurine and hypotaurine metabolism |
| 1758 | 25198 | NM_021754 | h | |
| 1758 | 20035 | NM_021754 | b, n, s, v, General | |
| 1759 | 20090 | NM_021757 | m | |
| 1760 | 17885 | NM_021765 | aa | |
| 1762 | 20161 | NM_021836 | cc, General | |
| 1764 | 1203 | NM_021997 | k, z | |
| 1765 | 23151 | NM_022005 | b | |
| 1767 | 17101 | NM_022179 | bb | Aminosugars metabolism, Fructose and mannose metabolism, Galactose metabolism, Glycolysis/ Gluconeogenesis, Starch and sucrose metabolism |
| 1767 | 17100 | NM_022179 | bb | Aminosugars metabolism, Fructose and mannose metabolism, Galactose metabolism, Glycolysis/ Gluconeogenesis, Starch and sucrose metabolism |
| 1768 | 20257 | NM_022180 | w, General | |
| 1768 | 25699 | NM_022180 | i | |
| 1768 | 10860 | NM_022180 | p | |
| 1769 | 23780 | NM_022183 | k, x | |
| 1770 | 20312 | NM_022224 | o | |
| 1771 | 6585 | NM_022266 | d, p, cc | |
| 1772 | 17161 | NM_022298 | i, v, cc, General | |
| 1772 | 17162 | NM_022298 | u | |
| 1772 | 17160 | NM_022298 | u | |
| 1772 | 17158 | NM_022298 | q | |
| 1773 | 11454 | NM_022381 | i, aa, General | |
| 1773 | 11455 | NM_022381 | l, General | |
| 1774 | 13480 | NM_022390 | s | Folate biosynthesis |
| 1775 | 15184 | NM_022391 | z | |
| 1776 | 22413 | NM_022392 | h | |
| 1776 | 22414 | NM_022392 | n | |
| 1777 | 22499 | NM_022393 | t | |
| 1779 | 24537 | NM_022399 | e | |
| 1779 | 24539 | NM_022399 | y | |
| 1780 | 1141 | NM_022401 | o, General | |
| 1781 | 1069 | NM_022402 | g | |
| 1782 | 8211 | NM_022500 | j, n, s | |
| 1782 | 8212 | NM_022500 | n, s | |
| 1783 | 6815 | NM_022503 | s | Oxidative phosphorylation |
| 1784 | 4259 | NM_022504 | q, w | |
| 1785 | 1611 | NM_022509 | j | |
| 1786 | 2236 | NM_022512 | y, z | Butanoate metabolism, Fatty acid metabolism, Valine, leucine and isoleucine degradation |
| 1787 | 3026 | NM_022514 | a | |
| 1787 | 3027 | NM_022514 | a, q, r, aa | |
| 1788 | 2696 | NM_022515 | a, d | |
| 1788 | 2697 | NM_022515 | n, w, aa | |
| 1789 | 3900 | NM_022516 | h | |
| 1790 | 4151 | NM_022518 | o | |
| 1791 | 4242 | NM_022521 | c | Arginine and proline metabolism, Urea cycle and metabolism of amino groups |
| 1792 | 4412 | NM_022523 | o | |

TABLE 2-continued

PATHWAYS

| Sequence ID No. | Identifier | GenBank Acc/ Ref. Seq. ID No. | Model Code | Pathways |
|---|---|---|---|---|
| 1793 | 6641 | NM_022533 | General | |
| 1794 | 8097 | NM_022536 | a | |
| 1795 | 8597 | NM_022538 | c, r, u | |
| 1795 | 8598 | NM_022538 | u | |
| 1796 | 9296 | NM_022541 | o | |
| 1797 | 21063 | NM_022585 | h | |
| 1799 | 20781 | NM_022591 | z | |
| 1800 | 20803 | NM_022592 | n | Carbon fixation, Pentose phosphate cycle |
| 1801 | 20925 | NM_022594 | q | |
| 1802 | 20944 | NM_022597 | aa | |
| 1803 | 21024 | NM_022599 | o, General | |
| 1804 | 2250 | NM_022643 | General | |
| 1805 | 17567 | NM_022672 | a, y | |
| 1806 | 17661 | NM_022674 | bb | |
| 1807 | 24563 | NM_022676 | b | |
| 1807 | 24564 | NM_022676 | b, x | |
| 1808 | 20506 | NM_022686 | l | |
| 1809 | 20508 | NM_022688 | g | |
| 1810 | 17586 | NM_022694 | k | |
| 1811 | 17730 | NM_022697 | a | |
| 1811 | 17729 | NM_022697 | q | |
| 1812 | 154 | NM_022849 | t | |
| 1813 | 127 | NM_022855 | h | |
| 1814 | 152 | NM_022858 | j | |
| 1816 | 18101 | NM_022948 | z | |
| 1816 | 18103 | NM_022948 | u | |
| 1817 | 21491 | NM_022951 | w | |
| 1818 | 15742 | NM_022958 | y | |
| 1819 | 9286 | NM_023027 | t, w | |
| 1820 | 23215 | NM_023102 | z | |
| 1821 | 21238 | NM_024125 | cc, General | il6, interact6-1 |
| 1821 | 21239 | NM_024125 | cc, General | il6, interact6-1 |
| 1822 | 353 | NM_024127 | i, n, General | |
| 1822 | 354 | NM_024127 | i, n, General | |
| 1822 | 352 | NM_024127 | h, General | |
| 1823 | 17227 | NM_024131 | x | |
| 1824 | 1598 | NM_024134 | l | |
| 1825 | 1162 | NM_024153 | d | Porphyrin and chlorophyll metabolism |
| 1826 | 7863 | NM_024156 | c | Oxidative phosphorylation, Type III protein secretion system |
| 1827 | 22079 | NM_024157 | x | |
| 1828 | 16476 | NM_024162 | General | |
| 1829 | 17765 | NM_024351 | b, s, v | |
| 1830 | 8879 | NM_024360 | h | |
| 1831 | 20772 | NM_024363 | x | |
| 1832 | 2812 | NM_024386 | c | Butanoate metabolism, Synthesis and degradation of ketone bodies, Valine, leucine and isoleucine degradation |
| 1833 | 335 | NM_024387 | j, y | Porphyrin and chlorophyll metabolism |
| 1834 | 21 | NM_024388 | cc | |
| 1834 | 22 | NM_024388 | cc | |
| 1836 | 9929 | NM_024392 | f | Androgen and estrogen metabolism |
| 1837 | 3582 | NM_024396 | aa | |
| 1838 | 19993 | NM_024398 | e, p, s, aa | |
| 1839 | 10789 | NM_024399 | o | |
| 1840 | 22626 | NM_024400 | cc, General | |
| 1841 | 13633 | NM_024403 | g, General | |
| 1841 | 13634 | NM_024403 | g, General | |
| 1842 | 23387 | NM_024404 | b, General | |
| 1843 | 21038 | NM_024484 | h | Glycine, serine and threonine metabolism |
| 1844 | 1853 | NM_030826 | s | Glutathione metabolism |
| 1845 | 15111 | NM_030827 | e, General | |
| 1845 | 15112 | NM_030827 | y, z | |
| 1845 | 15110 | NM_030827 | General | |
| 1846 | 808 | NM_030837 | k, m | |
| 1847 | 4057 | NM_030844 | k | |
| 1848 | 1221 | NM_030845 | t | |
| 1849 | 21509 | NM_030847 | x | |
| 1850 | 1928 | NM_030872 | v | |
| 1851 | 17342 | NM_030873 | u | |
| 1852 | 24648 | NM_030985 | u | |
| 1852 | 25453 | NM_030985 | General | |

TABLE 2-continued

PATHWAYS

| Sequence ID No. | Identifier | GenBank Acc/ Ref. Seq. ID No. | Model Code | Pathways |
|---|---|---|---|---|
| 1853 | 21802 | NM_030987 | h | |
| 1854 | 23109 | NM_031000 | f, s, z | Glycerolipid metabolism, Glycolysis/ Gluconeogenesis, Pentose and glucuronate interconversions |
| 1855 | 134 | NM_031003 | a, u | |
| 1856 | 25461 | NM_031009 | o | |
| 1857 | 1845 | NM_031010 | t | Prostaglandin and leukotriene metabolism |
| 1857 | 25517 | NM_031010 | c, t | Prostaglandin and leukotriene metabolism |
| 1858 | 16562 | NM_031020 | f | |
| 1859 | 1480 | NM_031021 | f | |
| 1860 | 1719 | NM_031024 | n | |
| 1861 | 1350 | NM_031030 | h | |
| 1862 | 16775 | NM_031031 | General | Arginine and proline metabolism, Glycine, serine and threonine metabolism, Urea cycle and metabolism of amino groups |
| 1863 | 691 | NM_031034 | w | |
| 1864 | 15886 | NM_031035 | z | |
| 1866 | 3608 | NM_031044 | k, General | Histidine metabolism |
| 1866 | 3610 | NM_031044 | d, General | Histidine metabolism |
| 1867 | 15137 | NM_031051 | s | |
| 1868 | 514 | NM_031056 | General | |
| 1869 | 17269 | NM_031057 | General | Inositol metabolism, Propanoate metabolism, Valine, leucine and isoleucine degradation |
| 1870 | 11849 | NM_031065 | a | |
| 1871 | 1855 | NM_031074 | h | |
| 1872 | 4683 | NM_031083 | d | |
| 1873 | 15202 | NM_031093 | a | |
| 1873 | 15201 | NM_031093 | a, n | |
| 1874 | 12639 | NM_031099 | aa | |
| 1875 | 20812 | NM_031100 | a | |
| 1876 | 16938 | NM_031103 | w | |
| 1877 | 19268 | NM_031104 | q | |
| 1878 | 16929 | NM_031108 | q | |
| 1879 | 10878 | NM_031110 | q, bb | |
| 1880 | 19162 | NM_031111 | aa | |
| 1880 | 19161 | NM_031111 | a, bb | |
| 1881 | 24615 | NM_031112 | a, y | |
| 1882 | 20839 | NM_031113 | a, q | |
| 1883 | 19040 | NM_031114 | l, m, General | |
| 1884 | 16349 | NM_031115 | u | |
| 1885 | 14970 | NM_031127 | General | |
| 1886 | 1814 | NM_031134 | n, q | |
| 1887 | 13359 | NM_031135 | General | |
| 1888 | 15052 | NM_031136 | a | |
| 1888 | 19359 | NM_031136 | a | |
| 1889 | 15185 | NM_031140 | General | |
| 1890 | 21625 | NM_031144 | a, e | |
| 1891 | 238 | NM_031152 | bb | |
| 1891 | 240 | NM_031152 | bb | |
| 1892 | 15277 | NM_031237 | g | |
| 1893 | 18083 | NM_031315 | q | |
| 1893 | 1858 | NM_031315 | q | |
| 1894 | 15663 | NM_031318 | General | |
| 1895 | 1422 | NM_031324 | bb, General | |
| 1896 | 18597 | NM_031325 | g, bb | Nucleotide sugars metabolism, Pentose and glucuronate interconversions, Starch and sucrose metabolism |
| 1897 | 11259 | NM_031327 | i, cc, General | |
| 1898 | 4235 | NM_031330 | General | |
| 1899 | 18375 | NM_031331 | l, m | |
| 1900 | 3519 | NM_031334 | cc | |
| 1901 | 20698 | NM_031357 | b | |
| 1903 | 634 | NM_031509 | n | Glutathione metabolism |
| 1903 | 25525 | NM_031509 | n | Glutathione metabolism |
| 1903 | 25069 | NM_031509 | b, n, w | |
| 1903 | 635 | NM_031509 | z | Glutathione metabolism |
| 1904 | 848 | NM_031517 | t | |
| 1905 | 1872 | NM_031523 | a | |
| 1905 | 16245 | NM_031523 | a, d, u | |
| 1905 | 16244 | NM_031523 | a | |
| 1906 | 9370 | NM_031527 | w | |

TABLE 2-continued

PATHWAYS

| Sequence ID No. | Identifier | GenBank Acc/ Ref. Seq. ID No. | Model Code | Pathways |
|---|---|---|---|---|
| 1907 | 20448 | NM_031530 | General | |
| 1907 | 20449 | NM_031530 | General | |
| 1908 | 14633 | NM_031533 | u | Androgen and estrogen metabolism, Pentose and glucuronate interconversions, Porphyrin and chlorophyll metabolism, Starch and sucrose metabolism |
| 1909 | 16048 | NM_031541 | f | |
| 1910 | 4011 | NM_031543 | c, q | Fatty acid metabolism, Tryptophan metabolism |
| 1910 | 4010 | NM_031543 | c, q | Fatty acid metabolism, Tryptophan metabolism |
| 1910 | 4012 | NM_031543 | q | Fatty acid metabolism, Tryptophan metabolism |
| 1911 | 28 | NM_031546 | General | |
| 1912 | 24640 | NM_031548 | h, cc | |
| 1913 | 17149 | NM_031549 | x | |
| 1913 | 17151 | NM_031549 | x | |
| 1914 | 13105 | NM_031552 | w | |
| 1915 | 15411 | NM_031559 | d, r | Fatty acid metabolism, Glycerolipid metabolism |
| 1916 | 16164 | NM_031563 | a, y | |
| 1917 | 9621 | NM_031570 | bb | |
| 1917 | 9620 | NM_031570 | w, bb | |
| 1918 | 546 | NM_031573 | f | |
| 1919 | 1921 | NM_031576 | f | |
| 1919 | 1920 | NM_031576 | r | |
| 1920 | 24219 | NM_031579 | i, General | |
| 1921 | 770 | NM_031584 | k, x | |
| 1922 | 18008 | NM_031588 | cc | |
| 1922 | 18005 | NM_031588 | h | |
| 1922 | 18011 | NM_031588 | cc, General | |
| 1923 | 1584 | NM_031595 | k | |
| 1924 | 24235 | NM_031614 | v | Pyrimidine metabolism |
| 1924 | 24234 | NM_031614 | General | Pyrimidine metabolism |
| 1925 | 1639 | NM_031627 | j, l, v | |
| 1926 | 1727 | NM_031642 | m, General | |
| 1927 | 20766 | NM_031643 | y | |
| 1929 | 1993 | NM_031655 | k, l, m, General | |
| 1930 | 2057 | NM_031660 | e | |
| 1931 | 15039 | NM_031672 | k, General | |
| 1932 | 15175 | NM_031682 | bb | Butanoate metabolism, Fatty acid biosynthesis (path 2), Fatty acid metabolism, Lysine degradation, Tryptophan metabolism, Valine, leucine and isoleucine degradation |
| 1933 | 1004 | NM_031685 | v | |
| 1934 | 19727 | NM_031687 | a, q, s | |
| 1935 | 20404 | NM_031700 | j, r, y | |
| 1935 | 20405 | NM_031700 | o, r | |
| 1936 | 811 | NM_031705 | General | Pantothenate and CoA biosynthesis, Pyrimidine metabolism, beta-Alanine metabolism |
| 1936 | 812 | NM_031705 | o, v, bb, General | Pantothenate and CoA biosynthesis, Pyrimidine metabolism, beta-Alanine metabolism |
| 1937 | 16204 | NM_031706 | q, bb | |
| 1937 | 16205 | NM_031706 | a, y | |
| 1938 | 24081 | NM_031708 | m | |
| 1939 | 16918 | NM_031709 | a, q | |
| 1940 | 1081 | NM_031712 | General | |
| 1941 | 1340 | NM_031715 | b, n, ucc, General | Fructose and mannose metabolism, Galactose metabolism, Glycolysis/ Gluconeogenesis, Pentose phosphate cycle |
| 1942 | 23884 | NM_031731 | j, s | Arginine and proline metabolism, Ascorbate and aldarate metabolism, Bile acid biosynthesis, Butanoate metabolism, Fatty acid metabolism, Glycerolipid metabolism, Histidine metabolism, Lysine degradation, Propanoate metabolism, Pyruvate metabolism, Tryptophan metabolism, Valine, |

TABLE 2-continued

Atty. Docket No. 44921-5089US
Doc. No. 1803440.1

PATHWAYS

| Sequence ID No. | Identifier | GenBank Acc/ Ref. Seq. ID No. | Model Code | Pathways |
|---|---|---|---|---|
| | | | | leucine and isoleucine degradation, beta-Alanine metabolism |
| 1943 | 10241 | NM_031740 | d | |
| 1944 | 1214 | NM_031741 | r | |
| 1944 | 1215 | NM_031741 | r | |
| 1945 | 20724 | NM_031753 | h | |
| 1946 | 20753 | NM_031763 | h | |
| 1946 | 20752 | NM_031763 | y | |
| 1947 | 14953 | NM_031774 | p | |
| 1948 | 14184 | NM_031776 | t, General | Purine metabolism |
| 1948 | 14185 | NM_031776 | d, o, t, General | Purine metabolism |
| 1949 | 1169 | NM_031789 | c | |
| 1950 | 16155 | NM_031810 | d, z | |
| 1950 | 16156 | NM_031810 | d | |
| 1951 | 17194 | NM_031814 | z | |
| 1952 | 17535 | NM_031816 | bb | |
| 1953 | 2655 | NM_031821 | i, l, m, aa | |
| 1954 | 10167 | NM_031830 | i | |
| 1955 | 22321 | NM_031832 | o, t, u, General | |
| 1956 | 4748 | NM_031834 | e, t | |
| 1956 | 4749 | NM_031834 | e, t | |
| 1957 | 7914 | NM_031835 | e | Alanine and aspartate metabolism, Glycine, serine and threonine metabolism |
| 1958 | 8385 | NM_031836 | h | |
| 1958 | 8384 | NM_031836 | h | |
| 1959 | 10268 | NM_031838 | a | |
| 1959 | 10269 | NM_031838 | aa | |
| 1959 | 10267 | NM_031838 | n, aa | |
| 1960 | 15077 | NM_031841 | b | |
| 1961 | 16726 | NM_031855 | x | Fructose and mannose metabolism |
| 1962 | 25802 | NM_031969 | a | |
| 1962 | 19191 | NM_031969 | c | |
| 1962 | 19195 | NM_031969 | r | |
| 1962 | 19190 | NM_031969 | p | |
| 1963 | 17734 | NM_031970 | v, General | |
| 1964 | 1475 | NM_031971 | v | |
| 1965 | 15470 | NM_031978 | f | |
| 1966 | 18502 | NM_031984 | c | |
| 1967 | 19768 | NM_031986 | v, aa, General | |
| 1968 | 723 | NM_032084 | n | |
| 1969 | 17935 | NM_032615 | a | |
| 1970 | 16831 | NM_033095 | n | |
| 1971 | 25468 | NM_033234 | c, z | |
| 1971 | 25469 | NM_033234 | c | |
| 1971 | 17832 | NM_033234 | c, p | |
| 1971 | 17829 | NM_033234 | c, z | |
| 1972 | 4723 | NM_033235 | z | |
| 1973 | 1409 | NM_033349 | p, General | Pyruvate metabolism |
| 1974 | 19998 | NM_033352 | General | |
| 1975 | 1410 | NM_052798 | d | |
| 1976 | 15028 | NM_052809 | f | Cysteine metabolism, Taurine and hypotaurine metabolism |
| 1977 | 5176 | NM_053297 | u | |
| 1978 | 7660 | NM_053299 | l | |
| 1979 | 5117 | NM_053310 | p | |
| 1981 | 17473 | NM_053319 | a, v | |
| 1982 | 25480 | NM_053329 | g | |
| 1982 | 21977 | NM_053329 | y | |
| 1983 | 14926 | NM_053330 | f | |
| 1983 | 14929 | NM_053330 | e, General | |
| 1984 | 16407 | NM_053332 | c, e | |
| 1985 | 15790 | NM_053341 | j, x | |
| 1986 | 6154 | NM_053356 | p | |
| 1987 | 9215 | NM_053374 | i | |
| 1988 | 6416 | NM_053380 | General | |
| 1989 | 19113 | NM_053395 | a | |
| 1990 | 2242 | NM_053433 | n, General | |
| 1991 | 5561 | NM_053438 | y | |
| 1992 | 14670 | NM_053439 | n, General | |
| 1993 | 17102 | NM_053440 | w | |
| 1994 | 24762 | NM_053442 | General | |
| 1995 | 8085 | NM_053453 | General | |

TABLE 2-continued

PATHWAYS

| Sequence ID No. | Identifier | GenBank Acc/ Ref. Seq. ID No. | Model Code | Pathways |
|---|---|---|---|---|
| 1996 | 4622 | NM_053463 | d | |
| 1997 | 21866 | NM_053472 | p | |
| 1998 | 9573 | NM_053475 | h | |
| 1999 | 16137 | NM_053480 | k | |
| 2000 | 15556 | NM_053483 | y | |
| 2001 | 16394 | NM_053485 | General | |
| 2002 | 4290 | NM_053487 | j, y | |
| 2004 | 18826 | NM_053523 | d | |
| 2005 | 7764 | NM_053525 | aa | |
| 2006 | 14199 | NM_053538 | c | |
| 2007 | 1058 | NM_053539 | c, d | |
| 2008 | 4327 | NM_053563 | General | |
| 2009 | 1342 | NM_053573 | h | |
| 2010 | 19254 | NM_053576 | h, s | Methane metabolism, Phenylalanine metabolism |
| 2010 | 19253 | NM_053576 | h | Methane metabolism, Phenylalanine metabolism |
| 2011 | 3049 | NM_053582 | p, cc, General | |
| 2011 | 3050 | NM_053582 | o, General | |
| 2012 | 21423 | NM_053586 | s, y | Oxidative phosphorylation |
| 2013 | 21445 | NM_053587 | t, v | |
| 2014 | 20871 | NM_053591 | j, l | |
| 2014 | 20870 | NM_053591 | l | |
| 2015 | 21044 | NM_053594 | d | |
| 2016 | 21709 | NM_053596 | k | |
| 2016 | 21708 | NM_053596 | z | |
| 2017 | 1597 | NM_053611 | t | |
| 2018 | 5565 | NM_053618 | General | |
| 2019 | 13004 | NM_053623 | t | Fatty acid metabolism |
| 2020 | 1127 | NM_053626 | g | Arginine and proline metabolism, D-Arginine and D-ornithine metabolism, Glycine, serine and threonine metabolism |
| 2021 | 18644 | NM_053648 | n | |
| 2022 | 21637 | NM_053653 | p | |
| 2023 | 3454 | NM_053662 | cc | |
| 2024 | 16121 | NM_053698 | h, j, z | |
| 2024 | 16122 | NM_053698 | h, j, z | |
| 2025 | 25379 | NM_053713 | General | |
| 2025 | 13622 | NM_053713 | General | |
| 2026 | 15376 | NM_053747 | h | |
| 2027 | 1218 | NM_053748 | b | |
| 2028 | 1137 | NM_053763 | y | |
| 2029 | 15996 | NM_053769 | cc | |
| 2030 | 8652 | NM_053774 | g | |
| 2031 | 14664 | NM_053806 | General | |
| 2032 | 4361 | NM_053812 | k | |
| 2034 | 15002 | NM_053819 | b, x, bb, General | |
| 2034 | 15003 | NM_053819 | b, l, x, bb, General | |
| 2035 | 16173 | NM_053822 | t | |
| 2036 | 17154 | NM_053835 | j, z | |
| 2037 | 20868 | NM_053843 | t | |
| 2037 | 20869 | NM_053843 | t | |
| 2040 | 714 | NM_053863 | y | |
| 2041 | 19781 | NM_053883 | b | |
| 2041 | 19780 | NM_053883 | b | |
| 2042 | 1454 | NM_053887 | General | |
| 2043 | 1660 | NM_053891 | g | |
| 2044 | 712 | NM_053896 | k | |
| 2045 | 753 | NM_053897 | k | |
| 2046 | 794 | NM_053902 | General | Tryptophan metabolism |
| 2047 | 17937 | NM_053911 | f | |
| 2048 | 8188 | NM_053927 | General | |
| 2050 | 1628 | NM_053936 | h | |
| 2051 | 13954 | NM_053955 | General | |
| 2052 | 408 | NM_053961 | General | |
| 2052 | 19991 | NM_053961 | a | |
| 2052 | 16190 | NM_053961 | q | |
| 2052 | 21355 | NM_053961 | j, l, y, z | |
| 2055 | 15136 | NM_053971 | aa | |
| 2055 | 15135 | NM_053971 | d | |
| 2056 | 1764 | NM_053974 | h | |

TABLE 2-continued

PATHWAYS

| Sequence ID No. | Identifier | GenBank Acc/ Ref. Seq. ID No. | Model Code | Pathways |
|---|---|---|---|---|
| 2057 | 1292 | NM_053980 | l | |
| 2058 | 15468 | NM_053982 | q | |
| 2059 | 15642 | NM_053985 | General | |
| 2060 | 21066 | NM_054001 | t | |
| 2061 | 17326 | NM_054008 | o | |
| 2061 | 17327 | NM_054008 | cc | |
| 2061 | 17329 | NM_054008 | g, o, cc | |
| 2062 | 25253 | NM_057099 | j, l, m, p, z | |
| 2062 | 22849 | NM_057099 | j, l | |
| 2063 | 19657 | NM_057103 | b, cc | |
| 2064 | 5492 | NM_057105 | w | Androgen and estrogen metabolism, Pentose and glucuronate interconversions, Porphyrin and chlorophyll metabolism, Starch and sucrose metabolism |
| 2064 | 15126 | NM_057105 | r | Androgen and estrogen metabolism, Pentose and glucuronate interconversions, Porphyrin and chlorophyll metabolism, Starch and sucrose metabolism |
| 2064 | 15125 | NM_057105 | s | Androgen and estrogen metabolism, Pentose and glucuronate interconversions, Porphyrin and chlorophyll metabolism, Starch and sucrose metabolism |
| 2066 | 15391 | NM_057114 | n | |
| 2067 | 727 | NM_057123 | m | |
| 2068 | 915 | NM_057124 | s | |
| 2069 | 15151 | NM_057131 | k | |
| 2070 | 1892 | NM_057144 | b | |
| 2071 | 12333 | NM_057155 | f | |
| 2071 | 12331 | NM_057155 | v, General | |
| 2071 | 12332 | NM_057155 | f, General | |
| 2072 | 17477 | NM_057194 | a, General | |
| 2073 | 15408 | NM_057197 | p, t | |
| 2073 | 15409 | NM_057197 | t | |
| 2074 | 7866 | NM_057198 | h | Glutamate metabolism, Purine metabolism |
| 2075 | 14125 | NM_057208 | h, j, y, z | |
| 2076 | 1743 | NM_057210 | k, s | |
| 2077 | 10498 | NM_078617 | a | |
| 2078 | 8820 | NM_080399 | n | |
| 2079 | 15701 | NM_080581 | j, m, y, z | |
| 2079 | 20105 | NM_080581 | aa | |
| 2080 | 16109 | NM_080585 | c | |
| 2081 | 1757 | NM_080766 | d | |
| 2082 | 7108 | NM_080778 | y | |
| 2083 | 132 | NM_080782 | k | |
| 2083 | 133 | NM_080782 | l | |
| 2084 | 20122 | NM_080887 | General | |
| 2085 | 6143 | NM_080892 | e | |
| 2086 | 9952 | NM_080902 | h | |
| 2087 | 17546 | NM_130401 | b | |
| 2088 | 21695 | NM_130411 | c, x | |
| 2089 | 21391 | NM_130416 | x, General | |
| 2090 | 20694 | NM_130430 | General | |
| 2090 | 19818 | NM_130430 | cc | |
| 2090 | 18810 | NM_130430 | e, s | |
| 2091 | 18293 | NM_130433 | q | Bile acid biosynthesis, Fatty acid biosynthesis (path 2), Fatty acid metabolism, Phenylalanine metabolism, Valine, leucine and isoleucine degradation |
| 2092 | 25064 | S45392 | a, n | |
| 2093 | 3244 | S63519 | u | |
| 2094 | 25501 | S63521 | q | |
| 2095 | 16248 | S68135 | h | |
| 2096 | 18647 | S69316 | q | |
| 2097 | 24351 | S74257 | v | |
| 2098 | 25066 | S75280 | d | |
| 2099 | 1460 | S76054 | j, l, m, x, y, General | |
| 2100 | 25539 | S76742 | v | |
| 2101 | 16400 | S76779 | c | |
| 2102 | 24469 | S77858 | n | |
| 2103 | 25545 | S77900 | k, s | |

TABLE 2-continued

PATHWAYS

| Sequence ID No. | Identifier | GenBank Acc/ Ref. Seq. ID No. | Model Code | Pathways |
|---|---|---|---|---|
| 2103 | 21583 | S77900 | k | |
| 2104 | 10260 | S81497 | s | |
| 2105 | 3609 | S82579 | k | Histidine metabolism |
| 2106 | 111 | U02506 | u | |
| 2107 | 14959 | U03390 | a, q, General | |
| 2109 | 2010 | U05675 | b, x, bb | |
| 2110 | 15462 | U06230 | d | |
| 2112 | 1583 | U07201 | s, General | |
| 2113 | 627 | U09229 | h | |
| 2114 | 809 | U17035 | General | |
| 2115 | 16675 | U17565 | k, x, bb | |
| 2116 | 25587 | U20110 | r | |
| 2117 | 90 | U20796 | r | |
| 2118 | 25589 | U21718 | h, aa | |
| 2119 | 22196 | U21719 | h | |
| 2120 | 17118 | U25746 | s | |
| 2121 | 1537 | U27518 | g, h, n | |
| 2122 | 1558 | U28504 | bb | |
| 2123 | 16193 | U30831 | n | |
| 2124 | 17480 | U31598 | z | |
| 2125 | 18302 | U33500 | General | |
| 2126 | 25599 | U34897 | y | |
| 2127 | 1394 | U37099 | h | |
| 2128 | 244 | U38376 | n | |
| 2129 | 1623 | U41164 | h | |
| 2130 | 15851 | U42719 | f, t, x, General | |
| 2131 | 17886 | U47315 | s, z | |
| 2132 | 21654 | U53184 | i, t, General | |
| 2133 | 1439 | U57391 | w | |
| 2134 | 725 | U62316 | bb | |
| 2137 | 2153 | U75404 | b, cc, General | |
| 2139 | 4956 | U76714 | j, y | |
| 2140 | 4477 | U77829 | l, m | |
| 2141 | 21703 | U82591 | z | |
| 2142 | 977 | U89744 | s | |
| 2143 | 23282 | U90725 | h | |
| 2144 | 22005 | U96490 | m | |
| 2146 | 819 | X02284 | j, z | Carbon fixation, Fructose and mannose metabolism, Glycolysis/Gluconeogenesis, Inositol metabolism, Pentose phosphate cycle |
| 2147 | 818 | X02291 | e, j, z | Carbon fixation, Fructose and mannose metabolism, Glycolysis/Gluconeogenesis, Inositol metabolism, Pentose phosphate cycle |
| 2148 | 20818 | X02904 | n, q | Glutathione metabolism |
| 2149 | 16401 | X04979 | c | |
| 2150 | 20513 | X05684 | o, r | Carbon fixation, Glycolysis/Gluconeogenesis, Purine metabolism, Pyruvate metabolism |
| 2151 | 25084 | X06769 | cc | |
| 2152 | 672 | X13722 | h | |
| 2153 | 25675 | X14181 | n | |
| 2153 | 20810 | X14181 | n, q, w | |
| 2154 | 18541 | X14671 | y | |
| 2155 | 25679 | X15013 | q | |
| 2155 | 19244 | X15013 | c, q, w | |
| 2156 | 15626 | X17665 | a | |
| 2157 | 1893 | X51529 | t | Glycerolipid metabolism, Phospholipid degradation, Prostaglandin and leukotriene metabolism |
| 2158 | 25686 | X51536 | bb | |
| 2158 | 10819 | X51536 | aa, bb | |
| 2159 | 18250 | X51706 | a, q, w | |
| 2160 | 20872 | X51707 | a | |
| 2161 | 516 | X52711 | c | |
| 2162 | 25689 | X52815 | g | |
| 2163 | 20427 | X53378 | w | |
| 2164 | 18606 | X53504 | General | |
| 2165 | 1463 | X54467 | d, u, General | |
| 2166 | 24577 | X55153 | a, v | |
| 2167 | 10344 | X57405 | j, m | |

TABLE 2-continued

Atty. Docket No. 44921-5089US
Doc. No. 1803440.1

PATHWAYS

| Sequence ID No. | Identifier | GenBank Acc/ Ref. Seq. ID No. | Model Code | Pathways |
|---|---|---|---|---|
| 2168 | 15106 | X57529 | g, n, q | |
| 2169 | 5667 | X58200 | q, bb | |
| 2169 | 18611 | X58200 | a, v | |
| 2170 | 17175 | X58389 | w | |
| 2171 | 25702 | X58465 | w | |
| 2171 | 10109 | X58465 | c, q | |
| 2172 | 25705 | X59375 | c, i, aa, General | |
| 2173 | 25709 | X59737 | u | |
| 2174 | 18354 | X59859 | General | |
| 2174 | 18355 | X59859 | t | |
| 2175 | 21657 | X61381 | General | |
| 2176 | 25718 | X62145 | bb, General | |
| 2176 | 15875 | X62145 | a, q, v | |
| 2177 | 13646 | X62166 | bb | |
| 2178 | 25721 | X62325 | p | |
| 2179 | 16012 | X62875 | m, s, z | |
| 2180 | 25730 | X63369 | cc | |
| 2181 | 25089 | X63594 | General | |
| 2181 | 25090 | X63594 | cc, General | |
| 2182 | 20844 | X65228 | n, w | |
| 2183 | 20879 | X65296 | j, y | |
| 2184 | 25736 | X68782 | c | |
| 2185 | 16426 | X70369 | c | |
| 2186 | 16300 | X70706 | u | |
| 2187 | 24232 | X75207 | c | |
| 2188 | 16272 | X76456 | n, p | |
| 2189 | 25741 | X76489 | u | |
| 2190 | 23302 | X78949 | h | |
| 2191 | 25747 | X81448 | General | |
| 2192 | 24115 | X81449 | u | |
| 2193 | 25754 | X89696 | g | |
| 2194 | 25097 | X90642 | y, z | |
| 2195 | 12978 | X96437 | cc, General | |
| 2197 | 4594 | Y07704 | c | |
| 2198 | 25777 | Y08355 | g, p, General | |
| 2199 | 15986 | Y09945 | bb, General | |
| 2200 | 20890 | Y13275 | k | |
| 2201 | 21914 | Y13336 | d | |
| 2202 | 406 | Z11995 | o, General | |
| 2203 | 18352 | Z12298 | t | |
| 2204 | 17481 | Z49761 | k | |
| 2205 | 8664 | Z75029 | r, v | |
| 2206 | 2459 | AA964755 | cc | |
| 2207 | 23830 | AA956638 | aa | |
| 2208 | 6100 | X73524 | x | |
| 2209 | 439 | Z22607 | w | |
| 2210 | 8665 | AI071965 | v | |
| 2211 | 155 | U32681 | t | |
| 2212 | 19252 | AA892041 | s | Methane metabolism, Phenylalanine metabolism |
| 2213 | 15582 | AI232320 | q | |
| 2214 | 17541 | M26125 | n | |
| 2215 | 18609 | M30689 | i | |
| 2216 | 6262 | AI177125 | g | |
| 2217 | 23859 | AI072161 | f | |
| 2218 | 21011 | H32189 | e | Glutathione metabolism |
| 2220 | 2572 | AI177143 | b | |
| 2221 | 25419 | M22922 | a | |

TABLE 3

Atty. Docket No. 44921-5089US
Doc. No. 1803440.1

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 1 | 6949 | AA012785 | q | | |
| 2 | 25098 | AA108277 | h, v | | |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 3 | 17312 | AA108308 | r | | EST, Moderately similar to A Chain A, Mdm2 Bound To The Transactivation Domain Of P53 {SUB 17-125 [*H. sapiens*], mouse double minute 2, human homolog of, p53-binding protein |
| 4 | 16882 | AA684537 | o | | NADH dehydrogenase (ubiquinone) 1 beta subcomplex, 5 (16 kD, SGDH) |
| 5 | 6049 | AA685178 | y | | EST, Weakly similar to T30827 nascent polypeptide-associated complex alpha chain, non-muscle splice form - mouse [*M. musculus*], FKSG17, *Homo sapiens* alpha-NAC gene for nascent polypeptide-associated complex component, KIAA0363 protein, expressed sequence AL022831, nascent-polypeptide-associated complex alpha polypeptide |
| 6 | 4426 | AA685974 | l, m | | |
| 7 | 21815 | AA686423 | g | | EST, Weakly similar to T46390 hypothetical protein DKFZp434C1920.1 [*H. sapiens*], hepatocellular carcinoma-associated antigen 59 |
| 8 | 1600 | AA686470 | i | DNA-damage inducible transcript 3, DNA-damage-inducible transcript 3 | DNA-damage inducible transcript 3, EST, Moderately similar to GA15__HUMAN GROWTH ARREST AND DNA-DAMAGE-INDUCIBLE PROTEIN GADD153 [*H. sapiens*], myozenin |
| 8 | 1599 | AA686470 | i | DNA-damage inducible transcript 3, DNA-damage-inducible transcript 3 | DNA-damage inducible transcript 3, EST, Moderately similar to GA15__HUMAN GROWTH ARREST AND DNA-DAMAGE-INDUCIBLE PROTEIN GADD153 [*H. sapiens*], myozenin |
| 9 | 21997 | AA799325 | u | | |
| 10 | 18396 | AA799330 | v | | |
| 11 | 6581 | AA799412 | f, l | | ESTs, Highly similar to ERR3__HUMAN ESTROGEN-RELATED RECEPTOR GAMMA [*H. sapiens*], Untitled, estrogen related receptor, alpha, estrogen related receptor, beta, estrogen-related receptor beta |
| 12 | 16538 | AA799449 | k | | ESTs, Moderately similar to NPL4__HUMAN NUCLEOSOME ASSEMBLY PROTEIN 1-LIKE 4 [*H. sapiens*], ESTs, Weakly similar to NPL4__HUMAN NUCLEOSOME ASSEMBLY PROTEIN 1-LIKE 4 [*H. sapiens*], SET translocation, nucleosome assembly protein 1-like 1, nucleosome assembly protein 1-like 4 |
| 13 | 23294 | AA799472 | u | | CGI-116 protein |
| 14 | 18290 | AA799497 | r | | |
| 15 | 18981 | AA799523 | e | | DAZ associated protein 1, ESTs, Highly similar to ROA1 RAT HETEROGENEOUS NUCLEAR RIBONUCLEOPROTEIN A1 [*R. norvegicus*], ESTs, Moderately similar to Up1, The Two Rna-Recognition Motif Domain Of Hnrnp A1 {SUB 3-184 [*H. sapiens*], ESTs, Weakly similar to ROA1 RAT HETEROGENEOUS NUCLEAR RIBONUCLEOPROTEIN A1 [*R. norvegicus*], ESTs, Weakly similar to ROA2 MOUSE HETEROGENEOUS NUCLEAR RIBONUCLEOPROTEINS A2/B1 [*M. musculus*], RIKEN cDNA 3010025E17 gene, Ras-GTPase activating protein SH3 domain-binding |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 16 | 20843 | AA799545 | h | | protein 2, Ras-GTPase-activating protein SH3-domain binding protein, cell death regulator aven, heterogeneous nuclear ribonucleoprotein A1, heterogeneous nuclear ribonucleoprotein A2/B1 EST, Moderately similar to A38983 TCP1 ring complex protein TRiC5 [*H. sapiens*], T-complex 1, chaperonin containing TCP1, subunit 3 (gamma), expressed sequence AI528772, t-complex 1, t-complex protein 1 |
| 17 | 16993 | AA799560 | b | | |
| 18 | 16576 | AA799570 | d | | |
| 19 | 18361 | AA799591 | i | | EST, Moderately similar to I38369 beta tubulin [*H. sapiens*], ESTs, Highly similar to I38370 beta-tubulin [*H. sapiens*], ESTs, Highly similar to T08726 tubulin beta chain [*H. sapiens*], ESTs, Highly similar to TBB1 RAT TUBULIN BETA CHAIN [*R. norvegicus*], ESTs, Moderately similar to I38370 beta-tubulin [*H. sapiens*], RIKEN cDNA 2410129E14 gene, RIKEN cDNA 4930447K03 gene, RIKEN cDNA 4930542G03 gene, Rat mRNA for beta tubulin T beta 15, beta tubulin 1, class VI, tubulin, beta 3, tubulin, beta, 2 |
| 20 | 17712 | AA799598 | z | | |
| 22 | 18346 | AA799718 | f | | |
| 23 | 8768 | AA799726 | l | | |
| 24 | 11687 | AA799732 | w | | DiGeorge syndrome chromosome region 6, DiGeorge syndrome critical region gene 6, DiGeorge syndrome critical region gene 6 like |
| 25 | 18349 | AA799744 | u | | |
| 26 | 17494 | AA799751 | n | | |
| 27 | 18360 | AA799771 | General | | |
| 28 | 18880 | AA799801 | w | | |
| 29 | 20998 | AA799803 | z | | EST, Moderately similar to MAS2_HUMAN MANNAN-BINDING LECTIN SERINE PROTEASE 2 PRECURSOR [*H. sapiens*], *Rattus norvegicus* mRNA for serine protease, complete cds, complement C1r-like proteinase precursor,, complement component 1, r subcomponent, complement component 1, s subcomponent, protein C |
| 30 | 21006 | AA799861 | c | | interferon regulatory factor 7 |
| 31 | 15011 | AA799893 | General | | ESTs, Moderately similar to Up1, The Two Rna-Recognition Motif Domain Of Hnrnp A1 {SUB 3-184 [*H. sapiens*], ESTs, Weakly similar to ROA1 RAT HETEROGENEOUS NUCLEAR RIBONUCLEOPROTEIN A1 [*R. norvegicus*], ESTs, Weakly similar to heterogeneous ribonuclear particle protein A1 [*H. sapiens*], Human DNA sequence from clone RP11-51N22 on chromosome 13 Contains ESTs, STSs and GSSs. Contains an HNRPA1 (heterogeneous nuclear ribonucleoprotein A1) pseudogene, RIKEN cDNA 4930547K05 gene, heterogeneous nuclear ribonucleoprotein A1 |
| 32 | 20811 | AA799899 | a | | EST, Moderately similar to RL1X_HUMAN 60S RIBOSOMAL PROTEIN L18A [*H. sapiens*], EST, Weakly similar to RL1X_HUMAN 60S RIBOSOMAL PROTEIN L18A |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| | | | | | [*H. sapiens*], EST, Weakly similar to S47353 ribosomal protein L18a, cytosolic [*H. sapiens*], ESTs, Highly similar to RL1X_HUMAN 60S RIBOSOMAL PROTEIN L18A [*H. sapiens*], RIKEN cDNA 2510019J09 gene, ribosomal protein L18a |
| 33 | 23202 | AA799971 | General | | |
| 34 | 4832 | AA800190 | b | | ESTs, Moderately similar to 1701409A glycogen phosphorylase [*H. sapiens*], ESTs, Weakly similar to 1701409A glycogen phosphorylase [*H. sapiens*], phosphorylase, glycogen; brain |
| 35 | 21656 | AA800202 | d | | |
| 36 | 18433 | AA800218 | j, y, z | | |
| 37 | 6386 | AA800235 | u | | |
| 38 | 18442 | AA800258 | h, k | | |
| 39 | 21092 | AA800380 | y | | DNA segment, Chr 14, University of California at Los Angeles 2, Hydroxysteroid dehydrogenase, 11 beta type 1, expressed sequence C79874, hydroxysteroid (11-beta) dehydrogenase 1, hydroxysteroid 11-beta dehydrogenase 1, hydroxysteroid 17-beta dehydrogenase 11, retinal short-chain dehydrogenase/reductase retSDR2 |
| 40 | 17325 | AA800587 | General | | ESTs, Highly similar to GSHG_MOUSE GLUTATHIONE PEROXIDASE-GASTROINTESTINAL (GSHPX-GI) [*M. musculus*], Glutathione peroxidase 1, glutathione peroxidase 1, glutathione peroxidase 2 (gastrointestinal) |
| 41 | 13930 | AA800613 | cc, General | | zinc finger protein 36, zinc finger protein homologous to Zfp-36 in mouse |
| 42 | 21372 | AA800693 | v | | |
| 42 | 21373 | AA800693 | s | | |
| 43 | 18161 | AA800701 | k | | |
| 44 | 6595 | AA800753 | w | | |
| 45 | 13348 | AA800928 | General | | |
| 46 | 23115 | AA801165 | o, y | | EST, Weakly similar to H2AL_HUMAN HISTONE H2A L (H2A/L) [*H. sapiens*], H2A histone family, member L, similar to H2A histone family, member A (*H. sapiens*) |
| 47 | 12399 | AA801307 | General | | |
| 48 | 7543 | AA801395 | General | | |
| 49 | 24237 | AA817726 | t, General | | |
| 50 | 11215 | AA817921 | o | | |
| 51 | 5985 | AA818005 | g | | |
| 52 | 11338 | AA818016 | x | | EST, Weakly similar to RB6K MOUSE RABKINESIN-6 [*M. musculus*], RAB6 interacting, kinesin-like (rabkinesin 6), RIKEN cDNA 3110001D19 gene, Rab6, kinesin-like |
| 53 | 2845 | AA818026 | k, General | | COP9 (constitutive photomorphogenic), subunit 6 (Arabidopsis), *Homo sapiens* cDNA FLJ14833 fis, clone OVARC1001171, moderately similar to *Homo sapiens* translation initiation factor 3 47 kDa subunit mRNA, IFP38, RIKEN cDNA 0610037M02 gene, eukaryotic translation initiation factor 3, subunit 5 (epsilon, 47 kD), hypothetical protein MGC13045, proteasome (prosome, macropain) 26S subunit, non-ATPase, 7 |
| 54 | 16756 | AA818089 | i, k, General | | glycyl-tRNA synthetase |
| 55 | 17771 | AA818224 | e, g, p, General | | EST, Weakly similar to S45140 tubulin beta chain [*H. sapiens*], RIKEN cDNA 2410129E14 gene, RIKEN cDNA |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| | | | | | 4930542G03 gene, tubulin, beta 2, tubulin, beta 5, tubulin, beta polypeptide, tubulin, beta, 2 |
| 56 | 6522 | AA818261 | g, m | | |
| 57 | 5924 | AA818359 | y | | |
| 58 | 7806 | AA818421 | b, aa | | |
| 59 | 8237 | AA818512 | v | | |
| 60 | 17434 | AA818574 | h | | |
| 61 | 8728 | AA818615 | General | | |
| 62 | 6054 | AA818658 | b, v, cc, General | diphtheria toxin receptor (heparin-binding epidermal growth factor-like growth factor), heparin binding epidermal growth factor-like growth factor | diphtheria toxin receptor (heparin-binding epidermal growth factor-like growth factor), expressed sequence AW047313, heparin binding epidermal growth factor-like growth factor |
| 63 | 11590 | AA818721 | d | | |
| 64 | 4291 | AA818741 | q, General | | |
| 65 | 4330 | AA818747 | o, General | | |
| 66 | 19723 | AA818761 | v, General | | |
| 67 | 13684 | AA818770 | h, j, l, m | | |
| 68 | 6322 | AA818801 | k | | |
| 69 | 7690 | AA818875 | General | | expressed sequence AV066530, guanylate cyclase activator 2B (uroguanylin), guanylate cyclase activator 2b (retina) |
| 70 | 4952 | AA818907 | q, General | | |
| 71 | 6094 | AA818911 | t | | |
| 72 | 10985 | AA818998 | o, General | | |
| 73 | 6120 | AA819008 | t | | |
| 74 | 2586 | AA819081 | c | | CocoaCrisp, ESTs, Weakly similar to JC5308 testis-specific, vespid, and pathogenesis-related protein 1 precursor [*H. sapiens*], *Homo sapiens*, Similar to RIKEN cDNA 1700011E04 gene, clone MGC: 26856 IMAGE: 4822995, mRNA, complete cds, RIKEN cDNA 1200009H11 gene, RIKEN cDNA 1700011E04 gene, RIKEN cDNA 4921508O11 gene, acidic epididymal glycoprotein-like 1, glioma pathogenesis-related protein, specific granule protein (28 kDa), testis specific gene 1, testis specific protein 1, testis specific protein 1 (probe H4-1 p3-1) |
| 76 | 6438 | AA819269 | o | | |
| 77 | 24721 | AA819306 | d, w | | |
| 78 | 6250 | AA819376 | o, y | | ESTs, Weakly similar to T17246 hypothetical protein DKFZp586M0617.1 [*H. sapiens*], KIAA0263 gene product, mammalian inositol hexakisphosphate kinase 2 |
| 80 | 6281 | AA819517 | j | | HYA22 protein, conserved gene amplified in osteosarcoma, nuclear LIM interactor-interacting factor |
| 81 | 10141 | AA819526 | j | | |
| 82 | 6551 | AA819558 | t | | |
| 83 | 6723 | AA819653 | r | | |
| 84 | 14958 | AA819744 | aa | | |
| 85 | 19433 | AA819776 | v | | ESTs, Highly similar to HS9B RAT HEAT SHOCK PROTEIN HSP 90-BETA [*R. norvegicus*], expressed sequence AL024080, expressed sequence C81438, heat shock 90 kD protein 1, beta, heat shock protein, 84 kDa 1 |
| 86 | 6204 | AA819889 | aa | | |
| 87 | 22820 | AA848315 | General | | GMPR2 for guanosine monophosphate reductase isolog, IMP (inosine monophosphate) dehydrogenase 2, RIKEN cDNA 2310004P21 gene, RIKEN cDNA 5730544D12 gene, expressed sequence AA959850, |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| | | | | | guanosine monophosphate reductase, inosine 5'-phosphate dehydrogenase 2 |
| 88 | 6614 | AA848389 | bb | | |
| 89 | 21125 | AA848437 | General | | |
| 90 | 23504 | AA848496 | q | | ESTs, Moderately similar to IF4B_HUMAN EUKARYOTIC TRANSLATION INITIATION FACTOR 4B [*H. sapiens*], eukaryotic translation initiation factor 4B |
| 91 | 18532 | AA848675 | g | | ESTs, Highly similar to FMO2_HUMAN DIMETHYLANILINE MONOOXYGENASE [*H. sapiens*], Flavin-containing monooxygenase 1, flavin containing monooxygenase 1, flavin containing monooxygenase 2, flavin containing monooxygenase 3, hypothetical protein PRO1257 |
| 92 | 21140 | AA848738 | c | | |
| 93 | 16128 | AA848807 | o | | |
| 94 | 22923 | AA848929 | g | | |
| 95 | 17339 | AA849497 | General | | |
| 96 | 11727 | AA849518 | l | | |
| 97 | 21275 | AA849796 | i, l, m, General | | |
| 98 | 16678 | AA849827 | aa | | |
| 99 | 8515 | AA849917 | e | | |
| 100 | 18447 | AA849939 | General | | |
| 101 | 12130 | AA850037 | p | | |
| 102 | 23981 | AA850040 | x, aa | | RIKEN cDNA 2810452G09 gene, adenylyl cyclase-associated CAP protein homolog 1 (*S. cerevisiae, S pombe*), adenylyl cyclase-associated protein |
| 103 | 13615 | AA850364 | t | | |
| 105 | 2637 | AA850893 | x | | DKFZP434O125 protein |
| 106 | 22093 | AA850909 | d | | |
| 107 | 21766 | AA850916 | c | | |
| 108 | 2847 | AA850919 | w | | ESTs, Highly similar to LB4D_HUMAN NADP-DEPENDENT LEUKOTRIENE B4 12-HYDROXYDEHYDROGENASE [*H. sapiens*], ESTs, Weakly similar to FAS RAT FATTY ACID SYNTHASE [*R. norvegicus*], ESTs, Weakly similar to LB4D_HUMAN NADP-DEPENDENT LEUKOTRIENE B4 12-HYDROXYDEHYDROGENASE [*H. sapiens*], crystallin, zeta, fatty acid synthase |
| 109 | 12162 | AA850975 | h | | |
| 110 | 9514 | AA850978 | General | | |
| 111 | 3924 | AA851017 | e, q | | |
| 111 | 3925 | AA851017 | o, General | | |
| 112 | 4490 | AA851184 | a, k | | cathepsin Z |
| 113 | 19187 | AA851230 | General | | |
| 114 | 19189 | AA851237 | c | | RIKEN cDNA 1110058H21 gene, ubiquitin specific protease 18 |
| 115 | 15386 | AA851241 | m | | breast cancer metastasis-suppressor 1, hypothetical protein MGC11296 |
| 116 | 21462 | AA851261 | g, l, General | | ART-4 protein |
| 117 | 21471 | AA851343 | General | | |
| 118 | 16902 | AA851379 | p | | NADH dehydrogenase (ubiquinone) Fe-S protein 8 (23 kD) (NADH-coenzyme Q reductase) |
| 119 | 23376 | AA851392 | i, x | | kinesin-like 4 |
| 119 | 23377 | AA851392 | x | | kinesin-like 4 |
| 120 | 13349 | AA851417 | General | | |
| 121 | 21527 | AA851733 | r, u | | |
| 122 | 4048 | AA851814 | i, o, u, General | | EST, Moderately similar to PM17 MOUSE MELANOCYTE PROTEIN PMEL 17 PRECURSOR [*M. musculus*], Homo sapiens, Similar to glycoprotein (transmembrane) nmb, clone MGC: 1696 IMAGE 3345861, mRNA, |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 123 | 10561 | AA851871 | bb | | complete cds, glycoprotein (transmembrane) nmb, silver signal sequence receptor, alpha (translocon-associated protein alpha) |
| 124 | 17411 | AA858621 | j, y | | ESTs, Weakly similar to A60021 tropomyosin-related protein, neuronal-rat [R. norvegicus], RIKEN cDNA 0710005K15 gene, expressed sequence R75279, reticulon 1, reticulon 3 |
| 125 | 1801 | AA858636 | k, s, x, bb | | expressed sequence AI747533, mini chromosome maintenance deficient 7 (S. cerevisiae), minichromosome maintenance deficient (S. cerevisiae) 7 |
| 126 | 18350 | AA858674 | p | | |
| 127 | 19484 | AA858693 | e | | |
| 128 | 6360 | AA858696 | d | | |
| 129 | 17334 | AA858704 | p | | exostoses (multiple) 1, exostoses (multiple)-like 1, expressed sequence AA409028 |
| 130 | 6380 | AA858758 | q | | |
| 131 | 13219 | AA858759 | a | | |
| 132 | 6384 | AA858788 | l, m, General | | |
| 134 | 13412 | AA858830 | p | | LanC (bacterial lantibiotic synthetase component C)-like, LanC (bacterial lantibiotic synthetase component C)-like 1, RIKEN cDNA 1700003F10 gene |
| 135 | 7279 | AA858892 | f | | |
| 136 | 18217 | AA858930 | t | | |
| 137 | 5867 | AA858953 | v, General | | asparaginyl-tRNA synthetase, hypothetical protein FLJ23441 |
| 138 | 14479 | AA858969 | r | | Interleukin 1 receptor accessory protein, Mus musculus IL-1Rrp2 mRNA, complete cds, interleukin 1 receptor accessory protein-like 2, interleukin 1 receptor, type I, interleukin 18 receptor 1 |
| 139 | 6431 | AA859085 | t | | |
| 140 | 17361 | AA859114 | o, General | | |
| 141 | 21025 | AA859241 | General | | EST, Highly similar to OM25_RAT MITOCHONDRIAL OUTER MEMBRANE PROTEIN 25 (NPW16) [R. norvegicus], EST, Weakly similar to OM25_RAT MITOCHONDRIAL OUTER MEMBRANE PROTEIN 25 (NPW16) [R. norvegicus], Erbb2 interacting protein, discs, large homolog 4 (Drosophila), expressed sequence AI118201, hypothetical protein FLJ11271, synaptojanin 2 binding protein |
| 142 | 10076 | AA859271 | c | | |
| 143 | 21791 | AA859333 | k | | EST, Moderately similar to CYSR RAT CYSTEINE-RICH PROTEIN 1 [R. norvegicus], ESTs, Weakly similar to S12658 cysteine-rich protein [H. sapiens], cysteine and glycine-rich protein 1, cysteine and glycine-rich protein 3 (cardiac LIM protein), cysteine rich protein, cysteine-rich protein 2, cysteine-rich protein 3, thymus LIM protein |
| 144 | 16314 | AA859348 | cc, General | | |
| 145 | 18862 | AA859520 | f | | |
| 146 | 15059 | AA859545 | r | | |
| 147 | 19894 | AA859581 | s | | EST, Highly similar to SPERM-COATING GLYCOPROTEIN PRECURSOR [R. norvegicus], ESTs, Weakly similar to JC4131 glioma pathogenesis-related protein [H. sapiens], Human DNA sequence from clone RP5-881L22 on chromosome 20 Contains ESTs, |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| | | | | | GSSs, STSs and CpG islands. Contains a gene for a novel protein similar to a trypsin inhibitor and four other genes for novel proteins, RIKEN cDNA 1810049K24 gene, RIKEN cDNA 2410114O14 gene, RIKEN cDNA 9230112K08 gene, acidic epididymal glycoprotein 1, acidic epididymal glycoprotein 2, epididymal glycoprotein, glioma pathogenesis-related protein |
| 148 | 14353 | AA859585 | h | | |
| 149 | 16318 | AA859648 | h | | DnaJ (Hsp40) homolog, subfamily B, member 1, DnaJ (Hsp40) homolog, subfamily B, member 5, DnaJ (Hsp40) homolog, subfamily B, member 6, DnaJ (Hsp40) homolog, subfamily B, member 8, ESTs, Weakly similar to DnaJ-like protein [*M. musculus*], ESTs, Weakly similar to HS44 MOUSE HEAT SHOCK 40 KDA PROTEIN 4 [*R. norvegicus*], *Homo sapiens* cDNA FLJ13992 fis, clone Y79AA1002139, weakly similar to DNAJ PROTEIN HOMOLOG 1, RIKEN cDNA 1700029A20 gene, RIKEN cDNA 2010306G19 gene |
| 150 | 17316 | AA859652 | General | | |
| 151 | 19067 | AA859663 | n, q | | |
| 152 | 22406 | AA859680 | n | | |
| 153 | 20599 | AA859690 | x | | |
| 154 | 14261 | AA859693 | u | | |
| 155 | 14138 | AA859700 | v | | protoporphyrinogen oxidase |
| 155 | 14139 | AA859700 | v | | protoporphyrinogen oxidase |
| 157 | 22374 | AA859804 | l | | |
| 158 | 22385 | AA859805 | b, k | | ESTs, Weakly similar to PROTEIN-LYSINE 6-OXIDASE PRECURSOR [*R. norvegicus*], Lysyl oxidase, lysyl oxidase, lysyl oxidase-like, lysyl oxidase-like 1, lysyl oxidase-like 2 |
| 159 | 22773 | AA859885 | n | | |
| 160 | 22816 | AA859898 | k, x, z | | |
| 161 | 11891 | AA859926 | x | | |
| 162 | 23070 | AA859942 | k | | EST, Weakly similar to JC1343 glycylpeptide N-tetradecanoyltransferase [*H. sapiens*], N-myristoyltransferase 1 |
| 163 | 23121 | AA859948 | k | | |
| 164 | 23166 | AA859954 | cc, General | | |
| 165 | 18468 | AA859966 | aa | | *Homo sapiens* cDNA FLJ14666 fis, clone NT2RP2003000, weakly similar to TUMOR NECROSIS FACTOR, ALPHA-INDUCED PROTEIN 1, *Homo sapiens* polymerase delta-interacting protein 1 mRNA, complete cds, MSTP028 protein, tumor necrosis factor, alpha-induced protein 1 (endothelial) |
| 166 | 23336 | AA859981 | q | | ESTs, Moderately similar to A Chain A, Inositol Monophosphatase [*H. sapiens*], Inositol (myo)-1(or 4)-monophosphatase 1, RIKEN cDNA 2900059K10 gene, bisphosphate 3'-nucleotidase 1, inositol (myo)-1(or 4)-monophosphatase 1, inositol (myo)-1(or 4)-monophosphatase 2, inositol(myo)-1(or 4)-monophosphatase 1, inositol(myo)-1(or 4)-monophosphatase 2 |
| 167 | 4222 | AA860024 | a, bb | | EST, Moderately similar to EF1G_HUMAN ELONGATION FACTOR 1-GAMMA [*H. sapiens*], ESTs, Highly similar to EF1G_HUMAN |

TABLE 3-continued

HUMAN HOMOLOGUE ANNOTATIONS

Atty. Docket No. 44921-5089US
Doc. No. 1803440.1

| Seq. ID No. | Identifier | GenBank Acc./ Ref. Seq. ID No. | Model Code | Homologous Gene Name | Homologous Cluster Name |
|---|---|---|---|---|---|
| 168 | 13974 | AA860030 | u, x, General | | ELONGATION FACTOR 1-GAMMA [*H. sapiens*], *Homo sapiens* cDNA FLJ11216 fis, clone PLACE1008002, eukaryotic translation elongation factor 1 gamma EST, Moderately similar to I38369 beta tubulin [*H. sapiens*], EST, Weakly similar to I38369 beta-tubulin [*H. sapiens*], EST, Weakly similar to TUBULIN BETA-5 CHAIN [*M. musculus*], ESTs, Highly similar to A25113 tubulin beta chain 15 - rat [*R. norvegicus*], FK506-binding protein 1A (12 kD), RIKEN cDNA 2310061K05 gene, RIKEN cDNA 2410129E14 gene, tubulin, beta 2, tubulin, beta 5, tubulin, beta polypeptide |
| 169 | 7090 | AA860039 | x | hyaluronan mediated motility receptor (RHAMM), hyaluronan-mediated motility receptor (RHAMM) | *Mus musculus* 12 days embryo male wolffian duct includes surrounding region cDNA, RIKEN full-length enriched library, clone 6720466F14, full insert sequence, RIKEN cDNA 0610027D24 gene, TRAF4 associated factor 1, hyaluronan mediated motility receptor (RHAMM), hyaluronan-mediated motility receptor (RHAMM) |
| 170 | 23769 | AA860055 | k, x | | DKFZP547E2110 protein, hypothetical protein FLJ10604 |
| 171 | 16323 | AA866240 | w | | |
| 172 | 4462 | AA866264 | General | | EST, Weakly similar to PE2R RAT 20-ALPHA-HYDROXYSTEROID DEHYDROGENASE [*R. norvegicus*], *Mus musculus* 10 days embryo cDNA, RIKEN full-length enriched library, clone.2610528B18, full insert sequence, RIKEN cDNA 9430025F20 gene, *Rattus norvegicus* mRNA for 20-alpha-hydroxysteroid dehydrogenase (20-alpha-HSD), complete cds, aldo-keto reductase family 1, member C1, aldo-keto reductase family 1, member C4 (chlordecone reductase; 3-alpha hydroxysteroid dehydrogenase, type I, dihydrodiol dehydrogenase 4), expressed sequence AI315367, expressed sequence AI503553, hydroxysteroid (17-beta) dehydrogenase 5 |
| 173 | 15884 | AA866276 | k | | ESTs, Highly similar to A54602 microtubule-associated serine/threonine protein kinase MAST2O5 - mouse [*M. musculus*], ESTs, Moderately similar to A54602 microtubule-associated serine/threonine protein kinase MAST205 - mouse [*M. musculus*], *Homo sapiens* cDNA: FLJ21699 fis, clone COL09829, KIAA0303 protein, KIAA0807 protein, *Mus musculus* adult male cecum cDNA, RIKEN full-length enriched library, clone 9130026D18, full insert sequence, microtubule associated testis specific serine/threonine protein kinase, syntrophin associated serine/threonine kinase |
| 174 | 17742 | AA866302 | c, y | 4-hydroxyphenylpyruvate dioxygenase, 4-hydroxyphenylpyruvic acid dioxygenase | 4-hydroxyphenylpyruvate dioxygenase, 4-hydroxyphenylpyruvic acid dioxygenase, ESTs, Weakly similar to HPPD MOUSE 4-HYDROXYPHENYLPYRUVATE DIOXYGENASE [*M. musculus*], ESTs, Weakly similar to S32820 alloantigen F - |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 175 | 16333 | AA866414 | a, h | solute carrier family 4 (anion exchanger), member 1, solute carrier family 4, anion exchanger, member 1 (erythrocyte membrane protein band 3, Diego blood group) | rat [*R. norvegicus*], hypothetical protein MGC15668 ESTs, Highly similar to BAND 3 ANION EXCHANGE PROTEIN [*M. musculus*], ESTs, Weakly similar to B3HU band 3 anion transport protein, erythrocyte [*H. sapiens*], solute carrier family 4 (anion exchanger) member 1, solute carrier family 4 anion exchanger, member 1 (erythrocyte membrane protein band 3, Diego blood group) |
| 176 | 18918 | AA866444 | p, q | | |
| 177 | 16853 | AA866454 | j, l, m, y, z | | |
| 178 | 18995 | AA866459 | h, m | | |
| 179 | 16013 | AA866482 | s | | ESTs, Highly similar to FGD1_HUMAN PUTATIVE RHO/RAC GUANINE NUCLEOTIDE EXCHANGE FACTOR [*H. sapiens*], ESTs, Weakly similar to FGD1 MOUSE PUTATIVE RHO/RAC GUANINE NUCLEOTIDE EXCHANGE FACTOR [*M. musculus*], ESTs, Weakly similar to FGD1_HUMAN PUTATIVE RHO/RAC GUANINE NUCLEOTIDE EXCHANGE FACTOR [*H. sapiens*], FGD1 family, member 3, RIKEN cDNA 5830461L01 gene, faciogenital dysplasia (Aarskog-Scott syndrome), faciogenital dysplasia homolog, faciogenital dysplasia homolog 2 (human) |
| 180 | 26036 | AA874849 | r | | |
| 181 | 16059 | AA874857 | h | | |
| 182 | 16069 | AA874873 | r | | |
| 183 | 21633 | AA874951 | f | | ESTs, Weakly similar to RNA binding protein [*H. sapiens*] |
| 184 | 16192 | AA874995 | w | | |
| 185 | 16254 | AA875025 | j | | cellular retinoic acid-binding protein 1 |
| 186 | 16312 | AA875032 | cc, General | | |
| 187 | 20701 | AA875097 | b | fibrinogen, A alpha polypeptide | *Homo sapiens* clone HQ0582, expressed sequence AI303526, fibrinogen, A alpha polypeptide, fibrinogen, gamma polypeptide |
| 188 | 16416 | AA875098 | bb | | ADP-ribosylation factor 3, RIKEN cDNA 5430400P17 gene, *Rattus norvegicus* ADP-ribosylation factor 3 mRNA, complete cds, expressed sequence AA408731 |
| 189 | 16419 | AA875102 | bb | | expressed sequence AL022645, expressed sequence C76690, small nuclear ribonucleoprotein E, small nuclear ribonucleoprotein polypeptide E |
| 190 | 15313 | AA875126 | l, m, General | | |
| 191 | 10936 | AA875146 | w | | |
| 192 | 18084 | AA875186 | h | | |
| 193 | 15371 | AA875205 | u | | ESTs. Weakly similar to IF39_HUMAN EUKARYOTIC TRANSLATION INITIATION FACTOR 3 SUBUNIT 9 [*H. sapiens*] |
| 194 | 15401 | AA875257 | x, z | | |
| 195 | 15410 | AA875268 | p, s | | NADH dehydrogenase (ubiquinone) Fe-S protein 7 (20 kD) (NADH-coenzyme Q reductase) |
| 196 | 15420 | AA875286 | f | | |
| 197 | 15446 | AA875327 | s, w | | |
| 198 | 7936 | AA875495 | b, General | | |
| 199 | 17314 | AA875509 | i, l, m | | EST, Moderately similar to A Chain A, Mdm2 Bound To The Transactivation Domain Of P53 {SUB 17-125 [*H. sapiens*], mouse double minute 2, human homolog of; p53-binding protein |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 200 | 24472 | AA875523 | k | | EST, Weakly similar to MOHU6N myosin alkali light chain 6, nonmuscle form [*H. sapiens*], myosin light chain, alkali, nonmuscle, myosin, light polypeptide 6, alkali, smooth muscle and non-muscle |
| 201 | 15587 | AA875577 | j | | |
| 202 | 15617 | AA875620 | General | | |
| 202 | 15618 | AA875620 | General | | |
| 203 | 5384 | AA891041 | f, cc, General | | Jun-B oncogene, jun B proto-oncogene |
| 204 | 24814 | AA891209 | f, p | | |
| 205 | 21930 | AA891322 | d | | EST, Moderately similar to JH0148 nucleolin - rat [*R. norvegicus*], EST, Weakly similar to NUCL_HUMAN NUCLEOLIN [*H. sapiens*], ESTs, Highly similar to FUS_HUMAN RNA-BINDING PROTEIN FUS [*H. sapiens*], ESTs, Weakly similar to T17210 hypothetical protein DKFZp434N041.1 [*H. sapiens*], RIKEN cDNA 2700022N21 gene, fusion, derived from t(12; 16) malignant liposarcoma, poly(A) binding protein, nuclear 1, small nuclear ribonucleoprotein 70 kD polypeptide (RNP antigen) |
| 206 | 17225 | AA891553 | h | | EST, Weakly similar to IF37 MOUSE EUKARYOTIC TRANSLATION INITIATION FACTOR 3 SUBUNIT 7 [*M. musculus*], eukaryotic translation initiation factor 3, subunit 7 (zeta, 66/67 kDa), eukaryotic translation initiation factor 3, subunit 7 (zeta, 66/67 kD) |
| 207 | 7522 | AA891571 | j, m | | |
| 208 | 9071 | AA891578 | b | | |
| 209 | 19321 | AA891666 | u | melanoma antigen, family D, 1 | *Homo sapiens*, Similar to neurofilament, heavy polypeptide (200 kD), clone MGC: 20701 IMAGE. 4634024, mRNA, complete cds, MAGE-E1 protein, MAGEF1 protein, Neurofilament, heavy polypeptide, RIKEN cDNA 2010107K23 gene, RIKEN cDNA 3830417A13 gene, general transcription factor IIH, polypeptide 1 (62 kD subunit), melanoma antigen, family D, 1, melanoma antigen, family D, 2, necdin, neurofilament, heavy polypeptide, neurofilament, heavy polypeptide (200 kD) |
| 210 | 17693 | AA891737 | j, l, m, n, y, z | | |
| 211 | 17256 | AA891739 | General | | |
| 213 | 18269 | AA891769 | General | | ESTs, Highly similar to S03917 fibronectin ED-A [*H. sapiens*], ESTs, Moderately similar to Fourth And Fifth Fibronectin Type I Module Pair {SUB 183-275 [*H. sapiens*], Fibronectin 1, fibronectin 1 |
| 214 | 9905 | AA891774 | s, bb, General | | |
| 215 | 17061 | AA891812 | d | | |
| 216 | 7050 | AA891824 | h | | ESTs, Highly similar to 2013348A Ser kinase SRPK1 [*H. sapiens*], *Mus musculus* 13 days embryo head cDNA, RIKEN full-length enriched library, clone: 3110005M20, full insert sequence, *Mus musculus* adult male lung cDNA, RIKEN full-length enriched library, clone.1200011B22, full insert sequence, SFRS protein kinase 1, SFRS protein kinase 2, serine/arginine-rich protein specific kinase 2, serine/threonine kinase 23 |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 217 | 4463 | AA891831 | General | | EST, Weakly similar to PE2R RAT 20-ALPHA-HYDROXYSTEROID DEHYDROGENASE [*R. norvegicus*], *Mus musculus* 10 days embryo cDNA, RIKEN full-length enriched library, clone: 2610528B18, full insert sequence, RIKEN cDNA 9430025F20 gene, *Rattus norvegicus* mRNA for 20-alpha-hydroxysteroid dehydrogenase (20-alpha-HSD), complete cds, aldo-keto reductase family 1, member C1, aldo-keto reductase family 1, member C4 (chlordecone reductase; 3-alpha hydroxysteroid dehydrogenase, type I; dihydrodiol dehydrogenase 4), expressed sequence AI315367, expressed sequence AI503553, hydroxysteroid (17-beta) dehydrogenase 5 |
| 218 | 14289 | AA891838 | i | | |
| 219 | 20523 | AA891842 | r, cc | | |
| 220 | 17779 | AA891914 | g, s, z | | EST, Weakly similar to ACY1_HUMAN AMINOACYLASE-1 [*H. sapiens*], aminoacylase 1 |
| 221 | 17438 | AA891943 | General | | |
| 222 | 22862 | AA891944 | p | | |
| 223 | 1159 | AA891949 | e, z | | |
| 224 | 4473 | AA891965 | General | | |
| 225 | 6362 | AA892053 | f, j, l, m | | |
| 226 | 9037 | AA892066 | y | | |
| 227 | 19469 | AA892112 | General | | EST, Weakly similar to PROD_HUMAN PROLINE OXIDASE, MITOCHONDRIAL PRECURSOR [*H. sapiens*], *Homo sapiens* mRNA for KIAA1653 protein, partial cds, proline dehydrogenase, proline dehydrogenase (proline oxidase), proline oxidase 1, proline oxidase homolog |
| 228 | 14595 | AA892128 | o, t, v | | |
| 229 | 16527 | AA892154 | cc | | |
| 230 | 4482 | AA892173 | bb | | |
| 231 | 20917 | AA892238 | h | | |
| 232 | 2357 | AA892268 | d | | Met proto-oncogene, RYK receptor-like tyrosine kinase, macrophage stimulating 1 receptor (c-met-related tyrosine kinase), met proto-oncogene |
| 233 | 18183 | AA892271 | h | | |
| 234 | 6523 | AA892299 | d | | |
| 236 | 13647 | AA892367 | a | | EST, Weakly similar to 60S RIBOSOMAL PROTEIN L3 [*R. norvegicus*], EST, Weakly similar to I84501 ribosomal protein L3 [*H. sapiens*], ESTs, Moderately similar to 60S RIBOSOMAL PROTEIN L3 [*R. norvegicus*], ESTs, Moderately similar to I84501 ribosomal protein L3 [*H. sapiens*], ESTs, Weakly similar to RL3 MOUSE 60S RIBOSOMAL PROTEIN L3 [*M. musculus*], RIKEN cDNA 1110057H16 gene, ribosomal protein L3, ribosomal protein L3-like |
| 237 | 3473 | AA892378 | v | | |
| 238 | 17682 | AA892382 | j, p, s, x, General | | ESTs, Weakly similar to T44342 hypothetical protein TSC501 [*H. sapiens*], kidney-and liver-specific gene, putative N-acetyltransferase Camello 2 |
| 239 | 820 | AA892395 | g, s | aldolase 2, B isoform, aldolase B, fructose-bisphosphate | |
| 240 | 14754 | AA892414 | u | | |
| 241 | 17439 | AA892446 | f | | |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 242 | 16469 | AA892462 | p | | ubiquinol-cytochrome c reductase (6.4 kD) subunit |
| 243 | 13609 | AA892468 | i, General | | EST, Weakly similar to MAST CELL PROTEASE 7 PRECURSOR [*M. musculus*], ESTs, Weakly similar to MCT7 RAT MAST CELL PROTEASE 7 PRECURSOR [*R. norvegicus*], RIKEN cDNA 2410039E18 gene, RIKEN cDNA 4933401F05 gene, marapsin, mast cell protease 7, protease, serine, 21 (testisin), protease, serine, 22, protease, serine, 8 (prostasin), tryptase delta 1, tryptase, alpha |
| 243 | 13610 | AA892468 | n, v, General | | EST, Weakly similar to MAST CELL PROTEASE 7 PRECURSOR [*M. musculus*], ESTs, Weakly similar to MCT7 RAT MAST CELL PROTEASE 7 PRECURSOR [*R. norvegicus*], RIKEN cDNA 2410039E18 gene, RIKEN cDNA 4933401F05 gene, marapsin, mast cell protease 7, protease, serine, 21 (testisin), protease, serine, 22, protease, serine, 8 (prostasin), tryptase delta 1, tryptase, alpha |
| 244 | 9254 | AA892470 | n, u | | EST, Weakly similar to histone H2A F/Z variant [*H. sapiens*], H2A histone family, member Z, RIKEN cDNA C530002L11 gene, histone H2A.F/Z variant |
| 245 | 11991 | AA892483 | s | | |
| 246 | 1522 | AA892486 | f | | EST, Weakly similar to A32609 alpha-glucosidase [*H. sapiens*], ESTs, Weakly similar to LYAG MOUSE LYSOSOMAL ALPHA-GLUCOSIDASE PRECURSOR [*M. musculus*], alpha glucosidase 2, alpha neutral subunit, glucosidase, alpha, acid |
| 247 | 11994 | AA892507 | aa | | ESTs, Highly similar to DS1_HUMAN DS-1 PROTEI [*H. sapiens*], immature colon carcinoma transcript 1 |
| 248 | 23888 | AA892520 | w | | |
| 248 | 23889 | AA892520 | h | | |
| 249 | 8599 | AA892522 | p | | |
| 250 | 15154 | AA892532 | p | | expressed sequence AI987846, expressed sequence AL023058, expressed sequence C77895, hypothetical protein MGC3178, protein disulfide isomerase-related protein, quiescin Q6 |
| 251 | 17468 | AA892545 | r | | |
| 252 | 11203 | AA892554 | f, h | | |
| 253 | 18906 | AA892561 | a, bb, General | | |
| 254 | 19327 | AA892562 | f, j, y, z | | ESTs, Moderately similar to DKC1 RAT DYSKERIN [*R. norvegicus*], ESTs, Weakly similar to DKC1_HUMAN DYSKERIN [*H. sapiens*], RIKEN cDNA 9030425C13 gene, dyskeratosis congenita 1, dyskerin, hypothetical protein, MGC:7014, nuclear factor of kappa light polypeptide gene enhancer in B-cells inhibitor-like 1 |
| 255 | 18274 | AA892572 | p | | |
| 256 | 4512 | AA892578 | cc | | |
| 257 | 15876 | AA892582 | w | | EST, Highly similar to 60S RIBOSOMAL PROTEIN L8 [*R. norvegicus*], EST, Moderately similar to 60S RIBOSOMAL PROTEIN L8 [*R. norvegicus*], EST, Weakly similar to JN0923 ribosomal protein L8, cytosolic [*H. sapiens*], ESTs, Highly similar to 60S RIBOSOMAL PROTEIN L8 [*R. norvegicus*], ESTs, Highly similar to RL8_HUMAN 60S RIBOSOMAL |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| | | | | | PROTEIN L [*M. musculus*], ESTs, Moderately similar to RL8_HUMAN 60S RIBOSOMAL PROTEIN L [*M. musculus*], expressed sequence AL024098, ribosomal protein L8 |
| 258 | 19085 | AA892598 | General | | |
| 258 | 19086 | AA892598 | General | | |
| 259 | 20065 | AA892647 | l | | EST, Highly similar to HISTONE H4 [*R. norvegicus*], ESTs, Highly similar to HISTONE H4 [*R. norvegicus*], H4 histone family, member D, H4 histone family, member H, H4 histone family, member I, H4 histone family, member K, *Mus musculus* 10 day old male pancreas cDNA, RIKEN full-length enriched library, clone: 1810029H14, full insert sequence, *Mus musculus* 10 days embryo cDNA, RIKEN full-length enriched library, clone: 2610027B07, full insert sequence, *Mus musculus* adult male testis cDNA, RIKEN full-length enriched library, clone: 4930558J22, full insert sequence, *Mus musculus* adult male tongue cDNA, RIKEN full-length enriched library, clone: 2310067E17, full insert sequence, histone 4 protein |
| 260 | 20088 | AA892666 | a, n | | |
| 261 | 23783 | AA892773 | n | | |
| 262 | 17549 | AA892776 | f, z | | *Mus musculus*, Similar to solute carrier family 25 (mitochondrial carrier; phosphate carrier), member 3, clone MGC: 7631, mRNA, complete cds, expressed sequence W51672, solute carrier family 25 (mitochondrial carrier, phosphate carrier), member 3 |
| 263 | 13542 | AA892798 | b | | |
| 264 | 22537 | AA892799 | General | | 3-phosphoglycerate dehydrogenase, EST, Weakly similar to SERA RAT D-3-PHOSPHOGLYCERATE DEHYDROGENASE [*R. norvegicus*], ESTs, Moderately similar to SERA_HUMAN D-3-PHOSPHOGLYCERATE DEHYDROGENASE [*H. sapiens*], *Mus musculus* adult male testis cDNA, RIKEN full-length enriched library, clone: 4930404C15, full insert sequence, RIKEN cDNA 1110059D05 gene, RIKEN cDNA 6430629L09 gene, glyoxylate reductase/hydroxypyruvate reductase, phosphoglycerate dehydrogenase |
| 264 | 22539 | AA892799 | v | | 3-phosphoglycerate dehydrogenase, EST, Weakly similar to SERA RAT D-3-PHOSPHOGLYCERATE DEHYDROGENASE [*R. norvegicus*], ESTs, Moderately similar to SERA_HUMAN D-3-PHOSPHOGLYCERATE DEHYDROGENASE [*H. sapiens*], *Mus musculus* adult male testis cDNA, RIKEN full-length enriched library, clone: 4930404C15, full insert sequence, RIKEN cDNA 1110059D05 gene, RIKEN cDNA 6430629L09 gene, glyoxylate reductase/hydroxypyruvate reductase, phosphoglycerate dehydrogenase |
| 264 | 22538 | AA892799 | General | | 3-phosphoglycerate dehydrogenase, EST, Weakly similar to SERA RAT D-3-PHOSPHOGLYCERATE DEHYDROGENASE [*R. norvegicus*], |

TABLE 3-continued

HUMAN HOMOLOGUE ANNOTATIONS

| Seq. ID No. | Identifier | GenBank Acc./Ref. Seq. ID No. | Model Code | Homologous Gene Name | Homologous Cluster Name |
|---|---|---|---|---|---|
| 265 | 6951 | AA892820 | h | | ESTs, Moderately similar to SERA_HUMAN D-3-PHOSPHOGLYCERATE DEHYDROGENASE [H. sapiens], Mus musculus adult male testis cDNA, RIKEN full-length enriched library, clone: 4930404C15, full insert sequence, RIKEN cDNA 1110059D05 gene, RIKEN cDNA 6430629L09 gene, glyoxylate reductase/hydroxypyruvate reductase, phosphoglycerate dehydrogenase |
| 266 | 23322 | AA892821 | j, z | | ESTs, Highly similar to AR72_HUMAN AFLATOXIN B1 ALDEHYDE REDUCTASE 1 (AFB1-AR 1) (ALDOKETOREDUCTASE 7) [H. sapiens], ESTs, Moderately similar to AFAR RAT AFLATOXIN B1 ALDEHYDE REDUCTASE [R. norvegicus], RIKEN cDNA 0610025K21 gene, aflatoxin B1 aldehyde reductase, aldo-keto reductase family 7, member A2 (aflatoxin aldehyde reductase), aldo-keto reductase family 7, member A3 (aflatoxin aldehyde reductase) |
| 267 | 17923 | AA892843 | f | | |
| 268 | 22871 | AA892859 | m | | RIKEN cDNA 2410042F05 gene, procollagen-lysine, 2-oxoglutarate 5-dioxygenase (lysine hydroxylase) 2, procollagen-lysine, 2-oxoglutarate 5-dioxygenase (lysine hydroxylase, Ehlers-Danlos syndrome type VI), procollagen-lysine, 2-oxoglutarate 5-dioxygenase 1 |
| 269 | 9053 | AA892861 | p, v, General | | |
| 270 | 16482 | AA892940 | w | | EST, Weakly similar to EFHU2 translation elongation factor eEF-2 [H. sapiens], ESTs, Highly similar to ELONGATION FACTOR 2 [R. norvegicus], U5 snRNP-specific protein, 116 kD, eukaryotic translation elongation factor 2, expressed sequence AI451340, hypothetical protein FLJ21661 |
| 271 | 12020 | AA893035 | j, y | | |
| 272 | 3863 | AA893060 | General | | |
| 273 | 13332 | AA893080 | i, General | | |
| 274 | 21305 | AA893082 | General | | |
| 275 | 16591 | AA893191 | j, z | | |
| 276 | 17447 | AA893192 | General | | |
| 277 | 3876 | AA893205 | n | | |
| 278 | 3878 | AA893230 | General | | Calmodulin 1 (phosphorylase kinase, delta), Calmodulin III, ESTs, Highly similar to A Chain A, Calmodulin Complexed With Calmodulin-Binding Peptide From Smooth Muscle Myosin Light Chain Kinase {SUB 2-148 [H. sapiens], RIKEN cDNA 2310068O22 gene, calmodulin, calmodulin 1, calmodulin 1 (phosphorylase kinase, delta), calmodulin 2, calmodulin 2 (phosphorylase kinase, delta), calmodulin 3, calmodulin-like 3 |
| 279 | 20986 | AA893242 | q | fatty acid Coenzyme A ligase, long chain 2, fatty-acid-Coenzyme A ligase, long-chain 2 | ESTs, Weakly similar to LCFB MOUSE LONG-CHAIN-FATTY-ACID - COA LIGASE 2 [M. musculus], Mus musculus, Similar to fatty-acid-Coenzyme A ligase, long-chain 6, clone MGC: 28744 IMAGE: 4481949, mRNA, complete cds, Rattus |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 280 | 16168 | AA893280 | i, z, General | | *norvegicus* gonadotropin-regulated long chain acyl-CoA synthetase (GR-LACS) mRNA, complete cds, fatty acid Coenzyme A ligase, long chain 2, fatty acid Coenzyme A ligase, long chain 5, fatty-acid-Coenzyme A ligase, long-chain 1, fatty-acid-Coenzyme A ligase, long-chain 2, lipidosin RIKEN cDNA 1300012C15 gene, RIKEN cDNA 2310076L09 gene, adipose differentiation related protein, adipose differentiation-related protein |
| 281 | 3886 | AA893289 | j, m, y | | |
| 282 | 15209 | AA893327 | y | | |
| 283 | 17800 | AA893436 | cc | | |
| 284 | 17836 | AA893626 | h | | Guanine nucleotide-binding protein beta 1, *Homo sapiens* mRNA for FLJ00083 protein, partial cds, *Mus musculus*, clone MGC: 7934 IMAGE: 3583848, mRNA, complete cds, RIKEN cDNA 5930415H02 gene, WD repeat domain 5, guanine nucleotide binding protein (G protein), beta polypeptide 1, guanine nucleotide binding protein beta subunit 4, guanine nucleotide binding protein, beta 1, guanine nucleotide binding protein, beta 4, hypothetical protein, recombination protein REC14 |
| 285 | 9084 | AA893717 | x | | |
| 286 | 22731 | AA893743 | d | | |
| 287 | 12031 | AA893860 | v | | ESTs, Highly similar to YSHUT threonine - tRNA ligase [*H. sapiens*], ESTs, Moderately similar to YSHUT threonine - tRNA ligase [*H. sapiens*], hypothetical protein FLJ12528, threonyl-tRNA synthetase |
| 288 | 17897 | AA893905 | k | | |
| 289 | 3447 | AA893982 | d | | |
| 290 | 22583 | AA894009 | n | | |
| 291 | 10540 | AA894027 | j | | |
| 292 | 4569 | AA894059 | x | | |
| 293 | 18419 | AA894130 | d | | Amyloid protein precursor-like protein 2, EST, Weakly similar to AMYLOID-LIKE PROTEIN 2 PRECURSOR [*R. norvegicus*], Human DNA sequence from clone RP3-461P17 on chromosome 20q12-13 2. Contains two novel genes, gene HE4 for Major Epididymis-specific protein E4 precursor (Epididymis Secretory protein E4), RPL5 (60S Ribosomal Protein L5), COX6C (Cytochrome C Oxidase subunit VIC) and HSPD1 (HSP60, Mitochondrial Matrix Protein P1 precursor, Heat Shock Protein 60, GROEL, HUCHA60) pseudogenes, the SPINT3 gene for Kunitz type serine protease inhibitor 3 (HKIB9), two genes for novel Kunitz/Bovine pancreatic trypsin inhibitor and WAP-type (Whey Acidic Protein) 'four-disulfide core' domains containing proteins and the gene for Eppin-1, -2 and-3 Contains ESTs, STSs, GSSs and a CpG island, RIKEN cDNA 1700024E17 gene, amyloid beta (A4) precursor-like protein 2, serine protease inhibitor, Kunitz type 2, tissue factor pathway inhibitor, tissue factor pathway inhibitor 2 |
| 294 | 17336 | AA894297 | j | | |
| 295 | 19120 | AA894318 | f, j | | |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 296 | 19762 | AA899113 | i | | |
| 297 | 18286 | AA899219 | u | | EST, Weakly similar to S45140 tubulin beta chain [*H. sapiens*], ESTs, Highly similar to T08726 tubulin beta chain [*H. sapiens*], ESTs, Highly similar to TBB1 RAT TUBULIN BETA CHAIN [*R. norvegicus*], ESTs, Moderately similar to I38370 beta-tubulin [*H. sapiens*], ESTs, Moderately similar to TBB1 RAT TUBULIN BETA CHAIN [*R. norvegicus*], RIKEN cDNA 2410129E14 gene, RIKEN cDNA 4930447K03 gene, RIKEN cDNA 4930542G03 gene, tubulin, beta 3, tubulin, beta polypeptide |
| 298 | 22051 | AA899498 | w | | |
| 298 | 22052 | AA899498 | q | | |
| 299 | 21628 | AA899563 | aa | | |
| 300 | 4262 | AA899590 | i | | |
| 301 | 4661 | AA899709 | t, General | receptor (calcitonin) activity modifying protein 3 | receptor (calcitonin) activity modifying protein 3 |
| 302 | 21354 | AA899721 | q | | |
| 303 | 17905 | AA899762 | General | | EST, Moderately similar to EGFR_HUMAN EPIDERMAL GROWTH FACTOR RECEPTOR PRECURSOR [*H. sapiens*], Epidermal growth factor receptor, formerly avian erythroblastic leukemia viral (v-erbB) oncogene homolog (Erbb1), avian erythroblastosis oncogene B 3, epidermal growth factor receptor, epidermal growth factor receptor (avian erythroblastic leukemia viral (v-erb-b) oncogene homolog) |
| 304 | 15231 | AA899840 | r | | |
| 305 | 23778 | AA899854 | c, k, x | topoisomerase (DNA) II alpha, topoisomerase (DNA) II alpha (170 kD) | ESTs, Moderately similar to A40493 DNA topoisomerase [*H. sapiens*], ESTs, Moderately similar to TP2A MOUSE DNA TOPOISOMERASE II, ALPHA [*M. musculus*], topoisomerase (DNA) II alpha, topoisomerase (DNA) II beta, topoisomerase (DNA) II beta (180 kD) |
| 306 | 22060 | AA899898 | b | | |
| 307 | 9114 | AA899951 | v, General | | |
| 308 | 8988 | AA900148 | f | | |
| 309 | 11841 | AA900247 | v | | ESTs, Highly similar to IEFS_HUMAN TRANSFORMATION-SENSITIVE PROTEIN IEF SSP 3521 [*H. sapiens*], hypothetical protein FLJ12788 |
| 310 | 4725 | AA900290 | cc | | Alpha-2-macroglobulin, ESTs, Moderately similar to A2M2 MOUSE MURINOGLOBULIN 2 PRECURSOR [*M. musculus*], RIKEN cDNA 2610307I21 gene, alpha-2-macroglobulin, carbon catabolite repression 4 homolog (*S. cerevisiae*), expressed sequence AW456442, pregnancy-zone protein |
| 311 | 4747 | AA900465 | General | | |
| 312 | 20988 | AA900562 | o | | |
| 313 | 3822 | AA900863 | b, g, General | | DNA segment, Chr 17, human D6S81E 1, ESTs, Highly similar to S33681 translation initiation factor eIF-4A.I [*H. sapiens*], HLA-B associated transcript 1, Human clone 23933 mRNA sequence, eukaryotic translation initiation factor 4A, isoform 1, mitochondrial DEAD-box polypeptide 28, nuclear RNA helicase, DECD variant of DEAD box family |
| 315 | 12420 | AA901017 | b | | *Mus musculus*, Similar to aspartyl-tRNA synthetase, clone MGC: 6719 |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| | | | | | IMAGE: 3586278, mRNA, complete cds, asparaginyl-tRNA synthetase, aspartyl-tRNA synthetase, hypothetical protein FLJ10514, hypothetical protein FLJ23441 |
| 316 | 4849 | AA901155 | s | | |
| 317 | 3959 | AA901338 | General | | |
| 318 | 22846 | AA923982 | a, d | | succinate-CoA ligase, ADP-forming, beta subunit |
| 319 | 4895 | AA923999 | k | | |
| 320 | 21546 | AA924188 | cc, General | | |
| 321 | 24192 | AA924210 | n, General | | |
| 322 | 4933 | AA924301 | g, l, General | | |
| 323 | 4944 | AA924405 | l, General | | ESTs, Weakly similar to NEUROFILAMENT TRIPLET H PROTEIN [*M. musculus*], RIKEN cDNA 0610009L18 gene, RIKEN cDNA 1300003A17 gene, RIKEN cDNA 2410142G14 gene, nucleolar protein (KKE/D repeat) |
| 324 | 4948 | AA924428 | r | | |
| 325 | 4949 | AA924432 | General | | ESTs, Weakly similar to NPT2_HUMAN RENAL SODIUM-DEPENDENT PHOSPHATE TRANSPORT PROTEIN 2 [*H. sapiens*], *Homo sapiens*, Similar to solute carrier family 34 (sodium phosphate), member 1, clone MGC 18179 IMAGE: 4155326, mRNA, complete cds, *Rattus norvegicus* mRNA for NaPi-2 alpha, complete cds, Solute carrier family 17 (sodium/hydrogen exchanger), member 2, expressed sequence AI649385, solute carrier family 34 (sodium phosphate), member 1, solute carrier family 34 (sodium phosphate), member 2 |
| 326 | 18891 | AA924598 | e | | |
| 327 | 22540 | AA924630 | v, General | | 3-phosphoglycerate dehydrogenase, EST, Weakly similar to SERA RAT D-3-PHOSPHOGLYCERATE DEHYDROGENASE [*R. norvegicus*], ESTs, Moderately similar to SERA_HUMAN D-3-PHOSPHOGLYCERATE DEHYDROGENASE [*H. sapiens*], *Mus musculus* adult male testis cDNA, RIKEN full-length enriched library, clone: 4930404C15, full insert sequence, RIKEN cDNA 1110059D05 gene, RIKEN cDNA 6430629L09 gene, glyoxylate reductase/hydroxypyruvate reductase, phosphoglycerate dehydrogenase |
| 327 | 22541 | AA924630 | General | | 3-phosphoglycerate dehydrogenase, EST, Weakly similar to SERA RAT D-3-PHOSPHOGLYCERATE DEHYDROGENASE [*R. norvegicus*], ESTs, Moderately similar to SERA_HUMAN D-3-PHOSPHOGLYCERATE DEHYDROGENASE [*H. sapiens*], *Mus musculus* adult male testis cDNA, RIKEN full-length enriched library, clone: 4930404C15, full insert sequence, RIKEN cDNA 1110059D05 gene, RIKEN cDNA 6430629L09 gene, glyoxylate reductase/hydroxypyruvate reductase, phosphoglycerate dehydrogenase |
| 328 | 14759 | AA924766 | k | | |
| 329 | 23123 | AA924794 | x | | |
| 330 | 4067 | AA924813 | g, p | | |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 331 | 2888 | AA924902 | r, General | | |
| 332 | 18130 | AA924964 | d | | |
| 333 | 23141 | AA925019 | r | | |
| 334 | 23195 | AA925026 | General | | ESTs, Weakly similar to A35863 tryptase [*H. sapiens*], ESTs, Weakly similar to MCT7 RAT MAST CELL PROTEASE 7 PRECURSOR [*R. norvegicus*], RIKEN cDNA 4733401N09 gene, mast cell protease 7, tryptase delta 1, tryptase gamma 1, tryptase, alpha |
| 335 | 21458 | AA925049 | f, aa, General | | |
| 336 | 5073 | AA925061 | m | | |
| 337 | 14790 | AA925087 | o, General | | |
| 338 | 5089 | AA925126 | g | | *Homo sapiens*, clone IMAGE: 3940519, mRNA, partial cds, hypothetical protein DKFZp762O076 |
| 339 | 23261 | AA925145 | k, General | | *Mus musculus* adult male testis cDNA, RIKEN full-length enriched library, clone. 4930572N12, full insert sequence, betaine-homocysteine methyltransferase, betaine-homocysteine methyltransferase 2 |
| 340 | 17363 | AA925150 | a | | KIAA0438 gene product, *Rattus norvegicus* mRNA for neurodegeneration associated protein 1, complete cds, expressed sequence AL022700, g1-related zinc finger protein, hypothetical protein, hypothetical protein FLJ11830 similar to Praja1, hypothetical protein, similar to (U06944) PRAJA1, praja1 |
| 341 | 23448 | AA925167 | l | | |
| 342 | 23159 | AA925318 | e | | EST, Weakly similar to TRI9_HUMAN THYROID RECEPTOR INTERACTING PROTEIN 9 [*H. sapiens*], ESTs, Highly similar to A44437 regenerating liver inhibitory factor RL/IF-1 - rat [*R. norvegicus*], ESTs, Weakly similar to I-kappa B alpha chain [*M. musculus*], nuclear factor of kappa light chain gene enhancer in B-cells inhibitor, alpha, nuclear factor of kappa light chain gene enhancer in B-cells inhibitor, beta, nuclear factor of kappa light polypeptide gene enhancer in B-cells inhibitor, alpha, nuclear factor of kappa light polypeptide gene enhancer in B-cells inhibitor, beta, nuclear factor of kappa light polypeptide gene enhancer in B-cells inhibitor, epsilon |
| 343 | 21500 | AA925353 | k | | |
| 344 | 22479 | AA925418 | t | | |
| 345 | 21151 | AA925539 | b | | |
| 346 | 16944 | AA925541 | f | heterogeneous nuclear ribonucleoprotein L | EST, Moderately similar to 1604358A nuclear RNP protein L [*H. sapiens*], ESTs, Highly similar to 1604358A nuclear RNP protein L [*H. sapiens*], ESTs, Moderately similar to 1604358A nuclear RNP protein L [*H. sapiens*], heterogeneous nuclear ribonucleoprotein L |
| 346 | 16945 | AA925541 | t | heterogeneous nuclear ribonucleoprotein L | EST, Moderately similar to 1604358A nuclear RNP protein L [*H. sapiens*], ESTs, Highly similar to 1604358A nuclear RNP protein L [*H. sapiens*], ESTs, Moderately similar to 1604358A nuclear RNP protein L [*H. sapiens*], heterogeneous nuclear ribonucleoprotein L |
| 347 | 17514 | AA925554 | bb | | ESTs, Moderately similar to JX0336 succinate dehydrogenase [*H. sapiens*], |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| | | | | | succinate dehydrogenase complex, subunit A, flavoprotein (Fp) |
| 348 | 5183 | AA925662 | i, General | | |
| 349 | 23189 | AA925844 | r | | |
| 350 | 23190 | AA925863 | aa | | EST, Weakly similar to IMB3_HUMAN IMPORTIN BETA-3 SUBUNIT [*H. sapiens*], *Homo sapiens* cDNA FLJ12978 fis, clone NT2RP2006321, RAN binding protein 6, karyopherin (importin) beta 3 |
| 351 | 5252 | AA926051 | General | | |
| 352 | 22967 | AA926080 | h, cc | | |
| 353 | 17157 | AA926129 | b | | |
| 354 | 13411 | AA926196 | u, General | | |
| 355 | 5295 | AA926247 | General | | potassium channel, subfamily K, member 1 (TWIK-1), potassium channel, subfamily K, member 3 (TASK-1), potassium channel, subfamily K, member 6 (TWIK-2), potassium channel, subfamily K, member 7 |
| 356 | 22928 | AA926262 | General | | DNA segment, human D4S114, P311 protein |
| 357 | 8948 | AA926316 | r | | |
| 358 | 21798 | AA926365 | aa | | CGI-69 protein, EST, Moderately similar to T43493 hypothetical protein DKFZp434C1I9 1 [*H. sapiens*], mitochondrial carrier family protein, mitochondrial solute carrier |
| 359 | 9942 | AA942697 | s | | |
| 360 | 6039 | AA942716 | x, General | | DNA segment, Chr 17, ERATO Doi 441, expressed, hematological and neurological expressed 1 |
| 361 | 11174 | AA942745 | g, o, w | | |
| 362 | 23005 | AA942770 | g | | |
| 363 | 21318 | AA942774 | General | | |
| 364 | 6615 | AA942889 | v | | |
| 365 | 6691 | AA943028 | c | | RAT MACROPHAGE COLONY STIMULATING FACTOR I RECEPTOR PRECURSOR [*R. norvegicus*], colony stimulating factor 1 receptor, colony stimulating factor 1 receptor, formerly McDonough feline sarcoma viral (v-fms) oncogene homolog |
| 366 | 22142 | AA943066 | p | | DEAD (aspartate-glutamate-alanine-aspartate) box polypeptide 5, DEAD/H (Asp-Glu-Ala-Asp/His) box polypeptide 17 (72 kD), KIAA0801 gene product, RIKEN cDNA 2610007K22 gene, RIKEN cDNA 4921506D17 gene, RIKEN cDNA 9130430L19 gene, RNA helicase, *Rattus norvegicus* RNA helicase with arginine-serine-rich domain mRNA, complete cds, expressed sequence AI325430, hypothetical protein, prp28, US snRNP 100 kD protein |
| 367 | 21993 | AA943149 | v, General | | ALEX1 protein, ALEX3 protein, armadillo repeat protein ALEX2, hypothetical protein MGC3195 |
| 368 | 9061 | AA943508 | General | | TU3A protein, hypothetical protein MGC11034 |
| 369 | 24390 | AA943531 | b, j, n, y | | ESTs, Weakly similar to VIL1 MOUSE VILLIN [*M. musculus*], actin binding LIM protein 1, advillin, erythrocyte membrane protein band 4.9 (dematin), erythrocyte protein band 4.9, villin |
| 370 | 13976 | AA943532 | f, s, x | | EST, Moderately similar to I38369 beta tubulin [*H. sapiens*], EST, Weakly similar to I38369 beta-tubulin [*H. sapiens*], EST, Weakly similar to TUBULIN BETA-5 CHAIN |

TABLE 3-continued

Atty. Docket No. 44921-5089US
Doc. No. 1803440.1

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| | | | | | [*M. musculus*], ESTs, Highly similar to A25113 tubulin beta chain 15-rat [*R. norvegicus*], FK506-binding protein 1A (12 kD), RIKEN cDNA 2310061K05 gene, RIKEN cDNA 2410129E14 gene, tubulin, beta 2, tubulin, beta 5, tubulin, beta polypeptide |
| 371 | 22248 | AA943537 | cc, General | | ajuba, expressed sequence AI481106, expressed sequence R75157, zyxin |
| 372 | 22257 | AA943558 | m | | TATA box binding protein (TBP)-associated factor, RNA polymerase II, J, 20 kD |
| 373 | 12673 | AA943773 | u, cc, General | | |
| 374 | 13641 | AA944154 | u | | |
| 375 | 2658 | AA944155 | f | | |
| 376 | 12770 | AA944161 | d | | |
| 377 | 20903 | AA944180 | i, x | | CDC28 protein kinase 2, RIKEN cDNA 1110038L14 gene, expressed sequence AI047807 |
| 378 | 13507 | AA944244 | v | | |
| 379 | 15596 | AA944353 | General | | |
| 380 | 22681 | AA944413 | i, v, cc, General | | |
| 381 | 6711 | AA944439 | General | | |
| 382 | 14763 | AA944481 | i, q, General | | ESTs, Highly similar to AGP2_RAT ANGIOPOIETIN-2 (ANG-2) [*R. norvegicus*], angiopoietin 1, angiopoietin 2, angiopoietin-like 3, angiopoietin-like 4, angiopoietin-like factor |
| 383 | 22466 | AA944605 | h | | |
| 384 | 12301 | AA944727 | b | | B-cell CLL/lymphoma 3, B-cell leukemia/lymphoma 3, ESTs, Highly similar to A44437 regenerating liver inhibitory factor RL/IF-1 - rat [*R. norvegicus*], ESTs, Weakly similar to I-kappa B alpha chain [*M. musculus*], molecule possessing ankyrin repeats induced by lipopolysaccharide (MAIL), homolog of mouse, nuclear factor of kappa light chain gene enhancer in B-cells 1, p105, nuclear factor of kappa light chain gene enhancer in B-cells inhibitor, alpha, nuclear factor of kappa light polypeptide gene enhancer in B-cells 2, p49/p100, nuclear factor of kappa light polypeptide gene enhancer in B-cells inhibitor, alpha, nuclear factor of kappa light polypeptide gene enhancer in B-cells inhibitor, epsilon, testis-specific ankyrin motif containing protein |
| 385 | 7023 | AA944792 | d, m, aa | | |
| 386 | 22536 | AA944803 | bb | | |
| 387 | 22501 | AA944811 | g, l | | CGI-89 protein, hypothetical protein DKFZp667O2416, hypothetical protein FLJ20984, leukocyte receptor cluster (LRC) member 4 |
| 388 | 23967 | AA944831 | s | | |
| 389 | 26084 | AA944922 | i | | |
| 390 | 11974 | AA944958 | General | | |
| 391 | 22547 | AA944970 | aa | | |
| 392 | 22554 | AA945076 | z, General | | |
| 393 | 14352 | AA945181 | General | | |
| 395 | 1798 | AA945569 | General | | |
| 396 | 22050 | AA945604 | i, aa | | |
| 397 | 19731 | AA945615 | d, o | | |
| 398 | 22612 | AA945624 | a, General | | Diaphorase (NADH/NADPH), NAD(P)H menadione oxidoreductase 2, dioxin inducible, NAD(P)H menadione oxidoreductase 2, dioxin-inducible, diaphorase (NADH/NADPH) (cytochrome b-5 reductase), diaphorase 4 (NADH/NADPH) |

TABLE 3-continued

HUMAN HOMOLOGUE ANNOTATIONS

Atty. Docket No. 44921-5089US
Doc. No. 1803440.1

| Seq. ID No. | Identifier | GenBank Acc./ Ref. Seq. ID No. | Model Code | Homologous Gene Name | Homologous Cluster Name |
|---|---|---|---|---|---|
| 399 | 22618 | AA945656 | aa | | |
| 400 | 11871 | AA945679 | v | | |
| 401 | 22656 | AA945818 | General | | |
| 402 | 6720 | AA945828 | p | | |
| 403 | 22351 | AA945867 | m | | |
| 404 | 22665 | AA945877 | f | | |
| 405 | 24243 | AA945950 | b | | |
| 406 | 22689 | AA945962 | General | | |
| 407 | 22692 | AA945986 | d | | |
| 408 | 22696 | AA945996 | c, General | | |
| 408 | 22697 | AA945996 | c, o | | |
| 409 | 22658 | AA945998 | w | | |
| 410 | 20832 | AA946040 | s | | ESTs, Weakly similar to COXG MOUSE CYTOCHROME C OXIDASE POLYPEPTIDE VIB [*M. musculus*], Human DNA sequence from clone RP4-591N18 on chromosome 22q13.1-13.2 Contains a COX6B (Cytochrome C Oxidase subunit VIb (EC 1.9.3.1)) pseudogene, ESTs, GSSs and two putative CpG islands, RIKEN cDNA 2010000G05 gene, cytochrome c oxidase subunit VIb |
| 411 | 18337 | AA946048 | General | | |
| 412 | 825 | AA946108 | General | | EST, Highly similar to LMA3_HUMAN LAMININ ALPHA-3 CHAIN PRECURSOR [*H. sapiens*], ESTs. Highly similar to LMA3_HUMAN LAMININ ALPHA-3 CHAIN PRECURSOR [*H. sapiens*], *Homo sapiens* cDNA: FLJ21236 fis, clone COL01111, expressed sequence AI853660, laminin, alpha 3 (nicein (150 kD), kalinin (165 kD), BM600 (150 kD), epilegrin) |
| 413 | 8639 | AA946221 | e, cc, General | | |
| 414 | 23237 | AA946224 | f | | |
| 415 | 15600 | AA946250 | o, aa | | |
| 416 | 19387 | AA946275 | t | | actin related protein 2/3 complex, subunit 3 (21 kD) |
| 417 | 6351 | AA946344 | d | | EST, Weakly similar to JC5111 cyclin-dependent kinase-related protein 1b - rat [*R. norvegicus*], EST, Weakly similar to S10889 proline-rich protein [*H. sapiens*], ESTs, Highly similar to JC5111 cyclin-dependent kinase-related protein 1b-rat [*R. norvegicus*], *Homo sapiens* ALS2CR7 mRNA, complete cds, PCTAIRE protein kinase 1, PCTAIRE-motif protein kinase 1, PFTAIRE protein kinase 1 |
| 418 | 22057 | AA946348 | e | | |
| 419 | 22069 | AA946349 | aa | | |
| 420 | 13962 | AA946351 | General | | |
| 421 | 18280 | AA946361 | g | | EST, Moderately similar to 1923401A protein CBP [*M. musculus*], EST, Weakly similar to 1923401A protein CBP [*M. musculus*], ESTs, Highly similar to 1923401A protein CBP [*M. musculus*], ESTs, Weakly similar to 1923401A protein CBP [*M. musculus*], bromodomain, testis-specific, bromodomain-containing 2 |
| 422 | 18944 | AA946391 | v | | |
| 424 | 21410 | AA946408 | t | | |
| 425 | 643 | AA946439 | o, y | | EST, Highly similar to HISTONE H4 [*R. norvegicus*], H4 histone family, member D, H4 histone family, member H, H4 histone family, member I, H4 histone family, member K, *Mus musculus* 10 day old male pancreas cDNA, RIKEN full-length enriched library, clone. 1810029H14, full insert |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| | | | | | sequence, *Mus musculus* 10 days embryo cDNA, RIKEN full-length enriched library, clone: 2610027B07, full insert sequence, *Mus musculus* adult male testis cDNA, RIKEN full-length enriched library, clone: 4930558J22, full insert sequence, *Mus musculus* adult male tongue cDNA, RIKEN full-length enriched library, clone: 2310067E17, full insert sequence, germinal histone H4 gene, histone 4 protein |
| 426 | 20736 | AA946443 | x | | EST, Weakly similar to NPD1_HUMAN NEURAL PROLIFERATION DIFFERENTIATION AND CONTROL PROTEIN-1 PRECURSOR (NPDC-1 PROTEIN) [*H. sapiens*], expressed sequence AI314472, neural proliferation, differentiation and control gene 1, neural proliferation. differentiation and control, 1 |
| 427 | 21878 | AA946448 | r | | |
| 428 | 21947 | AA946451 | bb | | EST, Highly similar to AF151863 1 CGI 105 protein [*H. sapiens*] |
| 429 | 17499 | AA946467 | General | | |
| 430 | 1809 | AA946503 | x, General | | |
| 431 | 23360 | AA955104 | f | | |
| 432 | 23471 | AA955162 | General | | |
| 433 | 9452 | AA955206 | b, General | | |
| 434 | 23512 | AA955282 | General | | |
| 435 | 22596 | AA955298 | General | | |
| 436 | 23283 | AA955391 | h | | high density lipoprotein binding protein (vigilin) |
| 437 | 23546 | AA955393 | General | | |
| 438 | 12404 | AA955408 | b | | ESTs, Weakly similar to SX10 RAT TRANSCRIPTION FACTOR SOX-10 [*R. norvegicus*], SRY (sex determining region Y)-box 10, SRY (sex determining region Y)-box 9 (campomelic dysplasia, autosomal sex-reversal), SRY-box containing gene 10, expressed sequence AV220920 |
| 439 | 23626 | AA955540 | aa | | |
| 441 | 17540 | AA955914 | bb | | EST, Highly similar to FBRL MOUSE FIBRILLARIN [*M. musculus*], EST, Weakly similar to A38712 fibrillarin [*H. sapiens*], ESTs, Highly similar to A38712 fibrillarin [*H. sapiens*], ESTs, Weakly similar to FBRL MOUSE FIBRILLARIN [*M. musculus*], expressed sequence AL022665, fibrillarin |
| 442 | 24277 | AA955962 | General | | |
| 443 | 19939 | AA955980 | General | | |
| 444 | 24000 | AA956005 | i | | ESTs, Weakly similar to PCB3_MOUSE POLY(RC)-BINDING PROTEIN 3 (ALPHA-CP3) [*M. musculus*], ESTs, Weakly similar to ROK_HUMAN HETEROGENEOUS NUCLEAR RIBONUCLEOPROTEIN K [*R. norvegicus*], IGF-II mRNA-binding protein 3, RIKEN cDNA 2610101N11 gene, coding region determinant-binding protein, heterogeneous nuclear ribonucleoprotein K, poly(rC)-binding protein 3, poly(rC)-binding protein 4 |
| 445 | 11050 | AA956164 | s, v | | EST, Weakly similar to T-COMPLEX PROTEIN 1, EPSILON SUBUNIT [*M. musculus*], ESTs, Moderately similar to T-COMPLEX PROTEIN 1, EPSILON SUBUNIT [*M. musculus*], T-complex 1, chaperonin containing TCP1, subunit 5 (epsilon), chaperonin |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| | | | | | subunit 5 (epsilon), expressed sequence AI528772, t-complex 1, t-complex protein 1 |
| 446 | 498 | AA956278 | a, General | | |
| 447 | 23409 | AA956294 | q | | |
| 449 | 23773 | AA956476 | f, x | | |
| 450 | 23799 | AA956530 | d | | |
| 451 | 23800 | AA956534 | aa | | ESTs, Weakly similar to RNG1_HUMAN RING1 PROTEIN [*H. sapiens*], ring finger protein 1, ring finger protein 2 |
| 452 | 23834 | AA956659 | cc, General | | |
| 453 | 16425 | AA956688 | f, x | | gene rich cluster, C8 gene, hypothetical protein MGC2577 |
| 454 | 23847 | AA956723 | s | | |
| 455 | 23852 | AA956746 | j, l, m, z | | ESTs, Weakly similar to CHD4_HUMAN CHROMODOMAIN HELICASE-DNA-BINDING PROTEIN 4 [*H. sapiens*], KIAA1416 protein, KIAA1696 protein, chromodomain helicase DNA binding protein 4 |
| 456 | 5989 | AA956907 | g, s | | DnaJ (Hsp40) homolog, subfamily C, member 8, *Homo sapiens* mRNA; cDNA DKFZp434C2016 (from clone DKFZp434C2016), eukaryotic translation initiation factor 3, eukaryotic translation initiation factor 3, subunit 10 (theta, 150/170 kD), expressed sequence C85189, guanylate kinase membrane-associated inverted 1, hypothetical protein DKFZp434B227, nasopharyngeal epithelium specific protein 1 |
| 456 | 5990 | AA956907 | General | | DnaJ (Hsp40) homolog, subfamily C, member 8, *Homo sapiens* mRNA, cDNA DKFZp434C2016 (from clone DKFZp434C2016), eukaryotic translation initiation factor 3, eukaryotic translation initiation factor 3, subunit 10 (theta, 150/170 kD), expressed sequence C85189, guanylate kinase membrane-associated inverted 1, hypothetical protein DKFZp434B227, nasopharyngeal epithelium specific protein 1 |
| 457 | 23957 | AA957123 | u, General | | X-linked protein, brain expressed, X-linked 1, hypothetical protein FLJ10097, nerve growth factor receptor (TNFRSF16) associated protein 1 |
| 458 | 22357 | AA957264 | General | | EST, Weakly similar to T12456 hypothetical protein DKFZp564M2423 1 [*H. sapiens*], ESTs, Highly similar to T12456 hypothetical protein DKFZp564M2423.1 [*H. sapiens*], PAI-1 mRNA-binding protein, intracellular hyaluronan-binding protein |
| 459 | 23314 | AA957270 | g, l, m, p, v, cc, General | | |
| 460 | 23995 | AA957292 | a, b | | |
| 461 | 2702 | AA957307 | General | | EST, Moderately similar to G01026 serine - tRNA ligase [*H. sapiens*], hypothetical protein FLJ20450, seryl-tRNA synthetase, uncharacterized gastric protein YC12P |
| 462 | 24040 | AA957422 | c | | CD3 antigen, zeta polypeptide, CD3Z antigen, zeta polypeptide (TIT3 complex), Fc fragment of IgE, high affinity I, receptor for; gamma polypeptide, Fc receptor, IgE, high |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 463 | 12478 | AA957554 | m | | affinity I, gamma polypeptide, expressed sequence AI573376 EST, Weakly similar to S01696 gene P3 protein [*H. sapiens*], ESTs, Highly similar to P3 PROTEIN [*M. musculus*], Protein P3 |
| 464 | 21306 | AA957811 | v | | |
| 465 | 24183 | AA957889 | t | | |
| 466 | 24178 | AA957905 | d | | |
| 467 | 17034 | AA963071 | e | | EST, Moderately similar to COPE_HUMAN COATOMER EPSILON SUBUNIT [*H. sapiens*], ESTs, Highly similar to COPE_HUMAN COATOMER EPSILON SUBUNIT [*H. sapiens*], coatomer protein complex, subunit epsilon, hypothetical protein FLJ13241 |
| 468 | 24053 | AA963092 | General | | X-linked protein, brain expressed, X-linked 1, hypothetical protein FLJ10097, nerve growth factor receptor (TNFRSF16) associated protein 1 |
| 469 | 2767 | AA963201 | o | | |
| 470 | 2022 | AA963259 | g | | |
| 471 | 2126 | AA963488 | d | | |
| 472 | 24246 | AA963703 | b | | |
| 473 | 2195 | AA963746 | General | | |
| 474 | 19370 | AA963797 | i | | |
| 475 | 2282 | AA964147 | e | | |
| 476 | 2284 | AA964152 | x | | |
| 478 | 2350 | AA964368 | g, General | | ubiquitin specific protease 14 (tRNA-guanine transglycosylase) |
| 479 | 18830 | AA964496 | aa | | ESTs, Weakly similar to A29861 actin gamma [*H. sapiens*], ESTs, Weakly similar to I39393 alpha-actin [*H. sapiens*], ESTs, Weakly similar to S38782 actin beta' chain [*H. sapiens*], *Homo sapiens* mRNA; cDNA DKFZp434B2115 (from clone DKFZp434B2115), RIKEN cDNA 1700052K15 gene, RIKEN cDNA 1700061J02 gene, actin-like 7a, expressed sequence AL023024, expressed sequence AV259599, melanoma X-actin, uncharacterized hypothalamus protein HARP11 |
| 480 | 2392 | AA964541 | b | | |
| 481 | 2395 | AA964554 | General | | |
| 482 | 2410 | AA964589 | i, aa | | |
| 483 | 19145 | AA964613 | t | | |
| 484 | 2424 | AA964617 | g | | |
| 485 | 3107 | AA964687 | General | | |
| 486 | 2457 | AA964752 | q, t | | |
| 487 | 6778 | AA964763 | b | | |
| 489 | 2468 | AA964807 | l | | |
| 490 | 2469 | AA964814 | w | glutamate-cysteine ligase, modifier subunit, glutamate cysteine ligase, modifier subunit | ESTs, Highly similar to GSH0_HUMAN GLUTAMATE - CYSTEINE LIGASE REGULATORY SUBUNIT [*H. sapiens*], glutamate-cysteine ligase, modifier subunit, glutamate-cysteine ligase, modifier subunit |
| 491 | 12561 | AA964815 | General | | |
| 492 | 2326 | AA964892 | aa | | EST, Weakly similar to PROCOLLAGEN ALPHA 1(IV) CHAIN PRECURSOR [*M. musculus*], collagen, type IV, alpha 1, procollagen, type IV, alpha 1, procollagen, type IV, alpha 3, procollagen, type IV, alpha 5 |
| 493 | 21339 | AA964962 | General | | ATP-binding cassette, sub-family A (ABC1), member 1, ATP-binding cassette, sub-family A (ABC1), member 12, ATP-binding cassette, sub-family A (ABC1), member 7, EST, |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 494 | 21390 | AA964988 | General | | Moderately similar to ABC1_HUMAN ATP-BINDING CASSETTE, SUB-FAMILY A, MEMBER 1 [*H. sapiens*], EST, Weakly similar to ABC1 MOUSE ATP-BINDING CASSETTE, SUB-FAMILY A, MEMBER 1 [*M. musculus*], RIKEN cDNA 1810036E22 gene |
| 495 | 12569 | AA965023 | g | | |
| 496 | 2583 | AA965166 | bb | | *Homo sapiens*, clone MGC: 8857 IMAGE 3866266, mRNA, complete cds, inorganic pyrophosphatase, pyrophosphatase (inorganic) |
| 497 | 15885 | AA965207 | r | | EST, Highly similar to T14795 hypothetical protein DKFZp434E171.1 [*H. sapiens*] |
| 499 | 2905 | AA996727 | b, l, m, u, General | | |
| 500 | 2915 | AA996782 | u, bb | | ESTs, Moderately similar to LAMIN B3 [*M. musculus*], hypothetical protein MGC2721, lamin B1, lamin B2 |
| 501 | 2920 | AA996813 | d | | |
| 502 | 19525 | AA996856 | aa, General | | |
| 503 | 2984 | AA997015 | c | | |
| 504 | 2986 | AA997028 | General | | |
| 505 | 3145 | AA997237 | General | | |
| 506 | 19249 | AA997342 | m | | |
| 507 | 16883 | AA997345 | General | | |
| 508 | 12598 | AA997362 | s | | methylene tetrahydrofolate dehydrogenase (NAD+ dependent), methenyltetrahydrofolate cyclohydrolase, protease, serine, 15 |
| 509 | 3470 | AA997374 | p | | EST, Weakly similar to LIS1 MOUSE PLATELET-ACTIVATING FACTOR ACETYLHYDROLASE IB ALPHA SUBUNIT [*R. norvegicus*], ESTs, Weakly similar to LIS1 MOUSE PLATELET-ACTIVATING FACTOR ACETYLHYDROLASE IB ALPHA SUBUNIT [*R. norvegicus*], WD repeat domain 3, f-box and WD-40 domain protein 2, hypothetical protein MGC2655, platelet-activating factor acetylhydrolase beta subunit (PAF-AH beta), platelet-activating factor acetylhydrolase, isoform 1b, beta 1 subunit, platelet-activating factor acetylhydrolase, isoform lb, alpha subunit (45 kD) |
| 510 | 3180 | AA997425 | t | | |
| 511 | 3245 | AA997608 | General | | EST, Weakly similar to PLASMINOGEN ACTIVATOR INHIBITOR-2, TYPE A [*R. norvegicus*], expressed sequence AI876477, expressed sequence C76171, plasminogen activator inhibitor 2 type A, serine (or cysteine) proteinase inhibitor, clade B (ovalbumin), member 2, serine (or cysteine) proteinase inhibitor, clade B (ovalbumin), member 6, serine protease inhibitor 12 |
| 512 | 3020 | AA997656 | t | | |
| 513 | 3269 | AA997800 | x, aa | | *Homo sapiens*, clone IMAGE: 4810400, mRNA, antigen identified by monoclonal antibody Ki 67 |
| 514 | 3288 | AA997877 | f | | |
| 515 | 23992 | AA998164 | k, x | | DNA segment, Chr 4, ERATO Doi 639, expressed, EST, Moderately similar to CGB2 MOUSE G2/MITOTIC-SPECIFIC CYCLIN B2 [*M. musculus*], ESTs, Weakly similar to CGB1_HUMAN G2/MITOTIC-SPECIFIC CYCLIN B [*H. sapiens*], cyclin B1 |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 516 | 17470 | AA998264 | b | | biliverdin reductase B (flavin reductase (NADPH)) |
| 517 | 3773 | AA998356 | General | | B-cell CLL/lymphoma 3, molecule possessing ankyrin repeats induced by lipopolysaccharide (MAIL), homolog of mouse, nuclear factor of kappa light polypeptide gene enhancer in B-cells inhibitor, epsilon |
| 518 | 19623 | AA998422 | General | | |
| 519 | 3572 | AA998516 | x | | ESTs, Weakly similar to G2/MITOTIC-SPECIFIC CYCLIN B1 [*R. norvegicus*], cyclin A2, cyclin B1, cyclin B1, related sequence 1, cyclin B2 |
| 520 | 2782 | AA998565 | c | | cyclin-dependent kinase inhibitor 1C (P57), cyclin-dependent kinase inhibitor 1C (p57, Kip2) |
| 521 | 26119 | AA998576 | l, r, w, General | | |
| 522 | 22737 | AA998660 | aa | | |
| 523 | 3696 | AA999030 | e | | |
| 524 | 3079 | AA999169 | k, x, General | | |
| 525 | 3081 | AA999171 | e, p, r | signal transducer and activator of transcription 1, signal transducer and activator of transcription 1, 91 kD | Signal transducer and activator of transcription 3, expressed sequence AA408197, signal transducer and activator of transcription 1, signal transducer and activator of transcription 1, 91 kD, signal transducer and activator of transcription 2, signal transducer and activator of transcription 3, signal transducer and activator of transcription 3 (acute-phase response factor), signal transducer and activator of transcription 4 |
| 526 | 3082 | AA999172 | General | | ESTs, Moderately similar to A54847 GMP synthase [*H. sapiens*], guanine monphosphate synthetase |
| 527 | 17337 | AB000717 | k | | |
| 528 | 1535 | AB000778 | a | | phospholipase D1, phophatidylcholine-specific, phospholipase D2 |
| 529 | 1382 | AB002406 | k | RuvB (*E. coli* homolog)-like 1, RuvB-like protein 1 | Homer, neuronal immediate early gene, 1B, Homer, neuronal immediate early gene, 2, homer, neuronal immediate early gene, 1, homer, neuronal immediate early gene, 2 |
| 530 | 20184 | AB003753 | d | | |
| 531 | 4312 | AB010635 | c, i, j, k, y, z | | EST, Weakly similar to JC5408 carboxylesterase [*H. sapiens*], ESTs, Moderately similar to ES22 MOUSE LIVER CARBOXYLESTERASE 22 PRECURSOR [*M. musculus*], ESTs, Weakly similar to A48809 carboxylesterase [*H. sapiens*], ESTs, Weakly similar to JC5408 carboxylesterase [*H. sapiens*], T-complex expressed gene 5, carboxylesterase 1, carboxylesterase 2 (intestine, liver), carboxylesterase 3, carboxylesterase 3 (brain), hypothetical protein FLJ21736 |
| 532 | 21666 | AB012214 | k | | DNA (cytosine-5-)-methyltransferase 1, DNA (cytosine-5-)-methyltransferase 2, DNA methyltransferase (cytosine-5) 1, EST, Weakly similar to JE0378 DNA [*R. norvegicus*], *Mus musculus* DNA cytosine methyltransferase mRNA, f-box and leucine-rich repeat protein 11, protein containing CXXC domain 2 |
| 533 | 15772 | AB015645 | g | | *Mus musculus* mouse-thyrotropin-releasing hormone receptor 2 (TRH-R2) mRNA, complete cds, thyrotropin releasing hormone receptor, thyrotropin-releasing hormone receptor |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 534 | 1183 | AF013144 | h | | ESTs, Weakly similar to DUS8_HUMAN DUAL SPECIFICITY PROTEIN PHOSPHATASE 8 [*H. sapiens*], Human DNA sequence from clone RP11-243J16 on chromosome 20 Contains parts of 2 isoforms of the BCL2L1 (BCL2-like 1) gene, the gene for a novel protein (FLS353), the gene for a protein similar to MYLK (myosin, light polypeptide kinase), the FKHL18 (forkhead (Drosophila)-like 18) gene, part of three novel genes, ESTs, STSs, GSSs and CpG islands, KIAA1725 protein, dual specificity phosphatase 13, dual specificity phosphatase 14, dual specificity phosphatase 5, expressed sequence BB104621, expressed sequence C79103, protein tyrosine phosphatase, non-receptor type 16 |
| 535 | 1582 | AF015911 | h, z | | B-cell CLL/lymphoma 6, member B (zinc finger protein), ESTs, Moderately similar to zinc finger protein [*H. sapiens*], Homo sapiens, Similar to RIKEN cDNA 0610020I02 gene, clone MGC: 23427 IMAGE: 4654320, mRNA, complete cds |
| 536 | 11483 | AF020618 | u, cc, General | | |
| 537 | 20295 | AF024712 | aa | | HLA-G histocompatibility antigen, class I, G |
| 538 | 19077 | AF030358 | y, z | | hypothetical protein, clone 1-53, small inducible cytokine subfamily D (Cys-X3 Cys), member 1 (fractalkine, neurotactin), small inducible cytokine subfamily D, 1 |
| 539 | 23044 | AF034218 | General | | RIKEN cDNA 4632428M18 gene, hyaluronidase 1, hyaluronidase 2, hyaluronoglucosaminidase 1, hyaluronoglucosaminidase 2, hyaluronoglucosaminidase 3, sperm adhesion molecule |
| 540 | 25178 | AF035955 | d | | |
| 541 | 1564 | AF035963 | x, bb, General | | ESTs, Moderately similar to hepatitis A virus cellular receptor 1 [*H. sapiens*], ESTs, Moderately similar to kidney injury molecule-1 [*R. norvegicus*], ESTs, Weakly similar to kidney injury molecule-1 [*R. norvegicus*] |
| 542 | 8426 | AF036335 | f | | ESTs, Moderately similar to NR54_HUMAN 54 KDA NUCLEAR RNA-BINDING PROTEIN [*H. sapiens*], ESTs, Moderately similar to p54nrb [*H. sapiens*], ESTs, Weakly similar to A54691 octamer-binding protein NonO - mouse [*M. musculus*], ESTs, Weakly similar to PSF_HUMAN PTB-ASSOCIATED SPLICING FACTOR [*H. sapiens*], RIKEN cDNA 5730470C09 gene, RIKEN cDNA 9030402K04 gene, non-POU-domain-containing, octamer-binding protein |
| 543 | 21817 | AF036537 | k | | ESTs, Highly similar to A55318 serine/threonine protein kinase [*M. musculus*], ESTs, Weakly similar to RIP MOUSE SERINE/THREONINE PROTEIN KINASE RIP [*M. musculus*], Human DNA sequence from clone RP5-1182A14 on chromosome 1 Contains part of a gene similar to rat Espin, a pseudogene similar to KIAA0454, a gene similar to MST1 (macrophage stimulating 1 (hepatocyte |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| | | | | | growth factor-like)), a pseudogene similar to KIAA0445, two isoforms of a novel gene (isoform 2 is the gene for KIAA1245 protein), ESTs, STSs, GSSs and CpG islands, ankyrin repeat domain 3, cerebral cavernous malformations 1, mitogen activated protein kinase kinase kinase 12, mitogen-activated protein kinase kinase kinase 12, receptor (TNFRSF)-interacting serine-threonine kinase 1, receptor interacting protein 3, receptor-interacting serine-threonine kinase 2 |
| 544 | 21145 | AF038571 | General | solute carrier family 1 (neuronal/epithelial high affinity glutamate transporter, system Xag), member 1, solute carrier family 1, member 1 | |
| 545 | 22602 | AF044574 | General | | 2,4-dienoyl CoA reductase 1, mitochondrial, 2,4-dienoyl CoA reductase 2, peroxisomal, 2-4-dienoyl-Coenzyme A reductase 2, peroxisomal, ESTs, Weakly similar to S11021 2,4-dienoyl-CoA reductase [*R. norvegicus*], *Homo sapiens* AS10 protein mRNA, partial cds, RIKEN cDNA 1200012F07 gene, RIKEN cDNA 2400003B18 gene, hydroxyprostaglandin dehydrogenase 15 (NAD), hydroxysteroid (17-beta) dehydrogenase 10, peroxisomal trans 2-enoyl CoA reductase; putative short chain alcohol dehydrogenase |
| 546 | 13464 | AF047707 | h | | UDP-glucose ceramide glucosyltransferase |
| 547 | 24024 | AF052695 | x | | |
| 548 | 12259 | AF061266 | h | | EST, Highly similar to JC5807 trp3 protein - rat [*R. norvegicus*], EST, Weakly similar to TRP1_MOUSE TRANSIENT RECEPTOR POTENTIAL CHANNEL 1 (TRANSIENT RECEPTOR PROTEIN 1) (MTRP1) (TRP-RELATED PROTEIN 1) [*M. musculus*], transient receptor potential channel 1, transient receptor protein 1, transient receptor protein 3, transient receptor protein 4, transient receptor protein 5 |
| 549 | 4589 | AF062389 | y, z | | EST, Highly similar to A61209 hypertension-associated protein SA - rat [*R. norvegicus*], ESTs, Highly similar to A61209 hypertension-associated protein SA - rat [*R. norvegicus*], ESTs, Weakly similar to I54401 hypertension-associated protein SA [*H. sapiens*], KIAA1504 protein, SA (rat hypertension-associated) homolog, SA rat hypertension-associated homolog, expressed sequence AI788978, hypothetical protein FLJ20581, medium-chain acyl-CoA synthetase, solute carrier family 27 (fatty acid transporter), member 1, solute carrier family 27 (fatty acid transporter), member 4 |
| 550 | 16007 | AF062594 | t | nucleosome assembly protein 1-like 1 | ESTs, Highly similar to 2008109A set gene [*R. norvegicus*], ESTs, Highly similar to SET_HUMAN SET PROTEIN [*H. sapiens*], SET translocation, SET translocation (myeloid leukemia-associated), nucleosome assembly |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| | | | | | protein 1-like 1, nucleosome assembly protein 1-like 2, nucleosome assembly protein 1-like 4 |
| 551 | 15761 | AF062741 | u | | KIAA1348 protein, protein phosphatase 1G (formerly 2C), magnesium-dependent, gamma isoform |
| 552 | 17426 | AF073839 | p | | |
| 553 | 18615 | AF074608 | s | | |
| 554 | 15797 | AF084205 | f | | ESTs, Moderately similar to T17365 serine/threonine protein kinase TAO1 - rat [*R. norvegicus*], ESTs, Weakly similar to ST25_MOUSE SERINE/THREONINE PROTEIN KINASE 25 (STERILE 20/OXIDANT STRESS-RESPONSE KINASE 1) (STE20/OXIDANT STRESS RESPONSE KINASE-1) (SOK-1) (STE20-LIKE KINASE) [*M. musculus*], KIAA1361 protein, STE20-like kinase, expressed sequence AU020252, prostate derived STE20-like kinase PSK, serine/threonine kinase 10, thousand and one amino acid protein kinase |
| 555 | 12932 | AF102552 | s | | ESTs, Moderately similar to A55575 ankyrin 3, long splice form [*H. sapiens*], RIKEN cDNA 2310026G15 gene, RIKEN cDNA 2410004E01 gene, RIKEN cDNA 2410197A17 gene, RIKEN cDNA 4933400N19 gene, RIKEN cDNA 8430401K06 gene, RIKEN cDNA C430011H06 gene, ankyrin 3, node of Ranvier (ankyrin G), hypothetical protein FLJ20189, phospholipase A2, group VI, phospholipase A2, group VI (cytosolic, calcium-independent), proteasome (prosome, macropain) 26S subunit, non-ATPase, 10 |
| 556 | 18603 | AI007649 | x | | EST, Moderately similar to A49013 tumor cell suppression protein HTS1 [*H. sapiens*], KIAA1277 protein, hypothetical protein FLJ22457, suppression of tumorigenicity 5 |
| 557 | 22733 | AI007668 | r | | |
| 558 | 22746 | AI007672 | r | | |
| 559 | 24109 | AI007725 | General | | |
| 560 | 15848 | AI007820 | n, v | | EST, Highly similar to HS9B RAT HEAT SHOCK PROTEIN HSP 90-BETA [*R. norvegicus*], EST, Weakly similar to HHMS84 heat shock protein 84 - mouse [*M. musculus*], ESTs, Highly similar to T46243 hypothetical protein DKFZp761K0511.1 [*H. sapiens*], expressed sequence AL022974, expressed sequence C81438, heat shock 90 kD protein 1, beta, heat shock protein, 84 kDa 1 |
| 561 | 10108 | AI007857 | f | | HGF-regulated tyrosine kinase substrate, *Homo sapiens* cDNA FLJ13428 fis, clone PLACE1002493, highly similar to *Homo sapiens* signal transducing adaptor molecule 2A (STAM2) mRNA, Mouse 31-kDa proline-rich salivary protein, complete cds of clone pUMP125, *Mus musculus*, Similar to proline-rich protein BstNI subfamily 2, clone MGC: 18611 IMAGE 4165240, mRNA, complete cds, RIKEN cDNA 1700120F24 gene, RIKEN cDNA 4930406E12 gene, *Rattus norvegicus* proline-rich |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| | | | | | proteoglycan (PRPG2) mRNA, complete cds, proline-rich protein HaeIII subfamily 2, signal transducing adaptor molecule (SH3 domain and ITAM motif) 2 |
| 562 | 6804 | AI007877 | General | | |
| 563 | 20099 | AI007893 | f, u | | |
| 564 | 11368 | AI007948 | d | | |
| 565 | 15849 | AI008074 | h | | EST, Highly similar to HS9B RAT HEAT SHOCK PROTEIN HSP 90-BETA [*R. norvegicus*], EST, Weakly similar to HHMS84 heat shock protein 84 - mouse [*M. musculus*], ESTs, Highly similar to T46243 hypothetical protein DKFZp761K0511.1 [*H. sapiens*], expressed sequence AL022974, expressed sequence C81438, heat shock 90 kD protein 1, beta, heat shock protein, 84 kDa 1 |
| 566 | 3121 | AI008160 | General | | CGI-83 protein |
| 567 | 16646 | AI008190 | t | | EST, Highly similar to JC7290 guanine nucleotide binding protein G gamma 2 chain [*H. sapiens*], EST, Weakly similar to GBG9 RAT GUANINE NUCLEOTIDE-BINDING PROTEIN G(I)/G(S)/G(O) GAMMA-9 SUBUNIT [*M. musculus*], EST, Weakly similar to JC7290 guanine nucleotide binding protein G gamma 2 chain [*H. sapiens*], RIKEN cDNA 1110003P13 gene, guanine nucleotide binding protein (G protein), gamma 12, guanine nucleotide binding protein (G protein), gamma 2, guanine nucleotide binding protein (G protein), gamma 2 subunit, guanine nucleotide binding protein (G protein), gamma 3 subunit, guanine nucleotide binding protein (G protein), gamma 4 subunit, guanine nucleotide binding protein 4 |
| 568 | 12683 | AI008203 | x | | EST, Moderately similar to CGB2 MOUSE G2/MITOTIC-SPECIFIC CYCLIN B2 [*M. musculus*], ESTs, Weakly similar to G2/MITOTIC-SPECIFIC CYCLIN B1 [*R. norvegicus*], *Homo sapiens* cDNA FLJ13342 fis, clone OVARC1001950, cyclin A1, cyclin B1, cyclin B1, related sequence 1, cyclin B2 |
| 569 | 22018 | AI008309 | b | | ESTs, Highly similar to PROTO-ONCOGENE SERINE/THREONINE-PROTEIN KINASE PIM-1 [*M. musculus*], ESTs, Highly similar to S55333 protein kinase pim-2 [*M. musculus*], ESTs, Moderately similar to S55333 protein kinase pim-2 [*M. musculus*], Pim-1 oncogene, pim-1 oncogene, pim-2 oncogene, proviral integration site 1, serine threonine kinase pim3 |
| 570 | 23917 | AI008441 | n | | phosphogluconate dehydrogenase |
| 571 | 22599 | AI008458 | General | | |
| 572 | 22698 | AI008578 | p, General | | |
| 573 | 14405 | AI008579 | r, x | | |
| 574 | 4086 | AI008629 | x | | EST, Weakly similar to JH0446 75 K autoantigen [*H. sapiens*], polymyositis/scleroderma autoantigen 1 (75 kD) |
| 575 | 3808 | AI008643 | i, v, General | | DnaJ (Hsp40) homolog, subfamily B, member 1, DnaJ (Hsp40) homolog, subfamily B, member 12, DnaJ (Hsp40) homolog, subfamily B, member 4, DnaJ (Hsp40) homolog, |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| | | | | | subfamily B, member 5, ESTs, Weakly similar to HS4L__HUMAN HEAT SHOCK 40 KDA PROTEIN 1 HOMOLOG [*H. sapiens*], RIKEN cDNA 1700029A20 gene, RIKEN cDNA 2010306G19 gene |
| 576 | 3931 | AI008697 | l | | |
| 577 | 7785 | AI008758 | aa | dipeptidylpeptidase 4, dipeptidylpeptidase IV (CD26, adenosine deaminase complexing protein 2) | ESTs, Weakly similar to DPP4 MOUSE DIPEPTIDYL PEPTIDASE IV [*M. musculus*], ESTs, Weakly similar to DPP4 RAT DIPEPTIDYL PEPTIDASE IV [*R. norvegicus*], *Homo sapiens* chromosome 19, cosmid R26894, *Homo sapiens*, clone IMAGE: 3447394, mRNA, partial cds, RIKEN cDNA 4932434F09 gene, dipeptidylpeptidase 4, dipeptidylpeptidase 6, dipeptidylpeptidase 8, fibroblast activation protein, fibroblast activation protein, alpha |
| 578 | 16701 | AI008838 | q | | |
| 579 | 21789 | AI008930 | k | | EST, Moderately similar to CYSR RAT CYSTEINE-RICH PROTEIN 1 [*R. norvegicus*], ESTs, Weakly similar to S12658 cysteine-rich protein [*H. sapiens*], cysteine and glycine-rich protein 1, cysteine and glycine-rich protein 3 (cardiac LIM protein), cysteine rich protein, cysteine-rich protein 2, cysteine-rich protein 3, thymus LIM protein |
| 580 | 21895 | AI008971 | General | | |
| 581 | 410 | AI008974 | i, aa, General | | |
| 582 | 21632 | AI009167 | General | | BCL2-associated athanogene 2, ESTs, Highly similar to T08764 hypothetical protein DKFZp586C021.1 [*H. sapiens*] |
| 583 | 21596 | AI009168 | General | | |
| 584 | 22801 | AI009197 | General | | |
| 585 | 11876 | AI009321 | cc, General | | |
| 586 | 2506 | AI009341 | General | | |
| 587 | 6382 | AI009362 | General | | |
| 588 | 14370 | AI009427 | k | | EST, Weakly similar to PRCF__HUMAN PROTEASOME COMPONENT MECL-1 PRECURSOR [*H. sapiens*], ESTs, Weakly similar to PRCF__HUMAN PROTEASOME COMPONENT MECL-1 PRECURSOR [*H. sapiens*], proteasome (prosome, macropain) subunit, beta type 10, proteasome (prosome, macropain) subunit, beta type 7, proteasome (prosome, macropain) subunit, beta type, 10, proteasome (prosome, macropain) subunit, beta type, 7 |
| 589 | 19275 | AI009460 | x | | EST, Moderately similar to ABP2__HUMAN ENDOTHELIAL ACTIN-BINDING PROTEIN [*H. sapiens*], ESTs, Moderately similar to ABP2__HUMAN ENDOTHELIAL ACTIN-BINDING PROTEIN [*H. sapiens*], filamin A, alpha (actin-binding protein-280), filamin B, beta (actin-binding protein-278) |
| 590 | 4154 | AI009467 | g | | |
| 591 | 3464 | AI009589 | cc | | |
| 592 | 3926 | AI009592 | e | | |
| 593 | 19358 | AI009675 | c | | |
| 594 | 22545 | AI009747 | g | | |
| 595 | 15089 | AI009752 | cc, General | | |
| 596 | 5458 | AI009756 | h | programmed cell death 6 interacting protein, programmed cell death 6-interacting protein | EST, Moderately similar to T14756 hypothetical protein DKFZp564F0923.1 [*H. sapiens*], EST, Weakly similar to A28996 proline-rich |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| | | | | | protein M14 precursor - mouse [*M. musculus*], EST, Weakly similar to PRP4_HUMAN SALIVARY PROLINE-RICH PROTEIN PO PRECURSOR [*H. sapiens*], expressed sequence AI462446, poly(A)-binding protein, nuclear 1, proline rich protein, proline rich protein 2, proline-rich protein BstNI subfamily 4, protein tyrosine phosphatase, non-receptor type 23 |
| 597 | 6844 | AI009770 | e, r, cc | | |
| 598 | 15627 | AI009810 | aa | | EST AI317031, EST, Weakly similar to R3HU16 ribosomal protein S16, cytosolic [*H. sapiens*], expressed sequence AA420385, ribosomal protein S16 |
| 599 | 22619 | AI009825 | d | | |
| 600 | 7857 | AI009898 | j, l, m, z | | |
| 601 | 13259 | AI009946 | r | | |
| 602 | 21105 | AI010067 | General | | |
| 603 | 24627 | AI010102 | aa | testis enhanced gene transcript, testis enhanced gene transcript (BAX inhibitor 1) | CGI-119 protein, RIKEN cDNA 5031406P05 gene, testis enhanced gene transcript (BAX inhibitor 1) |
| 604 | 12716 | AI010178 | General | | CGI-100 protein |
| 605 | 18757 | AI010216 | aa | | |
| 606 | 2912 | AI010220 | aa, General | | RIKEN cDNA 6720456I16 gene, claudin 10, claudin 15, claudin 7 |
| 607 | 3316 | AI010237 | t | | |
| 608 | 15644 | AI010256 | General | | ESTs, Highly similar to HISTONE H3.3 [*R. norvegicus*], H3 histone, family 3A, H3 histone, family 3B, H3 histone, family 3B (H3.3B) |
| 609 | 657 | AI010262 | b | | colony stimulating factor 2 receptor, beta 1, low-affinity (granulocyte-macrophage), interleukin 4 receptor, interleukin 4 receptor, alpha |
| 610 | 3271 | AI010303 | b | | |
| 611 | 11081 | AI010407 | bb | | |
| 612 | 16521 | AI010470 | c, s, t, General | ceruloplasmin, ceruloplasmin (ferroxidase) | DNA segment, Chr 3, ERATO Doi 555, expressed, EST, Highly similar to 1012298A factor VIIIC [*H. sapiens*], ESTs, Weakly similar to CERU MOUSE CERULOPLASMIN PRECURSOR [*M. musculus*], ESTs, Weakly similar to CERU RAT CERULOPLASMIN PRECURSOR [*R. norvegicus*], ESTs, Weakly similar to KUHU ferroxidase [*H. sapiens*], Hermansky-Pudlak syndrome 3, ceruloplasmin, ceruloplasmin (ferroxidase), hephaestin |
| 613 | 6927 | AI010542 | General | | |
| 614 | 17524 | AI010568 | a, j, y, General | growth hormone receptor | growth hormone receptor |
| 615 | 6946 | AI010642 | n | | |
| 616 | 23509 | AI010962 | aa | | RIKEN cDNA 2510028H01 gene, sorting nexin 2, sorting nexin 3 |
| 617 | 6044 | AI011285 | t | | |
| 618 | 13855 | AI011361 | o | | |
| 619 | 21779 | AI011380 | cc | | |
| 621 | 12534 | AI011460 | cc | | |
| 622 | 12629 | AI011492 | e, f | | HYA22 protein, conserved gene amplified in osteosarcoma, nuclear LIM interactor-interacting factor |
| 623 | 735 | AI011560 | f | | *Homo sapiens*, Similar to RIKEN cDNA 2300002L21 gene, clone MGC: 17528 IMAGE: 3458906, mRNA, complete cds, RIKEN cDNA 2300002L21 gene, S100 calcium-binding protein A12 (calgranulin C), S100 calcium-binding protein, beta (neural), S100 protein, beta polypeptide, neural |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 624 | 3941 | AI011598 | General | | ESTs, Moderately similar to 2113291A laminin SUBUNIT, Usher syndrome 2A (autosomal recessive, mild) homolog (human), hypothetical protein, MGC: 8159, laminin, alpha 5 |
| 625 | 17550 | AI011607 | j, General | | butyrobetaine (gamma), 2-oxoglutarate dioxygenase (gamma-butyrobetaine hydroxylase) 1, epsilon-trimethyllysine hydroxylase |
| 626 | 10636 | AI011634 | e | | |
| 627 | 3995 | AI011678 | General | | |
| 628 | 16112 | AI011706 | h | | EST, Weakly similar to SPLICING FACTOR, ARGININE/SERINE-RICH 5 [*R. norvegicus*], *Mus musculus*, Similar to splicing factor, arginine/serine-rich 7 (35 kD), clone MGC: 6268 IMAGE: 2646366, mRNA, complete cds, neural-salient serine/arginine-rich, splicing factor, arginine/serine-rich 3, splicing factor, arginine/serine-rich 3 (SRp20), splicing factor, arginine/serine-rich 5, splicing factor, arginine/serine-rich 5 (SRp40, HRS) |
| 629 | 13354 | AI011757 | c | | Fc fragment of IgG, high affinity Ia, receptor for (CD64), Fc fragment of IgG, low affinity IIIa, receptor for (CD16), Fc fragment of IgG, low affinity IIIb, receptor for (CD16), Fc receptor, IgG, low affinity III, expressed sequence BB219290 |
| 630 | 12745 | AI011799 | cc | | |
| 631 | 18684 | AI011812 | t | | DKFZP564O123 protein, putative breast adenocarcinoma marker (32 kD) |
| 632 | 4205 | AI011982 | b | | |
| 633 | 6518 | AI012114 | General | | chromosome 1 open reading frame 25, hypothetical protein FLJ20244 |
| 634 | 17407 | AI012145 | General | | |
| 635 | 13093 | AI012177 | r | | FK506 binding protein 4 (59 kDa), FK506 binding protein 8 (38 kDa), FK506-binding protein 4 (59 kD), FK506-binding protein 6 (36 kD), FK506-binding protein like, RIKEN cDNA 2210019E14 gene |
| 636 | 15395 | AI012216 | f | | Fas-associated factor 1, ORF, RIKEN cDNA 2210404D11 gene, UBX domain containing 2, expressed sequence AA408698, expressed sequence AI196514, putative glialblastoma cell differentiation-related |
| 637 | 21796 | AI012221 | d, General | | EST X83352, ESTs, Highly similar to T17226 hypothetical protein DKFZp566G223.1 [*H. sapiens*], *Homo sapiens*, Similar to chloride intracellular channel 4, clone MGC: 8812 IMAGE: 3861372, mRNA, complete cds, RIKEN cDNA 5730531E12 gene, chloride intracellular channel 1, chloride intracellular channel 4, chloride intracellular channel 4 (mitochondrial), hypothetical protein DKFZp434N127, intracellular chloride ion channel protein p64H1 |
| 638 | 3981 | AI012235 | i, General | | |
| 639 | 6606 | AI012308 | i, r | | |
| 640 | 3417 | AI012337 | w | | ESTs, Weakly similar to NHPX RAT NHP2/RS6 FAMILY PROTEIN YEL026W HOMOLOG [*R. norvegicus*], RIKEN cDNA 2410130M07 gene, non-histone chromosome protein 2 (S cerevisiae)-like 1, nucleolar protein family A, member 2 (H/ACA small |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| | | | | | nucleolar RNPs), sperm specific antigen 1 |
| 641 | 24200 | AI012356 | b, t, General | | |
| 642 | 7471 | AI012379 | cc | | |
| 643 | 7247 | AI012438 | g | | |
| 644 | 7127 | AI012464 | p, General | | |
| 645 | 3304 | AI012471 | b | | |
| 646 | 2311 | AI012485 | aa | | |
| 647 | 20817 | AI012589 | g, n, q | | |
| 648 | 3493 | AI012590 | v, General | | |
| 649 | 8975 | AI012613 | General | | |
| 650 | 11335 | AI012619 | j | | |
| 651 | 21409 | AI012637 | General | | |
| 652 | 8015 | AI012638 | aa | | |
| 653 | 8476 | AI012647 | w | | EST, Weakly similar to S33710 ribosomal protein S20, cytosolic [*H. sapiens*], *Mus musculus*, Similar to ribosomal protein S20, clone MGC: 6876 IMAGE: 2651405, mRNA, complete cds, expressed sequence AL024076 |
| 654 | 4232 | AI012958 | e, p, General | | |
| 655 | 23128 | AI013011 | General | | |
| 656 | 20086 | AI013260 | General | | |
| 657 | 11969 | AI013273 | k | | ESTs, Highly similar to A26061 glia-derived neurite promoting factor precursor [*H. sapiens*], ESTs, Highly similar to A27496 glia-derived nexin I alpha precursor [*H. sapiens*], ESTs, Weakly similar to GLIA DERIVED NEXIN PRECURSOR [*R. norvegicus*], serine (or cysteine) proteinase inhibitor, clade E (nexin, plasminogen activator inhibitor type 1), member 2, serine (or cysteine) proteinase inhibitor, clade I (neuroserpin), member 1 |
| 658 | 26147 | AI013387 | aa | | |
| 659 | 8815 | AI013437 | p | | |
| 660 | 19722 | AI013508 | k | | |
| 661 | 6674 | AI013568 | General | | |
| 662 | 23145 | AI013647 | o, t | | |
| 663 | 15130 | AI013676 | w | | |
| 664 | 7274 | AI013715 | aa | | Bone morphogenetic protein 6, bone morphogenetic protein 5, bone morphogenetic protein 6, bone morphogenetic protein 7, bone morphogenetic protein 7 (osteogenic protein 1), growth differentiation factor 15 |
| 665 | 7276 | AI013730 | e | | |
| 666 | 7278 | AI013738 | y, z, aa | | |
| 667 | 22592 | AI013740 | s, x, bb, General | | ESTs, Weakly similar to S32567 A4 protein [*H. sapiens*], *Homo sapiens*, Similar to RIKEN cDNA 2900052H21 gene, clone MGC. 21625 IMAGE: 4214683, mRNA, complete cds, *Homo sapiens*, clone MGC. 19762 IMAGE: 3636045, mRNA, complete cds, proteolipid protein 2 (colonic epithelium-enriched) |
| 668 | 16584 | AI013765 | w | | *Mus musculus* retinal cone arrestin 3 (Arr3) mRNA, complete cds, RIKEN cDNA 1200006I17 gene, arrestin, beta 2, expressed sequence AI326910, retinal S-antigen |
| 669 | 24143 | AI013804 | j, l | | |
| 670 | 15928 | AI013829 | a, General | | |
| 671 | 21950 | AI013861 | j | | 3-hydroxyisobutyrate dehydrogenase, ESTs, Highly similar to D3HL_HUMAN 3-HYDROXYISOBUTYRATE DEHYDROGENASE, MITOCHONDRIAL PRECURSOR |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| | | | | | (HIBADH) [*H. sapiens*], cytokine-like nuclear factor n-pac |
| 672 | 3260 | AI013875 | t | | |
| 673 | 2708 | AI013882 | d, q | | |
| 674 | 8585 | AI013886 | i | | |
| 675 | 7299 | AI013911 | p, r, t, General | | *H. sapiens* PABII pseudogene, Human DNA sequence from PAC 560B9 on chromosome 1q24-1q25. Contains profilin-like pseudogene, 60S ribosomal protein L4 pseudogene RNA binding protein, ESTs, GSS, *Mus musculus* adult male tongue cDNA, RIKEN full-length enriched library, clone: 2310074E15, full insert sequence, RNA binding motif protein 3, RNA binding motif protein, X chromosome, RNA binding motif protein, X chromosome retrogene, cold inducible RNA-binding protein, testes-specific heterogenous nuclear ribonucleoprotein G-T |
| 676 | 15904 | AI013971 | General | | |
| 677 | 12781 | AI014023 | w | | EST, Moderately similar to Y124__HUMAN HYPOTHETICAL PROTEIN KIAA0124 [*H. sapiens*], block of proliferation 1 |
| 678 | 19372 | AI014135 | aa | beta-carotene 15, 15'-dioxygenase, beta-carotene 15, 15'-dioxygenase | EST, Moderately similar to 0806162D protein COII [*M. musculus*], EST, Weakly similar to 810024D cytochrome oxidase II [*H. sapiens*] |
| 679 | 4241 | AI014140 | w | | DKFZP564A2416 protein, EST, Moderately similar to T14738 hypothetical protein DKFZp564A2416 1 [*H. sapiens*], *Homo sapiens* cDNA FLJ14138 fis, clone MAMMA1002765, hypothetical protein FLJ13117 |
| 680 | 15247 | AI014169 | c, u | | *Homo sapiens* cDNA: FLJ22783 fis, clone KAIA1993, *Homo sapiens* mRNA; cDNA DKFZp434B102 (from clone DKFZp434B102), KIAA1376 protein, expressed sequence AV216361, upregulated by 1, 25-dihydroxyvitamin D-3 |
| 681 | 7315 | AI028831 | n | | ESTs, Highly similar to JE0363 mitogen-activated protein kinase kinase kinase [*H. sapiens*], mitogen activated protein kinase kinase kinase 5, mitogen-activated protein kinase kinase kinase 6 |
| 682 | 16631 | AI028856 | General | | |
| 683 | 23297 | AI028953 | x | | ESTs, Moderately similar to RUXG__HUMAN SMALL NUCLEAR RIBONUCLEOPROTEIN G [*H. sapiens*], small nuclear ribonucleoprotein polypeptide G |
| 684 | 11326 | AI029015 | b | | |
| 685 | 2866 | AI029058 | n, y | | |
| 686 | 12812 | AI029126 | General | | |
| 687 | 17602 | AI029156 | p | | |
| 688 | 7392 | AI029185 | aa | | |
| 689 | 6517 | AI029264 | d, k, x | | |
| 690 | 7639 | AI029292 | b | | |
| 691 | 3874 | AI029428 | i, General | | ESTs, Moderately similar to CB80__HUMAN 80 KDA NUCLEAR CAP BINDING PROTEIN [*H. sapiens*], *Homo sapiens* cDNA FLJ11599 fis, clone HEMBA1003879, nuclear cap binding protein subunit 1, 80 kD |
| 692 | 12819 | AI029437 | f | | |
| 693 | 7452 | AI029466 | r | | |
| 694 | 7493 | AI029608 | b | | |
| 696 | 7537 | AI029829 | o, General | | |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 697 | 2310 | AI029969 | v | | |
| 698 | 7585 | AI030023 | x | | |
| 699 | 7586 | AI030024 | b, n | | |
| 700 | 14492 | AI030091 | cc | | |
| 701 | 10673 | AI030134 | f | | EST, Weakly similar to 1605244A erythrocyte ankyrin [*H. sapiens*], ESTs, Weakly similar to S68418 protein phosphatase 1M chain M110 isoform - rat [*R. norvegicus*], Human DNA sequence from clone RP11-196N14 on chromosome 20 Contains ESTs, STSs, GSSs and CpG islands. Contains three novel genes, part of a gene for a novel protein similar to protein serine/threonine phosphatase 4 regulatory subunit 1 (PP4R1) and a gene for a novel protein with an ankyrin domain, RIKEN cDNA 1110058D09 gene, RIKEN cDNA 1600009D24 gene, RIKEN cDNA 4930539L19 gene, expressed sequence AA408090, hypothetical protein MGC5540, leukocyte receptor cluster (LRC) member 3, myosin phosphatase, target subunit 1, protein phosphatase 1, regulatory (inhibitor) subunit 12A, testis-specific ankyrin motif containing protein |
| 702 | 7615 | AI030163 | o, r | | |
| 703 | 2370 | AI030179 | General | | |
| 704 | 7681 | AI030449 | n | | |
| 705 | 11559 | AI030472 | General | | |
| 706 | 7665 | AI030668 | t, bb | nucleosome assembly protein 1-like 1 | ESTs, Highly similar to 2008109A set gene [*R. norvegicus*], ESTs, Highly similar to SET_HUMAN SET PROTEIN [*H. sapiens*], SET translocation, SET translocation (myeloid leukemia-associated), nucleosome assembly protein 1-like 1, nucleosome assembly protein 1-like 2, nucleosome assembly protein 1-like 4 |
| 707 | 24222 | AI030704 | k | | |
| 708 | 10740 | AI030743 | h | | |
| 709 | 10742 | AI030773 | e | | |
| 711 | 16169 | AI030932 | General | | RIKEN cDNA 1300012C15 gene, RIKEN cDNA 2310076L09 gene, adipose differentiation related protein, adipose differentiation-related protein |
| 712 | 19527 | AI030991 | f | | |
| 713 | 22614 | AI031004 | r | | |
| 714 | 3167 | AI031012 | e | | ClpP (caseinolytic protease, ATP-dependent, proteolytic subunit, *E. coli*) homolog, caseinolytic protease, ATP-dependent, proteolytic subunit homolog (*E. coil*) |
| 715 | 5350 | AI043611 | a | | |
| 716 | 7858 | AI043654 | t | | |
| 717 | 10784 | AI043678 | d | | |
| 718 | 9180 | AI043694 | aa | | |
| 719 | 7867 | AI043695 | aa | | ESTs, Highly similar to PUR1_HUMAN AMIDOPHOSPHORIBOSYLTRANS-FERASE PRECURSOR [*H. sapiens*], ESTs, Moderately similar to PUR1_HUMAN AMIDOPHOSPHORIBOSYLTRANS-FERASE PRECURSOR [*H. sapiens*], RIKEN cDNA 5730454C12 gene, expressed sequence AA675351, expressed sequence C79945, glutamine fructose-6-phosphate transaminase 2, glutamine-fructose-6-phosphate transaminase 2, |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 720 | 7584 | AI043724 | General | | phosphoribosyl pyrophosphate amidotransferase |
| 721 | 7895 | AI043768 | e | | |
| 722 | 7903 | AI043805 | General | | |
| 723 | 7913 | AI043849 | cc | | ELL-RELATED RNA POLYMERASE II, ELONGATION FACTOR, ESTs, Highly similar to ELL2_HUMAN RNA POLYMERASE II ELONGATION FACTOR ELL2 [*H. sapiens*], ESTs, Weakly similar to ELL MOUSE RNA POLYMERASE II ELONGATION FACTOR ELL [*M. musculus*], ESTs, Weakly similar to ELL2_HUMAN RNA POLYMERASE II ELONGATION FACTOR ELL2 [*H. sapiens*], *Mus musculus*, clone IMAGE: 3583970, mRNA, partial cds, *Mus musculus*, clone MGC: 11987 IMAGE 3601737, mRNA, complete cds, eleven-nineteen lysine-rich leukemia gene, hypothetical protein FLJ22637 |
| 724 | 3899 | AI043904 | l | | |
| 725 | 6766 | AI043914 | f | | |
| 726 | 10818 | AI043990 | g, l, m, General | | |
| 727 | 7956 | AI044018 | f | | |
| 728 | 5393 | AI044170 | p | | |
| 729 | 5398 | AI044177 | q | | |
| 730 | 5425 | AI044237 | a, d | | EST, Weakly similar to S59856 collagen alpha 1(III) chain precursor - mouse [*M. musculus*], ESTs, Weakly similar to S59856 collagen alpha 1(III) chain precursor - mouse [*M. musculus*], *Homo sapiens*, Similar to hypothetical protein FLJ20783, clone MGC: 1005 IMAGE: 3139876, mRNA, complete cds, expressed sequence AW122071, hypothetical protein FLJ10355, procollagen, type XIX, alpha 1, sequence-specific single-stranded-DNA-binding protein, single-stranded DNA-binding protein 2 |
| 731 | 8692 | AI044247 | r | | 2,4-dienoyl CoA reductase 1, mitochondrial, 2,4-dienoyl CoA reductase 2, peroxisomal, ESTs, Weakly similar to LUNG CARBONYL REDUCTASE [*M. musculus*], ESTs, Weakly similar to S11021 2,4-dienoyl-CoA reductase [*R. norvegicus*], FabG (beta-ketoacyl-[acyl-carrier-protein] reductase, *E. coli*) like, *Homo sapiens* AS10 protein mRNA, partial cds, RIKEN cDNA 1200012F07 gene, RIKEN cDNA 1810027P18 gene, carbonyl reductase, carbonyl reductase 2, oxidoreductase UCPA |
| 732 | 5430 | AI044253 | i | | |
| 733 | 5461 | AI044338 | g, p, General | | |
| 734 | 5464 | AI044345 | i | | |
| 735 | 3359 | AI044347 | aa | | |
| 737 | 2695 | AI044396 | b | | EST, Moderately similar to IL6B_HUMAN INTERLEUKIN-6 RECEPTOR BETA CHAIN PRECURSOR [*H. sapiens*], colony stimulating factor 3 receptor (granulocyte), cytokine receptor-like factor 1, interleukin 12 receptor, beta 2, interleukin 6 signal transducer, interleukin 6 signal transducer (gp130, oncostatin M receptor) |
| 738 | 5494 | AI044425 | General | | |
| 740 | 9882 | AI044588 | j, m | | |
| 741 | 5575 | AI044688 | g | | |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 742 | 2348 | AI044794 | General | | |
| 743 | 18205 | AI044836 | n | | EST, Moderately similar to JH0148 nucleolin - rat [*R. norvegicus*], EST, Moderately similar to RBM8__HUMAN PUTATIVE RNA-BINDING PROTEIN 8 [*H. sapiens*], EST, Weakly similar to NUCL__HUMAN NUCLEOLIN [*H. sapiens*], ESTs, Highly similar to FUS__HUMAN RNA-BINDING PROTEIN FUS [*H. sapiens*], ESTs, Highly similar to RBM8__HUMAN PUTATIVE RNA-BINDING PROTEIN 8 [*H. sapiens*], ESTs, Moderately similar to RBM8__HUMAN PUTATIVE RNA-BINDING PROTEIN 8 [*H. sapiens*], *Mus musculus* pigpen protein mRNA, complete cds, RNA binding motif protein 8A, TATA box binding protein (TBP)-associated factor, RNA polymerase II, N, 68 kD (RNA-binding protein 56), fusion, derived from t(12, 16) malignant liposarcoma |
| 744 | 5626 | AI044864 | u | | |
| 745 | 5630 | AI044869 | f | | |
| 746 | 5634 | AI044883 | General | | |
| 747 | 4047 | AI044947 | l, m | | |
| 748 | 5654 | AI044976 | w | | |
| 749 | 5684 | AI045056 | r | | |
| 750 | 19235 | AI045074 | General | | ESTs, Highly similar to BGAL MOUSE BETA-GALACTOSIDASE PRECURSOR [*M. musculus*], ESTs, Weakly similar to BGAL MOUSE BETA GALACTOSIDASE PRECURSOR [*M. musculus*], *Homo sapiens*, clone IMAGE: 3502329, mRNA, partial cds, *Homo sapiens*, clone IMAGE: 3938286, mRNA, partial cds, RIKEN cDNA 4833408P15 gene, galactosidase, beta 1 |
| 751 | 5689 | AI045075 | i, aa, General | | |
| 752 | 5711 | AI045151 | General | | ESTs, Weakly similar to MCAT__HUMAN MITOCHONDRIAL CARNITINE/ACYLCARNITINE CARRIER PROTEIN [*H. sapiens*], expressed sequence AW108044, solute carrier family 25 (carnitine/acylcarnitine translocase), member 20, solute carrier family 25 (mitochondrial carnitine/acylcarnitine translocase), member 20, solute carrier family 25 (mitochondrial carrier; adenine nucleotide translocator), member 10, solute carrier family 25 (mitochondrial carrier; ornithine transporter), member 15, uncoupling protein 2 (mitochondrial, proton carrier), uncoupling protein 2, mitochondrial |
| 753 | 19237 | AI045153 | c | | ESTs, Moderately similar to K6B2__MOUSE RIBOSOMAL PROTEIN S6 KINASE BETA 2 (S6K-BETA 2) (70 kDa RIBOSOMAL PROTEIN S6 KINASE 2) (P70-S6KB) (P70 RIBOSOMAL S6 KINASE BETA) (P70 S6KBETA) (S6K2) [*M. musculus*], NIMA (never in mitosis gene a)-related expressed kinase 3, RIKEN cDNA 2610318I15 gene, expressed sequence AI256796, expressed sequence AW319595, ribosomal protein S6 kinase, 70 kD, polypeptide 2, serine/threonine kinase 5 |
| 754 | 9964 | AI045161 | f | | |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 755 | 5735 | AI045223 | f | | |
| 756 | 5474 | AI045477 | a, General | | |
| 757 | 5811 | AI045502 | d, e | | |
| 758 | 5819 | AI045537 | General | | |
| 759 | 5839 | AI045594 | i | | |
| 760 | 6808 | AI045600 | s | | TRAM-like protein, translocating chain-associating membrane protein |
| 761 | 17755 | AI045608 | y | | |
| 763 | 10020 | AI045632 | a | | |
| 764 | 5855 | AI045669 | General | | |
| 765 | 5881 | AI045789 | i | | B aggressive lymphoma gene, DKFZP434J214 protein, KIAA1268 protein |
| 766 | 5897 | AI045862 | General | | KIAA0138 gene product, hypothetical protein FLJ13213, scaffold attachment factor B |
| 767 | 5900 | AI045866 | y, z | | |
| 768 | 7540 | AI045882 | o, t, General | | EST, Weakly similar to C29149 proline-rich protein - mouse [*M. musculus*], ESTs, Weakly similar to C29149 proline-rich protein - mouse [*M. musculus*], KIAA0999 protein, Mouse 31-kDa proline-rich salivary protein, complete cds of clone pUMP125, *Mus musculus*, Similar to proline-rich protein BstNI subfamily 2, clone MGC: 18611 IMAGE: 4165240, mRNA, complete cds, RIKEN cDNA 6030468B19 gene, *Rattus norvegicus* proline-rich proteoglycan (PRPG2) mRNA, complete cds, proline-rich protein HaeIII subfamily 2 |
| 769 | 5329 | AI045970 | p | | |
| 770 | 15093 | AI058285 | d | | |
| 771 | 8002 | AI058304 | i | | |
| 772 | 8017 | AI058341 | c | | |
| 773 | 6828 | AI058359 | General | | Cdc42 effector protein 2, Cdc42 effector protein 3 |
| 774 | 8177 | AI058603 | aa | | |
| 775 | 3090 | AI058730 | aa | | |
| 776 | 10093 | AI058746 | g | | |
| 777 | 8143 | AI058759 | General | | |
| 778 | 18659 | AI058762 | f | | |
| 779 | 8163 | AI058837 | aa | | |
| 780 | 4789 | AI058889 | General | | |
| 781 | 8221 | AI059061 | General | | |
| 782 | 10159 | AI059147 | d | | |
| 783 | 8245 | AI059154 | b | | EST, Weakly similar to GBLP_HUMAN GUANINE NUCLEOTIDE-BINDING PROTEIN BETA SUBUNIT-LIKE PROTEIN 12.3 [*H. sapiens*], *Homo sapiens* mRNA for FLJ00083 protein, partial cds, IRA1 protein, *Rattus norvegicus* Sprague Dawley protein kinase C receptor mRNA, complete cds, WD repeat domain 5, expressed sequence AL033335, hypothetical protein, recombination protein REC14 |
| 784 | 8283 | AI059290 | n | | |
| 785 | 8314 | AI059386 | g, General | | |
| 786 | 10200 | AI059444 | i | | |
| 787 | 8347 | AI059519 | s | | DKFZP566D213 protein, EST, Moderately similar to EPIDERMAL GROWTH FACTOR PRECURSOR [*M. musculus*], ESTs, Weakly similar to mel [*M. musculus*], Epidermal growth factor, epidermal growth factor, epidermal growth factor (beta-urogastrone), hypothetical protein MGC11256, nel-like 2 homolog (chicken) |
| 788 | 18359 | AI059675 | n | | EST, Highly similar to TERA_HUMAN [*H. sapiens*], EST, Weakly similar to |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| | | | | | T46437 hypothetical protein DKFZp434K0126 1 [*H. sapiens*], ESTs, Weakly similar to T46437 hypothetical protein DKFZp434K0126.1 [*H. sapiens*], ESTs, Weakly similar to TERA HUMAN [*H. sapiens*], ESTs, Weakly similar to TERA RAT TRANSITIONAL ENDOPLASMIC RETICULUM ATPASE [*R. norvegicus*], RIKEN cDNA 4833413G10 gene, RIKEN cDNA 5430414H02 gene, spermatogenesis associated factor, valosin containing protein, valosin-containing protein |
| 789 | 10281 | AI059947 | b, t | | |
| 790 | 8494 | AI059968 | aa | | |
| 791 | 8495 | AI059971 | General | | *Homo sapiens* (clone NCD18) tumor necrosis factor receptor related protein mRNA, complete exon and repeat region, lymphotoxin B receptor, lymphotoxin beta receptor (TNFR superfamily, member 3), tumor necrosis factor receptor superfamily, member 8 |
| 792 | 8496 | AI059974 | General | | KIAA1685 protein, KIAA1713 protein |
| 793 | 10289 | AI060053 | i | | CGI-142, RIKEN cDNA 3930401K13 gene |
| 794 | 8548 | AI060176 | k | | |
| 795 | 8565 | AI060236 | t | | |
| 796 | 18322 | AI060279 | i, y, z | | |
| 797 | 8745 | AI069939 | r | | |
| 798 | 8785 | AI070067 | o | | IK cytokine, down-regulator of HLA II, *Mus musculus*, Similar to IK cytokine, down-regulator of HLA II, clone MGC 25508 IMAGE 4920184, mRNA, complete cds |
| 799 | 17506 | AI070068 | cc | | growth arrest and DNA-damage-inducible 45 beta, growth arrest and DNA-damage-inducible, alpha, growth arrest and DNA-damage-inducible, beta |
| 800 | 9067 | AI070087 | General | | ESTs, Highly similar to NUCL_HUMAN NUCLEOLIN [*H. sapiens*], Nucleolin, RIKEN cDNA 0610010A22 gene, eukaryotic translation initiation factor 3, subunit 4 (delta, 44 kDa), eukaryotic translation initiation factor 3, subunit 4 (delta, 44 kD), nucleolin |
| 801 | 3551 | AI070122 | e | | CGI-97 protein, EST, Weakly similar to YC97_HUMAN HYPOTHETICAL PROTEIN CGI-97 [*H. sapiens*], RIKEN cDNA 4733401P19 gene |
| 802 | 4967 | AI070179 | k | | glia maturation factor, gamma |
| 803 | 18 | AI070195 | General | | CGI-20 protein |
| 804 | 24197 | AI070314 | General | | armadillo repeat gene deletes in velocardiofacial syndrome, catenin (cadherin-associated protein), delta 1, catenin (cadherin-associated protein), delta 2 (neural plakophilin-related arm-repeat protein), plakophilin 4 |
| 805 | 8869 | AI070330 | r | | |
| 806 | 8874 | AI070336 | b, cc | | |
| 807 | 10417 | AI070410 | m | | |
| 808 | 8901 | AI070419 | aa | | toll-like receptor 1, toll-like receptor 10, toll-like receptor 2, toll-like receptor 6 |
| 809 | 14424 | AI070421 | l, p, General | | |
| 810 | 10434 | AI070497 | General | | |
| 811 | 8927 | AI070523 | v | | |
| 812 | 8946 | AI070611 | q | | |
| 813 | 8950 | AI070621 | w | | |
| 814 | 8972 | AI070673 | General | | |
| 815 | 8981 | AI070715 | bb | | |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 816 | 26184 | AI070784 | i, l | | ESTs, Highly similar to I49636 DNA-binding protein - mouse [*M. musculus*], ESTs, Moderately similar to I49636 DNA-binding protein - mouse [*M. musculus*], ESTs, Weakly similar to B57785 zinc finger protein ZNF136 [*H. sapiens*], ESTs, Weakly similar to OZF__HUMAN ZINC FINGER PROTEIN OZF [*H. sapiens*], *Homo sapiens*, Similar to zinc finger protein 136 (clone pHZ-20), clone MGC: 10647 IMAGE: 4053041, mRNA, complete cds, RIKEN cDNA 2310011F05 gene, pancreas zinc finger protein, zinc finger protein 136 (clone pHZ-20), zinc finger protein 260, zinc finger protein 63, zinc finger protein 97 |
| 817 | 3007 | AI070824 | w | | DKFZP564F0522 protein, ESTs, Weakly similar to T08675 hypothetical protein DKFZp564F0522.1 [*H. sapiens*] |
| 818 | 8999 | AI070839 | p | | |
| 819 | 10477 | AI070868 | e, f | | ESTs, Highly similar to NRP2__RAT NEUROPILIN-2 PRECURSOR (VASCULAR ENDOTHELIAL CELL GROWTH FACTOR 165 RECEPTOR 2) [*R. norvegicus*], neuropilin 2, neuropilin-2, platelet derived growth factor C |
| 820 | 24301 | AI070911 | k | | |
| 821 | 8721 | AI071024 | General | | |
| 822 | 9212 | AI071098 | x | | |
| 823 | 1831 | AI071137 | c | | cell division cycle 25 homolog B (S. cerevisiae), cell division cycle 25 homolog C (*S. cerevisiae*), cell division cycle 25B, cell division cycle 25C, expressed sequence AI604853 |
| 824 | 11005 | AI071139 | r | | |
| 825 | 9104 | AI071173 | j, m | | ESTs, Highly similar to ROG__HUMAN HETEROGENEOUS NUCLEAR RIBONUCLEOPROTEIN G [*H. sapiens*], *Homo sapiens*, Similar to RNA binding motif protein, X chromosome, clone MGC: 9398 IMAGE: 3875565, mRNA, complete cds, RIKEN cDNA 1700012H05 gene, RNA binding motif protein, X chromosome, RNA binding motif protein, X chromosome retrogene, RNA binding motif protein, Y chromosome, family 1, member A1, testes-specific heterogenous nuclear ribonucleoprotein G-T |
| 826 | 9583 | AI071185 | General | | |
| 827 | 9644 | AI071410 | c | | |
| 828 | 16058 | AI071490 | General | | serine palmitoyltransferase, long chain base subunit 2 |
| 829 | 11057 | AI071509 | f, o | | |
| 831 | 5695 | AI071566 | bb | | |
| 832 | 9671 | AI071568 | w | | |
| 833 | 22929 | AI071578 | General | | DNA segment, human D4S114, P311 protein |
| 834 | 9673 | AI071581 | General | | |
| 835 | 9699 | AI071646 | General | | |
| 837 | 9799 | AI072008 | q, y, z | | |
| 838 | 9808 | AI072050 | d | | |
| 839 | 22796 | AI072213 | General | | |
| 840 | 9271 | AI072405 | v | | |
| 841 | 10869 | AI072425 | w | | |
| 842 | 21797 | AI072439 | General | | EST X83352, ESTs, Highly similar to T17226 hypothetical protein DKFZp566G223.1 [*H. sapiens*], *Homo sapiens*, Similar to chloride intracellular channel 4, clone |

TABLE 3-continued

Atty. Docket No. 44921-5089US
Doc. No. 1803440.1

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| | | | | | MGC: 8812 IMAGE. 3861372, mRNA, complete cds, RIKEN cDNA 5730531E12 gene, chloride intracellular channel 1, chloride intracellular channel 4, chloride intracellular channel 4 (mitochondrial), hypothetical protein DKFZp434N127, intracellular chloride ion channel protein p64H1 |
| 843 | 9306 | AI072521 | r | | |
| 844 | 9312 | AI072550 | j | | |
| 845 | 10893 | AI072559 | x | | |
| 846 | 1501 | AI072634 | cc, General | | |
| 847 | 6548 | AI072658 | General | | |
| 848 | 9363 | AI072695 | d | | DnaJ (Hsp40) homolog, subfamily C, member 4, *Homo sapiens*, clone MGC: 19482 IMAGE: 4309314, mRNA, complete cds, hypothetical protein FLJ11506 |
| 850 | 9409 | AI072841 | n | | |
| 851 | 9410 | AI072842 | w | | |
| 852 | 9468 | AI073021 | General | | |
| 853 | 9518 | AI073223 | f | | |
| 854 | 11183 | AI100768 | t | | EST, Moderately similar to CARBONIC ANHYDRASE II [*R. norvegicus*], carbonic anhydrase 2, carbonic anhydrase II, carbonic anhydrase VIII, carbonic anhydrase-like sequence 1 |
| 855 | 9190 | AI100835 | e | | |
| 856 | 2029 | AI100842 | p | | |
| 857 | 5687 | AI101006 | e | | |
| 858 | 15192 | AI101099 | g, cc | | ESTs, Moderately similar to AF078844 1 hqp0376 protein [*H. sapiens*], expressed sequence AA409533 |
| 859 | 17399 | AI101157 | o | | ATP synthase, H+ transporting, mitochondrial F0 complex, subunit f, isoform 2, EST, Weakly similar to ATPK_HUMAN ATP SYNTHASE F CHAIN, MITOCHONDRIAL [*H. sapiens*], ESTs, Highly similar to ATPK_HUMAN ATP SYNTHASE F CHAIN, MITOCHONDRIAL [*H. sapiens*] |
| 860 | 9339 | AI101160 | l, m, o | | |
| 861 | 6321 | AI101256 | General | | ESTs, Moderately similar to HETEROGENEOUS NUCLEAR RIBONUCLEOPROTEIN C [*R. norvegicus*], *Mus musculus* high-glycine/tyrosine protein type I E5 mRNA, complete cds, RNA binding protein p45AUF1, expressed sequence C85084, heterogeneous nuclear ribonucleoprotein A/B, heterogeneous nuclear ribonucleoprotein D, heterogeneous nuclear ribonucleoprotein D (AU-rich element RNA-binding protein 1, 37 kD), heterogeneous nuclear ribonucleoprotein D-like |
| 862 | 5421 | AI101270 | c | | Rho GDP dissociation inhibitor (GDI) beta, expressed sequence C87222, rho, GDP dissociation inhibitor (GDI) beta |
| 863 | 11910 | AI101323 | General | | ets variant gene 5 (ets-related molecule) |
| 864 | 23140 | AI101608 | e | | |
| 865 | 4119 | AI101901 | General | | |
| 866 | 16324 | AI102009 | b | | |
| 867 | 18642 | AI102023 | o | | brain-specific membrane-anchored protein, chromosome 1 open reading frame 8 |
| 868 | 19373 | AI102044 | a | beta-carotene 15, 15'-dioxygenase, beta-carotene 15, 15'- | EST, Moderately similar to 0806162D protein COII [*M. musculus*], EST, Weakly similar to 810024D cytochrome |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| | | | | dioxygenase, frizzled (Drosophila) homolog 1, frizzled homolog 1, (Drosophila) | oxidase II [*H. sapiens*] |
| 869 | 7051 | AI102055 | h | | ESTs, Highly similar to 2013348A Ser kinase SRPK1 [*H. sapiens*], *Mus musculus* 13 days embryo head cDNA, RIKEN full-length enriched library, clone: 3110005M20, full insert sequence, *Mus musculus* adult male lung cDNA, RIKEN full-length enriched library, clone: 1200011B22, full insert sequence, SFRS protein kinase 1, SFRS protein kinase 2, serine/arginine-rich protein specific kinase 2, serine/threonine kinase 23 |
| 870 | 6544 | AI102064 | c | | |
| 871 | 10227 | AI102248 | w | | |
| 872 | 23849 | AI102318 | e, q | | |
| 873 | 11954 | AI102505 | g, j, s | | |
| 874 | 2125 | AI102519 | c, k | | TYRO protein tyrosine kinase binding protein |
| 875 | 5967 | AI102520 | y | | ESTs, Weakly similar to GEF2_HUMAN GANGLIOSIDE EXPRESSION FACTOR 2 [*R. norvegicus*], GABA(A) receptor-associated protein-like 2, RIKEN cDNA 0610012F20 gene, ganglioside expression factor 2 |
| 875 | 5969 | AI102520 | p, w | | ESTs, Weakly similar to GEF2_HUMAN GANGLIOSIDE EXPRESSION FACTOR 2 [*R. norvegicus*], GABA(A) receptor-associated protein-like 2, RIKEN cDNA 0610012F20 gene, gamma-aminobutyric acid (GABA(A)) receptor-associated protein-like 1, ganglioside expression factor 2 |
| 876 | 11563 | AI102560 | General | | |
| 877 | 15190 | AI102562 | b, g, n, p, v | | EST, Moderately similar to Cd-7 Metallothionein-2 [*H. sapiens*], EST, Moderately similar to SMHU1E metallothionein 1E [*H. sapiens*] |
| 878 | 19769 | AI102570 | bb | | |
| 879 | 22487 | AI102578 | General | | EST, Highly similar to I49523 Mouse primary response gene B94 mRNA, 3'end - mouse [*M. musculus*], *Homo sapiens*, clone MGC: 16332 IMAGE 3842543, mRNA, complete cds, RIKEN cDNA 1200009I06 gene, RIKEN cDNA 1600013K19 gene, similar to *S. cerevisiae* Sec6p and *R norvegicus* rsec6, tumor necrosis factor, alpha-induced protein 2 |
| 880 | 19011 | AI102618 | General | | |
| 881 | 23837 | AI102620 | q, t | | |
| 882 | 23538 | AI102727 | g, General | | solute carrier family 20 (phosphate transporter), member 1, solute carrier family 20 (phosphate transporter), member 2, solute carrier family 20, member 1, solute carrier family 20, member 2 |
| 883 | 17234 | AI102741 | c | tissue inhibitor of metalloproteinase 3, tissue inhibitor of metalloproteinase 3 (Sorsby fundus dystrophy, pseudoinflammatory) | tissue inhibitor of metalloproteinase 3, tissue inhibitor of metalloproteinase 3 (Sorsby fundus dystrophy, pseudoinflammatory) |
| 884 | 5891 | AI102745 | k | | |
| 885 | 6796 | AI102753 | General | | |
| 886 | 8837 | AI102849 | o, p | | |
| 887 | 15861 | AI102868 | i | | phosphoserine aminotransferase |
| 888 | 3533 | AI102877 | g | | |

TABLE 3-continued

HUMAN HOMOLOGUE ANNOTATIONS

| Seq. ID No. | GenBank Acc./ Identifier | Ref. Seq. ID No. | Model Code | Homologous Gene Name | Homologous Cluster Name |
|---|---|---|---|---|---|
| 889 | 13222 | AI102977 | General | | |
| 890 | 6806 | AI103018 | o, u | | |
| 891 | 10659 | AI103059 | w, cc, General | | |
| 892 | 17400 | AI103097 | e | | ATP synthase, H+ transporting, mitochondrial F0 complex, subunit f, isoform 2, EST, Weakly similar to ATPK__HUMAN ATP SYNTHASE F CHAIN, MITOCHONDRIAL [*H. sapiens*], ESTs, Highly similar to ATPK__HUMAN ATP SYNTHASE F CHAIN, MITOCHONDRIAL [*H. sapiens*] |
| 893 | 3584 | AI103106 | x, aa | | |
| 894 | 13298 | AI103143 | r | | |
| 895 | 15981 | AI103150 | i, x | | ESTs, Highly similar to S17516 hypothetical protein [*H. sapiens*], ESTs, Highly similar to UBIQUITIN-CONJUGATING ENZYME E2-17 KD [*R. norvegicus*], RIKEN cDNA 1110015A16 gene, RIKEN cDNA 2610301N02 gene, expressed sequence AI327276, ubiquitin conjugating enzyme, ubiquitin-conjugating enzyme E2A (RAD6 homolog), ubiquitin-conjugating enzyme E2B (RAD6 homolog), ubiquitin-conjugating enzyme E2B (RAD6 homology), ubiquitin-conjugating enzyme E2C, ubiquitin-conjugating enzyme E2G 2 |
| 896 | 3475 | AI103245 | w | | |
| 898 | 23619 | AI103314 | p | | |
| 899 | 24181 | AI103320 | e | | |
| 901 | 4355 | AI103410 | General | | |
| 902 | 7622 | AI103472 | General | | |
| 903 | 20918 | AI103552 | n | | |
| 904 | 21579 | AI103572 | General | | |
| 905 | 2222 | AI103631 | o | | |
| 906 | 2752 | AI103641 | e | | |
| 907 | 4856 | AI103708 | i | | |
| 908 | 8990 | AI103719 | l, m, y, z | | |
| 909 | 15942 | AI103738 | r | | |
| 910 | 22885 | AI103828 | e, General | | |
| 911 | 15853 | AI103841 | x | complement component 4 (within H-2S), complement component 4B | EST, Weakly similar to complement component C4A [*H. sapiens*] |
| 912 | 15050 | AI103911 | j, y | | EST, Moderately similar to UCRI RAT UBIQUINOL-CYTOCHROME C REDUCTASE IRON-SULFUR SUBUNIT, MITOCHONDRIAL PRECURSOR [*R. norvegicus*], EST, Weakly similar to UCRI__HUMAN UBIQUINOL-CYTOCHROME C REDUCTASE IRON-SULFUR SUBUNIT, MITOCHONDRIAL PRECURSOR [*H. sapiens*], ESTs, Moderately similar to UCRI__HUMAN UBIQUINOL-CYTOCHROME C REDUCTASE IRON-SULFUR SUBUNIT, MITOCHONDRIAL PRECURSOR [*H. sapiens*], Human DNA sequence from clone RP1-228J4 on chromosome 6 Contains a pseudogene similar to UQCRFS1 (ubiquinol-cytochrome c reductase, Rieske iron-sulfur polypeptide 1), ESTs, an STS and GSSs, RIKEN cDNA 4430402G14 gene, expressed sequence AI875505, ubiquinol-cytochrome c reductase, Rieske iron-sulfur polypeptide 1 |
| 913 | 12376 | AI103939 | u | | |
| 914 | 22271 | AI103947 | o, y | | |

TABLE 3-continued

Atty. Docket No. 44921-5089US
Doc. No. 1803440.1

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 915 | 20833 | AI104035 | f, q | | ESTs, Weakly similar to COXG MOUSE CYTOCHROME C OXIDASE POLYPEPTIDE VIB [*M. musculus*], Human DNA sequence from clone RP4-591N18 on chromosome 22q 13.1-13.2 Contains a COX6B (Cytochrome C Oxidase subunit VIb (EC 1.9.3.1)) pseudogene, ESTs, GSSs and two putative CpG islands, RIKEN cDNA 2010000G05 gene, cytochrome c oxidase subunit VIb |
| 916 | 7010 | AI104099 | w | | |
| 917 | 22101 | AI104251 | General | | DKFZP564O243 protein |
| 918 | 22833 | AI104258 | General | | |
| 919 | 22211 | AI104279 | g, m | | EST, Weakly similar to IF6_HUMAN EUKARYOTIC TRANSLATION INITIATION FACTOR 6 [*H. sapiens*], *Mus musculus* 10 days neonate cerebellum cDNA, RIKEN full-length enriched library, clone: 6530402L05, full insert sequence, integrin beta 4 binding protein |
| 920 | 10720 | AI104296 | l | | |
| 921 | 15416 | AI104340 | i | | |
| 922 | 10991 | AI104342 | a | | |
| 923 | 18831 | AI104357 | p | | ESTs, Weakly similar to A29861 actin gamma [*H. sapiens*], ESTs, Weakly similar to I39393 alpha-actin [*H. sapiens*], ESTs, Weakly similar to S38782 actin beta' chain [*H. sapiens*], Homo sapiens mRNA; cDNA DKFZp434B2115 (from clone DKFZp434B2115), RIKEN cDNA 1700052K15 gene, RIKEN cDNA 1700061J02 gene, actin-like 7a, expressed sequence AL023024, expressed sequence AV259599, melanoma X-actin, uncharacterized hypothalamus protein HARP11 |
| 924 | 7223 | AI104373 | e | | |
| 925 | 23574 | AI104520 | e, g, s | cytochrome c oxidase subunit VIa polypeptide 1, cytochrome c oxidase, subunit VI a, polypeptide 1 | |
| 926 | 18509 | AI104528 | q | | NADH dehydrogenase (ubiquinone) 1 beta subcomplex, 6 (17 kD, B17) |
| 927 | 11680 | AI104605 | v | | |
| 928 | 12342 | AI104658 | w | | ESTs, Weakly similar to RENAL TRANSCRIPTION FACTOR KID-1 [*R. norvegicus*], ESTs, Weakly similar to T42682 hypothetical protein DKFZp434G1221.1 [*H. sapiens*], Homo sapiens, clone MGC.20975 IMAGE: 4634585, mRNA, complete cds, expressed sequence AA415813, expressed sequence AI839920, expressed sequence AL024263, hypothetical protein FLJ20531, transcription factor 17, transcription factor 17-like 1, zinc finger protein 91, zinc finger protein homologous to Zfp91 in mouse |
| 929 | 23689 | AI104685 | r | | |
| 930 | 15377 | AI104821 | o, cc | | hypothetical protein MGC10947, leucine rich repeat (in FLII) interacting protein 2 |
| 931 | 22957 | AI104897 | General | | |
| 932 | 18451 | AI104953 | o, s | | ATP synthase, H+ transporting, mitochondrial F1 complex, delta subunit, EST, Moderately similar to ATPD_HUMAN ATP SYNTHASE DELTA CHAIN, MITOCHONDRIAL PRECURSO [*H. sapiens*], RIKEN |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| | | | | | cDNA 0610008F14 gene, expressed sequence AA960090, expressed sequence AI876556, expressed sequence C85518 |
| 933 | 24375 | AI104979 | n, General | | |
| 934 | 18278 | AI105080 | bb | | 3-oxoacid CoA transferase, hypothetical protein FKSG25 |
| 935 | 2196 | AI105243 | g | | |
| 936 | 5199 | AI105272 | bb, General | | |
| 937 | 12901 | AI105301 | o, s | | |
| 938 | 7700 | AI105383 | cc, General | | |
| 939 | 13343 | AI105398 | u | | |
| 940 | 22931 | AI105417 | e, General | | DNA segment, human D4S114, P311 protein |
| 941 | 23596 | AI105435 | bb | | expressed sequence D17825, glutaryl-Coenzyme A dehydrogenase |
| 942 | 15893 | AI105465 | o | | ESTs, Highly similar to DHSD_HUMAN SUCCINATE DEHYDROGENASE [*H. sapiens*], ESTs, Moderately similar to DHSD_HUMAN SUCCINATE DEHYDROGENASE [*H. sapiens*], succinate dehydrogenase complex, subunit D, integral membrane protein |
| 943 | 12660 | AI111492 | c | | |
| 944 | 4479 | AI111599 | General | | |
| 945 | 24211 | AI111853 | k | | EST, Moderately similar to 0710252A histone H3 [*H. sapiens*], ESTs, Highly similar to H33_HUMAN HISTONE H3.3 [*H. sapiens*], ESTs, Weakly similar to H33_HUMAN HISTONE H3 3 [*H. sapiens*], ESTs, Weakly similar to JQ1983 H3.3 like histone MH921 - mouse [*M. musculus*], H3 histone, family 3A, H3 histone, family 3B, H3 histone, family 3B (H3 3B) |
| 946 | 2539 | AI111960 | r | | |
| 947 | 5729 | AI111990 | k | | EGF-containing fibulin-like extracellular matrix protein 1, EGF-containing fibulin like extracellular matrix protein 2, EST, Weakly similar to FBL3_RAT EGF-CONTAINING FIBULIN-LIKE EXTRACELLULAR MATRIX PROTEIN 1 PRECURSOR (FIBULIN-3) (FIBL-3) (T16 PROTEIN) [*R. norvegicus*], ESTs, Highly similar to FBL3_RAT EGF-CONTAINING FIBULIN-LIKE EXTRACELLULAR MATRIX PROTEIN 1 PRECURSOR (FIBULIN-3) (FIBL-3) (T16 PROTEIN) [*R. norvegicus*], ESTs, Weakly similar to FBL3_RAT EGF-CONTAINING FIBULIN-LIKE EXTRACELLULAR MATRIX PROTEIN 1 PRECURSOR (FIBULIN-3) (FIBL-3) (T16 PROTEIN) [*R. norvegicus*], epidermal growth factor-containing fibulin-like extracellular matrix protein 1, epidermal growth factor-containing fibulin-like extracellular matrix protein 2 |
| 948 | 4049 | AI112012 | i, q, u, General | | EST, Moderately similar to PM17 MOUSE MELANOCYTE PROTEIN PMEL 17 PRECURSOR [*M. musculus*], *Homo sapiens*, Similar to glycoprotein (transmembrane) nmb, clone MGC: 1696 IMAGE: 3345861, mRNA, complete cds, glycoprotein (transmembrane) nmb, silver |
| 949 | 12908 | AI112043 | l | | |
| 950 | 20041 | AI112161 | t | | |
| 951 | 12937 | AI112462 | General | | |
| 952 | 3713 | AI112571 | b | | |
| 953 | 12921 | AI112636 | General | | *Homo sapiens* BAC clone RP11-335J18 from 2, RIKEN cDNA 1700124F02 gene, expressed |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| | | | | | sequence AI325217, uridine phosphorylase |
| 954 | 12965 | AI112926 | General | | |
| 955 | 7499 | AI112986 | General | | |
| 956 | 4969 | AI113008 | r | | |
| 957 | 11817 | AI136295 | f | | DKFZP564O123 protein, putative breast adenocarcinoma marker (32 kD) |
| 959 | 11165 | AI136372 | c | | |
| 960 | 4045 | AI136460 | cc | | |
| 961 | 12782 | AI136493 | k | | |
| 962 | 6850 | AI136665 | h | | RIKEN cDNA 2010320H07 gene, ectonucleoside triphosphate diphosphohydrolase 1, ectonucleoside triphosphate diphosphohydrolase 2, ectonucleoside triphosphate diphosphohydrolase 3, ectonucleoside triphosphate diphosphohydrolase 6 (putative function) |
| 963 | 20920 | AI136891 | p, v | butyrate response factor 1, zinc finger protein, C3H type, 36-like 1 | ESTs, Moderately similar to TISB RAT TIS11B PROTEIN [*R. norvegicus*], ESTs, Weakly similar to TISB RAT TIS11B PROTEIN [*R. norvegicus*], butyrate response factor 1, butyrate response factor 1 (EGF-response factor 1), butyrate response factor 2, butyrate response factor 2 (EGF-response factor 2), expressed sequence AW742437 |
| 964 | 6552 | AI137062 | o | | 6 2 kd protein |
| 965 | 22722 | AI137211 | i | | |
| 966 | 13111 | AI137224 | o, General | | hypothetical protein FLJ20260, oxysterol binding protein 2 |
| 967 | 15969 | AI137302 | e | | DNA segment, Chr 17, ERATO Doi 197, expressed, EST, Weakly similar to ZF37__RAT ZINC FINGER PROTEIN 37 (ZFP-37) [*R. norvegicus*], ESTs, Weakly similar to I38600 zinc finger protein ZNF 135 [*H. sapiens*], ESTs, Weakly similar to ZINC FINGER PROTEIN ZFP-29 [*M. musculus*], *Homo sapiens* GIOT-1 mRNA for gonadotropin inducible transcription repressor-1, partial cds, expressed sequence AI449432, hypothetical protein FLJ14855, zinc finger protein 135 (clone pHZ-17), zinc finger protein 29, zinc finger protein 37, zinc finger protein homologous to Zfp37 in mouse |
| 968 | 14349 | AI137303 | d | | |
| 969 | 9166 | AI137406 | General | | protein C receptor, endothelial, protein C receptor, endothelial (EPCR) |
| 970 | 9525 | AI137516 | r | | EST, Weakly similar to ZF37__RAT ZINC FINGER PROTEIN 37 (ZFP-37) [*R. norvegicus*], ESTs, Weakly similar to B32891 finger protein 2, placental [*H. sapiens*], ESTs, Weakly similar to MLZ4 MOUSE ZINC FINGER PROTEIN MLZ-4 [*M. musculus*], *Homo sapiens* cDNA FLJ14967 fis, clone THYRO1000242, moderately similar to ZINC FINGER PROTEIN 84, expressed sequence AI854635, zinc finger protein 113, zinc finger protein 268, zinc finger protein 37, zinc finger protein 46, zinc finger protein 84 (HPF2), zinc finger protein homologous to Zfp37 in mouse |
| 971 | 6638 | AI137579 | General | | |
| 972 | 7414 | AI137586 | General | | EST, Weakly similar to IMB3__HUMAN IMPORTIN BETA-3 SUBUNIT [*H. sapiens*], *Homo sapiens* cDNA FLJ12978 fis, clone NT2RP2006321, |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 973 | 11321 | AI137752 | z | | RAN binding protein 6, karyopherin (importin) beta 3 |
| 974 | 23473 | AI137932 | l | | EST, Highly similar to R5HU7 ribosomal protein L7, cytosolic [*H. sapiens*], EST, Weakly similar to RL7 MOUSE 60S RIBOSOMAL PROTEIN L7 [*M. musculus*], ESTs, Highly similar to R5HU7 ribosomal protein L7, cytosolic [*H. sapiens*], calponin like transmembrane domain protein, ribosomal protein L7 |
| 975 | 13158 | AI138024 | i | | |
| 976 | 13467 | AI138034 | cc | | UDP-glucose ceramide glucosyltransferase |
| 977 | 11377 | AI138105 | y | | |
| 978 | 6790 | AI144801 | d, h | | |
| 979 | 6506 | AI144919 | j, l, y | | |
| 980 | 8027 | AI144958 | i | | |
| 982 | 14458 | AI145095 | General | | |
| 983 | 7476 | AI145202 | g | | |
| 984 | 17545 | AI145384 | e | | |
| 985 | 17479 | AI145385 | r | | |
| 986 | 4194 | AI145387 | r | | |
| 987 | 8634 | AI145722 | g | | |
| 988 | 8339 | AI145761 | y, General | | |
| 989 | 2059 | AI146005 | h, General | | RIKEN cDNA 2610020J05 gene, pseudouridine synthase 1, pseudouridylate synthase 1 |
| 990 | 23224 | AI146033 | o | | translocase of inner mitochondrial membrane 10 homolog (yeast), translocase of inner mitochondrial membrane 9 (yeast) homolog |
| 991 | 5232 | AI168942 | bb | branched chain keto acid dehydrogenase E1, beta polypeptide (maple syrup urine disease), branched chain ketoacid dehydrogenase E1, beta polypeptide | |
| 992 | 18472 | AI168975 | u | | |
| 992 | 18473 | AI168975 | u | | |
| 993 | 13235 | AI169020 | r | | |
| 994 | 11618 | AI169115 | o, y, General | | |
| 995 | 17386 | AI169144 | o | | |
| 996 | 10984 | AI169156 | o, u | | |
| 997 | 8205 | AI169176 | e | | |
| 998 | 12979 | AI169177 | e | | immediate early response 3 |
| 999 | 2607 | AI169211 | c | | *Homo sapiens* clone 24468 mRNA sequence, *Mus musculus* 0 day neonate skin cDNA, RIKEN full-length enriched library, clone.4633401I22, full insert sequence, heterogeneous nuclear ribonucleoprotein C, heterogeneous nuclear ribonucleoprotein C (C1/C2), hnRNP-associated with lethal yellow |
| 1000 | 22661 | AI169265 | s, z | | ATPase, H+ transporting, lysosomal (vacuolar proton pump), subunit 1, EST, Weakly similar to I54197 hypothetical protein [*H. sapiens*], ESTs, Weakly similar to VAS1_RAT VACUOLAR ATP SYNTHASE SUBUNIT S1 PRECURSOR (V-ATPASE S1 SUBUNIT) (V-ATPASE S1 ACCESSORY PROTEIN) (V-ATPASE AC45 SUBUNIT) (C7-1 PROTEIN) [*R. norvegicus*], *Homo sapiens* cDNA FLJ12563 fis, clone NT2RM4000820, weakly similar to VACUOLAR ATP SYNTHASE SUBUNIT AC45 PRECURSOR (EC 3 6 1.34) |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 1001 | 13239 | AI169278 | g, j, l, y, z | | |
| 1002 | 24162 | AI169279 | m | | |
| 1003 | 16879 | AI169284 | o | | ADP-ribosylation factor-like 6 interacting protein |
| 1004 | 24213 | AI169289 | p | | EST, Moderately similar to 0710252A histone H3 [*H. sapiens*], ESTs, Highly similar to H33_HUMAN HISTONE H3.3 [*H. sapiens*], ESTs, Weakly similar to H33_HUMAN HISTONE H3.3 [*H. sapiens*], ESTs, Weakly similar to JQ1983 H3.3 like histone MH921 - mouse [*M. musculus*], H3 histone, family 3A, H3 histone, family 3B, H3 histone, family 3B (H3.3B) |
| 1005 | 13240 | AI169311 | cc | | |
| 1006 | 5931 | AI169324 | b | | |
| 1007 | 20891 | AI169337 | d | | hypothetical protein |
| 1008 | 11979 | AI169365 | cc | | |
| 1009 | 10947 | AI169372 | s | | EST, Weakly similar to S13101 cytochrome P450 cl17 - rat [*R. norvegicus*], RIKEN cDNA 2010301M18 gene, RIKEN cDNA 2010318C06 gene, RIKEN cDNA 2210009K14 gene, cytochrome P450, 2c29, cytochrome P450, subfamily IIC (mephenytoin 4-hydroxylase), polypeptide 19 |
| 1010 | 20697 | AI169494 | o, u | | ATPase, H+ transporting, lysosomal (vacuolar proton pump, 42 kDa, ATPase, H+ transporting, lysosomal (vacuolar proton pump), member D, ESTs, Moderately similar to VA0D_HUMAN VACUOLAR ATP SYNTHASE SUBUNIT D (V-ATPASE D SUBUNIT) (VACUOLAR PROTON PUMP D SUBUNIT) (V-ATPASE AC39 SUBUNIT) (V-ATPASE 40 KDA ACCESSORY PROTEIN) (P39) [*H. sapiens*] |
| 1011 | 8234 | AI169517 | z | | |
| 1012 | 18343 | AI169648 | o | | |
| 1013 | 10839 | AI169655 | l, m | | |
| 1014 | 24146 | AI169668 | j, l | | ATP-binding cassette, sub-family F (GCN20), member 1, ATP-binding cassette, sub-family F (GCN20), member 2, hypothetical protein FLJ11198 |
| 1015 | 22575 | AI169728 | r | | EST, Highly similar to T47184 hypothetical protein DKFZp434F1526.1 [*H. sapiens*], ESTs, Weakly similar to T47184 hypothetical protein DKFZp434F1526.1 [*H. sapiens*], hypothetical protein FLJ10889 |
| 1016 | 804 | AI169756 | cc | | Gene 33/Mig-6, RIKEN cDNA 1300002F13 gene |
| 1017 | 8213 | AI169883 | p | ferritin light chain 1, ferritin, light polypeptide | ESTs, Highly similar to FRHUL ferritin light chain [*H. sapiens*], ESTs, Moderately similar to FRHUL ferritin light chain [*H. sapiens*], PRO0470 protein, RIKEN cDNA 4933416E14 gene, ferritin light chain 2, ferritin, light polypeptide |
| 1018 | 3916 | AI169947 | i, bb | | |
| 1019 | 3733 | AI170053 | u, General | | |
| 1020 | 14179 | AI170224 | cc | | |
| 1021 | 11406 | AI170263 | r | | interleukin 20 receptor, alpha |
| 1022 | 3547 | AI170279 | General | | ESTs, Weakly similar to ZNT4_HUMAN ZINC TRANSPORTER 4 [*H. sapiens*], RIKEN cDNA 1810059J10 gene, hypothetical protein DKFZp547M236, hypothetical protein FLJ12496, solute carrier family 30 |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 1023 | 11524 | AI170340 | j, y, z | | (zinc transporter), member 1, solute carrier family 30 (zinc transporter), member 4 PDZ and LIM domain 1 (elfin), PDZ and LIM domain 3, PDZ-LIM protein mystique, RIKEN cDNA 1110003B01 gene, *Rattus norvegicus* LIM-domain protein LMP-1 mRNA, complete cds, Z-band alternatively spliced PDZ-motif, actinin alpha 2 associated LIM protein, alpha-actinin-2-associated LIM protein, reversion induced LIM gene |
| 1024 | 2729 | AI170363 | e, i | | |
| 1025 | 18811 | AI170525 | i | | |
| 1026 | 22524 | AI170542 | h | | |
| 1027 | 24048 | AI170570 | a, g | | CGI-10 protein |
| 1028 | 5968 | AI170692 | y, aa | | GABA(A) receptor-associated protein-like 2, RIKEN cDNA 0610012F20 gene, gamma-aminobutyric acid (GABA(A)) receptor-associated protein-like 1, ganglioside expression factor 2 |
| 1029 | 9757 | AI170693 | b | | |
| 1030 | 18905 | AI170770 | e, s | | |
| 1031 | 16170 | AI170894 | i | | RIKEN cDNA 1300012C15 gene, RIKEN cDNA 2310076L09 gene, adipose differentiation related protein, adipose differentiation-related protein |
| 1032 | 7089 | AI171185 | c | hyaluronan mediated motility receptor (RHAMM), hyaluronan-mediated motility receptor (RHAMM) | *Mus musculus* 12 days embryo male wolffian duct includes surrounding region cDNA, RIKEN full-length enriched library, clone 6720466F14, full insert sequence, RIKEN cDNA 0610027D24 gene, TRAF4 associated factor 1, hyaluronan mediated motility receptor (RHAMM), hyaluronan-mediated motility receptor (RHAMM) |
| 1033 | 17591 | AI171354 | b | | |
| 1034 | 13285 | AI171361 | h | | heterogeneous nuclear ribonucleoprotein A0 |
| 1035 | 4428 | AI171362 | a | | EST, Moderately similar to NUAM_HUMAN NADH-UBIQUINONE OXIDOREDUCTASE 75 KD SUBUNIT PRECURSOR [*H. sapiens*], NADH dehydrogenase (ubiquinone) Fe-S protein 1 (75 kD) (NADH-coenzyme Q reductase) |
| 1036 | 18126 | AI171369 | w | | |
| 1037 | 23253 | AI171448 | o | | RIKEN cDNA 2010107E04 gene, chromosome 14 open reading frame 2, expressed sequence AU043134, expressed sequence AV124504 |
| 1038 | 4584 | AI171492 | m, General | | |
| 1039 | 11158 | AI171542 | r, s | | EST, Moderately similar to NI2M_HUMAN NADH-UBIQUINONE OXIDOREDUCTASE B22 SUBUNIT [*H. sapiens*], NADH dehydrogenase (ubiquinone) 1 beta subcomplex, 9 (22 kD, B22) |
| 1040 | 15345 | AI171587 | l | | |
| 1041 | 21183 | AI171676 | k | | |
| 1042 | 8215 | AI171692 | i | ferritin light chain 1, ferritin, light polypeptide | ESTs, Highly similar to FRHUL ferritin light chain [*H. sapiens*], ESTs, Moderately similar to FRHUL ferritin light chain [*H. sapiens*], PRO0470 protein, RIKEN cDNA 2010009K05 gene, RIKEN cDNA 4933416E14 gene, cysteine conjugate-beta lyase; cytoplasmic (glutamine transaminase K, kyneurenine aminotransferase), ferritin light chain 2, ferritin, light polypeptide, hypothetical protein 669 |
| 1043 | 11437 | AI171794 | l | | |
| 1044 | 2625 | AI171800 | cc | | |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 1045 | 23579 | AI171802 | v | | |
| 1046 | 11708 | AI171807 | l, t | | |
| 1047 | 17204 | AI171844 | s, y, z | | ATP synthase, H+ transporting, mitochondrial F1 complex, epsilon subunit, RIKEN cDNA 2410043G19 gene, expressed sequence AV000645 |
| 1048 | 4420 | AI171916 | m | | |
| 1049 | 3266 | AI171948 | l, m | | DKFZP564F0522 protein, ESTs. Weakly similar to T08675 hypothetical protein DKFZp564F0522.1 [*H. sapiens*] |
| 1050 | 19012 | AI172056 | t | | |
| 1051 | 11205 | AI172057 | a, q, bb | | |
| 1052 | 6057 | AI172102 | b | | |
| 1053 | 19128 | AI172103 | m | | |
| 1054 | 15673 | AI172107 | z | | KIAA1883 protein, sirtuin (silent mating type information regulation 2, *S. cerevisiae*, homolog) 2, sirtuin 2 (silent mating type information regulation 2, homolog) 2 (*S. cerevisiae*) |
| 1055 | 6630 | AI172184 | n | | |
| 1056 | 11968 | AI172208 | bb | | Alpha-fetoprotein, ESTs, Weakly similar to ALPHA-FETOPROTEIN PRECURSOR [*M. musculus*], ESTs, Weakly similar to FPHU alpha-fetoprotein precursor [*H. sapiens*], alpha fetoprotein, alpha-fetoprotein |
| 1057 | 6974 | AI172263 | l, m | | |
| 1058 | 23313 | AI172271 | d | | |
| 1059 | 2140 | AI172272 | General | | ESTs, Highly similar to JC4577 transcription elongation factor T1 [*H. sapiens*], expressed sequence AI326274, transcription elongation factor A (SII), 2 |
| 1060 | 15382 | AI172302 | l, p, General | | |
| 1061 | 18689 | AI172329 | l | | |
| 1062 | 17887 | AI172414 | o | | |
| 1063 | 3042 | AI172447 | General | | ESTs, Highly similar to BCL3 [*M. musculus*], ESTs, Weakly similar to I-kappa B alpha chain [*M. musculus*], hypothetical protein MGC15396, nuclear factor of kappa light chain gene enhancer in B-cells inhibitor, alpha, nuclear factor of kappa light chain gene enhancer in B-cells inhibitor, beta, nuclear factor of kappa light polypeptide gene enhancer in B-cells inhibitor, alpha, nuclear factor of kappa light polypeptide gene enhancer in B-cells inhibitor, epsilon, testis-specific ankyrin motif containing protein |
| 1064 | 17291 | AI172491 | bb | | ESTs, Highly similar to ISOCITRATE DEHYDROGENASE [*R. norvegicus*], Isocitrate dehydrogenase 1, soluble, isocitrate dehydrogenase 1 (NADP+), soluble, isocitrate dehydrogenase 2 (NADP+), mitochondrial |
| 1065 | 26222 | AI172506 | p | | |
| 1066 | 13095 | AI172595 | r | | |
| 1067 | 8795 | AI172618 | General | | |
| 1068 | 6454 | AI175342 | j, l, m, y | | BACULOVIRAL IAP REPEAT-CONTAINING PROTEIN 6 (UBIQUITIN-CONJUGATING BIR-DOMAIN ENZYME APOLLON) [*H. sapiens*], ESTs, Moderately similar to T31067 BIR repeat containing ubiquitin-conjugating enzyme BRUCE - mouse [*M. musculus*], baculoviral IAP repeat-containing 6, hypothetical protein FLJ13855, likely ortholog of mouse ubiquitin-conjugating enzyme E2-230K |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 1070 | 4445 | AI175466 | x | | EST, Highly similar to RASN RAT TRANSFORMING PROTEIN P21/N-RAS [*R. norvegicus*], EST, Weakly similar to TVHURR transforming protein R-ras [*H. sapiens*], Harvey rat sarcoma oncogene, subgroup R, RIKEN cDNA 2610016H24 gene, RIKEN cDNA 4930526B11 gene, Ris, expressed sequence AI573426, neuroblastoma RAS viral (v-ras) oncogene homolog, neuroblastoma ras oncogene, related RAS viral (r-ras) oncogene homolog, similar to mouse Ras, dexamethasone-induced 1 |
| 1071 | 3418 | AI175475 | m | | ESTs, Weakly similar to NHPX RAT NHP2/RS6 FAMILY PROTEIN YEL026W HOMOLOG [*R. norvegicus*], RIKEN cDNA 2410130M07 gene, non-histone chromosome protein 2 (*S. cerevisiae*)-like 1, nucleolar protein family A, member 2 (H/ACA small nucleolar RNPs), sperm specific antigen 1 |
| 1072 | 18507 | AI175551 | bb | | ESTs, Highly similar to S25432 translation elongation factor eEF-1 beta chain [*H. sapiens*], eukaryotic translation elongation factor 1 beta 2 |
| 1073 | 10217 | AI175628 | w | | |
| 1074 | 7262 | AI175833 | j, m, x | | |
| 1075 | 19004 | AI175875 | r | | |
| 1076 | 22352 | AI175959 | l, General | | |
| 1077 | 7022 | AI176041 | h, n | | |
| 1078 | 21467 | AI176061 | t | | EST, Moderately similar to TIG2_HUMAN RETINOIC ACID RECEPTOR RESPONDER PROTEIN 2 PRECURSOR [*H. sapiens*], retinoic acid receptor responder (tazarotene induced) 2 |
| 1079 | 18581 | AI176160 | General | | |
| 1080 | 14159 | AI176169 | g | | |
| 1081 | 21742 | AI176172 | w | | |
| 1082 | 10182 | AI176185 | v | FBJ osteosarcoma oncogene, v-fos FBJ murine osteosarcoma viral oncogene homolog | |
| 1083 | 22765 | AI176265 | General | | |
| 1084 | 6905 | AI176275 | a | | EST, Moderately similar to T02747 phospholipid-hydroperoxide glutathione peroxidase [*H. sapiens*], EST, Weakly similar to T02747 phospholipid-hydroperoxide glutathione peroxidase [*H. sapiens*], ESTs, Weakly similar to GSHH RAT PHOSPHOLIPID HYDROPEROXIDE GLUTATHIONE PEROXIDASE [*R. norvegicus*], *Homo sapiens* PRO2893 mRNA, complete cds, RIKEN cDNA 2310016C16 gene, RIKEN cDNA 3110050F08 gene, glutathione peroxidase 4, glutathione peroxidase 4 (phospholipid hydroperoxidase) |
| 1085 | 12999 | AI176276 | cc | | *Homo sapiens* cDNA FLJ12570 fis, clone NT2RM4000895, UDP-N-acteylglucosamine pyrophosphorylase 1 |
| 1086 | 16438 | AI176294 | e | | ESTs, Weakly similar to B Chain B, Crystal Structure Of The D1d2 Sub-Complex From The Human Snrnp Core Domain [*H. sapiens*], small nuclear ribonucleoprotein D2 polypeptide (16 5 kD) |
| 1087 | 21130 | AI176298 | y | | |
| 1088 | 3014 | AI176362 | e | | |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 1089 | 15015 | AI176363 | r | | |
| 1090 | 19006 | AI176393 | x | | |
| 1091 | 20001 | AI176396 | o | | ESTs, Highly similar to C560__HUMAN SUCCINATE DEHYDROGENASE CYTOCHROME B560 SUBUNIT, MITOCHONDRIAL PRECURSOR [*H. sapiens*], succinate dehydrogenase complex, subunit C, integral membrane protein, 15 kD |
| 1092 | 12174 | AI176435 | j, m | | |
| 1093 | 15191 | AI176456 | b, o, t, v, cc | | ESTs, Moderately similar to AF078844 1 hqp0376 protein [*H. sapiens*], expressed sequence AA409533 |
| 1094 | 24236 | AI176473 | d, General | | |
| 1095 | 16518 | AI176546 | v | | ESTs, Highly similar to HS9B RAT HEAT SHOCK PROTEIN HSP 90-BETA [*R. norvegicus*], *Mus musculus*, clone IMAGE: 3584589, mRNA, partial cds, expressed sequence C81438, heat shock 90 kD protein 1, beta, heat shock protein, 84 kDa 1, heat shock protein, 86 kDa 1 |
| 1096 | 2161 | AI176592 | General | | |
| 1097 | 12436 | AI176610 | General | | ESTs, Weakly similar to SYC__HUMAN CYSTEINYL-TRNA SYNTHETASE [*H. sapiens*], cysteinyl-tRNA synthetase, hypothetical protein FLJ12118 |
| 1098 | 2536 | AI176616 | l, v, General | | |
| 1099 | 18525 | AI176792 | u | | |
| 1100 | 23449 | AI176828 | g | | |
| 1101 | 23299 | AI176839 | General | | |
| 1102 | 3580 | AI176848 | e | | |
| 1103 | 22103 | AI176849 | d, General | | |
| 1104 | 16036 | AI176855 | f | | |
| 1105 | 15588 | AI176916 | General | | phosphomannomutase 1 |
| 1106 | 16917 | AI176951 | t | | |
| 1107 | 16124 | AI176963 | cc | | with Glu/Asp-rich carboxy-terminal domain, 2, Cbp/p300-interacting transactivator, with Glu/Asp-rich carboxy-terminal domain, 4, ESTs, Weakly similar to MRG1__HUMAN MSG-RELATED PROTEIN 1 [*H. sapiens*], expressed sequence AW742964 |
| 1108 | 15146 | AI176969 | b, General | | |
| 1109 | 5786 | AI177058 | f | | |
| 1110 | 2852 | AI177059 | c | | |
| 1112 | 3156 | AI177092 | g | | |
| 1113 | 14384 | AI177096 | a | | EST, Moderately similar to APT RAT ADENINE PHOSPHORIBOSYLTRANSFERASE [*R. norvegicus*], Mouse adenine phosphoribosyltransferase (APRT), complete cds, adenine phosphoribosyl transferase, adenine phosphoribosyltransferase, expressed sequence C85684 |
| 1114 | 13310 | AI177119 | General | | ESTs, Weakly similar to COMPLEMENT C1Q SUBCOMPONENT, C CHAIN PRECURSOR [*M. musculus*], *Homo sapiens*, Similar to complement component 1, q subcomponent, c polypeptide, clone MGC: 17279 IMAGE: 4212772, mRNA, complete cds, complement component 1, q subcomponent, beta polypeptide, complement component 1, q subcomponent, c polypeptide, expressed sequence AI385742 |
| 1115 | 24049 | AI177341 | g, p, s, u | | CGI-10 protein |
| 1116 | 15964 | AI177360 | o, General | | |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 1117 | 14989 | AI177366 | u | | ESTs, Highly similar to B27079 fibronectin receptor beta chain precursor [*H. sapiens*], integrin beta 1 (fibronectin receptor beta), integrin beta 2, integrin, beta 1 (fibronectin receptor, beta polypeptide, antigen CD29 includes MDF2, MSK12), integrin, beta 2 (antigen CD18 (p95), lymphocyte function-associated antigen 1, macrophage antigen 1 (mac-1) beta subunit) |
| 1118 | 7975 | AI177374 | aa | | |
| 1119 | 3006 | AI177395 | k | | dickkopf (*Xenopus laevis*) homolog 3, dickkopf (*Xenopus laevis*) homolog 4, soggy-1 gene |
| 1120 | 17570 | AI177683 | r | | ESTs, Highly similar to ROA3_HUMAN HETEROGENEOUS NUCLEAR RIBONUCLEOPROTEIN A3 [*H. sapiens*], ESTs, Highly similar to S12520 core protein A1 [*H. sapiens*], ESTs, Weakly similar to ROA2 MOUSE HETEROGENEOUS NUCLEAR RIBONUCLEOPROTEINS A2/B1 [*M. musculus*], Human DNA sequence from clone 522P13 on chromosome 6p21.31-22.3. Contains a 60S Ribosomal Protein L21 pseudogene and an HNRNP A3 (Heterogenous Nuclear Riboprotein A3, FBRNP) pseudogene. Contains ESTs, STSs and GSSs, RIKEN cDNA 3010025E17 gene, Ras-GTPase-activating protein SH3-domain binding protein, heterogeneous nuclear ribonucleoprotein A1, heterogeneous nuclear ribonucleoprotein A2/B1, hypothetical protein 23851 |
| 1121 | 9521 | AI177706 | b | | |
| 1122 | 14425 | AI177755 | g, General | | ESTs, Moderately similar to PBEF_HUMAN PRE-B CELL ENHANCING FACTOR PRECURSO [*H. sapiens*], pre-B-cell colony-enhancing factor |
| 1123 | 10611 | AI177790 | j, m | | |
| 1124 | 5356 | AI177813 | cc | | modulator recognition factor I |
| 1125 | 11791 | AI177843 | General | | sarcoma amplified sequence |
| 1126 | 14484 | AI177867 | General | | EH-domain containing 3, EH-domain containing 4, ESTs, Highly similar to EP15 MOUSE EPIDERMAL GROWTH FACTOR RECEPTOR SUBSTRATE SUBSTRATE 15 [*M. musculus*], *Homo sapiens* cDNA FLJ13682 fis, clone PLACE2000015, weakly similar to EPIDERMAL GROWTH FACTOR RECEPTOR SUBSTRATE SUBSTRATE 15, *Mus musculus* adult male cecum cDNA, RIKEN full-length enriched library, clone: 9130014G17, full insert sequence, epidermal growth factor receptor pathway substrate 15, epidermal growth factor receptor substrate EPS15R |
| 1127 | 5780 | AI177869 | General | | EST, Weakly similar to TESTIN 2 [*M. musculus*], LIM and cysteine-rich domains 1, four and a half LIM domains 2, testis derived transcript, testis derived transcript (3 LIM domains), vascular Rab-GAP/TBC-containing |
| 1128 | 19184 | AI178025 | General | | ESTs, Weakly similar to TGIF MOUSE 5'-TG-3' INTERACTING FACTOR [*M. musculus*], *Homo sapiens* TGF beta induced transcription factor 2-like |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 1129 | 6059 | AI178245 | c, General | | mRNA, partial sequence, RIKEN cDNA 5430405H02 gene, RIKEN cDNA 5730599O09 gene, TG interacting factor, TGFB-induced factor (TALE family homeobox), TGFB-induced factor 2 (TALE family homeobox) ESTs, Highly similar to T13963 formin related protein, lymphocyte specific - mouse [*M. musculus*], ESTs, Moderately similar to T13963 formin related protein, lymphocyte specific - mouse [*M. musculus*], *Homo sapiens* mRNA; cDNA DKFZp762B245 (from clone DKFZp762B245); partial cds, KIAA1902 protein, formin-like chromosome 1 open reading frame 9 |
| 1130 | 23248 | AI178267 | y | | |
| 1131 | 4073 | AI178272 | o | | |
| 1132 | 7838 | AI178291 | e | | |
| 1133 | 18996 | AI178326 | y | | |
| 1134 | 22488 | AI178392 | b | | EST, Highly similar to I49523 Mouse primary response gene B94 mRNA, 3'end - mouse [*M. musculus*], *Homo sapiens*, clone MGC. 16332 IMAGE: 3842543, mRNA, complete cds, RIKEN cDNA 1200009I06 gene, RIKEN cDNA 1600013K19 gene, similar to *S. cerevisiae* Sec6p and *R. norvegicus* rsec6, tumor necrosis factor, alpha-induced protein 2 |
| 1135 | 18800 | AI178504 | n, p, aa | | |
| 1136 | 22197 | AI178527 | g, General | | |
| 1137 | 3401 | AI178684 | bb | | ESTs, Weakly similar to MCM3_HUMAN DNA REPLICATION LICENSING FACTOR MCM3 [*H. sapiens*], minichromosome maintenance deficient (*S. cerevisiae*) 3 |
| 1138 | 17713 | AI178700 | m | | |
| 1139 | 14874 | AI178735 | e | | |
| 1140 | 23567 | AI178746 | v, General | | |
| 1141 | 18907 | AI178971 | c | | EST, Moderately similar to HART1 hemoglobin alpha-1 chain - rat [*R. norvegicus*], EST, Weakly similar to A45964 hemoglobin alpha chain - mouse [*M. musculus*], ESTs, Moderately similar to HART1 hemoglobin alpha-1 chain - rat [*R. norvegicus*], Hemoglobin, alpha 1, hemoglobin alpha, adult chain 1, hemoglobin, alpha 1, hemoglobin, alpha 2 |
| 1142 | 20991 | AI178979 | l | | |
| 1143 | 5887 | AI179099 | q, t | | biotinidase, vanin 1, vanin 2, vanin 3 |
| 1144 | 8477 | AI179167 | b, e, General | | |
| 1145 | 3348 | AI179288 | u, v | | |
| 1146 | 13608 | AI179314 | e | | |
| 1147 | 8849 | AI179315 | g, p | | |
| 1148 | 13611 | AI179378 | v, General | | EST, Weakly similar to MAST CELL PROTEASE 7 PRECURSOR [*M. musculus*], ESTs, Weakly similar to MCT7 RAT MAST CELL PROTEASE 7 PRECURSOR [*R. norvegicus*], RIKEN cDNA 2410039E18 gene, RIKEN cDNA 4933401F05 gene, marapsin, mast cell protease 7, protease, serine, 21 (testisin), protease, serine, 22, protease, serine, 8 (prostasin), tryptase delta 1, tryptase, alpha |
| 1149 | 15438 | AI179399 | m, x | collagen, type V, alpha 2, procollagen, type V, alpha 2 | EST, Highly similar to CA13_HUMAN COLLAGEN ALPHA 1(III) CHAIN PRECURSOR [*H. sapiens*], EST, Weakly similar to CA25_HUMAN COLLAGEN ALPHA 2(V) CHAIN PRECURSO [*H. sapiens*], EST, Weakly |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| | | | | | similar to I49607 procollagen type V alpha 2 - mouse [*M. musculus*], RIKEN cDNA 2810002D19 gene, collagen, type III, alpha 1 (Ehlers-Danlos syndrome type IV, autosomal dominant), collagen, type V, alpha 2, hypothetical protein DKFZp434F0318, hypothetical protein MGC12921, procollagen, type III, alpha 1, procollagen, type V, alpha 2, procollagen, type XIII, alpha 1 |
| 1150 | 13614 | AI179407 | e, t, General | | |
| 1151 | 15042 | AI179422 | b, General | | |
| 1152 | 2768 | AI179481 | l, General | | |
| 1153 | 24041 | AI179580 | b, i | | |
| 1154 | 19822 | AI179599 | o, General | | |
| 1155 | 23270 | AI179601 | q, General | | |
| 1156 | 5901 | AI179605 | e | | |
| 1157 | 16081 | AI179610 | g, i, p | heme oxygenase (decycling) 1 | heme oxygenase (decycling) 1 |
| 1158 | 14564 | AI179717 | k | | |
| 1159 | 7918 | AI179750 | General | | |
| 1160 | 6647 | AI179795 | g | | |
| 1161 | 9097 | AI179875 | o, General | hypothetical protein similar to mouse aldehyde reductase 6 (renal), renal-specific oxido-reducatse | |
| 1162 | 23989 | AI179953 | a | | gap junction membrane channel protein beta 2, gap junction membrane channel protein beta 6, gap junction protein, beta 2, 26 kD (connexin 26), gap junction protein, beta 6 (connexin 30) |
| 1163 | 12899 | AI179967 | b | | |
| 1164 | 1687 | AI179971 | c | hemoglobin alpha, adult chain 2, hemoglobin, alpha 1 | EST, Moderately similar to HART1 hemoglobin alpha-1 chain - rat [*R. norvegicus*], ESTs, Moderately similar to HART1 hemoglobin alpha-1 chain - rat [*R. norvegicus*], RIKEN cDNA 2510042H12 gene, hemoglobin alpha, adult chain 1, hemoglobin, alpha 1, hemoglobin, alpha 2 |
| 1165 | 22569 | AI179979 | General | | |
| 1166 | 23514 | AI179986 | o, General | | phosphoserine phosphatase, phosphoserine phosphatase-like |
| 1167 | 15892 | AI179988 | c, General | | |
| 1168 | 12402 | AI180004 | g | | |
| 1169 | 5443 | AI180165 | General | | DnaJ (Hsp40) homolog, subfamily B, member 3, DnaJ (Hsp40) homolog, subfamily B, member 6, ESTs, Moderately similar to HSJ2_HUMAN DNAJ PROTEIN HOMOLOG 2 [*H. sapiens*], ESTs, Weakly similar to HSJ2_HUMAN DNAJ PROTEIN HOMOLOG 2 [*H. sapiens*], *Homo sapiens*, clone IMAGE.3930327, mRNA, partial cds, RIKEN cDNA 2810451A06 gene, expressed sequence AU020082 |
| 1170 | 5481 | AI180170 | General | | eukaryotic translation termination factor 1 |
| 1171 | 24028 | AI180239 | l | | |
| 1172 | 17089 | AI180281 | g | | |
| 1173 | 3701 | AI180306 | aa | | KIAA0273 gene product, KIAA1796 protein |
| 1174 | 3352 | AI180334 | m | | |
| 1175 | 24368 | AI180392 | l, m | | ESTs, Highly similar to NBP_HUMAN NUCLEOTIDE-BINDING PROTEIN [*H. sapiens*], hypothetical protein FLJ12660, nucleotide binding protein 1 (*E. coli* MinD like), nucleotide binding protein 2 (*E. coli* MinD like) |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 1176 | 14337 | AI180414 | c | | EST, Highly similar to T14106 probable GTPase-activating protein SPA-1 - rat [*R. norvegicus*], ESTs, Highly similar to T14106 probable GTPase-activating protein SPA-1 - rat [*R. norvegicus*], KIAA0440 protein, RIKEN cDNA 2610511M17 gene, expressed sequence AW213287, signal-induced proliferation associated gene 1 |
| 1177 | 19080 | AI227647 | j, y, z | | hypothetical protein, clone 1-53, small inducible cytokine subfamily D (Cys-X3 Cys), member 1 (fractalkine, neurotactin), small inducible cytokine subfamily D, 1 |
| 1178 | 22838 | AI227667 | aa | | |
| 1179 | 6765 | AI227761 | i, General | | KIAA0665 gene product, KIAA1821 protein |
| 1180 | 24054 | AI227867 | General | | X-linked protein, brain expressed, X-linked 1, hypothetical protein FLJ10097, nerve growth factor receptor (TNFRSF16) associated protein 1 |
| 1181 | 7324 | AI227885 | i | | |
| 1182 | 23898 | AI227987 | d | | |
| 1183 | 1651 | AI228068 | n, w | peptidylglycine alpha-amidating monooxygenase | peptidylglycine alpha-amidating monooxygenase |
| 1184 | 14237 | AI228128 | e | | |
| 1185 | 14242 | AI228197 | General | | ESTs, Moderately similar to C211_HUMAN PUTATIVE PROTEIN C21ORF18 [*H. sapiens*], chromosome 21 open reading frame 18 |
| 1186 | 16913 | AI228236 | o | | |
| 1187 | 22915 | AI228299 | r | | |
| 1188 | 8917 | AI228301 | General | | |
| 1189 | 15879 | AI228313 | r, General | | |
| 1190 | 13727 | AI228326 | o, General | | |
| 1191 | 6102 | AI228335 | General | | |
| 1192 | 13730 | AI228356 | a | | ESTs, Highly similar to S70642 ubiquitin ligase Nedd4 - rat [*R. norvegicus*], ESTs, Moderately similar to S70642 ubiquitin ligase Nedd4 - rat [*R. norvegicus*], ESTs, Weakly similar to NED4 MOUSE NEDD-4 PROTEIN [*M. musculus*], RIKEN cDNA 2600016C11 gene, neural precursor cell expressed, developmentally down-regulated 4, neural precursor cell expressed, developmentally down-regulated gene 4a |
| 1193 | 13745 | AI228494 | b, cc | | |
| 1194 | 4217 | AI228587 | s | | hypothetical protein MGC4614, membrane component, chromosome 17, surface marker 2 (ovarian carcinoma antigen CA125), next to the Brca1, oxidative stress induced like, sequestosome 1 |
| 1195 | 16053 | AI228596 | cc | | |
| 1196 | 3557 | AI228672 | e | | |
| 1197 | 11605 | AI228682 | e | | |
| 1198 | 13203 | AI228728 | r | | |
| 1199 | 13771 | AI228848 | g | | DEAD/H (Asp-Glu-Ala-Asp/His) box binding protein 1, Protein inhibitor of activated STAT X, protein inhibitor of activated STAT protein PIASy, protein inhibitor of activated STAT3 |
| 1200 | 5918 | AI229036 | r | | |
| 1201 | 8235 | AI229154 | k | | |
| 1202 | 16203 | AI229196 | r | vesicle-associated membrane protein 1, vesicle-associated membrane protein 1 | *Rattus norvegicus* mRNA for vesicle associated membrane protein 2B, vesicle-associated membrane protein 1, vesicle-associated membrane |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| | | | | (synaptobrevin 1), vesicle-associated membrane protein 2, vesicle-associated membrane protein 2 (synaptobrevin 2) | protein 1 (synaptobrevin 1), vesicle-associated membrane protein 2, vesicle-associated membrane protein 2 (synaptobrevin 2), vesicle-associated membrane protein 5, vesicle-associated membrane protein 5 (myobrevin), vesicle-associated membrane protein 8, vesicle-associated membrane protein 8 (endobrevin) |
| 1203 | 13826 | AI229304 | a | | |
| 1204 | 13144 | AI229320 | g | | |
| 1205 | 4640 | AI229404 | x, aa | | |
| 1206 | 23563 | AI229421 | l | | MAP kinase-activated protein kinase 2, mitogen-activated protein kinase-activated protein kinase 3 |
| 1207 | 15426 | AI229497 | s | | NADH dehydrogenase (ubiquinone) 1 beta subcomplex, 10 (22 kD, PDSW) |
| 1208 | 15193 | AI229508 | bb | | |
| 1209 | 19243 | AI229638 | x | | thymidine kinase 1, thymidine kinase 1, soluble |
| 1210 | 23078 | AI229647 | p | | |
| 1211 | 3099 | AI229680 | o | | NADH dehydrogenase (ubiquinone) Fe S protein 3 (30 kD) (NADH-coenzyme Q reductase) |
| 1212 | 19508 | AI229698 | bb | | |
| 1213 | 13977 | AI229707 | x | | EST, Moderately similar to I38369 beta tubulin [*H. sapiens*], EST, Weakly similar to I38369 beta-tubulin [*H. sapiens*], EST, Weakly similar to TUBULIN BETA-5 CHAIN [*M. musculus*], ESTs, Highly similar to A25113 tubulin beta chain 15 - rat [*R. norvegicus*], FK506-binding protein 1A (12 kD), RIKEN cDNA 2310061K05 gene, RIKEN cDNA 2410129E14 gene, tubulin, beta 2, tubulin, beta 5, tubulin, beta polypeptide |
| 1214 | 23983 | AI229708 | v | | quinolinate phosphoribosyltransferase (nicotinate-nucleotide pyrophosphorylase (carboxylating)) |
| 1215 | 2688 | AI229793 | e | | |
| 1216 | 13874 | AI229832 | g | | |
| 1217 | 12587 | AI229979 | General | | ESTs, Weakly similar to MOT2 MOUSE MONOCARBOXYLATE TRANSPORTER 2 [*M. musculus*], monocarboxylate transporter, monocarboxylate transporter 4, solute carrier 16 (monocarboxylic acid transporters), member 8, solute carrier family 16 (monocarboxylic acid transporters), member 3, solute carrier family 16 (monocarboxylic acid transporters), member 7, solute carrier family 16 (monocarboxylic acid transporters), member 8 |
| 1218 | 20591 | AI229993 | l, m | | |
| 1219 | 24042 | AI230002 | a, b, d, General | | |
| 1220 | 13880 | AI230042 | u | | EST, Highly similar to CCAA MOUSE VOLTAGE-DEPENDENT P/Q-TYPE CALCIUM CHANNEL ALPHA-1A SUBUNIT [*M. musculus*], ESTs, Weakly similar to CCAA MOUSE VOLTAGE-DEPENDENT P/Q-TYPE CALCIUM CHANNEL ALPHA-1A SUBUNIT [*M. musculus*], *Homo sapiens* mRNA; cDNA DKFZp434M0223 (from clone DKFZp434M0223); partial cds, *Mus musculus* calcium channel mRNA, complete cds, calcium channel, P/Q type, alpha 1A, calcium channel, |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 1221 | 17672 | AI230074 | d | | voltage-dependent, alpha 1G subunit, two-pore channel 1, homolog NADH dehydrogenase (ubiquinone) 1 alpha subcomplex, 1, NADH dehydrogenase (ubiquinone) 1 alpha subcomplex, 1 (7.5 kD, MWFE) |
| 1222 | 3652 | AI230113 | General | | ESTs, Highly similar to E2BE RAT TRANSLATION INITIATION FACTOR EIF-2B EPSILON SUBUNIT [*R. norvegicus*], HSPC028 protein, RIKEN cDNA 1200015E15 gene, *Rattus norvegicus* initiation factor eIF-2Be mRNA, complete cds, basic leucine-zipper protein BZAP45, eukaryotic translation initiation factor 2B, subunit 5 (epsilon, 82 kD), expressed sequence C81315 |
| 1223 | 18650 | AI230121 | aa | | EST, Weakly similar to ENPL_HUMAN ENDOPLASMIN PRECURSOR [*H. sapiens*], ESTs, Highly similar to HS9B RAT HEAT SHOCK PROTEIN HSP 90-BETA [*R. norvegicus*], ESTs, Weakly similar to ENPL_HUMAN ENDOPLASMIN PRECURSOR [*H. sapiens*], *Homo sapiens* mRNA; cDNA DKFZp564F053 (from clone DKFZp564F053), RIKEN cDNA 1810014B01 gene, RIKEN cDNA 2410002K23 gene, expressed sequence C81438, heat shock 90 kD protein 1, beta, heat shock protein, 84 kDa 1, tumor rejection antigen (gp96) 1, tumor rejection antigen gp96 |
| 1224 | 13025 | AI230173 | c | | ESTs, Moderately similar to CHD3_HUMAN CHROMODOMAIN HELICASE-DNA-BINDING PROTEIN 3 [*H. sapiens*], chromodomain helicase DNA binding protein 3 |
| 1225 | 4280 | AI230247 | z | selenoprotein P, plasma, 1 | ESTs, Highly similar to A47327 selenoprotein P precursor [*H. sapiens*], selenoprotein P, plasma, 1 |
| 1226 | 18528 | AI230284 | General | | |
| 1227 | 7084 | AI230362 | p | | *Homo sapiens*, clone IMAGE: 3845253, mRNA, partial cds |
| 1228 | 20895 | AI230549 | b, n | | |
| 1229 | 12961 | AI230554 | General | | |
| 1230 | 15636 | AI230616 | r | | EST, Moderately similar to GALECTIN-1 [*R. norvegicus*], Human HL14 gene encoding beta-galactoside-binding lectin, 3' end, clone 2, RIKEN cDNA 2200008F12 gene, beta-galactoside-binding lectin, lectin, galactose binding, soluble 1, lectin, galactoside-binding, soluble, 1 (galectin 1), lectin, galactoside-binding, soluble, 2 (galectin 2) |
| 1231 | 4121 | AI230647 | j, m | | |
| 1232 | 14388 | AI230702 | General | | DNA segment, Chr 17, ERATO Doi 441, expressed, hematological and neurological expressed 1 |
| 1233 | 18529 | AI230716 | x, General | | |
| 1234 | 13618 | AI230724 | General | | EST, Weakly similar to JW0105 synaptojanin 2 alpha protein - mouse [*M. musculus*], ESTs, Weakly similar to 2204390A synaptojanin [*R. norvegicus*], ESTs, Weakly similar to JW0105 synaptojanin 2 alpha protein - mouse [*M. musculus*], expressed sequence AA675315, inositol polyphosphate-5-phosphatase, 75 kD, putative phosphatase, suppressor of actin 1, synaptojanin 2 |
| 1235 | 8304 | AI230746 | cc | | |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 1236 | 4731 | AI230773 | e | | |
| 1237 | 14430 | AI230798 | c, k, x | | |
| 1238 | 16627 | AI230822 | bb | | Alg5, *S. cerevisiae*, homolog of, dolichyl-phosphate mannosyltransferase polypeptide 1, catalytic subunit |
| 1239 | 3125 | AI231028 | General | | DNA segment, Chr 10, ERATO Doi 398, expressed, ESTs, Weakly similar to PTNL RAT PROTEIN TYROSINE PHOSPHATASE, NON-RECEPTOR TYPE 21 [*R. norvegicus*], *Homo sapiens*, Similar to erythrocyte membrane protein band 4.1-like 3, clone MGC: 12343 IMAGE: 4044866, mRNA, complete cds, *Mus musculus* adult male pituitary gland cDNA, RIKEN full-length enriched library, clone 5330430I10, full insert sequence, *Rattus norvegicus* protein tyrosine phosphatase 2E (PTP2E) mRNA, complete cds, erythrocyte membrane protein band 4.1 (elliptocytosis 1, RH-linked), erythrocyte membrane protein band 4.1-like 1, erythrocyte membrane protein band 4.1-like 3, erythrocyte protein band 4.1-like 1, erythrocyte protein band 4.1-like 3, protein tyrosine phosphatase, non-receptor type 21 |
| 1240 | 633 | AI231127 | k | | |
| 1241 | 20846 | AI231140 | p | | EST, Highly similar to 60S RIBOSOMAL PROTEIN L23A [*R. norvegicus*], ESTs, Highly similar to RL2B_HUMAN 60S RIBOSOMAL PROTEIN L23A [*H. sapiens*], ribosomal protein L23a |
| 1242 | 6743 | AI231219 | d | | |
| 1244 | 26292 | AI231391 | k | | |
| 1245 | 12343 | AI231433 | w | | |
| 1246 | 7337 | AI231465 | aa | | |
| 1247 | 16321 | AI231506 | General | | |
| 1248 | 8004 | AI231532 | j, l | | ESTs, Moderately similar to Z183_HUMAN ZINC FINGER PROTEIN 183 [*H. sapiens*], zinc finger protein 183 (RING finger, C3HC4 type) |
| 1249 | 15171 | AI231792 | g | | BCL2-associated athanogene 3, Bcl2-associated athanogene 3, RIKEN cDNA 1600025G07 gene, RIKEN cDNA 2410112I15 gene |
| 1250 | 6193 | AI231797 | i | | |
| 1252 | 14227 | AI231999 | u | | RIKEN cDNA 2810411G23 gene, tumor protein D52-like 1 |
| 1253 | 24501 | AI232006 | w, y, bb | | EST, Moderately similar to EF1D_HUMAN ELONGATION FACTOR 1-DELTA [*H. sapiens*], ESTs, Weakly similar to EF1D_HUMAN ELONGATION FACTOR 1-DELTA [*H. sapiens*], eukaryotic translation elongation factor 1 delta (guanine nucleotide exchange protein), hypothetical protein FLJ20897 |
| 1254 | 3434 | AI232014 | g, q, z, cc, General | | |
| 1255 | 19094 | AI232021 | n, General | | ESTs, Highly similar to Human Translation Initiation Factor Eif1, Nmr, 29 Structures [*H. sapiens*], RIKEN cDNA 1500010M16 gene, RIKEN cDNA 3110001N14 gene, putative translation initiation factor, suppressor of initiator codon mutations, related sequence 1 (*S. cerevisiae*) |
| 1256 | 14020 | AI232076 | u | | |
| 1257 | 6726 | AI232157 | d | | |
| 1258 | 11549 | AI232174 | l, m | | |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 1259 | 23125 | AI232266 | j, s | | |
| 1260 | 2085 | AI232270 | bb | | |
| 1261 | 2913 | AI232272 | o | | |
| 1262 | 14304 | AI232281 | g | | |
| 1263 | 15955 | AI232294 | u, bb, General | | |
| 1264 | 15122 | AI232303 | y | | DKFZP566H073 protein, *Homo sapiens* chromosome 19, cosmid R31343, RIKEN cDNA 1700065B19 gene, RIKEN cDNA 5730408C10 gene, likely ortholog of mouse g1-related zinc finger protein, ring finger protein 13, zinc finger protein 103 |
| 1265 | 4716 | AI232313 | y | purinergic receptor P2X, ligand-gated ion channel 4, purinergic receptor P2X, ligand-gated ion channel, 4 | purinergic receptor P2X, ligand-gated ion channel 4, purinergic receptor P2X, ligand-gated ion channel, 1, purinergic receptor P2X, ligand-gated ion channel, 4 |
| 1266 | 15246 | AI232332 | t, u | | |
| 1267 | 24321 | AI232340 | o | stromal cell derived factor 1, stromal cell-derived factor 1 | stromal cell derived factor 1, stromal cell-derived factor 1 |
| 1268 | 16172 | AI232341 | d | | |
| 1269 | 11411 | AI232346 | h | | |
| 1270 | 19287 | AI232379 | f | platelet derived growth factor receptor, alpha polypeptide, platelet-derived growth factor receptor, alpha polypeptide | |
| 1271 | 5601 | AI232461 | n, General | | Flavin-containing monooxygenase 1, flavin containing monooxygenase 1, flavin containing monooxygenase 2, flavin containing monooxygenase 3, flavin containing monooxygenase 4, hypothetical protein PRO1257 |
| 1272 | 14051 | AI232489 | l, m | | |
| 1273 | 5572 | AI232490 | i, t | | ESTs, Moderately similar to A27340 complement C7 precursor [*H. sapiens*], complement component 7 |
| 1274 | 11157 | AI232494 | cc | | |
| 1275 | 8709 | AI232534 | o | | DnaJ (Hsp40) homolog, subfamily B, member 3, DnaJ (Hsp40) homolog, subfamily B, member 6, ESTs, Moderately similar to HSJ2_HUMAN DNAJ PROTEIN HOMOLOG 2 [*H. sapiens*], ESTs, Weakly similar to HSJ2_HUMAN DNAJ PROTEIN HOMOLOG 2 [*H. sapiens*], *Homo sapiens*, clone IMAGE.3930327, mRNA, partial cds, RIKEN cDNA 2810451A06 gene, expressed sequence AU020082 |
| 1276 | 20350 | AI232552 | j, v, y | | |
| 1277 | 14069 | AI232631 | e | | |
| 1278 | 4440 | AI232643 | w | | |
| 1279 | 17695 | AI232784 | e | | 2,4-dienoyl CoA reductase 1, mitochondrial, 2,4-dienoyl CoA reductase 2, peroxisomal, ESTs, Weakly similar to S11021 2,4-dienoyl-CoA reductase [*R. norvegicus*], FabG (beta-ketoacyl-[acyl-carrier-protein] reductase, *E. coil*) like, H2-K region expressed gene 6, *Homo sapiens* AS10 protein mRNA, partial cds, *Mus musculus*, clone MGC.6971 IMAGE:3154595, mRNA, complete cds, RIKEN cDNA 0610039E24 gene, RIKEN cDNA 1810026B04 gene, carbonyl reductase, oxidoreductase UCPA, peroxisomal trans 2-enoyl CoA reductase; putative short chain alcohol dehydrogenase |
| 1280 | 15796 | AI232874 | v | | |
| 1281 | 12467 | AI232924 | General | | |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 1282 | 12873 | AI232984 | i | | ESTs, Highly similar to I49636 DNA-binding protein - mouse [*M. musculus*], ESTs, Moderately similar to I49636 DNA-binding protein - mouse [*M. musculus*], ESTs, Weakly similar to OZF__HUMAN ZINC FINGER PROTEIN OZF [*H. sapiens*], RIKEN cDNA 2310011F05 gene, pancreas zinc finger protein, zinc finger protein 260, zinc finger protein 36 (KOX 18), zinc finger protein 63, zinc finger protein 97 |
| 1283 | 5355 | AI233031 | r | | |
| 1284 | 18794 | AI233121 | c | | |
| 1285 | 3823 | AI233147 | b, g, General | | DNA segment, Chr 17, human D6S81E 1, ESTs, Highly similar to S33681 translation initiation factor eIF-4A I [*H. sapiens*], HLA-B associated transcript 1, Human clone 23933 mRNA sequence, eukaryotic translation initiation factor 4A, isoform 1, mitochondrial DEAD-box polypeptide 28, nuclear RNA helicase, DECD variant of DEAD box family |
| 1286 | 11967 | AI233155 | c, k, General | | |
| 1287 | 11561 | AI233182 | d | | |
| 1288 | 3471 | AI233183 | g | | putative receptor protein |
| 1289 | 21948 | AI233191 | i | | |
| 1290 | 13598 | AI233194 | g, p, y | | |
| 1291 | 15552 | AI233195 | y | | |
| 1292 | 17907 | AI233224 | bb | | EST, Moderately similar to EGFR__HUMAN EPIDERMAL GROWTH FACTOR RECEPTOR PRECURSOR [*H. sapiens*], Epidermal growth factor receptor, formerly avian erythroblastic leukemia viral (v-erbB) oncogene homolog (Erbb1), avian erythroblastosis oncogene B 3, epidermal growth factor receptor, epidermal growth factor receptor (avian erythroblastic leukemia viral (v-erb-b) oncogene homolog) |
| 1293 | 14111 | AI233269 | cc | | |
| 1294 | 12894 | AI233365 | d | | |
| 1295 | 7161 | AI233407 | General | | |
| 1296 | 15906 | AI233425 | q | | |
| 1297 | 14120 | AI233433 | d | | |
| 1298 | 14095 | AI233468 | a, d | | |
| 1299 | 3075 | AI233494 | u, aa | | oxidase (cytochrome c) assembly 1-like |
| 1300 | 6046 | AI233530 | General | | |
| 1301 | 18900 | AI233570 | General | | EST, Moderately similar to S56108 26S proteasome regulatory complex chain p31 [*H. sapiens*], proteasome (prosome, macropain) 26S subunit, non-ATPase, 8 |
| 1302 | 7888 | AI233583 | General | | *Homo sapiens*, clone MGC: 14993 IMAGE: 3613406, mRNA, complete cds, arginyl-tRNA synthetase |
| 1303 | 16709 | AI233602 | General | adenosine kinase | adenosine kinase, expressed sequence AI255373 |
| 1304 | 5163 | AI233712 | y | | protein phosphatase 1D magnesium-dependent, delta isoform |
| 1305 | 7243 | AI233717 | General | | coatomer protein complex, subunit alpha, embryonic ectoderm development |
| 1306 | 3816 | AI233729 | g | | *Homo sapiens* cDNA FLJ10203 fis, clone HEMBA 1004930, moderately similar to 26S PROTEASOME SUBUNIT S5B, proteasome (prosome, macropain) 26S subunit, non-ATPase, 5 |
| 1307 | 13023 | AI233740 | d, h, General | | Aldehyde reductase 1 (low Km aldose reductase) (5 8 kb PstI fragment, |

TABLE 3-continued

HUMAN HOMOLOGUE ANNOTATIONS

| Seq. ID No. | GenBank Acc./ Identifier Ref. Seq. ID No. | | Model Code | Homologous Gene Name | Homologous Cluster Name |
|---|---|---|---|---|---|
| | | | | | probably the functional gene), EST, Highly similar to Aldose Reductase (E C.1.1 1 21) [*H. sapiens*], ESTs, Moderately similar to ALDOSE REDUCTASE [*R. norvegicus*], ESTs, Moderately similar to ALDOSE REDUCTASE-RELATED PROTEIN 2 [*M. musculus*], *Homo sapiens*, Similar to RIKEN cDNA 1110018J12 gene, clone IMAGE: 3865164, mRNA, partial cds, RIKEN cDNA 2310005E10 gene, aldo-keto reductase family 1, member A4 (aldehyde reductase), aldo-keto reductase family 1, member B1 (aldose reductase), aldo-keto reductase family 1, member B10 (aldose reductase), aldo-keto reductase family 1, member B3 (aldose reductase), fibroblast growth factor regulated protein |
| 1308 | 14871 | AI233743 | g | | |
| 1309 | 7469 | AI233767 | cc | | Golgi-associated, gamma-adaptin ear containing, ARF-binding protein 2 |
| 1310 | 7804 | AI233771 | b | | |
| 1311 | 13563 | AI233773 | e | | |
| 1312 | 2154 | AI233818 | k, cc | A kinase (PRKA) anchor protein (gravin) 12 | |
| 1313 | 16616 | AI234079 | h | | |
| 1314 | 13393 | AI234100 | a, d, General | | EST, Moderately similar to CYSR RAT CYSTEINE-RICH PROTEIN 1 [*R. norvegicus*], ESTs, Weakly similar to CYSR RAT CYSTEINE-RICH PROTEIN 1 [*R. norvegicus*], ESTs, Weakly similar to S12658 cysteine-rich protein [*H. sapiens*], cysteine and glycine-rich protein 1, cysteine rich protein, cysteine-rich protein 2, cysteine-rich protein 3, epithelial protein lost in neoplasm beta, thymus LIM protein |
| 1315 | 7071 | AI234162 | r | | |
| 1316 | 14677 | AI234620 | General | | |
| 1317 | 4443 | AI234629 | m | | |
| 1318 | 22453 | AI234678 | b | | |
| 1319 | 23964 | AI234748 | t, General | | |
| 1320 | 19581 | AI234753 | f | | |
| 1321 | 22152 | AI234822 | o, General | RAS, dexamethasone-induced 1 | Harvey rat sarcoma oncogene, subgroup R, RAP1B, member of RAS oncogene family, RAP2B, member of RAS oncogene family, RIKEN cDNA 2610016H24 gene, RIKEN cDNA 4021402C18 gene, RIKEN cDNA 4930526B11 gene, RIKEN cDNA 5830461H18 gene, expressed sequence AI573426, rap2A-like protein, ras-related protein |
| 1322 | 18942 | AI234865 | d | | |
| 1323 | 22662 | AI234939 | aa | | ATPase, H+ transporting, lysosomal (vacuolar proton pump), subunit 1, EST, Weakly similar to I54197 hypothetical protein [*H. sapiens*], ESTs, Weakly similar to VAS1_RAT VACUOLAR ATP SYNTHASE SUBUNIT S1 PRECURSOR (V-ATPASE S1 SUBUNIT) (V-ATPASE S1 ACCESSORY PROTEIN) (V-ATPASE AC45 SUBUNIT) (C7-1 PROTEIN) [*R. norvegicus*], *Homo sapiens* cDNA FLJ12563 fis, clone NT2RM4000820, weakly similar to VACUOLAR ATP SYNTHASE SUBUNIT AC45 PRECURSOR (EC 3 6 1.34) |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 1324 | 3875 | AI235047 | o, General | | ESTs, Moderately similar to CB80_HUMAN 80 KDA NUCLEAR CAP BINDING PROTEIN [*H. sapiens*], *Homo sapiens* cDNA FLJ11599 fis, clone HEMBA 1003879, nuclear cap binding protein subunit 1, 80 kD |
| 1325 | 19479 | AI235135 | o | | |
| 1326 | 14906 | AI235192 | g | | ATP-binding cassette, sub-family F (GCN20), member 1, ATP-binding cassette, sub-family F (GCN20), member 2, hypothetical protein FLJ11198 |
| 1327 | 14718 | AI235210 | e | | |
| 1328 | 15004 | AI235224 | b, General | | EST, Moderately similar to TIM1 RAT METALLOPROTEINASE INHIBITOR 1 PRECURSOR [*R. norvegicus*], EST, Weakly similar to TIM1 RAT METALLOPROTEINASE INHIBITOR 1 PRECURSOR [*R. norvegicus*], tissue inhibitor of metalloproteinase, tissue inhibitor of metalloproteinase 1 (erythroid potentiating activity, collagenase inhibitor) |
| 1329 | 6632 | AI235277 | v | | |
| 1330 | 14722 | AI235284 | x, z | | ESTs, Highly similar to A60592 T-cell surface glycoprotein E2 precursor [*H. sapiens*], *Homo sapiens* cDNA FLJ13471 fis, clone PLACE1003566, antigen identified by monoclonal antibodies 12E7, F21 and O13, hypothetical protein DKFZp761H2024 |
| 1331 | 1462 | AI235585 | u, General | | |
| 1332 | 21061 | AI235631 | l, m | | |
| 1333 | 14665 | AI235646 | m | MAD (mothers against decapentaplegic, Drosophila) homolog 4, MAD homolog 4 (Drosophila) | MAD (mothers against decapentaplegic, Drosophila) homolog 4 |
| 1334 | 19940 | AI235689 | General | | |
| 1335 | 5698 | AI235692 | u | | |
| 1336 | 23745 | AI235732 | k | | ESTs, Weakly similar to LDVR RAT VERY LOW-DENSITY LIPOPROTEIN RECEPTOR PRECURSOR [*R. norvegicus*], RIKEN cDNA 4933405I11 gene, Very low density lipoprotein receptor, nidogen 2, secreted modular calcium-binding protein 1, secreted modular calcium-binding protein 2, very low density lipoprotein receptor |
| 1337 | 11164 | AI235739 | General | | ESTs, Highly similar to A56716 aromatic ester hydrolase [*H. sapiens*], biphenyl hydrolase-like (serine hydrolase, breast epithelial mucin-associated antigen) |
| 1338 | 5212 | AI235745 | d | | |
| 1339 | 14768 | AI235912 | h | | |
| 1340 | 14776 | AI235950 | m | | |
| 1341 | 3091 | AI236027 | n, General | | |
| 1342 | 14861 | AI236045 | r | | |
| 1343 | 14862 | AI236048 | e | | |
| 1344 | 16943 | AI236097 | p | | integral membrane protein 2 B, integral membrane protein 2B, integral membrane protein 3 |
| 1345 | 8336 | AI236101 | l | | |
| 1346 | 23230 | AI236146 | v | | |
| 1347 | 22855 | AI236150 | e | | Down syndrome critical region gene 5 |
| 1348 | 14594 | AI236152 | i | | |
| 1349 | 18406 | AI236168 | r | | |
| 1350 | 15051 | AI236332 | General | | ESTs, Weakly similar to ATDA_HUMAN DIAMINE ACETYLTRANSFERASE [*H. sapiens*], RIKEN cDNA 2610016A03 gene, |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 1351 | 19298 | AI236338 | bb | | RIKEN cDNA 4930404K22 gene, spermidine/spermine N1-acetyl transferase, spermidine/spermine N1-acetyltransferase |
| 1352 | 10667 | AI236366 | b | | ESTs, Highly similar to NHPX RAT NHP2/RS6 FAMILY PROTEIN YEL026W HOMOLOG [*R. norvegicus*], RIKEN cDNA 2410130M07 gene, non-histone chromosome protein 2 (*S. cerevisiae*)-like 1, nucleolar protein family A, member 2 (H/ACA small nucleolar RNPs), sperm specific antigen 1 ELAV (embryonic lethal, abnormal vision, Drosophila)-like 4 (Hu antigen D), EST, Highly similar to 2201474A inducible poly(A)-binding protein [*H. sapiens*], EST, Weakly similar to 2201474A inducible poly(A)-binding protein [*H. sapiens*], ESTs, Highly similar to HUD RAT PARANEOPLASTIC ENCEPHALOMYELITIS ANTIGEN HUD HOMOLOG [*R. norvegicus*], ESTs, Moderately similar to HUD RAT PARANEOPLASTIC ENCEPHALOMYELITIS ANTIGEN HUD HOMOLOG [*R. norvegicus*], ESTs, Moderately similar to POLYADENYLATE-BINDING PROTEIN 1 [*M. musculus*], *Mus musculus* adult male testis cDNA, RIKEN full-length enriched library, clone.4933407N23, full insert sequence, RIKEN cDNA 4932702K14 gene, poly A binding protein, cytoplasmic 1, poly(A)-binding protein, cytoplasmic 4 (inducible form), siah binding protein 1; FBP interacting repressor, pyrimidine tract binding splicing factor; Ro ribonucleoprotein-binding protein 1 |
| 1353 | 10774 | AI236397 | f | | |
| 1354 | 9407 | AI236402 | aa | | |
| 1355 | 26335 | AI236460 | General | | |
| 1356 | 17950 | AI236590 | t, General | | |
| 1357 | 18259 | AI236601 | h, v | | |
| 1358 | 11445 | AI236613 | j, y | | |
| 1359 | 17248 | AI236635 | o, aa | | S-phase kinase-associated protein 1A (p19A), transcription elongation factor B (SIII), polypeptide 1 (15 kDa),-like, transcription elongation factor B (SIII), polypeptide 1-like |
| 1360 | 16859 | AI236753 | t, General | | |
| 1361 | 5208 | AI236754 | g | | chromosome 8 open reading frame 1 |
| 1362 | 24388 | AI236772 | e, General | | |
| 1363 | 15850 | AI236795 | n, v, w | | EST, Highly similar to HS9B RAT HEAT SHOCK PROTEIN HSP 90-BETA [*R. norvegicus*], EST, Weakly similar to HHMS84 heat shock protein 84 - mouse [*M. musculus*], ESTs, Highly similar to T46243 hypothetical protein DKFZp761K0511.1 [*H. sapiens*], expressed sequence AL022974, expressed sequence C81438, heat shock 90 kD protein 1, beta, heat shock protein, 84 kDa 1 |
| 1364 | 14800 | AI236856 | w | | |
| 1366 | 11404 | AI237002 | m | | Human DNA sequence from clone RP5-1057D4 on chromosome 20 Contains a spermidine synthase (SPDSY) pseudogene, a CpG island, |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 1367 | 18151 | AI237212 | o, General | | ESTs, STSs and GSSs, spermidine synthase hepatitis B virus x-interacting protein (96 kD) |
| 1368 | 21653 | AI237535 | t, General | | |
| 1369 | 11208 | AI237586 | z | | EST, Weakly similar to JC1241 beta-interferon-induced protein - rat [*R. norvegicus*], ESTs, Moderately similar to JC1241 beta-interferon-induced protein - rat [*R. norvegicus*], RIKEN cDNA 1110036C17 gene, RIKEN cDNA 4933438K12 gene, interferon induced transmembrane protein 2 (1-8D) |
| 1370 | 21893 | AI237713 | i, k, aa | | KIAA0101 gene product |
| 1371 | 14842 | AI237724 | r | | |
| 1372 | 3467 | AI237835 | General | | ESTs, Highly similar to MXI1 RAT MAX INTERACTING PROTEIN 1 [*R. norvegicus*], MAX dimerization protein, MAX-interacting protein 1, Max dimerization protein, Max interacting protein 1 |
| 1373 | 25840 | AI638972 | u | | |
| 1374 | 17108 | AI639017 | n | | EST, Highly similar to S30385 G9a protein [*H. sapiens*], ESTs, Weakly similar to T17453 ERG-associated protein ESET - mouse [*M. musculus*], HLA-B associated transcript 8, SET domain, bifurcated 1, expressed sequence C77070, hypothetical protein FLJ12879, suppressor of variegation 3-9 (Drosophila) homolog 2; hypothetical protein FLJ23414 |
| 1375 | 16676 | AI639082 | c, k, x | mini chromosome maintenance deficient 6 (*S. cerevisiae*), minichromosome maintenance deficient (mis5, *S. pombe*) 6 | mini chromosome maintenance deficient 6 (*S. cerevisiae*), minichromosome maintenance deficient (mis5, *S. pombe*) 6 |
| 1376 | 12400 | AI639107 | k | | |
| 1377 | 19952 | AI639108 | q, v | | |
| 1379 | 25907 | AI639167 | o, w | | |
| 1381 | 18533 | AI639231 | n | | hypothetical protein, hypothetical protein FLJ20333 |
| 1382 | 18353 | AI639233 | t, aa | decorin | ESTs, Moderately similar to dJ63G5.3 [*H. sapiens*], RIKEN cDNA 1700034K16 gene, RIKEN cDNA 5530600M07 gene, decorin |
| 1384 | 15330 | AI639285 | General | | |
| 1385 | 20026 | AI639354 | g | | |
| 1386 | 25971 | AI639365 | r | | |
| 1388 | 19152 | AI639387 | u, General | | |
| 1390 | 18338 | AI639422 | y | | EST, Weakly similar to CAQC RAT CALSEQUESTRIN, CARDIAC MUSCLE ISOFORM PRECURSOR [*R. norvegicus*], calsequestrin 1, calsequestrin 1 (fast-twitch, skeletal muscle), calsequestrin 2, calsequestrin 2 (cardiac muscle) |
| 1392 | 20082 | AI639488 | i, m | | EST, Moderately similar to A Chain A, Mdm2 Bound To The Transactivation Domain Of P53 {SUB 17-125 [*H. sapiens*], mouse double minute 2, human homolog of; p53-binding protein, transformed mouse 3T3 cell double minute 2 |
| 1394 | 20056 | AI639504 | a, bb, General | | |
| 1395 | 4713 | AI639518 | q | | |
| 1396 | 14332 | AJ001044 | bb | | EST, Moderately similar to T42215 zonadhesin - mouse [*M. musculus*], EST, Weakly similar to MUC2_HUMAN MUCIN 2 PRECURSOR [*H. sapiens*], *Homo sapiens* SIB 297 intestinal |

TABLE 3-continued

Atty. Docket No. 44921-5089US
Doc. No. 1803440.1

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| | | | | | mucin (MUC3) mRNA, partial cds, RIKEN cDNA 3110056H04 gene, RIKEN cDNA 4931407G18 gene, *Rattus norvegicus* podocalyxin mRNA, complete cds, hepatitis A virus cellular receptor 1, hypothetical protein DKFZp434N185, lymphocyte antigen 64, mucin 1, transmembrane, mucin 2, intestinal/tracheal, zonadhesin |
| 1397 | 7602 | AJ001929 | k | | |
| 1398 | 9867 | AJ005424 | u | | EST, Weakly similar to CGHU3B collagen alpha 3(IV) chain precursor, long splice form [*H. sapiens*], EST, Weakly similar to D40750 proline-rich protein PRB1/2S [*H. sapiens*], RIKEN cDNA 1190004M21 gene, RIKEN cDNA 2410150I18 gene, RIKEN cDNA 6330577E15 gene, expressed sequence AI551093, mitogen-activated protein kinase 7, murine leukemia viral (bmi-1) oncogene homolog, nemo-like kinase, phospholipid scramblase 1 |
| 1400 | 16351 | AJ011811 | General | claudin 7 | ESTs, Weakly similar to CLD7 MOUSE CLAUDIN-7 [*M. musculus*], ESTs, Weakly similar to CLD7 RAT CLAUDIN 7 [*R. norvegicus*], claudin 10, claudin 15, claudin 16, claudin 7 |
| 1401 | 20116 | AJ011969 | l, General | growth differentiation factor 15, prostate differentiation factor | |
| 1402 | 17635 | AJ223355 | v, w | | ESTs, Moderately similar to BMCP_HUMAN BRAIN MITOCHONDRIAL CARRIER PROTEIN-1 [*H. sapiens*], ESTs, Weakly similar to M2OM_HUMAN MITOCHONDRIAL 2-OXOGLUTARATE/MALATE CARRIER PROTEIN [*H. sapiens*], ESTs, Weakly similar to brain mitochondrial carrier protein BMCP1 [*M. musculus*], RIKEN cDNA 1810012H11 gene, expressed sequence AW108044, solute carrier family 25 (mitochondrial carrier; adenine nucleotide translocator), member 10, solute carrier family 25 (mitochondrial carrier; dicarboxylate transporter), member 10, solute carrier family 25 (mitochondrial carrier; ornithine transporter), member 15, solute carrier family 25 (mitochondrial carrier, oxoglutarate carrier), member 11, uncoupling protein 2, mitochondrial |
| 1403 | 18686 | D00729 | q | dodecenoyl-Coenzyme A delta isomerase (3,2 trans-enoyl-Coenyme A isomerase), dodecenoyl-Coenzyme A delta isomerase (3,2 trans-enoyl-Coenzyme A isomerase) | ESTs, Highly similar to D3D2 RAT 3,2-TRANS-ENOYL-COA ISOMERASE, MITOCHONDRIAL PRECURSOR [*R. norvegicus*], *Homo sapiens*, Similar to dodecenoyl-Coenzyme A delta isomerase (3,2 trans-enoyl-Coenzyme A isomerase), clone MGC.3903 IMAGE: 3630566, mRNA, complete cds, dodecenoyl-Coenzyme A delta isomerase (3,2 trans-enoyl-Coenyme A isomerase), dodecenoyl-Coenzyme A delta isomerase (3,2 trans-enoyl-Coenzyme A isomerase) |
| 1404 | 5049 | D10655 | n, w | | ESTs, Weakly similar to ODP2 RAT DIHYDROLIPOAMIDE ACETYLTRANSFERASE COMPONENT OF PYRUVATE DEHYDROGENASE COMPLEX [*R. norvegicus*], *Mus musculus*, clone IMAGE: 3586777, mRNA, partial cds, |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| | | | | | Pyruvate dehydrogenase complex, lipoyl-containing component X, E3-binding protein, RIKEN cDNA 1600017E01 gene, RIKEN cDNA 4930529O08 gene, dihydrolipoamide S acetyltransferase (E2 component of pyruvate dehydrogenase complex), dihydrolipoamide branched chain transacylase (E2 component of branched chain keto acid dehydrogenase complex; maple syrup urine disease), dihydrolipoamide branched chain transacylase E2 |
| 1405 | 25257 | D13623 | j | | |
| 1405 | 15281 | D13623 | h | | |
| 1406 | 11434 | D14014 | cc | | |
| 1407 | 1613 | D14076 | x | | EST, Moderately similar to DYN2 MOUSE DYNAMIN 2 [*M. musculus*], ESTs, Moderately similar to DYN2 MOUSE DYNAMIN 2 [*M. musculus*], KIAA0820 protein, dynamin 2 |
| 1408 | 1728 | D16479 | q | | |
| 1409 | 3015 | D16554 | c, s, v, z | | |
| 1410 | 472 | D26111 | d, s, bb | | |
| 1412 | 16233 | D29960 | j, l | | |
| 1413 | 9029 | D30804 | n | proteasome (prosome, macropain) subunit, alpha type 7, proteasome (prosome, macropain) subunit, alpha type, 7 | EST, Highly similar to PROTEASOME SUBUNIT RC6-1 [*R. norvegicus*], EST, Highly similar to PSA7_HUMAN PROTEASOME SUBUNIT ALPHA TYPE 7 (PROTEASOME SUBUNIT RC6-1) (PROTEASOME SUBUNIT XAPC7) [*H. sapiens*], ESTs, Highly similar to PROTEASOME SUBUNIT RC6-1 [*R. norvegicus*], ESTs, Weakly similar to PSA7_HUMAN PROTEASOME SUBUNIT ALPHA TYPE 7 (PROTEASOME SUBUNIT RC6-1) (PROTEASOME SUBUNIT XAPC7) [*H. sapiens*], Human DNA sequence from clone RP11-18O14 on chromosome 9 Contains a proteasome subunit pseudogene, ESTs, STSs, GSSs and a CpG island, RIKEN cDNA 2410072D24 gene, proteasome (prosome, macropain) subunit, alpha type 7, proteasome (prosome, macropain) subunit, alpha type, 7 |
| 1414 | 1485 | D38222 | y, z | | PROTEIN-TYROSINE PHOSPHATASE-LIKE N PRECURSOR [*H. sapiens*], protein tyrosine phosphatase, receptor type, N, protein tyrosine phosphatase, receptor-type, N |
| 1415 | 9135 | D45247 | s | proteasome (prosome, macropain) subunit, beta type 5, proteasome (prosome, macropain) subunit, beta type, 5 | EST, Moderately similar to PRCE RAT PROTEASOME EPSILON CHAIN PRECURSOR [*R. norvegicus*], RIKEN cDNA 5830406J20 gene, proteasome (prosome, macropain) subunit, beta type 5, proteasome (prosome, macropain) subunit, beta type, 5 |
| 1416 | 16354 | D50564 | u | | |
| 1417 | 1884 | D50695 | l, m, bb | | proteasome (prosome, macropain) 26S subunit, ATPase, 4 |
| 1418 | 21147 | D63772 | General | solute carrier family 1 (neuronal/epithelial high affinity glutamate transporter, system Xag), member 1, solute carrier family 1, member 1 | |
| 1419 | 826 | D82928 | f | | CDP-diacylglycerol—inositol 3-phosphatidyltransferase (phosphatidylinositol synthase) |
| 1420 | 25306 | D84485 | u | | |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 1421 | 18867 | D88250 | t | | EST, Moderately similar to MAS2_HUMAN MANNAN-BINDING LECTIN SERINE PROTEASE 2 PRECURSOR [*H. sapiens*], EST, Weakly similar to JC6554 probable serine proteinase [*R. norvegicus*], ESTs, Weakly similar to JC6554 probable serine proteinase [*R. norvegicus*], MASP-2 protein, complement component 1, r subcomponent, complement component 1, s subcomponent, mannan-binding lectin serine protease 1, mannan-binding lectin serine protease 2 |
| 1423 | 22543 | H31117 | r, v, General | | |
| 1424 | 12360 | H31456 | w | | |
| 1425 | 20514 | H31489 | h, j | | |
| 1426 | 11358 | H31610 | h | | DNA segment, Chr 16, Indiana University Medical 21, expressed, ESTs, Highly similar to JC5020 tetratricopeptide repeat protein [*H. sapiens*], ESTs, Moderately similar to JW0059 mtprd protein - mouse [*M. musculus*], PRO1880 protein, g1-related zinc finger protein, tetratricopeptide repeat domain, tetratricopeptide repeat domain 3 |
| 1427 | 4360 | H31813 | bb, General | | DKFZP586B1621 protein |
| 1428 | 9343 | H32169 | I | | EST, Moderately similar to COF1_HUMAN COFILIN, NON-MUSCLE ISOFOR [*H. sapiens*], cofilin 1 (non-muscle), cofilin 1, non-muscle, cofilin 2 (muscle), cofilin 2, muscle |
| 1429 | 4386 | H33093 | h, w | | |
| 1430 | 4415 | H33636 | h | | |
| 1431 | 15374 | H34186 | I | | ESTs, Weakly similar to IF39_HUMAN EUKARYOTIC TRANSLATION INITIATION FACTOR 3 SUBUNIT 9 [*H. sapiens*] |
| 1432 | 17159 | J00797 | u, General | | ESTs, Highly similar to A23035 tubulin alpha chain [*H. sapiens*], tubulin alpha 1, tubulin alpha 2, tubulin alpha 3, tubulin alpha 6, tubulin, alpha 2, tubulin, alpha 3, tubulin, alpha, ubiquitous |
| 1433 | 16260 | J01878 | f | | |
| 1434 | 17284 | J02827 | bb | branched chain keto acid dehydrogenase E1, alpha polypeptide (maple syrup urine disease), branched chain ketoacid dehydrogenase E1, alpha polypeptide | |
| 1435 | 15017 | J03752 | n | | |
| 1436 | 44 | J03819 | p, s | thyroid hormone receptor beta, thyroid hormone receptor, beta (avian erythroblastic leukemia viral (v-erb-a) oncogene homolog 2) | |
| 1437 | 21014 | J03914 | e, r, General | glutathione S-transferase M2 (muscle), glutathione S-transferase, mu 2 | ESTs, Moderately similar to GLUTATHIONE S-TRANSFERASE YB1 [*R. norvegicus*], glutathione S-transferase M1, glutathione S-transferase, mu 1 |
| 1438 | 20429 | J05035 | f | steroid 5 alpha-reductase 1, steroid-5-alpha-reductase, alpha polypeptide 1 (3-oxo-5 alpha-steroid delta 4-dehydrogenase alpha 1) | steroid-5-alpha-reductase, alpha polypeptide 1 (3-oxo-5 alpha-steroid delta 4-dehydrogenase alpha 1) |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 1439 | 1247 | J05181 | j, l, m, s, y, z | glutamate-cysteine ligase, catalytic subunit | glutamate-cysteine ligase, catalytic subunit |
| 1440 | 10464 | J05510 | n, u, General | inositol 1,4,5-triphosphate receptor 1, inositol 1,4,5-triphosphate receptor, type 1 | ESTs, Highly similar to A55713 inositol 1,4,5-triphosphate receptor type 1 [*H. sapiens*], ESTs, Weakly similar to IP3R MOUSE INOSITOL 1,4,5-TRISPHOSPHATE-BINDING PROTEIN TYPE 1 RECEPTOR [*M. musculus*], expressed sequence AI528790, inositol 1,4,5-triphosphate receptor 1, inositol 1,4,5-triphosphate receptor, type 1 |
| 1441 | 20149 | K03243 | q | | |
| 1442 | 17758 | K03249 | q | | ESTs, Highly similar to ECHP_HUMAN PEROXISOMAL BIFUNCTIONAL ENZYME [*H. sapiens*], enoyl-Coenzyme A, hydratase/3-hydroxyacyl Coenzyme A dehydrogenase |
| 1443 | 381 | L00124 | w | | |
| 1444 | 2048 | L00382 | k, x | | |
| 1445 | 10500 | L04619 | s | | |
| 1447 | 108 | L14002 | p | | |
| 1448 | 25366 | L14003 | t | | |
| 1449 | 109 | L14004 | c, p | | |
| 1450 | 20414 | L14323 | General | phosphoinositide-specific phospholipase C-beta 1, phospholipase C, beta 1 | ESTs, Highly similar to KIAA0581 protein [*H. sapiens*] |
| 1451 | 25369 | L14937 | y | | |
| 1452 | 16119 | L16532 | k | 2',3'-cyclic nucleotide 3' phosphodiesterase, cyclic nucleotide phosphodiesterase 1 | 2',3'-cyclic nucleotide 3' phosphodiesterase, cyclic nucleotide phosphodiesterase 1, hypothetical gene CG018 |
| 1453 | 25377 | L25387 | h | phosphofructokinase, platelet | |
| 1453 | 12058 | L25387 | h | phosphofructokinase, platelet | ESTs, Highly similar to JC2055 6-phosphofructokinase [*H. sapiens*], ESTs, Weakly similar to JC2055 6-phosphofructokinase [*H. sapiens*], *Mus musculus* adult male stomach cDNA, RIKEN full-length enriched library, clone: 2210403E17, full insert sequence, expressed sequence AA407869, phosphofructokinase, liver, B-type, phosphofructokinase, muscle, phosphofructokinase, platelet |
| 1455 | 21146 | L35558 | General | solute carrier family 1 (neuronal/epithelial high affinity glutamate transporter, system Xag), member 1, solute carrier family 1, member 1 | |
| 1456 | 106 | L37203 | w | | |
| 1458 | 13682 | L38482 | f, j, k, m, z | | |
| 1459 | 6405 | L38615 | p | glutathione synthetase | |
| 1461 | 15189 | M11794 | n, v | | |
| 1462 | 17086 | M13011 | j | | |
| 1464 | 21053 | M15481 | o | | |
| 1465 | 25405 | M18330 | j, l | | |
| 1466 | 25415 | M19648 | a | | |
| 1468 | 14967 | M22366 | w | | |
| 1469 | 20481 | M22631 | bb | | |
| 1471 | 15048 | M24542 | q | | EST, Moderately similar to UCRI RAT UBIQUINOL-CYTOCHROME C REDUCTASE IRON-SULFUR SUBUNIT, MITOCHONDRIAL PRECURSOR [*R. norvegicus*], EST, Weakly similar to UCRI_HUMAN UBIQUINOL-CYTOCHROME C REDUCTASE IRON-SULFUR SUBUNIT, MITOCHONDRIAL PRECURSOR [*H. sapiens*], ESTs, Moderately similar to UCRI_HUMAN UBIQUINOL-CYTOCHROME C |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| | | | | | REDUCTASE IRON-SULFUR SUBUNIT, MITOCHONDRIAL PRECURSOR [*H. sapiens*], Human DNA sequence from clone RP1-228J4 on chromosome 6 Contains a pseudogene similar to UQCRFS1 (ubiquinol-cytochrome c reductase, Rieske iron-sulfur polypeptide 1), ESTs, an STS and GSSs, RIKEN cDNA 4430402G14 gene, expressed sequence AI875505, ubiquinol-cytochrome c reductase, Rieske iron-sulfur polypeptide 1 |
| 1472 | 20921 | M29853 | m | cytochrome P450, subfamily IV B, polypeptide 1, cytochrome P450, subfamily IVB, polypeptide 1 | *Mus musculus*, Similar to cytochrome P450, 4a10, clone MGC: 25972 IMAGE: 4240359, mRNA, complete cds, RIKEN cDNA A230105L22 gene, cytochrome P450, 4a10, cytochrome P450, 4a14, cytochrome P450, subfamily IVA, polypeptide 11 |
| 1473 | 1224 | M31931 | u | | cytochrome P450, subfamily IIA (phenobarbital-inducible), polypeptide 13 |
| 1474 | 15579 | M33648 | q | | |
| 1474 | 15580 | M33648 | q | | |
| 1475 | 17211 | M34331 | g, n, q, v | | EST, Moderately similar to 60S RIBOSOMAL PROTEIN L35 [*R. norvegicus*], EST, Moderately similar to G01477 ribosomal protein L35 [*H. sapiens*], EST, Weakly similar to 60S RIBOSOMAL PROTEIN L35 [*R. norvegicus*], ESTs, Highly similar to G01477 ribosomal protein L35 [*H. sapiens*], Human DNA sequence from clone RP1-34P24 on chromosome 22 Contains a pseudogene similar to ribosomal protein L35, ESTs, STSs and GSSs, RIKEN cDNA 2410039E09 gene, ribosomal protein L35 |
| 1476 | 20699 | M35601 | b, x, bb | fibrinogen, A alpha polypeptide | *Homo sapiens* clone HQ0582, expressed sequence AI303526, fibrinogen, A alpha polypeptide, fibrinogen, gamma polypeptide |
| 1476 | 20700 | M35601 | b, t, bb | fibrinogen, A alpha polypeptide | *Homo sapiens* clone HQ0582, expressed sequence AI303526, fibrinogen, A alpha polypeptide, fibrinogen, gamma polypeptide |
| 1477 | 9223 | M36151 | o | | *H. sapiens* DMA, DMB, HLA-Z1, IPP2, LMP2, TAP1, LMP7, TAP2, DOB, DQB2 and RING8, 9, 13 and 14 genes, expressed sequence AI845868 |
| 1479 | 1585 | M57728 | j, m, y | | |
| 1480 | 24844 | M58040 | c | | *Homo sapiens* mRNA; cDNA DKFZp434M2227 (from clone DKFZp434M2227), *Homo sapiens* prostate-specific membrane antigen PSM mRNA, exon 6 alternative splice variant, partial cds, RIKEN cDNA 2610028K12 gene, folate hydrolase, transferrin receptor, transferrin receptor (p90, CD71), transferrin receptor 2 |
| 1481 | 25057 | M58495 | h | | |
| 1482 | 457 | M60666 | d, General | tropomyosin 1 (alpha), tropomyosin 1, alpha | ESTs, Moderately similar to alpha-tropomyosin slow [*M. musculus*], tropomyosin 4 |
| 1483 | 1223 | M75281 | f | | |
| 1484 | 5733 | M81855 | i, k, aa | ATP-binding cassette, sub-family B (MDR/TAP), member 1, ATP-binding cassette, sub-family B (MDR/TAP), member 1B | ATP-binding cassette, sub-family B (MDR/TAP), member 1, ATP-binding cassette, sub-family B (MDR/TAP), member 10, ATP-binding cassette, sub-family B (MDR/TAP), member 8, EST, |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| | | | | | Highly similar to MDR3 MOUSE MULTIDRUG RESISTANCE PROTEIN 3 [*M. musculus*], EST, Weakly similar to MDR1 RAT MULTIDRUG RESISTANCE PROTEIN 1 [*R. norvegicus*], ESTs, Weakly similar to MDR1 MOUSE MULTIDRUG RESISTANCE PROTEIN 1 [*M. musculus*] |
| 1485 | 4198 | M83143 | m | | ESTs, Highly similar to A41734 beta-galactoside alpha-2,6-sialyltransferase [*H. sapiens*] |
| 1485 | 4199 | M83143 | m | | ESTs, Highly similar to A41734 beta-galactoside alpha-2,6-sialyltransferase [*H. sapiens*] |
| 1486 | 24651 | M83678 | k, x, z | | RAB13, member RAS oncogene family, RIKEN cDNA 0610007N03 gene, expressed sequence AW107754 |
| 1487 | 1430 | M84648 | General | dopa decarboxylase, dopa decarboxylase (aromatic L-amino acid decarboxylase) | EST, Highly similar to AROMATIC-L-AMINO-ACID DECARBOXYLASE [*R. norvegicus*], EST, Moderately similar to AROMATIC-L-AMINO-ACID DECARBOXYLASE [*R. norvegicus*], *Mus musculus* 10 days embryo cDNA, RIKEN full-length enriched library, clone. 2610109O21, full insert sequence, dopa decarboxylase, dopa decarboxylase (aromatic L-amino acid decarboxylase) |
| 1488 | 25467 | M93297 | c | | |
| 1489 | 729 | M95762 | a, y | | ESTs, Highly similar to NTG3 MOUSE SODIUM-AND CHLORIDE-DEPENDENT GABA TRANSPORTER 3 [*M. musculus*], ESTs, Weakly similar to NTG3_HUMAN SODIUM-AND CHLORIDE-DEPENDENT GABA TRANSPORTER 3 [*H. sapiens*], expressed sequence AA589632, solute carrier family 6 (neurotransmitter transporter, GABA), member 13 |
| 1490 | 23698 | NM_012489 | q | | DNA segment, Chr 9, ERATO Doi 25, expressed, *Homo sapiens* clone 23623 mRNA, partial cds, *Homo sapiens*, Similar to Acetyl-CoA acyltransferase, 3-oxo acyl-CoA thiolase A, peroxisomal, clone MGC 18173 IMAGE: 4155289, mRNA, complete cds, *Homo sapiens*, Similar to acetyl-Coenzyme A acyltransferase 1 (peroxisomal 3-oxoacyl-Coenzyme A thiolase), clone MGC: 23127 IMAGE: 4908159, mRNA, complete cds, RIKEN cDNA 0610011L04 gene, acetyl-Coenzyme A acyltransferase 1 (peroxisomal 3-oxoacyl-Coenzyme A thiolase), expressed sequence AI255831, expressed sequence AI265397, t-complex protein 1, related sequence 1 |
| 1490 | 23699 | NM_012489 | q | | DNA segment, Chr 9, ERATO Doi 25, expressed, *Homo sapiens* clone 23623 mRNA, partial cds, *Homo sapiens*, Similar to Acetyl-CoA acyltransferase, 3-oxo acyl-CoA thiolase A, peroxisomal, clone MGC: 18173 IMAGE: 4155289, mRNA, complete cds, *Homo sapiens*, Similar to acetyl-Coenzyme A acyltransferase 1 (peroxisomal 3-oxoacyl-Coenzyme A thiolase), clone MGC: 23127 IMAGE: 4908159, mRNA, complete cds, RIKEN cDNA 0610011L04 gene, |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 1491 | 7062 | NM_012495 | q | aldolase 1, A isoform, aldolase A, fructose-bisphosphate | acetyl-Coenzyme A acyltransferase 1 (peroxisomal 3-oxoacyl-Coenzyme A thiolase), expressed sequence AI255831, expressed sequence AI265397, t-complex protein 1, related sequence 1 EST, Moderately similar to ADHUA fructose-bisphosphate aldolase [*H. sapiens*], EST, Weakly similar to ADHUA fructose-bisphosphate aldolase [*H. sapiens*], EST, Weakly similar to I39435 fructose-bisphosphate aldolase [*H. sapiens*], ESTs, Moderately similar to aldolase A [*M. musculus*], Homo sapiens, aldolase 1, A isoform, clone MGC. 18171 IMAGE: 4155253, mRNA, complete cds, RIKEN cDNA 4933425L11 gene, aldolase 1, A isoform, aldolase 3, C isoform, aldolase A, fructose-bisphosphate |
| 1492 | 15511 | NM_012498 | u | aldo-keto reductase family 1, member B1 (aldose reductase), aldo-keto reductase family 1, member B3 (aldose reductase) | |
| 1494 | 7427 | NM_012515 | General | benzodiazapine receptor (peripheral), benzodiazepine receptor, peripheral | Human DNA sequence from clone 34B21 on chromosome 6p12 1-21.1. Contains part of a gene for a novel protein with ZU5 domain similar to part of Tight Junction Protein ZO1 (TJP1) and UNC5 Homologs, the gene for a novel BZRP (peripheral benzodiazapine receptor (MBR, PBR, PBKS, IBP, Isoquinoline-binding protein)) LIKE protein, the gene for a novel protein similar to part of APOBEC1 (Phorbolin 1, Apolipoprotein B mRNA editing protein), and the NFYA gene for nuclear transcription factor Y, alpha (CCAAT-Binding transcription factor subunit B, CBF-B, CAAT-Box DNA binding protein subunit A) Contains ESTs, STSs, GSSs, two putative CpG islands and a ca repeat polymorphism, RIKEN cDNA 2510027D20 gene, benzodiazapine receptor (peripheral), benzodiazepine receptor, peripheral |
| 1495 | 24433 | NM_012527 | i | cholinergic receptor, muscarinic 3, cholinergic receptor, muscarinic 3, cardiac | cholinergic receptor, muscarinic 1, CNS, cholinergic receptor, muscarinic 3, cholinergic receptor, muscarinic 3, cardiac |
| 1496 | 4467 | NM_012529 | d | creatine kinase, brain | EST, Moderately similar to CREATINE KINASE, B CHAIN [*R. norvegicus*], EST, Weakly similar to KIHUCB creatine kinase [*H. sapiens*], creatine kinase, brain |
| 1497 | 16520 | NM_012532 | General | ceruloplasmin, ceruloplasmin (ferroxidase) | DNA segment, Chr 3, ERATO Doi 555, expressed, EST, Highly similar to 1012298A factor VIIIC [*H. sapiens*], ESTs, Weakly similar to CERU MOUSE CERULOPLASMIN PRECURSOR [*M. musculus*], ESTs, Weakly similar to CERU RAT CERULOPLASMIN PRECURSOR [*R. norvegicus*], ESTs, Weakly similar to KUHU ferroxidase [*H. sapiens*], Hermansky-Pudlak syndrome 3, ceruloplasmin, ceruloplasmin (ferroxidase), hephaestin |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 1498 | 225 | NM_012544 | x, z | angiotensin I converting enzyme (peptidyl-dipeptidase A) 1, angiotensin converting enzyme | ESTs, Highly similar to A31759 peptidyl-dipeptidase A [*H. sapiens*], ESTs, Highly similar to JC2038 peptidyl-dipeptidase A [*R. norvegicus*], *Mus musculus* adult male testis cDNA, RIKEN full-length enriched library, clone. 4933424D04, full insert sequence, RIKEN cDNA 2010305L05 gene, angiotensin I converting enzyme (peptidyl-dipeptidase A) 1, angiotensin converting enzyme |
| 1499 | 1431 | NM_012545 | General | dopa decarboxylase, dopa decarboxylase (aromatic L-amino acid decarboxylase) | EST, Highly similar to AROMATIC-L-AMINO-ACID DECARBOXYLASE [*R. norvegicus*], EST, Moderately similar to AROMATIC-L-AMINO-ACID DECARBOXYLASE [*R. norvegicus*], *Mus musculus* 10 days embryo cDNA, RIKEN full-length enriched library, clone: 2610109O21, full insert sequence, dopa decarboxylase, dopa decarboxylase (aromatic L-amino acid decarboxylase) |
| 1500 | 23868 | NM_012551 | l, m, v, General | early growth response 1 | ESTs, Weakly similar to I53869 zinc finger protein - mouse [*M. musculus*], early growth response 1, repressor of GATA, testis zinc finger protein |
| 1500 | 23872 | NM_012551 | l, v, cc, General | early growth response 1 | ESTs, Weakly similar to I53869 zinc finger protein - mouse [*M. musculus*], early growth response 1, repressor of GATA, testis zinc finger protein |
| 1500 | 23869 | NM_012551 | v, General | early growth response 1 | ESTs, Weakly similar to I53869 zinc finger protein - mouse [*M. musculus*], early growth response 1, repressor of GATA, testis zinc finger protein |
| 1501 | 19407 | NM_012554 | z | enolase 1, (alpha), enolase 1, alpha non-neuron | EST, Moderately similar to ALPHA ENOLASE [*R. norvegicus*], EST, Weakly similar to A29170 phosphopyruvate hydratase [*H. sapiens*], *Homo sapiens* cDNA FLJ12774 fis, clone NT2RP2001663, moderately similar to ENOLASE (EC 4.2.1.11), enolase 1, (alpha), enolase 1, alpha non-neuron, enolase alpha, lung-specific, expressed sequence AI427012 |
| 1501 | 19408 | NM_012554 | n, s, y, z | enolase 1, (alpha), enolase 1, alpha non-neuron | EST, Moderately similar to ALPHA ENOLASE [*R. norvegicus*], EST, Weakly similar to A29170 phosphopyruvate hydratase [*H. sapiens*], *Homo sapiens* cDNA FLJ12774 fis, clone NT2RP2001663, moderately similar to ENOLASE (EC 4.2.1.11), enolase 1, (alpha), enolase 1, alpha non-neuron, enolase alpha, lung-specific, expressed sequence AI427012 |
| 1502 | 21836 | NM_012555 | k | E26 avian leukemia oncogene 1, 5' domain, v-ets avian erythroblastosis virus E26 oncogene homolog 1 | E26 avian leukemia oncogene 1, 5' domain, ESTs, Moderately similar to FLI1 MOUSE RETROVIRAL INTEGRATION SITE PROTEIN FLI-1 [*M. musculus*], FEV protein, *Rattus norvegicus* ETS domain transcription factor Pet-1 mRNA, complete cds, v-ets avian erythroblastosis virus E26 oncogene homolog 1 |
| 1503 | 16895 | NM_012558 | g, s | | EST, Weakly similar to FRUCTOSE-1,6-BISPHOSPHATASE ISOZYME 2 [*M. musculus*], fructose bisphosphatase 1, fructose bisphosphatase 2, fructose-1,6-bisphosphatase 1, fructose-1,6-bisphosphatase 2 |
| 1504 | 25317 | NM_012559 | bb | | |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 1504 | 6477 | NM_012559 | b, bb | fibrinogen, gamma polypeptide | EST, Moderately similar to FGHUGB fibrinogen gamma-B chain precursor [*H. sapiens*], EST, Moderately similar to Recombinant Human Gamma-Fibrinogen Carboxyl Terminal Fragment [*H. sapiens*], ESTs, Weakly similar to FIBG RAT FIBRINOGEN GAMMA-A/-B CHAIN PRECURSOR [*R. norvegicus*], RIKEN cDNA 1110007F23 gene, expressed sequence AI303526, fibrinogen, gamma polypeptide, fibrinogen-like 1, ficolin A, ficolin B |
| 1504 | 6478 | NM_012559 | bb | fibrinogen, gamma polypeptide | EST, Moderately similar to FGHUGB fibrinogen gamma-B chain precursor [*H. sapiens*], EST, Moderately similar to Recombinant Human Gamma-Fibrinogen Carboxyl Terminal Fragment [*H. sapiens*], ESTs, Weakly similar to FIBG RAT FIBRINOGEN GAMMA-A/-B CHAIN PRECURSOR [*R. norvegicus*], RIKEN cDNA 1110007F23 gene, expressed sequence AI303526, fibrinogen, gamma polypeptide, fibrinogen-like 1, ficolin A, ficolin B |
| 1505 | 11731 | NM_012561 | k | follistatin | follistatin, follistatin-like 3, follistatin-like 3 (secreted glycoprotein). transmembrane protein with EGF-like and two follistatin-like domains 1 |
| 1507 | 4254 | NM_012564 | a | group specific component, group-specific component (vitamin D binding protein) | |
| 1508 | 16026 | NM_012578 | r | H1 histone family, member 0 | H1 histone family, member 0 |
| 1508 | 16024 | NM_012578 | r | H1 histone family, member 0 | H1 histone family, member 0 |
| 1508 | 16025 | NM_012578 | r | H1 histone family, member 0 | H1 histone family, member 0 |
| 1509 | 16080 | NM_012580 | g, m | heme oxygenase (decycling) 1 | heme oxygenase (decycling) 1 |
| 1510 | 15098 | NM_012588 | bb | insulin-like growth factor binding protein 3 | insulin-like growth factor binding protein 3, protease, serine, 11 (Igf binding) |
| 1511 | 4450 | NM_012592 | bb | isovaleryl Coenzyme A dehydrogenase, isovaleryl coenzyme A dehydrogenase | RIKEN cDNA 1300003O09 gene, RIKEN cDNA 2310016C19 gene, acetyl-Coenzyme A dehydrogenase, short chain, isovaleryl Coenzyme A dehydrogenase, isovaleryl coenzyme A dehydrogenase |
| 1511 | 4451 | NM_012592 | i, bb | isovaleryl Coenzyme A dehydrogenase, isovaleryl coenzyme A dehydrogenase | RIKEN cDNA 1300003O09 gene, RIKEN cDNA 2310016C19 gene, acetyl-Coenzyme A dehydrogenase, short chain, isovaleryl Coenzyme A dehydrogenase, isovaleryl coenzyme A dehydrogenase |
| 1511 | 4452 | NM_012592 | bb | isovaleryl Coenzyme A dehydrogenase, isovaleryl coenzyme A dehydrogenase | RIKEN cDNA 1300003O09 gene, RIKEN cDNA 2310016C19 gene, acetyl-Coenzyme A dehydrogenase, short chain, isovaleryl Coenzyme A dehydrogenase, isovaleryl coenzyme A dehydrogenase |
| 1512 | 17198 | NM_012593 | a, x | kallikrein 1, renal/pancreas/salivary, kallikrein 6 | kallikrein 1, renal/pancreas/salivary, kallikrein 21, kallikrein 24, kallikrein 27, kallikrein 5 |
| 1512 | 17197 | NM_012593 | x | kallikrein 1, renal/pancreas/salivary, kallikrein 6 | kallikrein 1, renal/pancreas/salivary, kallikrein 21, kallikrein 24, kallikrein 27, kallikrein 5 |
| 1513 | 18749 | NM_012600 | a, h | malic enzyme 1, NADP(+)-dependent, cytosolic, malic enzyme, supernatant | |
| 1514 | 2628 | NM_012603 | General | myelocytomatosis oncogene, v-myc avian myelocytomatosis viral oncogene homolog | |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 1514 | 2629 | NM_012603 | x, General | myelocytomatosis oncogene, v-myc avian myelocytomatosis viral oncogene homolog | RIKEN cDNA 2900002K07 gene, myelocytomatosis oncogene. v-myc avian myelocytomatosis viral oncogene homolog |
| 1515 | 16849 | NM_012608 | n, o, q | membrane metallo endopeptidase, membrane metallo-endopeptidase (neutral endopeptidase, enkephalinase, CALLA, CD10) | endothelin converting enzyme-like 1, expressed sequence AW322500, mel transforming oncogene-like 1, membrane metallo endopeptidase, membrane metallo-endopeptidase (neutral endopeptidase, enkephalinase, CALLA, CD10), membrane metallo-endopeptidase-like 2 |
| 1517 | 15540 | NM_012620 | General | serine (or cysteine) proteinase inhibitor, clade E (nexin, plasminogen activator inhibitor type 1), member 1 | serine (or cysteine) proteinase inhibitor, clade E (nexin, plasminogen activator inhibitor type 1), member 1 |
| 1518 | 24568 | NM_012630 | General | prolactin receptor | cytokine receptor-like factor 1, interleukin 13 receptor, alpha 2, interleukin 5 receptor, alpha, prolactin receptor, prolactin receptor related sequence 1 |
| 1518 | 24566 | NM_012630 | General | prolactin receptor | cytokine receptor-like factor 1, interleukin 13 receptor, alpha 2, interleukin 5 receptor, alpha, prolactin receptor, prolactin receptor related sequence 1 |
| 1519 | 18553 | NM_012631 | k | prion protein, prion protein (p27-30) (Creutzfeld-Jakob disease, Gerstmann-Strausler-Scheinker syndrome, fatal familial insomnia) | prion protein, prion protein (p27-30) (Creutzfeld-Jakob disease, Gerstmann-Strausler-Scheinker syndrome, fatal familial insomnia) |
| 1520 | 1844 | NM_012637 | General | | ESTs, Highly similar to TPHUN1 protein-tyrosine-phosphatase [*H. sapiens*], protein tyrosine phosphatase, non-receptor type 1 |
| 1521 | 24668 | NM_012642 | f | renin, renin 1 structural | expressed sequence D19352, renin, renin 1 structural, renin 2 tandem duplication of Ren1 |
| 1522 | 18632 | NM_012645 | a | | |
| 1523 | 25435 | NM_012647 | g | | |
| 1524 | 9423 | NM_012649 | b, cc | syndecan 4, syndecan 4 (amphiglycan, ryudocan) | syndecan 4, syndecan 4 (amphiglycan, ryudocan) |
| 1525 | 24496 | NM_012654 | n | solute carrier family 9 (sodium/hydrogen exchanger), isoform 3, solute carrier family 9 (sodium/hydrogen exchanger), member 3 | ESTs, Weakly similar to NAH1 MOUSE SODIUM/HYDROGEN EXCHANGER 1 [*M. musculus*], *Homo sapiens* mRNA; cDNA DKFZp434D0818 (from clone DKFZp43400818), RIKEN cDNA 0610040A22 gene, RIKEN cDNA 6430709P13 gene, expressed sequence AI182282, solute carrier family 9 (sodium/hydrogen exchanger), isoform 3, solute carrier family 9 (sodium/hydrogen exchanger), isoform 6, solute carrier family 9 (sodium/hydrogen exchanger), member 1 |
| 1526 | 7101 | NM_012679 | x, bb, General | | DNA segment, Chr 14, University of California at Los Angeles 3, EST, Moderately similar to A41386 clusterin precursor [*H. sapiens*], ESTs, Moderately similar to A41386 clusterin precursor [*H. sapiens*], clusterin, clusterin (complement lysis inhibitor, SP-40, 40, sulfated glycoprotein 2, testosterone-repressed prostate message 2, apolipoprotein J), expressed sequence AI893575 |
| 1527 | 24707 | NM_012693 | i | | cytochrome P450, 2a12, cytochrome P450, subfamily IIA (phenobarbital-inducible), polypeptide 13, cytochrome |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| | | | | | P450, subfamily IIA (phenobarbital-inducible), polypeptide 7, pseudogene 1, cytochrome P450, subfamily IIA (phenobarbital-inducible), polypeptide 7, pseudogene 2 |
| 1528 | 1850 | NM_012696 | t | kininogen | EST, Weakly similar to KNG__MOUSE KININOGEN PRECURSOR [CONTAINS. BRADYKININ] [*M. musculus*], kininogen |
| 1528 | 1854 | NM_012696 | t | kininogen | EST, Weakly similar to KNG__MOUSE KININOGEN PRECURSOR [CONTAINS: BRADYKININ] [*M. musculus*], kininogen |
| 1529 | 1603 | NM_012697 | General | | EST, Weakly similar to OCN2 MOUSE ORGANIC CATION/CARNITINE TRANSPORTER 2 [*M. musculus*], ESTs, Highly similar to OCN2__HUMAN ORGANIC CATION/CARNITINE TRANSPORTER 2 [*H. sapiens*], solute carrier family 22 (organic cation transporter), member 1, solute carrier family 22 (organic cation transporter), member 4, solute carrier family 22 (organic cation transporter), member 5, solute carrier family 22 (organic cation transporter), member 9 |
| 1530 | 1372 | NM_012734 | u | hexokinase 1 | ESTs, Highly similar to HXK1 RAT HEXOKINASE, TYPE I [*R. norvegicus*], hexokinase 1, hypothetical protein FLJ22761 |
| 1531 | 1478 | NM_012744 | bb, General | | expressed sequence C79630, methylcrotonoyl-Coenzyme A carboxylase 1 (alpha), pyruvate carboxylase, pyruvate decarboxylase |
| 1532 | 343 | NM_012747 | h, t | | Signal transducer and activator of transcription 1, signal transducer and activator of transcription 1, signal transducer and activator of transcription 1, 91 kD, signal transducer and activator of transcription 3, signal transducer and activator of transcription 3 (acute-phase response factor) |
| 1533 | 8829 | NM_012749 | General | | |
| 1534 | 20828 | NM_012752 | General | CD24 antigen (small cell lung carcinoma cluster 4 antigen), CD24a antigen | CD24 antigen (small cell lung carcinoma cluster 4 antigen), CD24a antigen |
| 1534 | 20829 | NM_012752 | i, General | CD24 antigen (small cell lung carcinoma cluster 4 antigen), CD24a antigen | CD24 antigen (small cell lung carcinoma cluster 4 antigen), CD24a antigen |
| 1534 | 20830 | NM_012752 | i, General | CD24 antigen (small cell lung carcinoma cluster 4 antigen), CD24a antigen | CD24 antigen (small cell lung carcinoma cluster 4 antigen), CD24a antigen |
| 1535 | 15174 | NM_012756 | b | | ESTs, Highly similar to 1312358A IGF II receptor [*H. sapiens*], expressed sequence AI661837, insulin-like growth factor 2 receptor |
| 1536 | 21685 | NM_012760 | j, m, n | | EST, Weakly similar to ZF37__RAT ZINC FINGER PROTEIN 37 (ZFP-37) [*R. norvegicus*], ESTs, Weakly similar to S59069 Z13 protein - mouse [*M. musculus*], *Homo sapiens* chromosome 19, BAC 273239 (CIT-B-320G 13), *Homo sapiens*, clone MGC. 23189 IMAGE: 4854518, mRNA, complete cds, RIKEN cDNA 2410081M15 gene, RIKEN cDNA 2610019F01 gene, RIKEN cDNA 2810011C24 gene, hypothetical protein FLJ12488, hypothetical zinc finger protein MGC: 2396, zinc finger protein 37, zinc finger protein homologous to Zfp37 in mouse |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 1537 | 18068 | NM_012762 | t | | CARD only protein, ESTs, Moderately similar to A56084 interleukin-1beta converting enzyme beta isozyme [*H. sapiens*], ESTs, Weakly similar to interleukin-1beta converting enzyme gamma isozyme [*H. sapiens*], *Homo sapiens* mRNA; cDNA DKFZp586A181 (from clone DKFZp586A181); partial cds, ICEBERG caspase-1 inhibitor, caspase 1, caspase 1, apoptosis-related cysteine protease (interleukin 1, beta, convertase) |
| 1538 | 1246 | NM_012770 | a, General | | ESTs, Weakly similar to ANPA MOUSE ATRIAL NATRIURETIC PEPTIDE RECEPTOR A PRECURSOR [*M. musculus*], guanylate cyclase 1, soluble, alpha 3, guanylate cyclase 1, soluble, beta 2, guanylate cyclase 1, soluble, beta 3, natriuretic peptide receptor 1 |
| 1539 | 1348 | NM_012776 | f | adrenergic receptor kinase, beta 1, adrenergic, beta, receptor kinase 1 | G protein-coupled receptor kinase 2, groucho gene related (Drosophila), G protein-coupled receptor kinase 5, G protein-coupled receptor kinase 6, adrenergic, beta, receptor kinase 1, rhodopsin kinase |
| 1540 | 18135 | NM_012791 | w | dual-specificity tyrosine-(Y) phosphorylation regulated kinase 1A, dual-specificity tyrosine-(Y)-phosphorylation regulated kinase 1a | ESTs, Moderately similar to DYRK RAT DUAL-SPECIFICITY TYROSINE-(Y)-PHOSPHORYLATION REGULATED KINASE [*R. norvegicus*], ESTs, Weakly similar to DYRK MOUSE DUAL-SPECIFICITY TYROSINE-(Y)-PHOSPHORYLATION REGULATED KINASE [*M. musculus*], *Homo sapiens* chromosome 19, CIT-HSP BAC 470n8, *Mus musculus*, clone MGC: 6699 IMAGE: 3584001, mRNA, complete cds, dual-specificity tyrosine-(Y)-phosphorylation regulated kinase 1A, dual-specificity tyrosine-(Y)-phosphorylation regulated kinase 1a, dual-specificity tyrosine-(Y)-phosphorylation regulated kinase 1b, dual-specificity tyrosine-(Y)-phosphorylation regulated kinase 2, homeodomain-interacting protein kinase2 |
| 1541 | 16947 | NM_012793 | p, bb | guanidinoacetate N-methyltransferase, guanidinoacetate methyltransferase | GAMT_HUMAN GUANIDINOACETATE N-METHYLTRANSFERASE [*H. sapiens*], *Homo sapiens*, clone MGC: 14390 IMAGE: 4300887, mRNA, complete cds, guanidinoacetate N-methyltransferase, guanidinoacetate methyltransferase |
| 1542 | 960 | NM_012796 | u | glutathione S-transferase theta 2, glutathione S-transferase, theta 2 | ESTs, Highly similar to GTT2 RAT GLUTATHIONE S-TRANSFERASE YRS-YRS [*R. norvegicus*], *Homo sapiens* mRNA; cDNA DKFZp762N226 (from clone DKFZp762N226), expressed sequence AI266894, glutathione S-transferase theta 2, glutathione S-transferase, theta 2, hypothetical protein |
| 1543 | 260 | NM_012798 | f, u | mal, T-cell differentiation protein, myelin and lymphocyte protein; T-cell differentiation protein | BENE protein, *Mus musculus*, Similar to BENE protein, clone MGC: 19097 IMAGE: 4205488, mRNA, complete cds, RIKEN cDNA 2700018N07 gene, expressed sequence AI461653, mal, T-cell differentiation protein, mal, T-cell differentiation protein 2, myelin and lymphocyte protein; T-cell differentiation protein |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 1544 | 556 | NM_012803 | d | protein C, protein C (inactivator of coagulation factors Va and VIIIa) | B-factor, properdin, DKFZP586H2123 protein, ESTs, Weakly similar to PRTC RAT VITAMIN-K DEPENDENT PROTEIN C PRECURSOR [*R. norvegicus*], protein C, protein C (inactivator of coagulation factors Va and VIIIa) |
| 1545 | 21729 | NM_012804 | q | ATP-binding cassette, sub-family D (ALD), member 3 | ATP-binding cassette, sub-family D (ALD), member 1, ATP-binding cassette, sub-family D (ALD), member 2, ATP-binding cassette, sub-family D (ALD), member 3, ESTs, Weakly similar to ABD3 RAT ATP-BINDING CASSETTE, SUB-FAMILY D, MEMBER 3 [*R. norvegicus*] |
| 1546 | 15032 | NM_012816 | General | | alpha-methylacyl-CoA racemase, hypothetical protein FLJ11808 |
| 1547 | 24895 | NM_012817 | General | insulin-like growth factor binding protein 5 | insulin-liKe growtn factor binding protein 5 |
| 1548 | 18109 | NM_012823 | u, General | | EST, Weakly similar to ANXA_HUMAN ANNEXIN XI [*H. sapiens*], annexin A10, annexin A3 |
| 1549 | 373 | NM_012833 | h, l, q, General | ATP-binding cassette, sub-family C (CFTR/MRP), member 2 | ATP-binding cassette, sub-family C (CFTR/MRP), member 10, ATP-binding cassette, sub-family C (CFTR/MRP), member 1a, ATP-binding cassette, sub-family C (CFTR/MRP), member 2, ATP-binding cassette, sub-family C (CFTR/MRP), member 4, ATP-binding cassette, sub-family C (CFTR/MRP), member 6, ESTs, Weakly similar to A40303 cystic fibrosis transmembrane conductance regulator - mouse [*M. musculus*], expressed sequence AI132311 |
| 1550 | 2855 | NM_012838 | e | cystatin B, cystatin B (stefin B) | cystatin B, cystatin B (stefin B), expressed sequence AA960480 |
| 1551 | 11136 | NM_012839 | s | cytochrome c, cytochrome c, somatic | ESTs, Highly similar to 630485A cytochrome c [*H. sapiens*], ESTs, Weakly similar to CYTOCHROME C, SOMATIC [*M. musculus*], *Homo sapiens* pseudogene for cytochrome c-like protein, clone pHGC4E1, Human DNA sequence from clone RP11-169O17 on chromosome 13 Contains ESTs, GSSs, STSs and four CpG islands. Contains a novel protein similar to cytochrome c, part of a novel gene similar to TPTE encoding a transmembrane phosphatase with tensin homology and the ADPRTL1 gene encoding ADP-ribosyltransferase (NAD+, poly (ADP-ribose) polymerase)-like protein 1 (vault protein, KIAA0177), cytochrome c, cytochrome c, somatic |
| 1552 | 20885 | NM_012842 | a | epidermal growth factor, epidermal growth factor (beta-urogastrone) | EST, Moderately similar to EPIDERMAL GROWTH FACTOR PRECURSOR [*M. musculus*], ESTs, Moderately similar to EPIDERMAL GROWTH FACTOR PRECURSOR [*M. musculus*], ESTs, Weakly similar to EGRT epidermal growth factor precursor - rat [*R. norvegicus*], *Homo sapiens* mRNA, cDNA DKFZp434O0213 (from clone DKFZp434O0213); partial cds, epidermal growth factor, epidermal growth factor (beta-urogastrone), nidogen 2 |
| 1552 | 20884 | NM_012842 | a, bb | epidermal growth factor, epidermal growth factor (beta-urogastrone) | EST, Moderately similar to EPIDERMAL GROWTH FACTOR PRECURSOR [*M. musculus*], ESTs, |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| | | | | | Moderately similar to EPIDERMAL GROWTH FACTOR PRECURSOR [*M. musculus*], ESTs, Weakly similar to EGRT epidermal growth factor precursor - rat [*R. norvegicus*], *Homo sapiens* mRNA; cDNA DKFZp434O0213 (from clone DKFZp434O0213), partial cds, epidermal growth factor, epidermal growth factor (beta-urogastrone), nidogen 2 |
| 1553 | 18770 | NM_012857 | e | lysosomal membrane glycoprotein 1, lysosomal-associated membrane protein 1 | CD68 antigen, ESTs, Weakly similar to LMP1 RAT LYSOSOME-ASSOCIATED MEMBRANE GLYCOPROTEIN 1 PRECURSOR [*R. norvegicus*], lysosomal membrane glycoprotein 1, lysosomal-associated membrane protein 1, similar to S68401 (cattle) glucose induced gene |
| 1554 | 20674 | NM_012861 | i | 0-6-methylguanine-DNA methyltransferase, O-6-methylguanine-DNA methyltransferase | ESTs, Highly similar to 1207289A reverse transcriptase related protein [*H. sapiens*], ESTs, Highly similar to S21348 probable pol polyprotein-related protein 4 - rat [*R. norvegicus*], ESTs, Moderately similar to GNMSLL retrovirus-related reverse transcriptase homolog - mouse retrotransposon [*M. musculus*], ESTs, Weakly similar to 1207289A reverse transcriptase related protein [*H. sapiens*], ESTs, Weakly similar to B34087 hypothetical protein [*H. sapiens*], *Homo sapiens* cDNA FLJ12202 fis, clone MAMMA1000908, *Mus musculus*, Similar to L1 repeat, Tf subfamily, member 30, clone MGC 7372 IMAGE: 3487559, mRNA, complete cds, RIKEN cDNA 1700082M22 gene, T lymphoma oncogene, expressed sequence AI267024, hypothetical protein FLJ21032, pheromone receptor V3R4 |
| 1555 | 13151 | NM_012862 | a, r, General | matrix Gla protein, matrix gamma-carboxyglutamate (gla) protein | MATRIX GLA-PROTEIN PRECURSOR [*H. sapiens*], matrix Gla protein, matrix gamma-carboxyglutamate (gla) protein |
| 1556 | 24617 | NM_012870 | General | tumor necrosis factor receptor superfamily, member 11b (osteoprotegerin) | Nerve growth factor receptor, fast, RIKEN cDNA 2610311B09 gene, nerve growth factor receptor, nerve growth factor receptor (TNFR superfamily, member 16), tumor necrosis factor receptor superfamily, member 11b (osteoprotegerin), tumor necrosis factor receptor superfamily, member 21 |
| 1557 | 20945 | NM_012875 | a, v | | EST, Moderately similar to 60S RIBOSOMAL PROTEIN L39 [*R. norvegicus*], ESTs, Highly similar to 60S RIBOSOMAL PROTEIN L39 [*R. norvegicus*], ESTs, Highly similar to G02654 ribosomal protein L39 [*H. sapiens*], ESTs, Moderately similar to G02654 ribosomal protein L39 [*H. sapiens*], RIKEN cDNA 2810465O16 gene, RIKEN cDNA 4930517K11 gene, ribosomal protein L39, ribosomal protein L39-like 1 |
| 1558 | 15872 | NM_012879 | o, r | solute carrier family 2 (facilitated glucose transporter), member 2 | ESTs, Highly similar to A31318 glucose transporter-like protein [*H. sapiens*], ESTs, Weakly similar to GLUCOSE TRANSPORTER TYPE 2, LIVER [*R. norvegicus*], ESTs, Weakly similar to S05319 glucose transport |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| | | | | | protein, hepatic - mouse [*M. musculus*], solute carrier family 2 (facilitated glucose transporter), member 10, solute carrier family 2 (facilitated glucose transporter), member 2, solute carrier family 2, (facilitated glucose transporter) member 8 |
| 1559 | 495 | NM_012880 | z | superoxide dismutase 3, extracellular | RIKEN cDNA 1700105P06 gene, superoxide dismutase 3, extracellular |
| 1559 | 494 | NM_012880 | c | superoxide dismutase 3, extracellular | RIKEN cDNA 1700105P06 gene, superoxide dismutase 3, extracellular |
| 1560 | 23651 | NM_012881 | d, u, General | secreted phosphoprotein 1, secreted phosphoprotein 1 (osteopontin, bone sialoprotein I, early T-lymphocyte activation 1) | |
| 1562 | 19477 | NM_012891 | q | | |
| 1563 | 18564 | NM_012899 | v, General | aminolevulinate, delta-, dehydratase | aminolevulinate, delta-, dehydratase |
| 1564 | 7197 | NM_012904 | f, r, cc, General | annexin A1 | EST, Weakly similar to A Chain A, Nmr Solution Structure Of Domain 1 Of Human Annexin I {SUB 41-113 [*H. sapiens*], annexin A1 |
| 1564 | 7196 | NM_012904 | v, cc, General | annexin A1 | |
| 1565 | 20202 | NM_012909 | b, r | aquaporin 2, aquaporin 2 (collecting duct) | aquaporin 2, aquaporin 2 (collecting duct), aquaporin 6, aquaporin 6, kidney specific |
| 1566 | 16581 | NM_012911 | c, j | | *Mus musculus* retinal cone arrestin 3 (Arr3) mRNA, complete cds, RIKEN cDNA 1200006I17 gene, arrestin, beta 2, expressed sequence AI326910, retinal S-antigen |
| 1566 | 16582 | NM_012911 | c | | *Mus musculus* retinal cone arrestin 3 (Arr3) mRNA, complete cds, RIKEN cDNA 1200006I17 gene, arrestin, beta 2, expressed sequence AI326910, retinal S-antigen |
| 1567 | 24431 | NM_012912 | General | activating transcription factor 3 | ESTs, Highly similar to 1604249C transcription factor ATF3 [*H. sapiens*], ESTs, Weakly similar to ATF3 RAT CYCLIC-AMP-DEPENDENT TRANSCRIPTION FACTOR ATF-3 [*R. norvegicus*], Jun dimerization protein 2, activating transcription factor 3, basic leucine zipper transcription factor, ATF-like |
| 1568 | 18118 | NM_012913 | p | ATPase, Na+/K+ transporting, beta 3 polypeptide | ATPase, Na+/K+ transporting, beta 3 polypeptide, ESTs, Highly similar to G02485 Na+/K+-exchanging ATPase [*H. sapiens*], expressed sequence AI664000 |
| 1569 | 6108 | NM_012915 | n | | ATPase inhibitor, ATPase inhibitor precursor, ESTs, Moderately similar to ATPASE INHIBITOR, MITOCHONDRIAL PRECURSOR [*R. norvegicus*], *Mus musculus* 10 days embryo cDNA, RIKEN full-length enriched library, clone: 2610204M17, full insert sequence |
| 1570 | 20757 | NM_012923 | c, i, aa | cyclin G, cyclin G1 | cyclin G, cyclin G1, cyclin G2, cyclin I |
| 1570 | 20755 | NM_012923 | i | cyclin G, cyclin G1 | cyclin G, cyclin G1, cyclin G2, cyclin I |
| 1571 | 2830 | NM_012925 | f | CD59 antigen p18-20 (antigen identified by monoclonal antibodies 16.3A5, EJI6, EJ30, EL32 and G344), CD59a antigen | CD59 antigen p18-20 (antigen identified by monoclonal antibodies 16.3A5, EJI6, EJ30, EL32 and G344), CD59a antigen, ESTs, Weakly similar to CD59 RAT CD59 GLYCOPROTEIN PRECURSOR [*R. norvegicus*] |
| 1571 | 2831 | NM_012925 | f | CD59 antigen p18-20 (antigen identified by monoclonal antibodies 16.3A5, EJI6, EJ30, EL32 and G344), CD59a antigen | CD59 antigen p18-20 (antigen identified by monoclonal antibodies 16.3A5, EJI6, EJ30, EL32 and G344), CD59a antigen, ESTs, Weakly similar to CD59 RAT CD59 GLYCOPROTEIN PRECURSOR [*R. norvegicus*] |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 1572 | 1977 | NM_012930 | q | carnitine palmitoyltransferase 2, carnitine palmitoyltransferase II | EST, Moderately similar to CPT2 RAT CARNITINE O-PALMITOYLTRANSFERASE II, MITOCHONDRIAL PRECURSOR [*R. norvegicus*], carnitine palmitoyltransferase 2, carnitine palmitoyltransferase II, expressed sequence AI323697 |
| 1573 | 18694 | NM_012931 | j, l, m, z | | CD2-associated protein, HEF like Protein, *Homo sapiens* cDNA FLJ14854 fis, clone PLACE1000972, breast cancer anti-estrogen resistance 1, enhancer of filamentation 1 (cas-like docking, Crk-associated substrate related), neural precursor cell expressed, developmentally down-regulated gene 9, v-crk-associated tyrosine kinase substrate |
| 1574 | 13723 | NM_012935 | n | crystallin, alpha B | |
| 1575 | 9109 | NM_012939 | j, y, z | cathepsin H | ESTs, Highly similar to KHHUH cathepsin H [*H. sapiens*], ESTs, Weakly similar to CATHEPSIN H PRECURSOR [*R. norvegicus*], *Homo sapiens* cDNA FLJ22499 fis, clone HRC11250, highly similar to HSCATHH Human mRNA for cathepsin H (EC 3.4.22.16), cathepsin H, cathepsin W, cathepsin W (lymphopain) |
| 1575 | 19398 | NM_012939 | aa | | |
| 1576 | 223 | NM_012945 | b, cc | diphtheria toxin receptor (heparin-binding epidermal growth factor-like growth factor), heparin binding epidermal growth factor-like growth factor | diphtheria toxin receptor (heparin-binding epidermal growth factor-like growth factor), expressed sequence AW047313, heparin binding epidermal growth factor-like growth factor |
| 1577 | 15058 | NM_012950 | cc | coagulation factor II (thrombin) receptor | ESTs, Weakly similar to GPRY_MOUSE PROBABLE G PROTEIN-COUPLED RECEPTOR GPR34 [*M. musculus*], G protein-coupled receptor 41, G protein-coupled receptor 43, *Rattus norvegicus* protease activated receptor 3 mRNA, complete cds, coagulation factor II (thrombin) receptor |
| 1579 | 19111 | NM_012963 | g | high mobility group box 1, high-mobility group (nonhistone chromosomal) protein 1 | EST, Moderately similar to A Chain A, Crystal Structure Of Hmg1 Domain A Bound To A Cisplatin-Modified Dna Duplex [*R. norvegicus*], EST, Weakly similar to A Chain A, Crystal Structure Of Hmg1 Domain A Bound To A Cisplatin-Modified Dna Duplex [*R. norvegicus*], ESTs, Highly similar to S02826 nonhistone chromosomal protein HMG-1 [*H. sapiens*], ESTs, Moderately similar to HIGH MOBILITY GROUP PROTEIN HMG1 [*M. musculus*], RIKEN cDNA 4932431P20 gene, high mobility group box 1, high mobility group box 3, high-mobility group (nonhistone chromosomal) protein 1, high-mobility group (nonhistone chromosomal) protein 1-like 10, high-mobility group (nonhistone chromosomal) protein 1-like 3 |
| 1580 | 19374 | NM_012964 | x | hyaluronan mediated motility receptor (RHAMM), hyaluronan-mediated motility receptor (RHAMM) | *Mus musculus* 12 days embryo male wolffian duct includes surrounding region cDNA, RIKEN full-length enriched library, clone 6720466F14, full insert sequence, RIKEN cDNA 0610027D24 gene, TRAF4 associated factor 1, hyaluronan mediated motility |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 1581 | 2554 | NM_012967 | t | intercellular adhesion molecule, intercellular adhesion molecule 1 (CD54), human rhinovirus receptor | receptor (RHAMM), hyaluronan-mediated motility receptor (RHAMM) Homo sapiens mRNA, cDNA DKFZp434E0516 (from clone DKFZp434E0516), intercellular adhesion molecule, intercellular adhesion molecule 1 (CD54), human rhinovirus receptor, intercellular adhesion molecule 3, intercellular adhesion molecule 5, telencephalin |
| 1581 | 2555 | NM_012967 | t, cc, General | intercellular adhesion molecule, intercellular adhesion molecule 1 (CD54), human rhinovirus receptor | Homo sapiens mRNA; cDNA DKFZp434E0516 (from clone DKFZp434E0516), intercellular adhesion molecule, intercellular adhesion molecule 1 (CD54), human rhinovirus receptor, intercellular adhesion molecule 3, intercellular adhesion molecule 5, telencephalin |
| 1582 | 24528 | NM_012973 | c | potassium voltage-gated channel, lsk-related family, member 1, potassium voltage-gated channel, lsk-related subfamily, member 1 | potassium voltage-gated channel, lsk-related family, member 1, potassium voltage-gated channel, lsk-related subfamily, member 1 |
| 1583 | 956 | NM_012976 | c | | ESTs, Highly similar to LEG9 RAT GALECTIN-9 [R. norvegicus], ESTs, Highly similar to LEG9_HUMAN GALECTIN-9 [H. sapiens], ESTs, Weakly similar to LEG9 RAT GALECTIN-9 [R. norvegicus], expressed sequence AI265545, lectin, galactose binding, soluble 12, lectin, galactose binding, soluble 9, lectin, galactoside-binding, soluble, 9 (galectin 9) |
| 1584 | 16417 | NM_012991 | g | nucleoporin 50 kD, nucleoprotein 50 | nucleoporin 50 kD, nucleoprotein 50 |
| 1585 | 17393 | NM_012992 | d | nucleophosmin (nucleolar phosphoprotein B23, numatrin), nucleophosmin 1 | ESTs, Moderately similar to NPM_HUMAN NUCLEOPHOSMIN [H. sapiens], ESTs, Weakly similar to NPM_HUMAN NUCLEOPHOSMIN [H. sapiens], nucleophosmin (nucleolar phosphoprotein B23, numatrin), nucleophosmin 1, nucleophosmin/nucleoplasmin 3, nucleoplasmin 3 |
| 1586 | 23544 | NM_013013 | s | prosaposin, prosaposin (variant Gaucher disease and variant metachromatic leukodystrophy) | ESTs, Weakly similar to 1504251A sphingolipid activator [H. sapiens], RIKEN cDNA 2310020A21 gene, prosaposin, prosaposin (variant Gaucher disease and variant metachromatic leukodystrophy) |
| 1587 | 1588 | NM_013026 | k | syndecan 1 | syndecan 1 |
| 1588 | 17894 | NM_013027 | m | selenoprotein W, 1, selenoprotein W, muscle 1 | ESTs, Weakly similar to SELW MOUSE SELENOPROTEIN W [M. musculus], selenoprotein W, 1, selenoprotein W, muscle 1 |
| 1589 | 18300 | NM_013030 | s, v, General | | ESTs, Weakly similar to NPT2 RAT RENAL SODIUM-DEPENDENT PHOSPHATE TRANSPORT PROTEIN 2 [R. norvegicus], ESTs, Weakly similar to NPT2_HUMAN RENAL SODIUM-DEPENDENT PHOSPHATE TRANSPORT PROTEIN 2 [H. sapiens], Homo sapiens, Similar to solute carrier family 34 (sodium phosphate), member 1, clone MGC: 18179 IMAGE: 4155326, mRNA, complete cds, Solute carrier family 17 (sodium/hydrogen exchanger), member 2, expressed sequence AI649385, solute carrier family 34 (sodium phosphate), member 1, solute carrier family 34 (sodium phosphate), member 2 |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 1589 | 18076 | NM_013030 | g, s, z | solute carrier family 34 (sodium phosphate), member 1 | ESTs, Weakly similar to NPT2 RAT RENAL SODIUM-DEPENDENT PHOSPHATE TRANSPORT PROTEIN 2 [*R. norvegicus*], ESTs, Weakly similar to NPT2_HUMAN RENAL SODIUM-DEPENDENT PHOSPHATE TRANSPORT PROTEIN 2 [*H. sapiens*], *Homo sapiens*, Similar to solute carrier family 34 (sodium phosphate), member 1, clone MGC: 18179 IMAGE: 4155326, mRNA, complete cds, *Rattus norvegicus* mRNA for NaPi-2 alpha, complete cds, expressed sequence AI649385, solute carrier family 34 (sodium phosphate), member 1, solute carrier family 34 (sodium phosphate), member 2 |
| 1589 | 18078 | NM_013030 | s | solute carrier family 34 (sodium phosphate), member 1 | ESTs, Weakly similar to NPT2 RAT RENAL SODIUM-DEPENDENT PHOSPHATE TRANSPORT PROTEIN 2 [*R. norvegicus*], ESTs, Weakly similar to NPT2_HUMAN RENAL SODIUM-DEPENDENT PHOSPHATE TRANSPORT PROTEIN 2 [*H. sapiens*], *Homo sapiens*, Similar to solute carrier family 34 (sodium phosphate), member 1, clone MGC: 18179 IMAGE: 4155326, mRNA, complete cds, *Rattus norvegicus* mRNA for NaPi-2 alpha, complete cds, Solute carrier family 17 (sodium/hydrogen exchanger), member 2, expressed sequence AI649385, solute carrier family 34 (sodium phosphate), member 1, solute carrier family 34 (sodium phosphate), member 2 |
| 1589 | 18077 | NM_013030 | e, s, z | solute carrier family 34 (sodium phosphate), member 1 | ESTs, Weakly similar to NPT2 RAT RENAL SODIUM-DEPENDENT PHOSPHATE TRANSPORT PROTEIN 2 [*R. norvegicus*], ESTs, Weakly similar to NPT2_HUMAN RENAL SODIUM-DEPENDENT PHOSPHATE TRANSPORT PROTEIN 2 [*H. sapiens*], *Homo sapiens*, Similar to solute carrier family 34 (sodium phosphate), member 1, clone MGC: 18179 IMAGE: 4155326, mRNA, complete cds, *Rattus norvegicus* mRNA for NaPi-2 alpha, complete cds, expressed sequence AI649385, solute carrier family 34 (sodium phosphate), member 1, solute carrier family 34 (sodium phosphate), member 2 |
| 1591 | 730 | NM_013040 | w | ATP-binding cassette, sub-family C (CFTR/MRP), member 9 | ATP-binding cassette, sub-family C (CFTR/MRP), member 8, ATP-binding cassette, sub-family C (CFTR/MRP), member 9, ESTs, Highly similar to ACC8_HUMAN SULFONYLUREA RECEPTOR 1 [*H. sapiens*], ESTs, Weakly similar to T42728 sulfonylurea receptor 2, isoform B - mouse [*M. musculus*], *Mus musculus* adult male pituitary gland cDNA, RIKEN full-length enriched library, clone.5330439B14, full insert sequence |
| 1592 | 17401 | NM_013043 | i, o, General | transforming growth factor beta 1 induced transcript 4, transforming growth factor beta-stimulated protein TSC-22 | ESTs, Moderately similar to DIP_HUMAN DIP PROTEIN [*H. sapiens*], delta sleep inducing peptide, immunoreactor, glucocorticoid-induced leucine zipper, transforming growth factor beta 1 induced transcript |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 1593 | 16684 | NM_013052 | General | tyrosine 3-monooxygenase/tryptophan 5-monooxygenase activation protein, eta polypeptide | 4, transforming growth factor beta-stimulated protein TSC-22 3-monooxgenase/tryptophan 5-monooxgenase activation protein, gamma polypeptide, tyrosine 3-monooxygenase/tryptophan 5-monooxygenase activation protein, eta polypeptide |
| 1594 | 14421 | NM_013053 | u | | RIKEN cDNA 2700028P07 gene, tyrosine 3-monooxygenase/tryptophan 5-monooxygenase activation protein, theta polypeptide |
| 1595 | 15254 | NM_013058 | k | | inhibitor of DNA binding 3, inhibitor of DNA binding 3, dominant negative helix-loop-helix protein |
| 1596 | 14997 | NM_013059 | s, z | | alkaline phosphatase, liver/bone/kidney |
| 1596 | 14996 | NM_013059 | General | | alkaline phosphatase, liver/bone/kidney |
| 1597 | 25676 | NM_013069 | aa | | |
| 1597 | 16924 | NM_013069 | o | | CD74 antigen (invariant polypeptide of major histocompatibility complex, class II antigen-associated), Ia-associated invariant chain, KIAA0275 gene product, sparc/osteonectin, cwcv and kazal-like domains proteoglycan (testican), sparc/osteonectin, cwcv and kazal-like domains proteoglycan 1, sparc/osteonectin, cwcv and kazal-like domains proteoglycan 2 |
| 1598 | 24748 | NM_013070 | h, q | utrophin, utrophin (homologous to dystrophin) | Dystrophin, dystrophin (muscular dystrophy, Duchenne and Becker types), includes DXS142, DXS164, DXS206, DXS230, DXS239, DXS268, DXS269, DXS270, DXS272, dystrophin, muscular dystrophy, dystrophin-related protein 2 A-form splice variant, utrophin, utrophin (homologous to dystrophin) |
| 1599 | 1529 | NM_013082 | d, General | | syndecan 2, syndecan 2 (heparan sulfate proteoglycan 1, cell surface-associated, fibroglycan) |
| 1600 | 1521 | NM_013091 | j, l, z, General | | tumor necrosis factor receptor superfamily, member 12, tumor necrosis factor receptor superfamily, member 12 (translocating chain-association membrane protein), tumor necrosis factor receptor superfamily, member 1A, tumor necrosis factor receptor superfamily, member 1a, tumor necrosis factor receptor superfamily, member 1a-like 1, tumor necrosis factor receptor superfamily, member 1a-like 2 |
| 1601 | 1685 | NM_013096 | c, aa | hemoglobin alpha, adult chain 2, hemoglobin, alpha 1 | |
| 1601 | 26150 | NM_013096 | c, i | | |
| 1601 | 1688 | NM_013096 | p | hemoglobin alpha, adult chain 2, hemoglobin, alpha 1 | |
| 1601 | 1689 | NM_013096 | c, p | hemoglobin alpha, adult chain 2, hemoglobin, alpha 1 | EST, Moderately similar to HART1 hemoglobin alpha-1 chain - rat [*R. norvegicus*], ESTs, Moderately similar to HART1 hemoglobin alpha-1 chain - rat [*R. norvegicus*], RIKEN cDNA 2510042H12 gene, hemoglobin alpha, adult chain 1, hemoglobin, alpha 1, hemoglobin, alpha 2 |
| 1601 | 1684 | NM_013096 | c, s, aa | hemoglobin alpha, adult chain 2, hemoglobin, alpha 1 | EST, Moderately similar to HART1 hemoglobin alpha-1 chain - rat [*R. norvegicus*], ESTs, Moderately similar to HART1 hemoglobin alpha-1 chain - rat [*R. norvegicus*], RIKEN cDNA 2510042H12 gene, hemoglobin |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 1602 | 20886 | NM_013097 | u, x, bb | | alpha, adult chain 1, hemoglobin, alpha 1, hemoglobin, alpha 2 |
| 1602 | 20887 | NM_013097 | u, x, bb | | ESTs, Weakly similar to DRN1 RAT DEOXYRIBONUCLEASE I PRECURSOR [*R. norvegicus*], *Mus musculus* DNaseI precursor mRNA, complete cds, RIKEN cDNA 4733401H14 gene, deoxyribonuclease I, expressed sequence AI788650 |
| 1603 | 1321 | NM_013098 | c | | ESTs, Weakly similar to G6PT RAT GLUCOSE-6-PHOSPHATASE [*R. norvegicus*], *Homo sapiens*, clone IMAGE: 3050476, mRNA, partial cds, RIKEN cDNA 0710001K01 gene, expressed sequence AW545836, glucose-6-phosphatase, catalytic, glucose-6-phosphatase, catalytic (glycogen storage disease type I, von Gierke disease), glucose-6-phosphatase, catalytic, related sequence, islet-specific glucose-6-phosphatase catalytic subunit-related protein |
| 1604 | 15296 | NM_013102 | l, m | FK506 binding protein 1a (12 kDa), FK506-binding protein 1A (12 kD) | ESTs, Moderately similar to 1613455A FK506 binding protein FKBP [*H. sapiens*], FK506 binding protein 1a (12 kDa), FK506 binding protein 1b (12 6 kDa), FK506 binding protein 2 (13 kDa), FK506 binding protein 4 (59 kDa), FK506 binding protein 5 (51 kDa), FK506-binding protein 1A (12 kD) |
| 1606 | 23709 | NM_013113 | o, s, z, aa | | ATPase, Na+/K+ transporting, beta 1 polypeptide |
| 1606 | 23711 | NM_013113 | p | | ATPase, Na+/K+ transporting, beta 1 polypeptide |
| 1606 | 23710 | NM_013113 | s | | ATPase, Na+/K+ transporting, beta 1 polypeptide |
| 1607 | 1976 | NM_013118 | u | | guanylate cyclase activator 1B (retina), guanylate cyclase activator 2 (guanylin 2, intestinal, heatstable), guanylate cyclase activator 2A (guanylin) |
| 1609 | 870 | NM_013130 | h | | MAD (mothers against decapentaplegic, Drosophila) homolog 1, MAD (mothers against decapentaplegic, Drosophila) homolog 5, MAD (mothers against decapentaplegic, Drosophila) homolog 9 |
| 1610 | 16650 | NM_013132 | u, General | annexin A5 | annexin A5 |
| 1611 | 650 | NM_013134 | h | | 3-hydroxy-3-methylglutaryl-Coenzyme A reductase, ESTs, Moderately similar to hydroxymethylglutaryl-CoA reductase [*M. musculus*], SREBP CLEAVAGE-ACTIVATING PROTEIN |
| 1611 | 651 | NM_013134 | h, j, l | | 3-hydroxy-3-methylglutaryl-Coenzyme A reductase, ESTs, Moderately similar to hydroxymethylglutaryl-CoA reductase [*M. musculus*], SREBP CLEAVAGE-ACTIVATING PROTEIN |
| 1612 | 1712 | NM_013138 | General | inositol 1,4,5-triphosphate receptor 3, inositol 1,4,5-triphosphate receptor, type 3 | ESTs, Moderately similar to INOSITOL 1,4,5-TRIPHOSPHATE-BINDING PROTEIN TYPE 1 RECEPTOR [*M. musculus*], *Mus musculus*, Similar to Purkinje cell protein 1, clone MGC: 11943 IMAGE: 3600031, mRNA, complete cds, RIKEN cDNA 9330127120 gene, inositol 1,4,5-triphosphate receptor 1, inositol 1,4,5-triphosphate receptor 2, inositol 1,4,5-triphosphate receptor 5, inositol 1,4,5-triphosphate receptor, type 3 |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 1613 | 16982 | NM_013144 | o, v, General | | insulin-like growth factor binding protein 1, protease, serine, 11 (IGF binding) |
| 1614 | 21683 | NM_013154 | t, cc, General | CCAAT/enhancer binding protein (C/EBP), delta | CCAAT/enhancer binding protein (C/EBP), delta |
| 1614 | 21682 | NM_013154 | cc | CCAAT/enhancer binding protein (C/EBP), delta | CCAAT/enhancer binding protein (C/EBP), delta |
| 1615 | 3431 | NM_013156 | b, g, n | cathepsin L | ESTs, Weakly similar to CATHEPSIN L PRECURSOR [*M. musculus*], RIKEN cDNA 2310051M13 gene, RIKEN cDNA 4930486L24 gene, cathepsin 7, cathepsin F, cathepsin L, cathepsin L2, cathepsin O |
| 1615 | 25567 | NM_013156 | v, General | | |
| 1615 | 3430 | NM_013156 | General | cathepsin L | ESTs, Weakly similar to CATHEPSIN L PRECURSOR [*M. musculus*], RIKEN cDNA 2310051M13 gene, RIKEN cDNA 4930486L24 gene, cathepsin 7, cathepsin F, cathepsin L, cathepsin L2, cathepsin O |
| 1616 | 1309 | NM_013159 | w | | RIKEN cDNA 4833415K22 gene, expressed sequence AA675336, insulin degrading enzyme, insulin-degrading enzyme |
| 1616 | 1310 | NM_013159 | w | | RIKEN cDNA 4833415K22 gene, expressed sequence AA675336, insulin degrading enzyme, insulin-degrading enzyme |
| 1617 | 21723 | NM_013174 | w | | TGF beta 2 protein, transforming growth factor, beta 2, transforming growth factor, beta 3 |
| 1618 | 1314 | NM_013181 | m | | EST, Moderately similar to CAMP-DEPENDENT PROTEIN KINASE TYPE I-ALPHA REGULATORY CHAIN [*R. norvegicus*], protein kinase, cAMP dependent regulatory, type 1, alpha, protein kinase, cAMP dependent regulatory, type I beta, protein kinase, cAMP-dependent, regulatory, type I, alpha (tissue specific extinguisher 1) |
| 1619 | 17357 | NM_013183 | p, bb, General | meprin 1 beta, meprin A, beta | expressed sequence C87576, meprin 1 beta, meprin A, beta |
| 1620 | 1300 | NM_013190 | y | | *Mus musculus* adult male stomach cDNA, RIKEN full-length enriched library, clone 2210403E17, full insert sequence, expressed sequence AA407869, phosphofructokinase, liver, phosphofructokinase, liver, B-type, phosphofructokinase, muscle |
| 1621 | 16448 | NM_013197 | c | | EST, Highly similar to HEMO RAT 5-AMINOLEVULINIC ACID SYNTHASE, ERYTHROID-SPECIFIC, MITOCHONDRIAL PRECURSOR [*R. norvegicus*], ESTs, Highly similar to SYHUAE 5-aminolevulinate synthase [*H. sapiens*], aminolevulinate, delta-, synthase 2 (sideroblastic/hypochromic anemia), aminolevulinic acid synthase 1, aminolevulinic acid synthase 2, erythroid, glycine C-acetyltransferase (2-amino-3-ketobutyrate coenzyme A ligase), glycine C-acetyltransferase (2-amino-3-ketobutyrate-coenzyme A ligase) |
| 1622 | 20856 | NM_013200 | b | carnitine palmitoyltransferase 1, muscle, carnitine palmitoyltransferase I, muscle | ESTs, Moderately similar to CPTM RAT CARNITINE O-PALMITOYLTRANSFERASE I, MITOCHONDRIAL MUSCLE ISOFORM [*R. norvegicus*], ESTs, Weakly similar to CPT1 MOUSE CARNITINE O-PALMITOYLTRANSFERASE I, MITOCHONDRIAL LIVER ISOFORM |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| | | | | | [*M. musculus*], carnitine palmitoyltransferase 1, liver, carnitine palmitoyltransferase 1, muscle, carnitine palmitoyltransferase I, muscle |
| 1623 | 397 | NM_013214 | f | | |
| 1624 | 20864 | NM_013215 | g, n, y | | ESTs, Highly similar to AR72_HUMAN AFLATOXIN B1 ALDEHYDE REDUCTASE 1 (AFB1-AR 1) (ALDOKETOREDUCTASE 7) [*H. sapiens*], ESTs, Moderately similar to AFAR RAT AFLATOXIN B1 ALDEHYDE REDUCTASE [*R. norvegicus*], RIKEN cDNA 0610025K21 gene, *Rattus norvegicus* aiar mRNA for androgen-inducible aldehyde reductase, complete cds, aldo-keto reductase family 7, member A2 (aflatoxin aldehyde reductase), aldo-keto reductase family 7, member A3 (aflatoxin aldehyde reductase) |
| 1625 | 20728 | NM_013217 | v | | ESTs, Moderately similar to T30989 serine/threonine protein kinase NIK-mouse [*M. musculus*], *Mus musculus*, Similar to zinc finger protein 347, clone MGC: 18913 IMAGE: 4242025, mRNA, complete cds, RIKEN cDNA 1500031A17 gene, mitogen-activated protein kinase kinase kinase kinase 4, mitogen-activated protein kinase kinase kinase kinase 6, myeloid/lymphoid or mixed-lineage leukemia (trithorax (Drosophila) homolog), translocated to, 4, syntaxin binding protein 4 |
| 1626 | 1396 | NM_013222 | j | growth factor, erv1 (*S. cerevisiae*)-like (augmenter of liver regeneration) | ESTs, Highly similar to ALR RAT AUGMENTER OF LIVER REGENERATION [*R. norvegicus*], growth factor, erv1 (*S. cerevisiae*)-like (augmenter of liver regeneration) |
| 1627 | 815 | NM_013224 | w | | ESTs, Highly similar to RS26_HUMAN 40S RIBOSOMAL PROTEIN S26 [*H. sapiens*], *Homo sapiens*, clone IMAGE: 4100953, mRNA, Human DNA sequence from PAC 384D21 on chromosome X contains ribosomal protein S26 pseudogene, STS, polymerase (RNA) II (DNA directed) polypeptide D, ribosomal protein S26 |
| 1628 | 18305 | NM_013226 | v | | |
| 1629 | 21078 | NM_016986 | d | acetyl-Coenzyme A dehydrogenase, medium chain, acyl-Coenzyme A dehydrogenase, C-4 to C-12 straight chain | ESTs, Highly similar to ACDM MOUSE ACYL-COA DEHYDROGENASE, MEDIUM-CHAIN SPECIFIC PRECURSOR [*M. musculus*], acetyl-Coenzyme A dehydrogenase, medium chain, acyl-Coenzyme A dehydrogenase, C-4 to C-12 straight chain, expressed sequence AI987948 |
| 1630 | 24649 | NM_016988 | v | acid phosphatase 2, lysosomal | ESTs, Weakly similar to PPAL RAT LYSOSOMAL ACID PHOSPHATASE PRECURSOR [*R. norvegicus*], acid phosphatase 2, lysosomal, acid phosphatase 6, lysophosphatidic, acid phosphatase, prostate, acid phosphatase, testicular |
| 1631 | 15239 | NM_016989 | q, w | | EST, Weakly similar to RL15 RAT 60S RIBOSOMAL PROTEIN L15 [*R. norvegicus*], ESTs, Highly similar to RL15_HUMAN 60S RIBOSOMAL PROTEIN L15 [*H. sapiens*], ESTs, Moderately similar to RL15 RAT 60S RIBOSOMAL PROTEIN L15 [*R. norvegicus*], RIKEN cDNA |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 1632 | 45 | NM_016996 | General | calcium-sensing receptor, calcium-sensing receptor (hypocalciuric hypercalcemia 1, severe neonatal hyperparathyroidism) | 2510008H07 gene, ribosomal protein L15 EST, Weakly similar to EXTRACELLULAR CALCIUM-SENSING RECEPTOR PRECURSOR [*R. norvegicus*], ESTs, Weakly similar to CASR_HUMAN EXTRACELLULAR CALCIUM-SENSING RECEPTOR PRECURSOR [*H. sapiens*], ESTs, Weakly similar to JC7160 metabotropic glutamate receptor subtype 3 precursor - mouse [*M. musculus*], G protein coupled receptor, family C, group 1, member A, G protein coupled receptor, family C, group 1, member C, calcium-sensing receptor (hypocalciuric hypercalcemia 1, severe neonatal hyperparathyroidism), vomeronasal 2, receptor, 11, vomeronasal 2, receptor, 12 |
| 1633 | 20714 | NM_016999 | t | cytochrome P450, subfamily IV B, polypeptide 1, cytochrome P450, subfamily IVB, polypeptide 1 | *Mus musculus*, Similar to cytochrome P450, 4a10, clone MGC: 25972 IMAGE: 4240359, mRNA, complete cds, RIKEN cDNA A230105L22 gene, cytochrome P450, 4a10, cytochrome P450, 4a14, cytochrome P450, subfamily IVA, polypeptide 11 |
| 1633 | 20713 | NM_016999 | t | cytochrome P450, subfamily IV B, polypeptide 1, cytochrome P450, subfamily IVB, polypeptide 1 | *Mus musculus*, Similar to cytochrome P450, 4a10, clone MGC: 25972 IMAGE: 4240359, mRNA, complete cds, RIKEN cDNA A230105L22 gene, cytochrome P450, 4a10, cytochrome P450, 4a14, cytochrome P450, subfamily IVA, polypeptide 11 |
| 1633 | 20711 | NM_016999 | q, t | cytochrome P450, subfamily IV B, polypeptide 1, cytochrome P450, subfamily IVB, polypeptide 1 | *Mus musculus*, Similar to cytochrome P450, 4a10, clone MGC 25972 IMAGE: 4240359, mRNA, complete cds, RIKEN cDNA A230105L22 gene, cytochrome P450, 4a10, cytochrome P450, 4a14, cytochrome P450, subfamily IVA, polypeptide 11 |
| 1633 | 20715 | NM_016999 | q, t | cytochrome P450, subfamily IV B, polypeptide 1, cytochrome P450, subfamily IVB, polypeptide 1 | *Mus musculus*, Similar to cytochrome P450, 4a10, clone MGC: 25972 IMAGE 4240359, mRNA, complete cds, RIKEN cDNA A230105L22 gene, cytochrome P450, 4a10, cytochrome P450, 4a14, cytochrome P450, subfamily IVA, polypeptide 11 |
| 1634 | 1698 | NM_017000 | e, n, p, General | diaphorase (NADH/NADPH) (cytochrome b-5 reductase), diaphorase 4 (NADH/NADPH) | ESTs, Weakly similar to DHQU RAT NAD(P)H DEHYDROGENASE [*R. norvegicus*], NAD(P)H menadione oxidoreductase 2, dioxin inducible, NAD(P)H menadione oxidoreductase 2, dioxin-inducible, diaphorase (NADH/NADPH) (cytochrome b-5 reductase), diaphorase 4 (NADH/NADPH) |
| 1635 | 1399 | NM_017006 | h, n, General | glucose-6-phosphate dehydrogenase, glucose-6-phosphate dehydrogenase X-linked | glucose-6-phosphate dehydrogenase, glucose-6-phosphate dehydrogenase 2, glucose-6-phosphate dehydrogenase X-linked, hexose-6-phosphate dehydrogenase (glucose 1-dehydrogenase) |
| 1637 | 18989 | NM_017013 | n | glutathione S-transferase A2, glutathione S-transferase, alpha 2 (Yc2) | glutathione S-transferase A2, glutathione S-transferase, alpha 2 (Yc2) |
| 1638 | 21013 | NM_017014 | e, f | glutathione S-transferase M2 (muscle), glutathione S-transferase, mu 2 | ESTs, Moderately similar to GLUTATHIONE S-TRANSFERASE YB1 [*R. norvegicus*], glutathione S-transferase M1, glutathione S-transferase, mu 1 |
| 1638 | 21015 | NM_017014 | e, General | glutathione S-transferase M2 (muscle), glutathione S-transferase, mu 2 | ESTs, Moderately similar to GLUTATHIONE S-TRANSFERASE YB1 [*R. norvegicus*], glutathione S- |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 1639 | 11836 | NM_017023 | b | potassium inwardly-rectifying channel, subfamily J, member 1 | transferase M1, glutathione S-transferase, mu 1 EST, Weakly similar to IRKF MOUSE ATP-SENSITIVE INWARD RECTIFIER POTASSIUM CHANNEL 15 [*M. musculus*], potassium inwardly-rectifying channel, subfamily J, member 1, potassium inwardly-rectifying channel, subfamily J, member 10, potassium inwardly-rectifying channel, subfamily J, member 15 |
| 1639 | 5475 | NM_017023 | b | potassium inwardly-rectifying channel, subfamily J, member 1 | EST, Weakly similar to IRKF MOUSE ATP-SENSITIVE INWARD RECTIFIER POTASSIUM CHANNEL 15 [*M. musculus*], potassium inwardly-rectifying channel, subfamily J, member 1, potassium inwardly-rectifying channel, subfamily J, member 10, potassium inwardly-rectifying channel, subfamily J, member 15 |
| 1639 | 25546 | NM_017023 | b, bb | | |
| 1640 | 17807 | NM_017025 | i, General | lactate dehydrogenase 1, A chain, lactate dehydrogenase A | ESTs, Highly similar to DEHULM L-lactate dehydrogenase [*H. sapiens*], ESTs, Moderately similar to DEHULM L-lactate dehydrogenase [*H. sapiens*], ESTs, Moderately similar to L-LACTATE DEHYDROGENASE M CHAIN [*R. norvegicus*], ESTs, Weakly similar to DEMSLM L-lactate dehydrogenase [*M. musculus*], *Homo sapiens*, Similar to lactate dehydrogenase 1, A chain, clone MGC 23940 IMAGE.3935569, mRNA, complete cds, expressed sequence AI326310, lactate dehydrogenase 1, A chain, lactate dehydrogenase A, lactate dehydrogenase C |
| 1641 | 24597 | NM_017040 | u | protein phosphatase 2 (formerly 2A), catalytic subunit, beta isoform, protein phosphatase 2a, catalytic subunit, beta isoform | *Mus musculus* adult female placenta cDNA, RIKEN full-length enriched library, clone 1600017J22, full insert sequence, RIKEN cDNA 2310003C10 gene, expressed sequence AI115466, protein phosphatase 2 (formerly 2A), catalytic subunit, beta isoform, protein phosphatase 2a, catalytic subunit, beta isoform, protein phosphatase 4, catalytic subunit |
| 1642 | 24696 | NM_017048 | f, j, z | solute carrier family 4 (anion exchanger), member 2, solute carrier family 4, anion exchanger, member 2 (erythrocyte membrane protein band 3-like 1) | ESTs, Moderately similar to A25104 band 3 protein, nonerythroid [*H. sapiens*], Human DNA sequence from clone RP4-794I6 on chromosome 20 Contains a gene for a putative oncogene protein, parts of 2 novel genes, ESTs, STSs, GSSs and CpG islands, solute carrier family 4 (anion exchanger), member 2, solute carrier family 4, anion exchanger, member 2 (erythrocyte membrane protein band 3-like 1), solute carrier family 4, sodium bicarbonate cotransporter, member 4, solute carrier family 4, sodium bicarbonate cotransporter, member 9, solute carrier family 4, sodium bicarbonate transporter-like, member 11 |
| 1643 | 24695 | NM_017049 | u | | EST, Highly similar to B3A3 RAT ANION EXCHANGE PROTEIN 3 [*R. norvegicus*], ESTs, Weakly similar to I38496 anion exchanger 3 brain isoform [*H. sapiens*], Human DNA sequence from clone RP4-794I6 on |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| | | | | | chromosome 20 Contains a gene for a putative oncogene protein, parts of 2 novel genes, ESTs, STSs, GSSs and CpG islands, solute carrier family 4 (anion exchanger), member 3, solute carrier family 4, anion exchanger, member 3, solute carrier family 4, sodium bicarbonate transporter-like, member 11 |
| 1644 | 20876 | NM_017050 | j, n, z | superoxide dismutase 1, soluble, superoxide dismutase 1, soluble (amyotrophic lateral sclerosis 1 (adult)) | ESTs, Moderately similar to SUPEROXIDE DISMUTASE [*M. musculus*], copper chaperone for superoxide dismutase, superoxide dismutase 1, soluble, superoxide dismutase 1, soluble (amyotrophic lateral sclerosis 1 (adult)) |
| 1645 | 910 | NM_017059 | f, l, m | BCL2-associated X protein, Bcl2-associated X protein | BCL2-associated X protein, Bcl2-associated X protein |
| 1645 | 912 | NM_017059 | i | BCL2-associated X protein, Bcl2-associated X protein | BCL2-associated X protein, Bcl2-associated X protein |
| 1646 | 1946 | NM_017061 | h | lysyl oxidase | ESTs, Moderately similar to LYOX__HUMAN PROTEIN-LYSINE 6-OXIDASE PRECURSOR [*H. sapiens*], ESTs, Moderately similar to PROTEIN-LYSINE 6-OXIDASE PRECURSOR [*R. norvegicus*], hypothetical protein FLJ21889, lysyl oxidase, lysyl oxidase-like, lysyl oxidase-like 1, lysyl oxidase-like 2 |
| 1646 | 1942 | NM_017061 | t, General | lysyl oxidase | ESTs, Moderately similar to LYOX__HUMAN PROTEIN-LYSINE 6-OXIDASE PRECURSOR [*H. sapiens*], ESTs, Moderately similar to PROTEIN-LYSINE 6-OXIDASE PRECURSOR [*R. norvegicus*], hypothetical protein FLJ21889, lysyl oxidase, lysyl oxidase-like, lysyl oxidase-like 1, lysyl oxidase-like 2 |
| 1646 | 1943 | NM_017061 | t | lysyl oxidase | ESTs, Moderately similar to LYOX__HUMAN PROTEIN-LYSINE 6-OXIDASE PRECURSOR [*H. sapiens*], ESTs, Moderately similar to PROTEIN-LYSINE 6-OXIDASE PRECURSOR [*R. norvegicus*], hypothetical protein FLJ21889, lysyl oxidase, lysyl oxidase-like, lysyl oxidase-like 1, lysyl oxidase-like 2 |
| 1647 | 6062 | NM_017066 | d | pleiotrophin, pleiotrophin (heparin binding growth factor 8, neurite growth-promoting factor 1) | EST, Moderately similar to JH0385 midkine precursor [*H. sapiens*], EST, Weakly similar to PTN MOUSE PLEIOTROPHIN PRECURSOR [*R. norvegicus*], midkine, midkine (neurite growth-promoting factor 2), pleiotrophin, pleiotrophin (heparin binding growth factor 8, neurite growth-promoting factor 1) |
| 1648 | 6654 | NM_017068 | w | lysosomal membrane glycoprotein 2, lysosomal-associated membrane protein 2 | CD68 antigen, ESTs, Highly similar to LMP2 RAT LYSOSOME-ASSOCIATED MEMBRANE GLYCOPROTEIN 2 PRECURSOR [*R. norvegicus*], ESTs, Weakly similar to A48042 lysosomal membrane glycoprotein lamp-2 homolog [*H. sapiens*], lysosomal membrane glycoprotein 2, lysosomal-associated membrane protein 2 |
| 1649 | 11153 | NM_017073 | s | glutamate-ammonia ligase (glutamine synthase), glutamine synthetase | glutamate-ammonia ligase (glutamine synthase), glutamine synthetase |
| 1650 | 923 | NM_017076 | General | | DNA segment, Chr 7, ERATO Doi 458, expressed, RIKEN cDNA 2610301B19 |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| | | | | | gene, RIKEN cDNA 3830421F03 gene, poliovirus receptor, poliovirus receptor-related 2 (herpesvirus entry mediator B), poliovirus receptor-related 3, poliovirus sensitivity, tumor-associated antigen 1 |
| 1651 | 1523 | NM_017079 | s | | CD1B antigen, b polypeptide, CD1D antigen, d polypeptide, CD1E antigen, e polypeptide, CD1d1 antigen, CD1d2 antigen |
| 1652 | 23660 | NM_017080 | s | hydroxysteroid (11-beta) dehydrogenase 1, hydroxysteroid 11-beta dehydrogenase 1 | DNA segment, Chr 14, University of California at Los Angeles 2, ESTs, Weakly similar to CORTICOSTEROID 11-BETA-DEHYDROGENASE, ISOZYME 1 [*R. norvegicus*], expressed sequence C79874, hydroxysteroid (11-beta) dehydrogenase 1, hydroxysteroid 11-beta dehydrogenase 1, hydroxysteroid 17-beta dehydrogenase 11, retinal short-chain dehydrogenase/reductase retSDR2 |
| 1653 | 275 | NM_017081 | b, d, General | hydroxysteroid (11-beta) dehydrogenase 2, hydroxysteroid 11-beta dehydrogenase 2 | *Mus musculus*, Similar to hydroxysteroid 11-beta dehydrogenase 2, clone MGC: 25647 IMAGE.4235545, mRNA, complete cds, hydroxysteroid (11-beta) dehydrogenase 2 |
| 1654 | 16211 | NM_017082 | j, s, z | uromodulin, uromodulin (uromucoid, Tamm-Horsfall glycoprotein) | RIKEN cDNA 2310037I18 gene, tectorin beta, uromodulin, uromodulin (uromucoid, Tamm-Horsfall glycoprotein), zona pellucida glycoprotein 1 |
| 1655 | 1552 | NM_017084 | j | glycine N-methyltransferase | glycine N-methyltransferase |
| 1655 | 1550 | NM_017084 | y | glycine N-methyltransferase | glycine N-methyltransferase |
| 1656 | 22552 | NM_017087 | a, k, x | biglycan | ESTs, Weakly similar to BONE/CARTILAGE PROTEOGLYCAN I PRECURSOR [*R. norvegicus*], ESTs, Weakly similar to PGS1_HUMAN BONE/CARTILAGE PROTEOGLYCAN I PRECURSOR [*H. sapiens*], asporin, asporin (LRR class 1), biglycan, opticin |
| 1657 | 8888 | NM_017090 | m | guanylate cyclase 1, soluble, alpha 3 | ESTs, Weakly similar to ANPA MOUSE ATRIAL NATRIURETIC PEPTIDE RECEPTOR A PRECURSOR [*M. musculus*], ESTs, Weakly similar to GUANYLATE CYCLASE SOLUBLE, ALPHA-1 CHAIN [*R. norvegicus*], guanylate cyclase 1, soluble, alpha 2, guanylate cyclase 1, soluble, alpha 3, guanylate cyclase 1, soluble, beta 3, natriuretic peptide receptor 1, soluble guanylyl cyclase alpha2 subunit |
| 1658 | 10887 | NM_017094 | a, General | growth hormone receptor | growth hormone receptor |
| 1659 | 4393 | NM_017101 | a, y | peptidylprolyl isomerase A, peptidylprolyl isomerase A (cyclophilin A) | ESTs, Highly similar to A Chain A, Cyclophilin A [*H. sapiens*], ESTs, Weakly similar to PEPTIDYL-PROLYL CIS-TRANS ISOMERASE A [*R. norvegicus*], KIAA1228 protein, RIKEN cDNA 2310076N22 gene, RIKEN cDNA 4930520F12 gene, expressed sequence AI256741, expressed sequence AW457192, peptidylprolyl isomerase A, peptidylprolyl isomerase A (cyclophilin A), peptidylprolyl isomerase E (cyclophilin E) |
| 1660 | 24770 | NM_017111 | d | solute carrier family 21 (organic anion transporter), member 1 | blood-brain barrier specific anion transporter, solute carrier family (organic anion transporter) member |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| | | | | | 10, solute carrier family 21 (organic anion transporter), member 1, solute carrier family 21 (organic anion transporter), member 10, solute carrier family 21 (organic anion transporter), member 14, solute carrier family 21 (organic anion transporter), member 3, solute carrier family 21 (organic anion transporter), member 6, solute carrier family 21 (organic anion transporter), member 8 |
| 1661 | 20745 | NM_017113 | e | granulin | granulin |
| 1661 | 20746 | NM_017113 | a | granulin | granulin |
| 1662 | 1375 | NM_017122 | w | hippocalcin | DNA segment, Chr 15, ERATO Doi 412, expressed, ESTs, Highly similar to HIPP RAT NEURON SPECIFIC CALCIUM-BINDING PROTEIN HIPPOCALCIN [*R. norvegicus*], ESTs, Highly similar to VIS3 MOUSE VISININ LIKE PROTEIN 3 [*M. musculus*], hippocalcin, hippocalcin-like 1, hypothetical protein FLJ20481 |
| 1663 | 12903 | NM_017124 | k | CD37 antigen | CD37 antigen, EST, Highly similar to A47629 cell surface glycoprotein CD37 [*H. sapiens*], *Mus musculus*, Similar to CD37 antigen, clone MGC: 7983 IMAGE: 3585492, mRNA, complete cds, oculospanin |
| 1664 | 24885 | NM_017138 | r | laminin receptor 1 (67 kD, ribosomal protein SA) | EST, Moderately similar to 40S RIBOSOMAL PROTEIN SA [*R. norvegicus*], ESTs, Highly similar to A31233 ribosomal protein RS.40K, cytosolic [*H. sapiens*], ESTs, Highly similar to A56880 laminin receptor, 67K [*H. sapiens*], ESTs, Moderately similar to A29395 ribosomal protein RS 40K - mouse [*M. musculus*], ESTs, Weakly similar to 1405340A protein 40 kD [*M. musculus*], Homo sapiens laminin receptor-like protein LAMRL5 mRNA, complete cds, laminin receptor 1 (67 kD, ribosomal protein SA) |
| 1664 | 24886 | NM_017138 | d, q | laminin receptor 1 (67 kD, ribosomal protein SA) | EST, Moderately similar to 40S RIBOSOMAL PROTEIN SA [*R. norvegicus*], ESTs, Highly similar to A31233 ribosomal protein RS.40K, cytosolic [*H. sapiens*], ESTs, Highly similar to A56880 laminin receptor, 67K [*H. sapiens*], ESTs, Moderately similar to A29395 ribosomal protein RS 40K - mouse [*M. musculus*], ESTs, Weakly similar to 1405340A protein 40 kD [*M. musculus*], Homo sapiens laminin receptor-like protein LAMRL5 mRNA, complete cds, laminin receptor 1 (67 kD, ribosomal protein SA) |
| 1665 | 15363 | NM_017147 | n, u | cofilin 1 (non-muscle), cofilin 1, non-muscle | EST, Moderately similar to COF1_HUMAN COFILIN, NON-MUSCLE ISOFOR [*H. sapiens*], ESTs, Highly similar to DEST_HUMAN DESTRIN [*H. sapiens*], ESTs, Moderately similar to COF1 RAT COFILIN, NON-MUSCLE ISOFORM [*R. norvegicus*], ESTs, Moderately similar to COF1_HUMAN COFILIN, NON-MUSCLE ISOFOR [*H. sapiens*], cofilin 1 (non-muscle), cofilin 1, non-muscle, cofilin 2 (muscle), cofilin 2, muscle, destrin |
| 1666 | 13392 | NM_017148 | u, General | | EST, Moderately similar to CYSR RAT CYSTEINE-RICH PROTEIN 1 [*R. norvegicus*], ESTs, Weakly similar to CYSR RAT CYSTEINE-RICH |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 1667 | 5351 | NM_017150 | q | ribosomal protein L29 | PROTEIN 1 [*R. norvegicus*], ESTs, Weakly similar to S12658 cysteine-rich protein [*H. sapiens*], cysteine and glycine-rich protein 1, cysteine rich protein, cysteine-rich protein 2, cysteine-rich protein 3, epithelial protein lost in neoplasm beta, thymus LIM protein<br>EST, Moderately similar to 60S RIBOSOMAL PROTEIN L29 [*R. norvegicus*], EST, Weakly similar to S65784 ribosomal protein L29. cytosolic [*H. sapiens*], ESTs, Highly similar to S65784 ribosomal protein L29, cytosolic [*H. sapiens*], ESTs, Weakly similar to 60S RIBOSOMAL PROTEIN L29 [*M. musculus*], Human DNA sequence from clone RP4-595K12 on chromosome 1p31.2-31.3 Contains a pseudogene similar to 60S RPL29 (ribosomal protein L29 (cell surface heparin binding protein HIP)), a chromosome 1 specific mRNA (KIAA0499), a novel mRNA (KIAA0433), ESTs, STSs, GSSs and a CpG Island, ribosomal protein L29 |
| 1668 | 16954 | NM_017151 | a, n | ribosomal protein S15 | EST, Moderately similar to R3HU15 ribosomal protein S15, cytosolic [*H. sapiens*], EST, Weakly similar to 40S RIBOSOMAL PROTEIN S15 [*R. norvegicus*], ESTs, Highly similar to R3HU15 ribosomal protein S15, cytosolic [*H. sapiens*], *Homo sapiens*, clone IMAGE: 4479080, mRNA, partial cds, ribosomal protein S15 |
| 1669 | 21643 | NM_017152 | g | ribosomal protein S17 | EST, Weakly similar to 40S RIBOSOMAL PROTEIN S17 [*M. musculus*], ESTs, Highly similar to R4HU17 ribosomal protein S17, cytosolic [*H. sapiens*], ESTs, Moderately similar to R4HU17 ribosomal protein S17, cytosolic [*H. sapiens*], ribosomal protein S17 |
| 1670 | 1694 | NM_017153 | a, q | ribosomal protein S3A, ribosomal protein S3a | EST, Weakly similar to RS3A MOUSE 40S RIBOSOMAL PROTEIN S3A [*M. musculus*], ESTs, Highly similar to JC4662 ribosomal protein S3a, cytosolic [*H. sapiens*], ribosomal protein S3A, ribosomal protein S3a |
| 1671 | 17104 | NM_017160 | bb, General | ribosomal protein S6 | EST, Moderately similar to R3HU6 ribosomal protein S6, cytosolic [*H. sapiens*], EST, Weakly similar to 40S RIBOSOMAL PROTEIN S6 [*R. norvegicus*], ESTs, Moderately similar to 40S RIBOSOMAL PROTEIN S6 [*M. musculus*], *Homo sapiens* cDNA: FLJ23534 fis, clone LNG06974, highly similar to HUMRPS6A Human ribosomal protein S6 mRNA, RIKEN cDNA 5830405M20 gene, ribosomal protein S6 |
| 1671 | 17106 | NM_017160 | u | ribosomal protein S6 | EST, Moderately similar to R3HU6 ribosomal protein S6, cytosolic [*H. sapiens*], EST, Weakly similar to 40S RIBOSOMAL PROTEIN S6 [*R. norvegicus*], ESTs, Moderately similar to 40S RIBOSOMAL PROTEIN S6 [*M. musculus*], *Homo sapiens* cDNA: FLJ23534 fis, clone LNG06974, highly similar to HUMRPS6A Human ribosomal protein S6 mRNA, RIKEN cDNA 5830405M20 gene, ribosomal protein S6 |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 1671 | 17107 | NM_017160 | d, e | ribosomal protein S6 | EST, Moderately similar to R3HU6 ribosomal protein S6, cytosolic [*H. sapiens*], EST, Weakly similar to 40S RIBOSOMAL PROTEIN S6 [*R. norvegicus*], ESTs, Moderately similar to 40S RIBOSOMAL PROTEIN S6 [*M. musculus*], Homo sapiens cDNA: FLJ23534 fis, clone LNG06974, highly similar to HUMRPS6A Human ribosomal protein S6 mRNA, RIKEN cDNA 5830405M20 gene, ribosomal protein S6 |
| 1672 | 17686 | NM_017165 | n, q | glutathione peroxidase 4, glutathione peroxidase 4 (phospholipid hydroperoxidase) | EST, Moderately similar to T02747 phospholipid-hydroperoxide glutathione peroxidase [*H. sapiens*], EST, Weakly similar to T02747 phospholipid-hydroperoxide glutathione peroxidase [*H. sapiens*], ESTs, Weakly similar to GSHH RAT PHOSPHOLIPID HYDROPEROXIDE GLUTATHIONE PEROXIDASE [*R. norvegicus*], Homo sapiens PRO2893 mRNA, complete cds, RIKEN cDNA 2310016C16 gene, RIKEN cDNA 3110050F08 gene, glutathione peroxidase 4, glutathione peroxidase 4 (phospholipid hydroperoxidase) |
| 1673 | 20702 | NM_017166 | c | leukemia-associated gene, stathmin 1/oncoprotein 18 | ESTs, Weakly similar to STHM MOUSE STATHMIN [*M. musculus*], Homo sapiens (clone B3B3E13) Huntington's disease candidate region mRNA fragment, leukemia-associated gene, stathmin 1/oncoprotein 18 |
| 1674 | 3513 | NM_017177 | r | choline kinase-like, choline/ethanolamine kinase | EST, Weakly similar to KICE MOUSE CHOLINE/ETHANOLAMINE KINASE [*M. musculus*], ESTs, Weakly similar to KICE RAT CHOLINE/ETHANOLAMINE KINASE [*R. norvegicus*], Homo sapiens, Similar to hypothetical protein FLJ10761, clone MGC: 19512 IMAGE: 4329734, mRNA, complete cds, Mus musculus mRNA for choline/ethanolamine kinase, complete cds, RIKEN cDNA 4930555L11 gene, choline kinase-like, choline/ethanolamine kinase, ethanolamine kinase, hypothetical protein FLJ10761 |
| 1675 | 19031 | NM_017180 | v, General | T-cell death associated gene, pleckstrin homology-like domain, family A, member 1 | ESTs, Weakly similar to S58222 PQ-rich protein [*H. sapiens*], MARCKS-like protein, Mus musculus 8 days embryo cDNA, RIKEN full-length enriched library, clone: 5730519L10, full insert sequence, Myristoylated alanine-rich protein kinase C substrate, myristoylated alanine rich protein kinase C substrate, myristoylated alanine-rich protein kinase C substrate (MARCKS, 80K-L), pleckstrin homology-like domain, family A, member 1, pleckstrin homology-like domain, family A, member 3, tumor suppressing subtransferable candidate 3 |
| 1676 | 15437 | NM_017187 | x, z | | EST, Moderately similar to HMG2 RAT HIGH MOBILITY GROUP PROTEIN HMG2 [*R. norvegicus*], EST, Weakly similar to HMG2 RAT HIGH MOBILITY GROUP PROTEIN HMG2 [*R. norvegicus*], ESTs, Weakly similar to 2001363A high mobility group protein 2 [*H. sapiens*], ESTs, Weakly similar to HMG2 RAT HIGH MOBILITY |

TABLE 3-continued

Atty. Docket No. 44921-5089US
Doc. No. 1803440.1

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| | | | | | GROUP PROTEIN HMG2 [R. norvegicus], Human DNA sequence from clone RP3-527B10 on chromosome 6q25.1-25.3 Contains a pseudogene similar to HMG (high mobility group) protein, STSs and GSSs, Human DNA sequence from clone RP5-1007G16 on chromosome 1p34.2-35.3. Contains part of the gene for a novel CUB and Sushi (SCR repeat) domain protein, a novel high-mobility group (nonhistone chromosomal) protein 2 (HMG2) like protein (pseudo) gene, a heat shock 60 kD protein 1 (chaperonin) (HSPD1) pseudogene, ESTs, STSs and GSSs, RIKEN cDNA 2610021J01 gene, expressed sequence AI326135, expressed sequence C80539, high mobility group box 2, high-mobility group (nonhistone chromosomal) protein 2 |
| 1676 | 15433 | NM_017187 | y | | EST, Moderately similar to HMG2 RAT HIGH MOBILITY GROUP PROTEIN HMG2 [R. norvegicus], EST, Weakly similar to HMG2 RAT HIGH MOBILITY GROUP PROTEIN HMG2 [R. norvegicus], ESTs, Weakly similar to 2001363A high mobility group protein 2 [H. sapiens], ESTs, Weakly similar to HMG2 RAT HIGH MOBILITY GROUP PROTEIN HMG2 [R. norvegicus], Human DNA sequence from clone RP3-527B10 on chromosome 6q25.1-25.3 Contains a pseudogene similar to HMG (high mobility group) protein, STSs and GSSs, Human DNA sequence from clone RP5-1007G16 on chromosome 1p34.2-35.3. Contains part of the gene for a novel CUB and Sushi (SCR repeat) domain protein, a novel high-mobility group (nonhistone chromosomal) protein 2 (HMG2) like protein (pseudo) gene, a heat shock 60 kD protein 1 (chaperonin) (HSPD1) pseudogene. ESTs, STSs and GSSs, RIKEN cDNA 2610021J01 gene, expressed sequence AI326135, expressed sequence C80539, high mobility group box 2, high-mobility group (nonhistone chromosomal) protein 2 |
| 1676 | 15434 | NM_017187 | x, z | | EST, Moderately similar to HMG2 RAT HIGH MOBILITY GROUP PROTEIN HMG2 [R. norvegicus], EST, Weakly similar to HMG2 RAT HIGH MOBILITY GROUP PROTEIN HMG2 [R. norvegicus], ESTs, Weakly similar to 2001363A high mobility group protein 2 [H. sapiens], ESTs, Weakly similar to HMG2 RAT HIGH MOBILITY GROUP PROTEIN HMG2 [R. norvegicus], Human DNA sequence from clone RP3-527B10 on chromosome 6q25.1-25.3 Contains a pseudogene similar to HMG (high mobility group) protein, STSs and GSSs, Human DNA sequence from clone RP5-1007G16 on chromosome 1p34.2-35.3. Contains part of the gene for a novel CUB and Sushi (SCR repeat) domain protein, a novel high- |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| | | | | | mobility group (nonhistone chromosomal) protein 2 (HMG2) like protein (pseudo) gene, a heat shock 60 kD protein 1 (chaperonin) (HSPD1) pseudogene, ESTs, STSs and GSSs, RIKEN cDNA 2610021J01 gene, expressed sequence AI326135, expressed sequence C80539, high mobility group box 2, high-mobility group (nonhistone chromosomal) protein 2 |
| 1677 | 24437 | NM_017190 | p | malignancy-associated protein, myelin-associated glycoprotein | CD33 antigen, CD33 antigen (gp67), ESTs, Weakly similar to MYELIN-ASSOCIATED GLYCOPROTEIN PRECURSOR [*R. norvegicus*], *Homo sapiens* HSPC078 mRNA, partial cds, myelin associated glycoprotein, myelin-associated glycoprotein |
| 1678 | 1542 | NM_017193 | j, l, m, z | L-kynurenine/alpha-aminoadipate aminotransferase, kynurenine aminotransferase II | ESTs, Weakly similar to S48737 kynurenine aminotransferase - rat [*R. norvegicus*], cysteine conjugate-beta lyase; cytoplasmic (glutamine transminase K, kyneurenine aminotransferase), hypothetical protein 669 |
| 1679 | 14695 | NM_017202 | q, s | | EST, Weakly similar to COX4_HUMAN CYTOCHROME C OXIDASE POLYPEPTIDE IV PRECURSO [*H. sapiens*], cytochrome c oxidase subunit IV, cytochrome c oxidase subunit IV isoform 2, cytochrome c oxidase subunit IV isoform 2 precursor, cytochrome c oxidase, subunit IVa, cytochrome c oxidase, subunit IVb, expressed sequence AL024441 |
| 1679 | 14694 | NM_017202 | s, z | | EST, Weakly similar to COX4_HUMAN CYTOCHROME C OXIDASE POLYPEPTIDE IV PRECURSO [*H. sapiens*], cytochrome c oxidase subunit IV, cytochrome c oxidase subunit IV isoform 2, cytochrome c oxidase subunit IV isoform 2 precursor, cytochrome c oxidase, subunit IVa, cytochrome c oxidase, subunit IVb, expressed sequence AL024441 |
| 1680 | 1428 | NM_017213 | m | outer dense fiber of sperm tails 2, outer dense fibre of sperm tails 2 | ESTs, Highly similar to T09400 outer dense fiber protein 2 - mouse [*M. musculus*], KIAA1229 protein, Myosin heavy chain 11, Myosin, heavy polypeptide 9, non-muscle, expressed sequence C80049, myosin, heavy polypeptide 9, non-muscle, outer dense fiber of sperm tails 2, outer dense fibre of sperm tails 2 |
| 1681 | 1622 | NM_017216 | g, j, s, z | solute carrier family 3 (cystine, dibasic and neutral amino acid transporters, activator of cystine dibasic and neutral amino acid transport), member 1, solute carrier family 3, member 1 | ESTs, Moderately similar to 1914205A AA transporter [*H. sapiens*], putative L-type neutral amino acid transporter, solute carrier family 3 (activators of dibasic and neutral amino acid transport), member 2, solute carrier family 3 (cystine, dibasic and neutral amino acid transporters, activator of cystine, dibasic and neutral amino acid transport), member 1, solute carrier family 3, member 1 |
| 1682 | 13642 | NM_017220 | v | | |
| 1682 | 19976 | NM_017220 | w | | |
| 1683 | 1510 | NM_017224 | General | | EST, Moderately similar to JC4884 organic cation transporter protein 2-rat [*R. norvegicus*], EST, Weakly similar to OCN2 MOUSE ORGANIC |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| | | | | | CATION/CARNITINE TRANSPORTER 2 [*M. musculus*], ESTs, Highly similar to OCN2_HUMAN ORGANIC CATION/CARNITINE TRANSPORTER 2 [*H. sapiens*], ESTs, Highly similar to organic cation transporter [*H. sapiens*], solute carrier family 22 (organic cation transporter), member 1, solute carrier family 22 (organic cation transporter), member 4, solute carrier family 22 (organic cation transporter), member 5, solute carrier family 22 (organic cation transporter), member 9, solute carrier family 22, member 2, solute carrier family 22, member 3 |
| 1684 | 1811 | NM_017228 | j, l, m, z | dentatorubral pallidoluysian atrophy, dentatorubral-pallidoluysian atrophy (atrophin-1) | ESTs, Moderately similar to DRPL RAT ATROPHIN-1 [*R. norvegicus*], ESTs, Weakly similar to G01763 atrophin-1 [*H. sapiens*], *Homo sapiens*, clone IMAGE: 4153246, mRNA, partial cds, RIKEN cDNA 2310009E07 gene, RIKEN cDNA 2810012K09 gene, arginine-glutamic acid dipeptide (RE) repeats, dentatorubral pallidoluysian atrophy, dentatorubral-pallidoluysian atrophy (atrophin-1), expressed sequence C78339, formin |
| 1686 | 17563 | NM_017245 | a, c, e, q | eukaryotic translation elongation factor 2 | EST, Weakly similar to EFHU2 translation elongation factor eEF-2 [*H. sapiens*], ESTs, Highly similar to ELONGATION FACTOR 2 [*R. norvegicus*], ESTs, Weakly similar to ELONGATION FACTOR 2 [*R. norvegicus*], G1 to phase transition 1, G1 to phase transition 2, RIKEN cDNA 4930594C11 gene, U5 snRNP-specific protein, 116 kD, eukaryotic translation elongation factor 1 alpha 1, eukaryotic translation elongation factor 2, expressed sequence AI451340, hypothetical protein FLJ21661 |
| 1687 | 17502 | NM_017248 | r | heterogeneous nuclear ribonucleoprotein A1 | ESTs, Highly similar to ROA1 RAT HETEROGENEOUS NUCLEAR RIBONUCLEOPROTEIN A1 [*R. norvegicus*], ESTs, Moderately similar to Up1, The Two Rna-Recognition Motif Domain Of Hnrnp A1 {SUB 3-184 [*H. sapiens*], ESTs, Weakly similar to ROA1 RAT HETEROGENEOUS NUCLEAR RIBONUCLEOPROTEIN A1 [*R. norvegicus*], ESTs, Weakly similar to heterogeneous ribonuclear particle protein A1 [*H. sapiens*], Human DNA sequence from clone RP11-51N22 on chromosome 13 Contains ESTs, STSs and GSSs. Contains an HNRPA1 (heterogeneous nuclear ribonucleoprotein A1) pseudogene, RIKEN cDNA 4930547K05 gene, heterogeneous nuclear ribonucleoprotein A1 |
| 1687 | 17501 | NM_017248 | x | heterogeneous nuclear ribonucleoprotein A1 | ESTs, Highly similar to ROA1 RAT HETEROGENEOUS NUCLEAR RIBONUCLEOPROTEIN A1 [*R. norvegicus*], ESTs, Moderately similar to Up1, The Two Rna-Recognition Motif Domain Of Hnrnp A1 {SUB 3-184 [*H. sapiens*], ESTs, Weakly similar to ROA1 RAT HETEROGENEOUS NUCLEAR RIBONUCLEOPROTEIN A1 [*R. norvegicus*], ESTs, Weakly similar |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| | | | | | to heterogeneous ribonuclear particle protein A1 [*H. sapiens*], Human DNA sequence from clone RP11-51N22 on chromosome 13 Contains ESTs, STSs and GSSs. Contains an HNRPA1 (heterogeneous nuclear ribonucleoprotein A1) pseudogene, RIKEN cDNA 4930547K05 gene, heterogeneous nuclear ribonucleoprotein A1 |
| 1688 | 19 | NM_017258 | v, General | B-cell translocation gene 1, anti-proliferative | B-cell translocation gene 1, anti-proliferative, ESTs, Weakly similar to BTG1 RAT BTG1 PROTEIN [*R. norvegicus*], transducer of ERBB2, 1, transducer of ERBB2, 2, transducer of ErbB-2.1 |
| 1689 | 15300 | NM_017259 | i, v, cc, General | B-cell translocation gene 2, anti-proliferative, BTG family, member 2 | B-cell translocation gene 2, anti-proliferative, B-cell translocation gene 3, B-cell translocation gene 4, BTG family, member 2, BTG family, member 3, BTG family, member 4, ESTs, Highly similar to BTG2_HUMAN BTG2 PROTEIN PRECURSOR [*H. sapiens*] |
| 1689 | 15301 | NM_017259 | l, m, v, aa, cc, General | B-cell translocation gene 2, anti-proliferative, BTG family, member 2 | B-cell translocation gene 2, anti-proliferative, B-cell translocation gene 3, B-cell translocation gene 4, BTG family, member 2, BTG family, member 3, BTG family, member 4, ESTs, Highly similar to BTG2_HUMAN BTG2 PROTEIN PRECURSOR [*H. sapiens*] |
| 1689 | 15299 | NM_017259 | l, y, cc, General | B-cell translocation gene 2, anti-proliferative, BTG family, member 2 | B-cell translocation gene 2, anti-proliferative, B-cell translocation gene 3, B-cell translocation gene 4, BTG family, member 2, BTG family, member 3, BTG family, member 4, ESTs, Highly similar to BTG2_HUMAN BTG2 PROTEIN PRECURSOR [*H. sapiens*] |
| 1690 | 15224 | NM_017264 | d | protease (prosome, macropain) 28 subunit, alpha, proteasome (prosome, macropain) activator subunit 1 (PA28 alpha) | EST, Moderately similar to A Chain A, Proteasome Activator Reg(Alpha) {SUB 4-63 [*H. sapiens*], proteasome (prosome, macropain) activator subunit 1 (PA28 alpha) |
| 1691 | 3987 | NM_017280 | bb | proteasome (prosome, macropain) subunit, alpha type 3, proteasome (prosome, macropain) subunit, alpha type, 3 | multicatalytic endopeptidase complex [*H. sapiens*], ESTs, Highly similar to PRC8 MOUSE PROTEASOME COMPONENT C8 [*M. musculus*], ESTs, Highly similar to PROTEASOME COMPONENT C8 [*R. norvegicus*], ESTs, Weakly similar to SNHUC8 multicatalytic endopeptidase complex [*H. sapiens*], proteasome (prosome, macropain) subunit, alpha type 3, proteasome (prosome, macropain) subunit, alpha type, 3 |
| 1692 | 1447 | NM_017281 | l | proteasome (prosome, macropain) subunit, alpha type 4, proteasome (prosome, macropain) subunit, alpha type, 4 | EST, Weakly similar to SNHUC9 multicatalytic endopeptidase complex [*H. sapiens*], proteasome (prosome, macropain) subunit, alpha type 4, proteasome (prosome, macropain) subunit, alpha type, 4 |
| 1693 | 15535 | NM_017283 | s, bb | proteasome (prosome, macropain) subunit, alpha type 6, proteasome (prosome, macropain) subunit, alpha type, 6 | ESTs, Weakly similar to PRCI_HUMAN PROTEASOME IOTA CHAIN [*R. norvegicus*], proteasome (prosome, macropain) subunit, alpha type 6, proteasome (prosome, macropain) subunit, alpha type, 6 |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 1694 | 12349 | NM_017290 | General | ATPase, Ca++ transporting, cardiac muscle, slow twitch 2 | |
| 1695 | 15819 | NM_017298 | p | calcium channel, voltage-dependent, L type, alpha 1D subunit | EST, Highly similar to CCAD MOUSE VOLTAGE-DEPENDENT L-TYPE CALCIUM CHANNEL ALPHA-1D SUBUNIT [*M. musculus*], EST, Moderately similar to CCAD MOUSE VOLTAGE-DEPENDENT L-TYPE CALCIUM CHANNEL ALPHA-1D SUBUNIT [*M. musculus*], EST, Moderately similar to CCAD RAT VOLTAGE-DEPENDENT L-TYPE CALCIUM CHANNEL ALPHA-1D SUBUNIT [*R. norvegicus*], RIKEN cDNA 8430418G19 gene, calcium channe, voltage-dependent, alpha 1F subunit, calcium channel, voltage-dependent, L type, alpha 1D subunit, calcium channel, voltage-dependent, alpha 1F subunit, polycystic kidney disease 2-like 2 |
| 1696 | 23825 | NM_017299 | v | solute carrier family 19 (folate transporter), member 1, solute carrier family 19 (sodium/hydrogen exchanger), member 1 | expressed sequence AW322295, solute carrier family 19 (folate transporter), member 1, solute carrier family 19 (sodium/hydrogen exchanger), member 1, solute carrier family 19 (sodium/hydrogen exchanger), member 3, solute carrier family 19 (thiamine transporter), member 2, solute carrier family 19, member 3 |
| 1696 | 23826 | NM_017299 | v | solute carrier family 19 (folate transporter), member 1, solute carrier family 19 (sodium/hydrogen exchanger), member 1 | expressed sequence AW322295, solute carrier family 19 (folate transporter), member 1, solute carrier family 19 (sodium/hydrogen exchanger), member 1, solute carrier family 19 (sodium/hydrogen exchanger), member 3, solute carrier family 19 (thiamine transporter), member 2, solute carrier family 19, member 3 |
| 1697 | 14003 | NM_017305 | j, l, m, y, z | glutamate-cysteine ligase, modifier subunit, glutamate-cysteine ligase, modifier subunit | ESTs, Highly similar to GSH0_HUMAN GLUTAMATE - CYSTEINE LIGASE REGULATORY SUBUNIT [*H. sapiens*], glutamate-cysteine ligase, modifier subunit, glutamate-cysteine ligase, modifier subunit |
| 1698 | 26109 | NM_017306 | q, s | | |
| 1698 | 18687 | NM_017306 | q, t | dodecenoyl-Coenzyme A delta isomerase (3,2 trans-enoyl-Coenyme A isomerase), dodecenoyl-Coenzyme A delta isomerase (3,2 trans-enoyl-Coenzyme A isomerase) | ESTs, Highly similar to D3D2 RAT 3,2-TRANS-ENOYL-COA ISOMERASE, MITOCHONDRIAL PRECURSOR [*R. norvegicus*], *Homo sapiens*, Similar to dodecenoyl-Coenzyme A delta isomerase (3,2 trans-enoyl-Coenzyme A isomerase), clone MGC: 3903 IMAGE: 3630566, mRNA, complete cds, dodecenoyl-Coenzyme A delta isomerase (3,2 trans-enoyl-Coenyme A isomerase), dodecenoyl-Coenzyme A delta isomerase (3,2 trans-enoyl-Coenzyme A isomerase) |
| 1699 | 18142 | NM_017314 | g, s, aa | | EST, Moderately similar to S12583 polyubiquitin 4 - mouse [*M. musculus*], EST, Weakly similar to JE0190 polyubiquitin unit [*H. sapiens*], *Homo sapiens* UBBP2 pseudogene for ubiquitin UBB, RIKEN cDNA 2700054O04 gene, expressed sequence AI194771, expressed sequence AL033289, ubiquitin B, ubiquitin C |
| 1700 | 1894 | NM_017320 | t | | cathepsin S |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 1701 | 20809 | NM_017326 | u | calmodulin 2, calmodulin 2 (phosphorylase kinase, delta) | Calmodulin 1 (phosphorylase kinase, delta), Calmodulin III, ESTs, Highly similar to A Chain A, Calmodulin Complexed With Calmodulin-Binding Peptide From Smooth Muscle Myosin Light Chain Kinase {SUB 2-148 [*H. sapiens*], *R. norvegicus* CaMII retropseudogene (clone lambda SC27), RIKEN cDNA 2310068O22 gene, calmodulin 1, calmodulin 1 (phosphorylase kinase, delta), calmodulin 2, calmodulin 2 (phosphorylase kinase, delta), calmodulin 3, calmodulin-like 3 |
| 1702 | 355 | NM_017334 | cc | | |
| 1703 | 16148 | NM_017340 | q, s | | ESTs, Highly similar to ACYL-COENZYME A OXIDASE, PEROXISOMAL [*R. norvegicus*], ESTs, Highly similar to CAOP_HUMAN ACYL-COENZYME A OXIDASE, PEROXISOMAL [*H. sapiens*], RIKEN cDNA 1300003O09 gene, RIKEN cDNA 2310016C19 gene, acetyl-Coenzyme A dehydrogenase, short chain, acyl-Coenzyme A oxidase 2, branched chain, isovaleryl coenzyme A dehydrogenase |
| 1703 | 16150 | NM_017340 | a | | ESTs, Highly similar to ACYL-COENZYME A OXIDASE, PEROXISOMAL [*R. norvegicus*], ESTs, Highly similar to CAOP_HUMAN ACYL-COENZYME A OXIDASE, PEROXISOMAL [*H. sapiens*], RIKEN cDNA 1300003O09 gene, RIKEN cDNA 2310016C19 gene, acetyl-Coenzyme A dehydrogenase, short chain, acyl-Coenzyme A oxidase 2, branched chain, isovaleryl coenzyme A dehydrogenase |
| 1704 | 20849 | NM_017343 | r, u, General | | ESTs, Weakly similar to MOHULP myosin regulatory light chain, placental [*H. sapiens*], RIKEN cDNA 2900073G15 gene, expressed sequence C77744, myosin, light polypeptide, regulatory, non-sarcomeric (20 kD) |
| 1704 | 20848 | NM_017343 | b, General | | ESTs, Weakly similar to MOHULP myosin regulatory light chain, placental [*H. sapiens*], RIKEN cDNA 2900073G15 gene, expressed sequence C77744, myosin, light polypeptide, regulatory, non-sarcomeric (20 kD) |
| 1705 | 606 | NM_017350 | b | | GPI-anchored metastasis-associated protein homolog, metastasis-associated GPI-anchored protein, plasminogen activator, urokinase receptor, urokinase plasminogen activator receptor |
| 1706 | 1581 | NM_017365 | General | PDZ and LIM domain 1 (elfin) | ESTs, Weakly similar to LIM PROTEIN CLP36 [*R. norvegicus*], PDZ and LIM domain 1 (elfin), PDZ and LIM domain 3, PDZ-LIM protein mystique, RIKEN cDNA 1110003B01 gene, *Rattus norvegicus* LIM-domain protein LMP-1 mRNA, complete cds, Z-band alternatively spliced PDZ-motif, actinin alpha 2 associated LIM protein, alpha-actinin-2-associated LIM protein, reversion induced LIM gene |
| 1707 | 455 | NM_019131 | x | tropomyosin 1 (alpha), tropomyosin 1, alpha | ESTs, Moderately similar to alpha-tropomyosin slow [*M. musculus*], tropomyosin 4 |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 1707 | 456 | NM_019131 | y, z | tropomyosin 1 (alpha), tropomyosin 1, alpha | ESTs, Moderately similar to alpha-tropomyosin slow [*M. musculus*], tropomyosin 4 |
| 1708 | 4532 | NM_019134 | b | solute carrier family 12 (sodium/potassium/chloride transporters), member 1, solute carrier family 12, member 1 | EST, Weakly similar to NKC2_HUMAN BUMETANIDE-SENSITIVE SODIUM-(POTASSIUM)-CHLORIDE COTRANSPORTER 2 (KIDNEY-SPECIFIC NA-K-CL SYMPORTER) [*H. sapiens*], expressed sequence AI788571, hypothetical protein FLJ23188, solute carrier family 12 (sodium/potassium/chloride transporters), member 1, solute carrier family 12, member 1, solute carrier family 12, member 2 |
| 1709 | 1608 | NM_019166 | j, y, z | synaptogyrin 1 | ESTs, Moderately similar to SNG1 RAT SYNAPTOGYRIN 1 [*R. norvegicus*], synaptogyrin 1, synaptogyrin 3, synaptogyrin 4 |
| 1710 | 7489 | NM_019169 | c, General | synuclein, alpha, synuclein, alpha (non A4 component of amyloid precursor) | synuclein, alpha, synuclein, alpha (non A4 component of amyloid precursor), synuclein, beta, synuclein, gamma |
| 1711 | 17066 | NM_019170 | p | | ESTs, Weakly similar to JC5284 carbonyl reductase (NADPH) (EC 1 1 1.184), inducible - rat [*R. norvegicus*], *Homo sapiens*, clone MGC: 23280 IMAGE: 4637504, mRNA, complete cds, RIKEN cDNA 1110001J05 gene, RIKEN cDNA 9430059D04 gene, carbonyl reductase 1, carbonyl reductase 3, expressed sequence C81353 |
| 1712 | 23924 | NM_019174 | bb | carbonic anhydrase 4, carbonic anhydrase IV | ESTs, Weakly similar to CARBONIC ANHYDRASE IV PRECURSOR [*R. norvegicus*], carbonic anhydrase 15, carbonic anhydrase 4, carbonic anhydrase IV, carbonic anhydrase XIV, expressed sequence AW456718 |
| 1713 | 24019 | NM_019186 | t | ADP-ribosylation factor-like 4, ADP-ribosylation-like 4 | ADP-ribosylation factor-like 4, ADP-ribosylation factor-like 7, ADP-ribosylation-like 4, ESTs, Weakly similar to ARL4 MOUSE ADP-RIBOSYLATION FACTOR-LIKE PROTEIN 4 [*M. musculus*], *Mus musculus*, Similar to ADP-ribosylation-like 4, clone MGC: 5774 IMAGE: 3599701, mRNA, complete cds |
| 1714 | 22063 | NM_019195 | d | CD47 antigen (Rh-related antigen, integrin-associated signal transducer), integrin-associated protein | |
| 1715 | 2079 | NM_019220 | j, k, z | | ESTs, Weakly similar to GRG MOUSE GRG PROTEIN [*R. norvegicus*], amino-terminal enhancer of split |
| 1716 | 16284 | NM_019229 | l, m | solute carrier family 12 (potassium/chloride transporters), member 4, solute carrier family 12, member 4 | EST, Moderately similar to T31429 K-Cl cotransport protein KCC1, furosemide-sensitive - rat [*R. norvegicus*], EST, Weakly similar to T31429 K-Cl cotransport protein KCC1, furosemide-sensitive - rat [*R. norvegicus*], ESTs, Highly similar to T17275 hypothetical protein DKFZp434D2135 1 [*H. sapiens*], *Mus musculus* strain ILS K-Cl cotransporter (Slc12a5) mRNA, complete cds, *Rattus norvegicus* ccc6 mRNA for cation-chloride cotransporter 6, complete cds, expressed sequence AW546649, solute carrier family 12 (potassium/chloride transporters), member 4, solute carrier family 12 |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| | | | | | (potassium/chloride transporters), member 6, solute carrier family 12 (potassium/chloride transporters), member 7, solute carrier family 12, member 2, solute carrier family 12, member 4, solute carrier family 12, member 7 |
| 1717 | 985 | NM_019233 | b, cc | small inducible cytokine subfamily A (Cys-Cys), member 20, small inducible cytokine subfamily A20 | small inducible cytokine subfamily A (Cys-Cys), member 20, small inducible cytokine subfamily A20 |
| 1718 | 15503 | NM_019237 | k, x | procollagen C-endopeptidase enhancer, procollagen C-proteinase enhancer protein | EST, Weakly similar to PCO1_HUMAN PROCOLLAGEN C-PROTEINASE ENHANCER PROTEIN PRECURSOR [*H. sapiens*], *Homo sapiens* cDNA FLJ12558 fis, clone NT2RM4000787, *Mus musculus* CSMD1 (Csmd1) mRNA, complete cds, RIKEN cDNA 2400001O18 gene, expressed sequence AI043106, membrane-type frizzled-related protein, procollagen C-endopeptidase enhancer, procollagen C-endopeptidase enhancer 2, procollagen C-proteinase enhancer protein |
| 1718 | 15504 | NM_019237 | k, x | procollagen C-endopeptidase enhancer, procollagen C-proteinase enhancer protein | EST, Weakly similar to PCO1_HUMAN PROCOLLAGEN C-PROTEINASE ENHANCER PROTEIN PRECURSOR [*H. sapiens*], *Homo sapiens* cDNA FLJ12558 fis, clone NT2RM4000787, *Mus musculus* CSMD1 (Csmd1) mRNA, complete cds, RIKEN cDNA 2400001O18 gene, expressed sequence AI043106, membrane-type frizzled-related protein, procollagen C-endopeptidase enhancer, procollagen C-endopeptidase enhancer 2, procollagen C-proteinase enhancer protein |
| 1719 | 17908 | NM_019242 | l, v, cc, General | interferon-related developmental regulator 1 | ESTs, Weakly similar to INTERFERON RELATED PROTEIN PC4 [*R. norvegicus*], interferon-related developmental regulator 1, interferon-related developmental regulator 2 |
| 1720 | 11218 | NM_019247 | c | paired-like homeodomain transcription factor 3 | paired-like homeodomain transcription factor 1, paired-like homeodomain transcription factor 2, paired-like homeodomain transcription factor 3 |
| 1721 | 15259 | NM_019259 | d, f | complement component 1, q subcomponent binding protein | DNA segment, Chr 11, Wayne State University 182, expressed, complement component 1, q subcomponent binding protein, expressed sequence AA986492 |
| 1722 | 21443 | NM_019262 | aa, General | complement component 1, q subcomponent, beta polypeptide | C1q-related factor, *Homo sapiens*, Similar to complement component 1, q subcomponent, c polypeptide, clone MGC: 17279 IMAGE: 4212772, mRNA, complete cds, complement component 1, q subcomponent, beta polypeptide, complement component 1, q subcomponent, c polypeptide, expressed sequence AI385742 |
| 1722 | 21444 | NM_019262 | t, General | complement component 1, q subcomponent, beta polypeptide | C1q-related factor, *Homo sapiens*, Similar to complement component 1, q subcomponent, c polypeptide, clone MGC: 17279 IMAGE: 4212772, mRNA, complete cds, complement component 1, q subcomponent, beta polypeptide, complement component 1, q subcomponent, c polypeptide, expressed sequence AI385742 |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 1723 | 117 | NM_019266 | o, bb | sodium channel, voltage gated, type VIII, alpha polypeptide, sodium channel, voltage-gated, type VIII, alpha polypeptide | ESTs, Highly similar to voltage gated Na channel Scn8a [*M. musculus*], *Mus musculus* adult male hypothalamus cDNA, RIKEN full-length enriched library, clone: A230108N10, full insert sequence, hypothetical protein MGC: 15619, sodium channel, voltage gated, type VIII, alpha polypeptide, sodium channel, voltage-gated, type II, alpha 2 polypeptide, sodium channel, voltage-gated, type III, alpha polypeptide, sodium channel, voltage-gated, type VIII, alpha polypeptide |
| 1724 | 1145 | NM_019280 | w | gap junction membrane channel protein alpha 5, gap junction protein, alpha 5, 40 kD (connexin 40) | |
| 1725 | 22220 | NM_019286 | c | alcohol dehydrogenase 1, complex, alcohol dehydrogenase 1A (class I), alpha polypeptide | ESTs, Weakly similar to ADHA MOUSE ALCOHOL DEHYDROGENASE A CHAIN [*M. musculus*], alcohol dehydrogenase 1A (class I), alpha polypeptide, alcohol dehydrogenase 1B (class I), beta polypeptide, expressed sequence AI194826, nuclear receptor binding factor 1 |
| 1726 | 10015 | NM_019289 | l, m, t, x, General | | EST, Highly similar to AR41_HUMAN ARP2/3 COMPLEX 41 KDA SUBUNIT [*H. sapiens*], ESTs, Moderately similar to AR41_HUMAN ARP2/3 COMPLEX 41 KDA SUBUNIT [*H. sapiens*], actin related protein 2/3 complex, subunit 1A (41 kD), actin related protein 2/3 complex, subunit 1A (41 kDa), actin related protein 2/3 complex, subunit 1B (41 kDa), expressed sequence AA408064, suppressor of profilin/p41 of actin-related complex 2/3 |
| 1726 | 10016 | NM_019289 | bb, General | | EST, Highly similar to AR41_HUMAN ARP2/3 COMPLEX 41 KDA SUBUNIT [*H. sapiens*], ESTs, Moderately similar to AR41_HUMAN ARP2/3 COMPLEX 41 KDA SUBUNIT [*H. sapiens*], actin related protein 2/3 complex, subunit 1A (41 KD), actin related protein 2/3 complex, subunit 1A (41 kDa), actin related protein 2/3 complex, subunit 1B (41 kDa), expressed sequence AA408064, suppressor of profilin/p41 of actin-related complex 2/3 |
| 1727 | 21651 | NM_019296 | c, f, x | | RIKEN cDNA 2310015O17 gene, RIKEN cDNA 4933411O17 gene, cell division cycle 2 homolog A (*S. pombe*), cell division cycle 2, G1 to S and G2 to M, cyclin-dependent kinase-like 1 (CDC2-related kinase), cyclin-dependent kinase-like 2 (CDC2-related kinase), cyclin-dependent kinase-like 3, expressed sequence AI852479, serine/threonine kinase NKIATRE beta |
| 1728 | 20751 | NM_019301 | s | | CUB and Sushi multiple domains 1, ESTs, Highly similar to I73012 complement C3b/C4b receptor, membrane-bound form precursor [*H. sapiens*], ESTs, Weakly similar to JC2054 complement regulatory protein, 512 antigen precursor - rat [*R. norvegicus*], *Mus musculus* 8 days embryo cDNA, RIKEN full-length enriched library, clone: 5730478H20, full insert sequence, complement component (3b/4b) receptor 1, including Knops blood group system, |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| | | | | | complement receptor related protein, decay accelerating factor 1, decay accelerating factor 2, membrane cofactor protein |
| 1729 | 645 | NM_019345 | bb | solute carrier family 12 (sodium/chloride transporters), member 3, solute carrier family 12, member 3 | ESTs, Moderately similar to PC4180 thiazide-sensitive sodium-chloride cotransporter [*H. sapiens*], ESTs, Moderately similar to thiazide-sensitive Na-Cl cotransporter [*M. musculus*], ESTs, Weakly similar to BUMETANIDE-SENSITIVE SODIUM-(POTASSIUM)-CHLORIDE COTRANSPORTER 2 [*M. musculus*], expressed sequence AI788571, solute carrier family 12 (sodium/chloride transporters), member 3, solute carrier family 12, member 1, solute carrier family 12, member 3 |
| 1730 | 1301 | NM_019349 | c | | |
| 1731 | 3776 | NM_019354 | a, u | | ESTs, Moderately similar to BMCP_HUMAN BRAIN MITOCHONDRIAL CARRIER PROTEIN-1 [*H. sapiens*], RIKEN cDNA 3632410G24 gene, RIKEN cDNA 4933433D23 gene, expressed sequence AW108044, solute carrier family 25 (mitochondrial carrier, brain), member 14, solute carrier family 25 (mitochondrial carrier; adenine nucleotide translocator), member 10, solute carrier family 25 (mitochondrial carrier, ornithine transporter), member 15, uncoupling protein 2 (mitochondrial, proton carrier), uncoupling protein 2, mitochondrial |
| 1732 | 4592 | NM_019356 | General | | RIKEN cDNA 0910001O23 gene, eukaryotic translation initiation factor 2, subunit 1 (alpha, 35 kD), eukaryotic translation initiation factor 2A |
| 1733 | 1324 | NM_019371 | w | | EGL nine (*C. elegans*) homolog 1, EGL nine (*C. elegans*) homolog 2, EGL nine (*C. elegans*) homolog 3, EGL nine homolog 3 (*C. elegans*), ESTs, Moderately similar to A53770 growth factor-responsive protein, vascular smooth muscle - rat [*R. norvegicus*], ESTs, Weakly similar to A53770 growth factor-responsive protein, vascular smooth muscle - rat [*R. norvegicus*], SCAN domain-containing 2 |
| 1734 | 19577 | NM_019377 | e | tyrosine 3-monooxgenase/tryptophan 5-monooxgenase activation protein, beta polypeptide, tyrosine 3-monooxygenase/tryptophan 5-monooxygenase activation protein, beta polypeptide | |
| 1735 | 24626 | NM_019381 | s | testis enhanced gene transcript, testis enhanced gene transcript (BAX inhibitor 1) | CGI-119 protein, RIKEN cDNA 5031406P05 gene, testis enhanced gene transcript (BAX inhibitor 1) |
| 1736 | 744 | NM_019622 | p | | ESTs, Highly similar to T42716 ankyrin 3, splice form 4 - mouse [*M. musculus*], ESTs, Moderately similar to A55575 ankyrin 3, long splice form [*H. sapiens*], ESTs, Weakly similar to T42716 ankyrin 3, splice form 4 - mouse [*M. musculus*], RIKEN cDNA 2310026G15 gene, RIKEN cDNA 4833425P12 gene, RIKEN cDNA |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 1737 | 20716 | NM_019623 | c | | 4930400E23 gene, RIKEN cDNA C430011H06 gene, ankyrin 3, node of Ranvier (ankyrin G), hypothetical protein FLJ20189, phospholipase A2, group VI, phospholipase A2, group VI (cytosolic, calcium-independent), proteasome (prosome, macropain) 26S subunit, non-ATPase, 10 EST, Weakly similar to CPF1 RAT CYTOCHROME P450 4F1 [*R. norvegicus*], ESTs, Weakly similar to S45702 leukotriene-B4 20-monooxygenase [*H. sapiens*], *Mus musculus*, Similar to RIKEN cDNA 1810054N16 gene, clone MGC: 7384 IMAGE: 3487830, mRNA, complete cds, RIKEN cDNA 2310021J05 gene, cytochrome P450 isoform 4F12, cytochrome P450, subfamily IV B, polypeptide 1, cytochrome P450, subfamily IVF, polypeptide 11, cytochrome P450, subfamily IVF, polypeptide 2, cytochrome P450, subfamily IVF, polypeptide 8, expressed sequence AI787289 |
| 1738 | 20709 | NM_019904 | x | lectin, galactose binding, soluble 1, lectin, galactoside-binding, soluble, 1 (galectin 1) | EST, Moderately similar to 1713410A beta galactoside soluble lectin [*H. sapiens*], EST, Moderately similar to GALECTIN-1 [*R. norvegicus*], Human HL14 gene encoding beta-galactoside-binding lectin, 3' end, clone 2, RIKEN cDNA 2200008F12 gene, *Rattus norvegicus* mRNA for galectin-2 related protein, complete cds, lectin, galactose binding, soluble 1, lectin, galactoside-binding, soluble, 1 (galectin 1), lectin, galactoside-binding, soluble, 2 (galectin 2) |
| 1739 | 574 | NM_019905 | u, General | hydroxyacid oxidase (glycolate oxidase) 3, hydroxyacid oxidase 3 (medium-chain) | ESTs, Highly similar to (S)-2-HYDROXY-ACID OXIDASE, PEROXISOMAL [*R. norvegicus*], ESTs, Highly similar to LUHU36 annexin II [*H. sapiens*], RIKEN cDNA 1110003P15 gene, RIKEN cDNA B430311C09 gene, annexin A2, annexin A2 pseudogene 2, caspase recruitment domain family, member 6, expressed sequence AW215814, hydroxyacid oxidase (glycolate oxidase) 3, hydroxyacid oxidase 1, liver, hydroxyacid oxidase 2 (long chain), nucleolar protein 3 (apoptosis repressor with CARD domain) |
| 1740 | 9096 | NM_019908 | j | hypothetical protein similar to mouse aldehyde reductase 6 (renal), renal-specific oxido-reducatse | |
| 1741 | 20457 | NM_020073 | i, General | | parathyroid hormone receptor, parathyroid hormone receptor 1 |
| 1741 | 20458 | NM_020073 | General | | parathyroid hormone receptor, parathyroid hormone receptor 1 |
| 1741 | 20460 | NM_020073 | General | | parathyroid hormone receptor, parathyroid hormone receptor 1 |
| 1742 | 18713 | NM_020075 | r | eukaryotic translation initiation factor 5 | DNA segment, Chr 12, ERATO Doi 549, expressed, KIAA1856 protein, eukaryotic translation initiation factor 5 |
| 1742 | 18715 | NM_020075 | r | eukaryotic translation initiation factor 5 | DNA segment, Chr 12, ERATO Doi 549, expressed, KIAA1856 protein, eukaryotic translation initiation factor 5 |
| 1743 | 20493 | NM_020076 | p | | 3-hydroxyanthranilate 3,4-dioxygenase, RIKEN cDNA 0610007K21 gene, RIKEN cDNA 0610012J07 gene |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 1744 | 16375 | NM_020976 | g | | angiotensin I converting enzyme (peptidyl-dipeptidase A) 2, kidney-specific membrane protein |
| 1745 | 20816 | NM_021261 | k, General | | EST, Highly similar to THYMOSIN BETA-10 [R. norvegicus], ESTs, Highly similar to TYB4 MOUSE THYMOSIN BETA-4 [M. musculus], expressed sequence AW544206, thymosin, beta 10, thymosin, beta 4, X chromosome |
| 1746 | 15335 | NM_021264 | a | ribosomal protein L35a | EST, Weakly similar to 60S RIBOSOMAL PROTEIN L35A [R. norvegicus], EST, Weakly similar to R35A MOUSE 60S RIBOSOMAL PROTEIN L35A [M. musculus], EST, Weakly similar to R5HU35 ribosomal protein L35a [H. sapiens], Homo sapiens cDNA FLJ11509 fis, clone HEMBA1002166, RIKEN cDNA 2810431L15 gene, ribosomal protein L35a, uncharacterized hypothalamus protein HSMNP1 |
| 1747 | 18729 | NM_021578 | k, z | transforming growth factor, beta 1 | transforming growth factor, beta 1 |
| 1748 | 19060 | NM_021587 | cc | latent transforming growth factor beta binding protein 1 | EST, Weakly similar to TGFB_HUMAN LATENT TRANSFORMING GROWTH FACTOR BETA BINDING PROTEIN 1 PRECURSOR [H. sapiens], ESTs, Weakly similar to TGFB RAT LATENT TRANSFORMING GROWTH FACTOR BETA BINDING PROTEIN 1 PRECURSOR [R. norvegicus], RIKEN cDNA 2310046A13 gene, hypothetical protein MGC13010, latent transforming growth factor beta binding protein 1, latent transforming growth factor beta binding protein 2, latent transforming growth factor beta binding protein 3 |
| 1749 | 17324 | NM_021593 | o, General | | |
| 1750 | 19679 | NM_021653 | General | deiodinase, iodothyronine, type I | ESTs, Moderately similar to TYPE I IODOTHYRONINE DEIODINASE [R. norvegicus], deiodinase, iodothyronine, type I |
| 1750 | 19678 | NM_021653 | a, v, General | deiodinase, iodothyronine, type I | ESTs, Moderately similar to TYPE I IODOTHYRONINE DEIODINASE [R. norvegicus], deiodinase, iodothyronine, type I |
| 1751 | 19665 | NM_021688 | u, General | | potassium channel, subfamily K, member 1 (TWIK-1), potassium channel, subfamily K, member 3 (TASK-1), potassium channel, subfamily K, member 6 (TWIK-2), potassium channel, subfamily K, member 7 |
| 1752 | 19667 | NM_021690 | m | | EST, Highly similar to GUANINE NUCLEOTIDE RELEASING PROTEIN [R. norvegicus], EST, Weakly similar to 2009427A guanine nucleotide-releasing protein [H. sapiens], ESTs, Highly similar to 2009427A guanine nucleotide-releasing protein [H. sapiens], ESTs, Weakly similar to S28407 guanine nucleotide-exchange activator CDC25 homolog - mouse [M. musculus], RAS protein-specific guanine nucleotide-releasing factor 1, RAS protein-specific guanine nucleotide-releasing factor 2, RIKEN cDNA 4921528G01 gene, Rap1 guanine-nucleotide-exchange factor directly activated by cAMP, Rattus norvegicus strain Wistar RAS guanine nucleotide-releasing factor 1 (Rasgrf1) mRNA, partial cds, guanine nucleotide- |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 1754 | 22916 | NM_021740 | a | prothymosin alpha, prothymosin, alpha (gene sequence 28) | releasing factor 2 (specific for crk proto oncogene) ESTs, Highly similar to THYA_HUMAN PROTHYMOSIN ALPHA [*H. sapiens*], RIKEN cDNA 2610009E16 gene, prothymosin a14, prothymosin alpha, prothymosin, alpha (gene sequence 28) |
| 1755 | 19710 | NM_021744 | t | | CD14 antigen, ESTs, Weakly similar to CD14 RAT MONOCYTE DIFFERENTIATION ANTIGEN CD14 PRECURSOR [*R. norvegicus*] |
| 1755 | 19711 | NM_021744 | t | | CD14 antigen, ESTs, Weakly similar to CD14 RAT MONOCYTE DIFFERENTIATION ANTIGEN CD14 PRECURSOR [*R. norvegicus*] |
| 1756 | 19712 | NM_021745 | r | | EST, Weakly similar to I38975 nuclear orphan receptor LXR-alpha [*H. sapiens*], ESTs, Moderately similar to JC4014 steroid hormone-nuclear receptor NER [*H. sapiens*], expressed sequence AI957360, nuclear receptor subfamily 1, group H, member 3, nuclear receptor subfamily 1, group H, member 4 |
| 1757 | 1962 | NM_021750 | j, k, y, z | | |
| 1757 | 19824 | NM_021750 | a, bb | | *Homo sapiens*, clone MGC: 18185 IMAGE: 4155381, mRNA, complete cds, KIAA0251 hypothetical protein, RIKEN cDNA 1110027M19 gene, cysteine sulfinic acid decarboxylase-related protein 2, glutamic acid decarboxylase 2 |
| 1758 | 25198 | NM_021754 | h | | |
| 1758 | 20035 | NM_021754 | b, n, s, v, General | | DKFZP566J153 protein, ESTs, Moderately similar to T17299 hypothetical protein DKFZp564H2171.1 [*H. sapiens*], nucleolar protein NOP5/NOP58 |
| 1759 | 20090 | NM_021757 | m | pleiotropic regulator 1 (PRL1, Arabidopsis homolog), pleiotropic regulator 1, PRL1 homolog (Arabidopsis) | EST, Weakly similar to LIS1 MOUSE PLATELET-ACTIVATING FACTOR ACETYLHYDROLASE IB ALPHA SUBUNIT [*R. norvegicus*], ESTs, Weakly similar to LIS1 MOUSE PLATELET-ACTIVATING FACTOR ACETYLHYDROLASE IB ALPHA SUBUNIT [*R. norvegicus*], *Homo sapiens* mRNA for FLJ00083 protein, partial cds, WD repeat domain 5, f-box and WD-40 domain protein 2, hypothetical protein, platelet-activating factor acetylhydrolase beta subunit (PAF-AH beta), platelet-activating factor acetylhydrolase, isoform 1b, beta1 subunit, platelet-activating factor acetylhydrolase, isoform lb, alpha subunit (45 kD), recombination protein REC14 |
| 1760 | 17885 | NM_021765 | aa | | ESTs, Weakly similar to COPP RAT COATOMER BETA' SUBUNIT [*R. norvegicus*], *Mus musculus*, Similar to RIKEN cDNA 1500041N16 gene, clone MGC: 12066 IMAGE: 3708188, mRNA, complete cds, RIKEN cDNA 2510040D07 gene, coatomer protein complex, subunit beta 2 (beta prime), expressed sequence AA408785, expressed sequence AI256832, expressed sequence C77982, glutamate rich WD repeat protein GRWD, platelet-activating factor acetylhydrolase, isoform 1b, beta1 subunit |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 1762 | 20161 | NM_021836 | cc, General | | Jun-B oncogene, jun B proto-oncogene |
| 1764 | 1203 | NM_021997 | k, z | cytoplasmic linker 2 | DKFZP586N1922 protein, ESTs, Moderately similar to S22695 restin [*H. sapiens*], ESTs, Weakly similar to T42734 cytoplasmic linker protein CLIP-115-rat [*R. norvegicus*], RIKEN cDNA 1500005P14 gene, RIKEN cDNA 4631429H07 gene, RIKEN cDNA 5830409B12 gene, cytoplasmic linker 2, hypothetical protein FLJ20364, restin (Reed-Steinberg cell-espressed intermediate filament-associated protein), restin (Reed-Steinberg cell-expressed intermediate filament-associated protein) |
| 1765 | 23151 | NM_022005 | b | FXYD domain-containing ion transport regulator 6 | EST, Moderately similar to PLM RAT PHOSPHOLEMMAN PRECURSOR [*R. norvegicus*], EST, Weakly similar to PLM_HUMAN PHOSPHOLEMMAN PRECURSOR [*H. sapiens*], FXYD domain-containing ion transport regulator 1, FXYD domain-containing ion transport regulator 1 (phospholemman), FXYD domain-containing ion transport regulator 3, FXYD domain-containing ion transport regulator 4, FXYD domain-containing ion transport regulator 6, FXYD domain-containing ion transport regulator 7, hypothetical protein MGC13186 |
| 1767 | 17101 | NM_022179 | bb | | EST, Moderately similar to HXK3_HUMAN HEXOKINASE TYPE III [*H. sapiens*], EST, Weakly similar to HXK2 MOUSE HEXOKINASE TYPE II [*M. musculus*], ESTs, Moderately similar to HXK2 MOUSE HEXOKINASE TYPE II [*M. musculus*], ESTs, Weakly similar to HXK2 MOUSE HEXOKINASE TYPE II [*M. musculus*], hexokinase 2, hexokinase 3 (white cell) |
| 1767 | 17100 | NM_022179 | bb | | EST, Moderately similar to HXK3_HUMAN HEXOKINASE TYPE III [*H. sapiens*], EST, Weakly similar to HXK2 MOUSE HEXOKINASE TYPE II [*M. musculus*], ESTs, Moderately similar to HXK2 MOUSE HEXOKINASE TYPE II [*M. musculus*], ESTs, Weakly similar to HXK2 MOUSE HEXOKINASE TYPE II [*M. musculus*], hexokinase 2, hexokinase 3 (white cell) |
| 1768 | 20257 | NM_022180 | w, General | | expressed sequence AA986699, hepatic nuclear factor 4, hepatocyte nuclear factor 4, alpha |
| 1768 | 25699 | NM_022180 | i | | expressed sequence AA986699, hepatic nuclear factor 4, hepatocyte nuclear factor 4, alpha |
| 1768 | 10860 | NM_022180 | p | | |
| 1769 | 23780 | NM_022183 | k, x | topoisomerase (DNA) II alpha, topoisomerase (DNA) II alpha (170 kD) | ESTs, Moderately similar to A40493 DNA topoisomerase [*H. sapiens*], ESTs, Moderately similar to TP2A MOUSE DNA TOPOISOMERASE II, ALPHA [*M. musculus*], topoisomerase (DNA) II alpha, topoisomerase (DNA) II beta, topoisomerase (DNA) II beta (180 kD) |
| 1770 | 20312 | NM_022224 | o | | expressed sequence AI790318, expressed sequence AI836570, phosphotriesterase related |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 1771 | 6585 | NM_022266 | d, p, cc | | WNT1 inducible signaling pathway protein 1, WNT1 inducible signaling pathway protein 2, WNT1 inducible signaling pathway protein 3, connective tissue growth factor |
| 1772 | 17161 | NM_022298 | i, v, cc, General | | ESTs, Highly similar to A23035 tubulin alpha chain [*H. sapiens*], tubulin alpha 1, tubulin alpha 2, tubulin alpha 3, tubulin alpha 6, tubulin, alpha 2, tubulin, alpha 3, tubulin, alpha, ubiquitous |
| 1772 | 17162 | NM_022298 | u | | ESTs, Highly similar to A23035 tubulin alpha chain [*H. sapiens*], tubulin alpha 1, tubulin alpha 2, tubulin alpha 3, tubulin alpha 6, tubulin, alpha 2, tubulin, alpha 3, tubulin, alpha, ubiquitous |
| 1772 | 17160 | NM_022298 | u | | ESTs, Highly similar to A23035 tubulin alpha chain [*H. sapiens*], tubulin alpha 1, tubulin alpha 2, tubulin alpha 3, tubulin alpha 6, tubulin, alpha 2, tubulin, alpha 3, tubulin, alpha, ubiquitous |
| 1772 | 17158 | NM_022298 | q | | ESTs, Highly similar to A23035 tubulin alpha chain [*H. sapiens*], tubulin alpha 1, tubulin alpha 2, tubulin alpha 3, tubulin alpha 6, tubulin, alpha 2, tubulin, alpha 3, tubulin, alpha, ubiquitous |
| 1773 | 11454 | NM_022381 | i, aa, General | | EST, Moderately similar to E Chain E, Human Pcn [*H. sapiens*], proliferating cell nuclear antigen |
| 1773 | 11455 | NM_022381 | I, General | | EST, Moderately similar to E Chain E, Human Pcn [*H. sapiens*], proliferating cell nuclear antigen |
| 1774 | 13480 | NM_022390 | s | | RIKEN cDNA 2610008L04 gene, quinoid dihydropteridine reductase |
| 1775 | 15184 | NM_022391 | z | pituitary tumor-transforming 1 | |
| 1776 | 22413 | NM_022392 | h | | EST, Highly similar to ISI1_HUMAN INSULIN-INDUCED PROTEIN 1 [*H. sapiens*], ESTs, Highly similar to INSULIN-INDUCED GROWTH RESPONSE PROTEIN CL-6 [*R. norvegicus*], *Mus musculus*, clone MGC: 18904 IMAGE: 4240711, mRNA, complete cds, insulin induced gene 1, insulin induced protein 2 |
| 1776 | 22414 | NM_022392 | n | | EST, Highly similar to ISI1_HUMAN INSULIN-INDUCED PROTEIN 1 [*H. sapiens*], ESTs, Highly similar to INSULIN-INDUCED GROWTH RESPONSE PROTEIN CL-6 [*R. norvegicus*], *Mus musculus*, clone MGC: 18904 IMAGE: 4240711, mRNA, complete cds, insulin induced gene 1, insulin induced protein 2 |
| 1777 | 22499 | NM_022393 | t | | C-type (calcium dependent, carbohydrate recognition domain) lectin, superfamily member 10, C-type (calcium dependent, carbohydrate recognition domain) lectin, superfamily member 6, C-type (calcium dependent, carbohydrate-recognition domain) lectin, superfamily member 6, CD72 antigen, *Mus musculus* Ly-49Q mRNA for NK receptor Ly-49Q, complete cds, *Mus musculus*, Similar to macrophage galactose N-acetyl-galactosamine specific lectin, clone MGC: 25983 IMAGE: 4456238, mRNA, complete cds, RIKEN cDNA 4930572L20 gene, asialoglycoprotein receptor 1, |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 1779 | 24537 | NM_022399 | e | | macrophage lectin 2 (calcium dependent) ESTs, Weakly similar to CALRETICULIN PRECURSOR [*R. norvegicus*], *Homo sapiens*, Similar to RIKEN cDNA 1700031L01 gene, clone MGC: 26577 IMAGE: 4822010, mRNA, complete cds, RIKEN cDNA 1700031L01 gene, RIKEN cDNA 6330586I20 gene, calreticulin |
| 1779 | 24539 | NM_022399 | y | | ESTs, Weakly similar to CALRETICULIN PRECURSOR [*R. norvegicus*], *Homo sapiens*, Similar to RIKEN cDNA 1700031L01 gene, clone MGC: 26577 IMAGE: 4822010, mRNA, complete cds, RIKEN cDNA 1700031L01 gene, RIKEN cDNA 6330586I20 gene, calreticulin |
| 1780 | 1141 | NM_022401 | o, General | | ESTs, Highly similar to I39161 dystonin isoform 2 [*H. sapiens*], ESTs, Weakly similar to T42725 actin binding protein ACF7, neural isoform 1 - mouse (fragment) [*M. musculus*], Leman coiled-coil protein, actin-crosslinking protein 7, expressed sequence AA591047, expressed sequence AW554249, plectin 1, intermediate filament binding protein, 500 kD, serologically defined colon cancer antigen 8 |
| 1781 | 1069 | NM_022402 | g | | EST, Highly similar to R5HUP0 acidic ribosomal protein P0, cytosolic [*H. sapiens*], EST, Moderately similar to RLA0 RAT 60S ACIDIC RIBOSOMAL PROTEIN P0 [*R. norvegicus*], ESTs, Highly similar to R5HUP0 acidic ribosomal protein P0, cytosolic [*H. sapiens*], ESTs, Highly similar to RLA0 MOUSE 60S ACIDIC RIBOSOMAL PROTEIN P0 [*M. musculus*], RIKEN cDNA 2610012O22 gene, acidic ribosomal phosphoprotein P0, hypothetical protein IMAGE3455200, ribosomal protein, large, P0 |
| 1782 | 8211 | NM_022500 | j, n, s | ferritin light chain 1, ferritin, light polypeptide | ESTs, Highly similar to FRHUL ferritin light chain [*H. sapiens*], ESTs, Moderately similar to FRHUL ferritin light chain [*H. sapiens*], PRO0470 protein, RIKEN cDNA 4933416E14 gene, ferritin light chain 2, ferritin, light polypeptide |
| 1782 | 8212 | NM_022500 | n, s | ferritin light chain 1, ferritin, light polypeptide | ESTs, Highly similar to FRHUL ferritin light chain [*H. sapiens*], ESTs, Moderately similar to FRHUL ferritin light chain [*H. sapiens*], PRO0470 protein, RIKEN cDNA 4933416E14 gene, ferritin light chain 2, ferritin, light polypeptide |
| 1783 | 6815 | NM_022503 | s | cytochrome c oxidase subunit VIIa polypeptide 3 (liver), cytochrome c oxidase, subunit VIIa 3 | EST, Moderately similar to OSHU7L cytochrome-c oxidase [*H. sapiens*], cytochrome c oxidase subunit VIIa polypeptide 2 (liver), cytochrome c oxidase, subunit VIIa 1, cytochrome c oxidase, subunit VIIa 3 |
| 1784 | 4259 | NM_022504 | q, w | ribosomal protein L36 | EST, Moderately similar to T08720 ribosomal protein L36 [*H. sapiens*], ESTs, Weakly similar to RL36_HUMAN 60S RIBOSOMAL PROTEIN L36 [*H. sapiens*], RIKEN cDNA 1110038G14 gene, ribosomal protein L36 |

TABLE 3-continued

HUMAN HOMOLOGUE ANNOTATIONS

| Seq. ID No. | GenBank Acc./ Identifier Ref. Seq. ID No. | | Model Code | Homologous Gene Name | Homologous Cluster Name |
|---|---|---|---|---|---|
| 1785 | 1611 | NM_022509 | j | | ESTs, Weakly similar to SMN1_HUMAN SURVIVAL MOTOR NEURON PROTEIN 1 [H. sapiens], RIKEN cDNA 2410004J23 gene, expressed sequence AI849087, expressed sequence AW122398, splicing factor 30, survival of motor neuron-related, survival motor neuron, survival motor neuron pseudogene, survival of motor neuron 1, telomeric, survival of motor neuron 2, centromeric |
| 1786 | 2236 | NM_022512 | y, z | | ESTs, Weakly similar to acyl-CoA dehydrogenase [R. norvegicus], RIKEN cDNA 1300003O09 gene, RIKEN cDNA 2310016C19 gene, acetyl-Coenzyme A dehydrogenase, short chain, acyl-Coenzyme A dehydrogenase family, member 8, acyl-Coenzyme A dehydrogenase, C-2 to C-3 short chain, hypothetical protein FLJ12592, hypothetical protein MGC5601, isovaleryl coenzyme A dehydrogenase |
| 1787 | 3026 | NM_022514 | a | | EST, Weakly similar to 60S RIBOSOMAL PROTEIN L27 [R. norvegicus], EST, Weakly similar to S43505 ribosomal protein L27, cytosolic [H. sapiens], ribosomal protein L27 |
| 1787 | 3027 | NM_022514 | a, q, r, aa | | EST, Weakly similar to 60S RIBOSOMAL PROTEIN L27 [R. norvegicus], EST, Weakly similar to S43505 ribosomal protein L27, cytosolic [H. sapiens], ribosomal protein L27 |
| 1788 | 2696 | NM_022515 | a, d | | ESTs, Highly similar to RL24_HUMAN 60S RIBOSOMAL PROTEIN L24 [H. sapiens], RIKEN cDNA 0610008L05 gene, ribosomal protein L24 |
| 1788 | 2697 | NM_022515 | n, w, aa | | ESTs, Highly similar to RL24_HUMAN 60S RIBOSOMAL PROTEIN L24 [H. sapiens], RIKEN cDNA 0610008L05 gene, ribosomal protein L24 |
| 1789 | 3900 | NM_022516 | h | neural polypyrimidine tract binding protein, polypyrimidine tract binding protein | ESTs, Moderately similar to S15552 polypyrimidine tract-binding protein 1 - rat [R. norvegicus], ESTs, Weakly similar to S15552 polypyrimidine tract-binding protein 1 - rat [R. norvegicus], RIKEN cDNA 2810036L13 gene, expressed sequence AW107884, heterogeneous nuclear ribonucleoprotein L, neural polypyrimidine tract binding protein, polypyrimidine tract binding protein, polypyrimidine tract binding protein 2 |
| 1790 | 4151 | NM_022518 | o | | ADP-ribosylation factor 1, ADP-ribosylation factor domain protein 1, 64 kD, ADP-ribosylation factor-like 1, ARF protein, Homo sapiens, Similar to DKFZP727C091 protein, clone MGC:10677 IMAGE:3948445, mRNA, complete cds |
| 1791 | 4242 | NM_022521 | c | | ESTs, Highly similar to ORNITHINE AMINOTRANSFERASE PRECURSOR [R. norvegicus], RIKEN cDNA 1300019H02 gene, RIKEN cDNA 2900006B13 gene, hypothetical protein MGC15875, ornithine aminotransferase, ornithine aminotransferase (gyrate atrophy) |
| 1792 | 4412 | NM_022523 | o | | CD151 antigen, Homo sapiens cDNA FLJ14609 fis, clone NT2RP1000944, |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 1793 | 6641 | NM_022533 | General | | RIKEN cDNA 1110014F12 gene, RIKEN cDNA 1110031P12 gene, RIKEN cDNA 2700063A19 gene, transmembrane 4 superfamily member (tetraspan NET-2), transmembrane 4 superfamily member 6 |
| 1794 | 8097 | NM_022536 | a | | ESTs, Weakly similar to A55046 plasmolipin - rat [R. norvegicus], ESTs, Weakly similar to PLLP_HUMAN PLASMOLIPIN [H. sapiens], Homo sapiens cDNA FLJ14787 fis, clone NT2RP4000878, highly similar to MYELOID UPREGULATED PROTEIN, Mus musculus, Similar to BENE protein, clone MGC: 19097 IMAGE. 4205488, mRNA, complete cds, RIKEN cDNA 2700018N07 gene, expressed sequence AI461653, myelin and lymphocyte protein; T-cell differentiation protein, plasmolipin |
| 1795 | 8597 | NM_022538 | c, r, u | | ESTs, Moderately similar to A Chain A, Cyclophilin B Complexed With [H. sapiens], RIKEN cDNA 1110060O10 gene, RIKEN cDNA 3732410E19 gene, RIKEN cDNA 4833408F11 gene, expressed sequence AA408962, expressed sequence AA553318, peptidylprolyl isomerase B, peptidylprolyl isomerase B (cyclophilin B) |
| 1795 | 8598 | NM_022538 | u | | |
| 1796 | 9296 | NM_022541 | o | | EST, Highly similar to IM8B_MOUSE MITOCHONDRIAL IMPORT INNER MEMBRANE TRANSLOCASE SUBUNIT TIM8 B (DEAFNESS DYSTONIA PROTEIN 2 HOMOLOG) [R. norvegicus], translocase of inner mitochondrial membrane 8 (yeast) homolog B, translocase of inner mitochondrial membrane 8 homolog b (yeast) |
| 1797 | 21063 | NM_022585 | h | ornithine decarboxylase antizyme inhibitor | ESTs, Weakly similar to A Chain A, Crystal Structure Ornithine Decarboxylase From Mouse, Truncated 37 Residues From The C-Terminus, To 1 6 Angstrom Resolution [M. musculus], ESTs, Weakly similar to ORNITHINE DECARBOXYLASE [R. norvegicus], Ornitine decarboxylase, ornithine decarboxylase 1, ornithine decarboxylase antizyme inhibitor, ornithine decarboxylase, structural, ornithine decarboxylase-like protein |
| 1799 | 20781 | NM_022591 | z | | apoptotic protease activating factor, telomerase associated protein 1, telomerase-associated protein 1 |
| 1800 | 20803 | NM_022592 | n | | RIKEN cDNA 4933401I19 gene, hypothetical protein DKFZp434L1717, transketolase, transketolase (Wernicke Korsakoff syndrome), transketolase-like 1 |
| 1801 | 20925 | NM_022594 | q | enoyl Coenzyme A hydratase 1, peroxisomal, enoyl coenzyme A hydratase 1, peroxisomal | AU RNA-binding protein/enoyl-coenzyme A hydratase, EST, Weakly similar to ECH1_HUMAN DELTA3, 5-DELTA2, 4-DIENOYL-COA ISOMERASE PRECURSO [H. sapiens], RIKEN cDNA 2610009M20 gene, enoyl Coenzyme A hydratase 1, peroxisomal, enoyl coenzyme A hydratase 1, peroxisomal, expressed sequence AA617331 |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 1802 | 20944 | NM_022597 | aa | | cathepsin B, lipocalin 7, tubulointerstitial nephritis antigen |
| 1803 | 21024 | NM_022599 | o, General | | EST, Highly similar to OM25_RAT MITOCHONDRIAL OUTER MEMBRANE PROTEIN 25 (NPW16) [*R. norvegicus*], EST, Weakly similar to OM25_RAT MITOCHONDRIAL OUTER MEMBRANE PROTEIN 25 (NPW16) [*R. norvegicus*], Erbb2 interacting protein, discs, large homolog 4 (Drosophila), expressed sequence AI118201, hypothetical protein FLJ11271, synaptojanin 2 binding protein |
| 1804 | 2250 | NM_022643 | General | | H2B histone family, member D, H2B histone family, member G, H2B histone family, member K, RIKEN cDNA 2610022J01 gene, expressed sequence AI413321, expressed sequence R74621 |
| 1805 | 17567 | NM_022672 | a, y | ribosomal protein S14 | EST, Moderately similar to 40S RIBOSOMAL PROTEIN S14 [*R. norvegicus*], EST, Weakly similar to A25220 ribosomal protein S14, cytosolic [*H. sapiens*], EST, Weakly similar to JE0129 ribosomal protein S14 - mouse [*M. musculus*], ESTs, Highly similar to A25220 ribosomal protein S14, cytosolic [*H. sapiens*], ribosomal protein S14 |
| 1806 | 17661 | NM_022674 | bb | H2A histone family, member Z | EST, Weakly similar to histone H2A.F/Z variant [*H. sapiens*], ESTs, Highly similar to HISTONE H2A.Z [*R. norvegicus*], H2A histone family, member Z, RIKEN cDNA C530002L11 gene, histone H2A.F/Z variant |
| 1807 | 24563 | NM_022676 | b | protein phosphatase 1, regulatory (inhibitor) subunit 1A | EST, Weakly similar to IPP1_HUMAN PROTEIN PHOSPHATASE INHIBITOR 1 [*H. sapiens*], ESTs, Weakly similar to IPP1_HUMAN PROTEIN PHOSPHATASE INHIBITOR 1 [*H. sapiens*], RIKEN cDNA 4930579P15 gene, protein phosphatase 1, regulatory (inhibitor) subunit 1A, protein phosphatase 1, regulatory (inhibitor) subunit 1B (dopamine and cAMP regulated phosphoprotein, DARPP-32) |
| 1807 | 24564 | NM_022676 | b,x | protein phosphatase 1, regulatory (inhibitor) subunit 1A | EST, Weakly similar to IPP1_HUMAN PROTEIN PHOSPHATASE INHIBITOR 1 [*H. sapiens*], ESTs, Weakly similar to IPP1_HUMAN PROTEIN PHOSPHATASE INHIBITOR 1 [*H. sapiens*], RIKEN cDNA 4930579P15 gene, protein phosphatase 1, regulatory (inhibitor) subunit 1A, protein phosphatase 1, regulatory (inhibitor) subunit 1B (dopamine and cAMP regulated phosphoprotein, DARPP-32) |
| 1808 | 20506 | NM_022686 | l | | |
| 1809 | 20508 | NM_022688 | g | | |
| 1810 | 17586 | NM_022694 | k | | EBNA-2 co-activator (100 kD), ESTs, Moderately similar to I38968 100 kDa coactivator [*H. sapiens*] |
| 1811 | 17730 | NM_022697 | a | | DNA segment, Chr 7, Wayne State University 21, expressed, EST, Highly similar to S55915 ribosomal protein L28 [*H. sapiens*], ESTs, Highly similar to S55915 ribosomal protein L28 [*H. sapiens*], ribosomal protein L28 |
| 1811 | 17729 | NM_022697 | q | | DNA segment, Chr 7, Wayne State University 21, expressed, EST, Highly |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 1812 | 154 | NM_022849 | t | crp-ductin, deleted in malignant brain tumors 1 | similar to S55915 ribosomal protein L28 [*H. sapiens*], ESTs, Highly similar to S55915 ribosomal protein L28 [*H. sapiens*], ribosomal protein L28 CD163 antigen, ESTs, Highly similar to I38005 M130 antigen precursor, splice form 4 [*H. sapiens*], KIAA1822 protein, apoptosis inhibitory 6, crp-ductin, deleted in malignant brain tumors 1, lectin, galactoside-binding, soluble, 3 binding protein, macrophage scavenger receptor 2, peptidylprolyl isomerase C-associated protein |
| 1813 | 127 | NM_022855 | h | | EST, Weakly similar to KC13 RAT CASEIN KINASE I, GAMMA 3 ISOFORM [*R. norvegicus*], ESTs, Highly similar to KC13 RAT CASEIN KINASE I, GAMMA 3 ISOFORM [*R. norvegicus*], ESTs, Weakly similar to casein kinase [*M. musculus*], RIKEN cDNA 2610208K14 gene, RIKEN cDNA 3300002K07 gene, casein kinase 1, alpha 1, casein kinase 1, delta, casein kinase 1, epsilon, casein kinase 1, gamma 1, casein kinase 1, gamma 3 |
| 1814 | 152 | NM_022858 | j | | ESTs, Highly similar to FXD3_HUMAN FORKHEAD BOX PROTEIN D3 [*H. sapiens*], ESTs, Weakly similar to FXD3_HUMAN FORKHEAD BOX PROTEIN D3 [*H. sapiens*], ESTs, Weakly similar to HFH1 RAT HEPATOCYTE NUCLEAR FACTOR 3 FORKHEAD HOMOLOG 1 [*R. norvegicus*], HNF-3/forkhead homolog 1 like, expressed sequence AI385632, forkhead box D1, forkhead box D2, forkhead box D3, winged helix/forkhead transcription factor |
| 1816 | 18101 | NM_022948 | z | | |
| 1816 | 18103 | NM_022948 | u | | |
| 1817 | 21491 | NM_022951 | w | | CAT56 protein, EST, Highly similar to CA13_HUMAN COLLAGEN ALPHA 1(III) CHAIN PRECURSOR [*H. sapiens*], EST, Weakly similar to A28996 proline-rich protein M14 precursor - mouse [*M. musculus*], EST, Weakly similar to JE0291 FB19 protein [*H. sapiens*], collagen, type III, alpha 1 (Ehlers-Danlos syndrome type IV, autosomal dominant), procollagen, type III, alpha 1, proline rich protein, proline rich protein 2, protein phosphatase 1, regulatory subunit 10 |
| 1818 | 15742 | NM_022958 | y | | ESTs, Moderately similar to S57219 phosphatidylinositol 3-kinase [*H. sapiens*], FK506 binding protein 12-rapamycin associated protein 1, *Homo sapiens* cDNA FLJ12591 fis, clone NT2RM4001313, moderately similar to PHOSPHATIDYLINOSITOL 3-KINASE VPS34-LIKE (EC 2.7.1.137), *Homo sapiens* cDNA FLJ14331 fis, clone PLACE4000320, RIKEN cDNA 2410099E07 gene, phosphatidylinositol 3-kinase catalytic delta polypeptide, phosphatidylinositol 3-kinase, catalytic, beta polypeptide, phosphoinositide-3-kinase, class 3, rapamycin and FKBP12 target-1 protein |
| 1819 | 9286 | NM_023027 | t, w | | ELAV (embryonic lethal, abnormal vision, Drosophila)-like 4 (Hu antigen |

TABLE 3-continued

HUMAN HOMOLOGUE ANNOTATIONS

| Seq. ID No. | GenBank Acc./ Identifier Ref. Seq. ID No. | | Model Code | Homologous Gene Name | Homologous Cluster Name |
|---|---|---|---|---|---|
| | | | | | D), ESTs, Highly similar to HUD RAT PARANEOPLASTIC ENCEPHALOMYELITIS ANTIGEN HUD HOMOLOG [*R. norvegicus*], ESTs, Moderately similar to HUD RAT PARANEOPLASTIC ENCEPHALOMYELITIS ANTIGEN HUD HOMOLOG [*R. norvegicus*], ESTs, Moderately similar to POLYADENYLATE-BINDING PROTEIN 1 [*M. musculus*], *Mus musculus* adult male testis cDNA, RIKEN full-length enriched library, clone: 4933407N23, full insert sequence, RIKEN cDNA 4932702K14 gene, poly A binding protein, cytoplasmic 1 |
| 1820 | 23215 | NM_023102 | z | | RIKEN cDNA 2610208K14 gene, VRK3 for vaccinia related kinase 3, casein kinase 1, alpha 1, casein kinase 1, delta, casein kinase 1, epsilon, casein kinase 1, gamma 2 |
| 1821 | 21238 | NM_024125 | cc, General | CCAAT/enhancer binding protein (C/EBP), beta | CCAAT/enhancer binding protein (C/EBP), beta |
| 1821 | 21239 | NM_024125 | cc, General | CCAAT/enhancer binding protein (C/EBP), beta | CCAAT/enhancer binding protein (C/EBP), beta |
| 1822 | 353 | NM_024127 | i, n, General | growth arrest and DNA-damage-inducible 45 alpha, growth arrest and DNA-damage-inducible, alpha | growth arrest and DNA-damage-inducible 45 alpha, growth arrest and DNA-damage-inducible 45 beta, growth arrest and DNA-damage-inducible, alpha |
| 1822 | 354 | NM_024127 | i, n, General | growth arrest and DNA-damage-inducible 45 alpha, growth arrest and DNA-damage-inducible, alpha | growth arrest and DNA-damage-inducible 45 alpha, growth arrest and DNA-damage-inducible 45 beta, growth arrest and DNA-damage-inducible, alpha |
| 1822 | 352 | NM_024127 | h, General | growth arrest and DNA-damage-inducible 45 alpha, growth arrest and DNA-damage-inducible, alpha | growth arrest and DNA-damage-inducible 45 alpha, growth arrest and DNA-damage-inducible 45 beta, growth arrest and DNA-damage-inducible, alpha |
| 1823 | 17227 | NM_024131 | x | D-dopachrome tautomerase | D-dopachrome tautomerase, expressed sequence C78655 |
| 1824 | 1598 | NM_024134 | l | DNA-damage inducible transcript 3, DNA-damage-inducible transcript 3 | DNA-damage inducible transcript 3, EST, Moderately similar to GA15_HUMAN GROWTH ARREST AND DNA-DAMAGE-INDUCIBLE PROTEIN GADD153 [*H. sapiens*], myozenin |
| 1825 | 1162 | NM_024153 | d | | ferredoxin reductase |
| 1826 | 7863 | NM_024156 | c | | ATPase, H+ transporting, lysosomal (vacuolar proton pump) 16 kD, ATPase, H+ transporting, lysosomal (vacuolar proton pump) 21 kD, ESTs, Weakly similar to VACUOLAR ATP SYNTHASE 16 KD PROTEOLIPID SUBUNIT [*R. norvegicus*], *Mus musculus*, Similar to ATPase, H+ transporting, lysosomal (vacuolar proton pump) 21 kD, clone MGC 6568 IMAGE 2812497, mRNA, complete cds |
| 1827 | 22079 | NM_024157 | x | | EST, Weakly similar to A29154 complement factor I [*H. sapiens*], I factor (complement), RIKEN cDNA 1300008A22 gene, complement component factor i, protease, serine, 7 (enterokinase), suppression of tumorigenicity 14 (colon carcinoma), transmembrane protease, serine 2 |
| 1828 | 16476 | NM_024162 | General | fatty acid binding protein 3, muscle and heart, fatty acid binding protein 3, muscle and heart | EST, Moderately similar to FABH MOUSE FATTY ACID-BINDING PROTEIN, HEART [*M. musculus*], ESTs, Highly similar to PC4011 fatty |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| | | | | (mammary-derived growth inhibitor) | acid-binding protein - mouse [*M. musculus*], fatty acid binding protein 3, muscle and heart, fatty acid binding protein 3, muscle and heart (mammary derived growth inhibitor), fatty acid binding protein 3, pseudogene 2 |
| 1829 | 17765 | NM_024351 | b, s, v | heat shock 70 kD protein 8 | EST, Moderately similar to A27077 dnaK-type molecular chaperone [*H. sapiens*], EST, Weakly similar to A27077 dnaK-type molecular chaperone [*H. sapiens*], EST, Weakly similar to A45935 dnaK-type molecular chaperone hsc70 - mouse [*M. musculus*], heat shock 70 kD protein 8, hypothetical protein MGC4859 similar to HSPA8 |
| 1830 | 8879 | NM_024360 | h | | bHLH factor Hes4, basic helix-loop-helix domain containing, class B, 2, basic helix-loop-helix domain containing, class B, 3, hairy (Drosophila)-homolog, hairy and enhancer of split 1, (Drosophila), hairy and enhancer of split 6, (Drosophila), hairy/enhancer-of-split related with YRPW motif 1, hairy/enhancer-of-split related with YRPW motif 2, likely ortholog of mouse Hes6 neuronal differentiation gene |
| 1831 | 20772 | NM_024363 | x | HMT1 (hnRNP methyltransferase, *S. cerevisiae*)-like 2, heterogeneous nuclear ribonucleoproteins methyltransferase-like 2 (*S. cerevisiae*) | ANM1__HUMAN PROTEIN ARGININE N-METHYLTRANSFERASE 1 [*H. sapiens*], EST, Weakly similar to ANM1__HUMAN PROTEIN ARGININE N-METHYLTRANSFERASE 1 [*H. sapiens*], ESTs, Moderately similar to ANM1__MOUSE PROTEIN ARGININE N-METHYLTRANSFERASE 1 [*M. musculus*], HMT1 (hnRNP methyltransferase, *S. cerevisiae*)-like 2, HMT1 (hnRNP methyltransferase, *S. cerevisiae*)-like 3, *Homo sapiens* cDNA. FLJ23133 fis, clone LNG08560, RIKEN cDNA 2410018A17 gene, coactivator-associated arginine methyltransferase-1, expressed sequence AW214366, heterogeneous nuclear ribonucleoproteins methyltransferase-like 2 (S. cerevisiae), heterogeneous nuclear ribonucleoproteins methyltransferase-like 2 (*S. cerevisiae*), related sequence, hypothetical protein FLJ10559 |
| 1832 | 2812 | NM_024386 | c | | 3-hydroxy-3-methylglutaryl-Coenzyme A lyase, 3-hydroxymethyl-3-methylglutaryl-Coenzyme A lyase (hydroxymethylglutaricaciduria), *Homo sapiens* clone 24959 mRNA sequence, partial cds, hypothetical protein |
| 1833 | 335 | NM_024387 | j, y | | RIKEN cDNA 2700048O17 gene, heme oxygenase (decycling) 2 |
| 1834 | 21 | NM_024388 | cc | | nuclear receptor subfamily 4, group A, member 1 |
| 1834 | 22 | NM_024388 | cc | | nuclear receptor subfamily 4, group A, member 1 |
| 1836 | 9929 | NM_024392 | f | | *Homo sapiens* cDNA FLJ13261 fis, clone OVARC1000885, weakly similar to OXIDOREDUCTASE UCPA (EC 1.—.—.—), Human DNA sequence from clone 1068E13 on chromosome 20p11 21-12.3 Contains two putative novel genes, the gene for a novel protein similar to bovine SCP2 (Sterol Carrier |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| | | | | | Protein 2) and part of HSD17B4 (hydroxysteroid (17-beta) dehydrogenase 4), an EEF1A1 (eukaryotic translation elongation factor 1 alpha 1) pseudogene, ESTs, STSs and GSSs, RIKEN cDNA 1110029G07 gene, RIKEN cDNA 1700010M22 gene, RIKEN cDNA 1810026B04 gene, RIKEN cDNA 2610207I16 gene, expressed sequence AW208803, hydroxysteroid (17-beta) dehydrogenase 4, hydroxysteroid 17-beta dehydrogenase 4, hypothetical protein MGC10940, oxidoreductase UCPA, retinal short-chain dehydrogenase/reductase 1 |
| 1837 | 3582 | NM_024396 | aa | | ATP-binding cassette, sub-family A (ABC1), member 2, ATP-binding cassette, sub-family A (ABC1), member 3, ATP-binding cassette, sub-family A (ABC1), member 4, ATP-binding cassette, sub-family A (ABC1), member 7, ATP-binding cassette, sub-family A (ABC1), member 8, ESTs, Weakly similar to ABC2 MOUSE ATP-BINDING CASSETTE TRANSPORTER 2 [*M. musculus*], *Homo sapiens* mRNA for KIAA1888 protein, partial cds, hypothetical protein FLJ14297, hypothetical protein PRO2543 |
| 1838 | 19993 | NM_024398 | e, p, s, aa | | DNA segment, Chr 9, ERATO Doi 85, expressed, *Homo sapiens* aconitase precursor (ACON) mRNA, nuclear gene encoding mitochondrial protein, partial cds, RIKEN cDNA 5031409G22 gene, aconitase 1, aconitase 1, soluble, aconitase 2, mitochondrial, iron-responsive element-binding protein |
| 1839 | 10789 | NM_024399 | o | | *Homo sapiens*, RIKEN cDNA 0610006H10 gene, clone MGC: 17267 IMAGE 4155233, mRNA, complete cds, *Homo sapiens*, Similar to RIKEN cDNA 0610006H10 gene, clone MGC: 9740 IMAGE.3853707, mRNA, complete cds, aspartoacylase (aminoacylase 2, Canavan disease) |
| 1840 | 22626 | NM_024400 | cc, General | | ESTs, Weakly similar to T47158 hypothetical protein DKFZp762C1110.1 [*H. sapiens*], *Mus musculus* papilin mRNA, complete cds, *Mus musculus*, Similar to a disintegrin and metalloproteinase with thrombospondin motifs 1 (ADAMTS-1), clone IMAGE 3491991, mRNA, partial cds, RIKEN cDNA 6720426B09 gene, RIKEN cDNA A930008K15 gene, a disintegrin-like and metalloprotease (reprolysin type) with thrombospondin type 1 motif, 1, a disintegrin-like and metalloprotease (reprolysin type) with thrombospondin type 1 motif, 4, a disintegrin-like and metalloprotease (reprolysin type) with thrombospondin type 1 motif, 8, a disintegrin-like and metalloprotease (reprolysin type) with thrombospondin type 1 motif, 9 |
| 1841 | 13633 | NM_024403 | g, General | | EST, Weakly similar to ATF4_HUMAN CYCLIC-AMP-DEPENDENT TRANSCRIPTION FACTOR ATF-4 [*H. sapiens*], activating transcription |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| | | | | | factor 4 (tax-responsive enhancer element B67), activating transcription factor 5 |
| 1841 | 13634 | NM_024403 | g, General | | EST, Weakly similar to ATF4_HUMAN CYCLIC-AMP-DEPENDENT TRANSCRIPTION FACTOR ATF-4 [*H. sapiens*], activating transcription factor 4 (tax-responsive enhancer element B67), activating transcription factor 5 |
| 1842 | 23387 | NM_024404 | b, General | | ESTs, Moderately similar to HETEROGENEOUS NUCLEAR RIBONUCLEOPROTEIN C [*R. norvegicus*], ESTs, Weakly similar to A44192 heterogeneous nuclear ribonucleoprotein C-like protein [*H. sapiens*], *Mus musculus* high-glycine/tyrosine protein type I E5 mRNA, complete cds, expressed sequence C85084, heterogeneous nuclear ribonucleoprotein A/B, heterogeneous nuclear ribonucleoprotein D, heterogeneous nuclear ribonucleoprotein D (AU-rich element RNA-binding protein 1, 37 kD) |
| 1843 | 21038 | NM_024484 | h | aminolevulinate, delta-, synthase 1, aminolevulinic acid synthase 1 | EST, Weakly similar to SYHUAL 5-aminolevulinate synthase [*H. sapiens*], ESTs, Moderately similar to 5-AMINOLEVULINIC ACID SYNTHASE MITOCHONDRIAL PRECURSOR, NONSPECIFIC [*R. norvegicus*], aminolevulinate, delta-, synthase 1, aminolevulinic acid synthase 1, aminolevulinic acid synthase 2, erythroid, serine palmitoyltransferase, long chain base subunit 1, serine palmitoyltransferase, long chain base subunit 2 |
| 1844 | 1853 | NM_030826 | s | glutathione peroxidase 1 | GSHG_MOUSE GLUTATHIONE PEROXIDASE-GASTROINTESTINAL (GSHPX-GI) [*M. musculus*], ESTs, Weakly similar to GSHC RAT GLUTATHIONE PEROXIDASE [*R. norvegicus*], glutathione peroxidase 1, glutathione peroxidase 2 (gastrointestinal) |
| 1845 | 15111 | NM_030827 | e, General | low density lipoprotein receptor-related protein 2, low density lipoprotein-related protein 2 | EST, Highly similar to LRP2 RAT LOW-DENSITY LIPOPROTEIN RECEPTOR-RELATED PROTEIN 2 PRECURSOR [*R. norvegicus*], EST, Moderately similar to S25111 alpha-2-macroglobulin receptor precursor - mouse [*M. musculus*], ESTs, Highly similar to S02392 alpha-2-macroglobulin receptor precursor [*H. sapiens*], ESTs, Highly similar to S25111 alpha-2-macroglobulin receptor precursor - mouse [*M. musculus*], ESTs, Weakly similar to I53413 calcium sensor protein [*H. sapiens*], expressed sequence C79313, low density lipoprotein receptor-related protein 1, low density lipoprotein receptor-related protein 2, low density lipoprotein-related protein 1B (deleted in tumors), low density lipoprotein-related protein 2 |
| 1845 | 15112 | NM_030827 | y, z | low density lipoprotein receptor-related protein 2, low density lipoprotein-related protein 2 | EST, Highly similar to LRP2 RAT LOW-DENSITY LIPOPROTEIN RECEPTOR-RELATED PROTEIN 2 PRECURSOR [*R. norvegicus*], EST, Moderately similar to S25111 alpha-2-macroglobulin receptor precursor - |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| | | | | | mouse [*M. musculus*], ESTs, Highly similar to S02392 alpha-2-macroglobulin receptor precursor [*H. sapiens*], ESTs, Highly similar to S25111 alpha-2-macroglobulin receptor precursor - mouse [*M. musculus*], ESTs, Weakly similar to I53413 calcium sensor protein [*H. sapiens*], expressed sequence C79313, low density lipoprotein receptor-related protein 1, low density lipoprotein receptor-related protein 2, low density lipoprotein-related protein 1B (deleted in tumors), low density lipoprotein-related protein 2 |
| 1845 | 15110 | NM_030827 | General | low density lipoprotein receptor-related protein 2, low density lipoprotein-related protein 2 | EST, Highly similar to LRP2 RAT LOW-DENSITY LIPOPROTEIN RECEPTOR-RELATED PROTEIN 2 PRECURSOR [*R. norvegicus*], EST, Moderately similar to S25111 alpha-2-macroglobulin receptor precursor - mouse [*M. musculus*], ESTs, Highly similar to S02392 alpha-2-macroglobulin receptor precursor [*H. sapiens*], ESTs, Highly similar to S25111 alpha-2-macroglobulin receptor precursor - mouse [*M. musculus*], ESTs, Weakly similar to I53413 calcium sensor protein [*H. sapiens*], expressed sequence C79313, low density lipoprotein receptor-related protein 1, low density lipoprotein receptor-related protein 2, low density lipoprotein-related protein 1B (deleted in tumors), low density lipoprotein-related protein 2 |
| 1846 | 808 | NM_030837 | k, m | | solute carrier family 21 (organic anion transporter), member 1, solute carrier family 21 (organic anion transporter), member 10, solute carrier family 21 (organic anion transporter), member 14, solute carrier family 21 (organic anion transporter), member 3, solute carrier family 21 (organic anion transporter), member 6 |
| 1847 | 4057 | NM_030844 | k | | ESTs, Weakly similar to I65309 autoantigen p69 - rat [*R. norvegicus*], *Homo sapiens* ALS2CR15 mRNA, partial cds, RIKEN cDNA 1700030B17 gene, islet cell autoantigen 1 (69 kD), islet cell autoantigen 1, 69 kDa |
| 1848 | 1221 | NM_030845 | t | | GRO1 oncogene, GRO2 oncogene, *Rattus norvegicus* CXC chemokine RTCK1 (Rtck1) mRNA, complete cds, interleukin 8, platelet factor 4, pro-platelet basic protein, pro-platelet basic protein (includes platelet basic protein, beta-thromboglobulin, connective tissue-activating peptide III, neutrophil-activating peptide-2) |
| 1849 | 21509 | NM_030847 | x | | ESTs, Weakly similar to PERIPHERAL MYELIN PROTEIN 22 [*R. norvegicus*], Peripheral myelin protein, epithelial membrane protein 3, peripheral myelin protein 22, peripheral myelin protein, 22 kDa |
| 1850 | 1928 | NM_030872 | v | pyruvate dehydrogenase 2, pyruvate dehydrogenase kinase, isoenzyme 2 | EST, Highly similar to PDK2 RAT [*R. norvegicus*], expressed sequence AI035637, pyruvate dehydrogenase 2, pyruvate dehydrogenase kinase, isoenzyme 2 |
| 1851 | 17342 | NM_030873 | u | | EST, Weakly similar to A Chain A, Human Platelet Profilin Complexed |

TABLE 3-continued

HUMAN HOMOLOGUE ANNOTATIONS

| Seq. ID No. | GenBank Acc./ Identifier Ref. Seq. ID No. | | Model Code | Homologous Gene Name | Homologous Cluster Name |
|---|---|---|---|---|---|
| 1852 | 24648 | NM_030985 | u | | With The L-Pro10 Peptide {SUB 3-140 [*H. sapiens*], ESTs, Weakly similar to profilin [*R. norvegicus*], RIKEN cDNA 1700012P12 gene, profilin, profilin 1, profilin 2<br>G protein-coupled receptor 15, G-protein coupled receptor SALPR, somatostatin and angiotensin-like peptide receptor, angiotensin receptor 1, expressed sequence AI551199 |
| 1852 | 25453 | NM_030985 | General | | |
| 1853 | 21802 | NM_030987 | h | | ESTs, Weakly similar to GBB1 RAT GUANINE NUCLEOTIDE-BINDING PROTEIN G(I)/G(S)/G(T) BETA SUBUNIT 1 [*R. norvegicus*], *Mus musculus*, clone MGC 7934 IMAGE: 3583848, mRNA, complete cds, RIKEN cDNA 5930415H02 gene, constitutive photomorphogenic protein 1 (Arabidopsis), guanine nucleotide binding protein (G protein), beta polypeptide 1, guanine nucleotide binding protein beta subunit 4, guanine nucleotide binding protein, beta 1, guanine nucleotide binding protein, beta 4, similar to constitutive photomorphogenic protein 1 (Arabidopsis) |
| 1854 | 23109 | NM_031000 | f, s, z | | EST, Weakly similar to ALCOHOL DEHYDROGENASE [*R. norvegicus*], RIKEN cDNA 2310005E10 gene, aldo-keto reductase family 1, member A1 (aldehyde reductase), aldo-keto reductase family 1, member A4 (aldehyde reductase), aldo-keto reductase family 1, member E1 |
| 1855 | 134 | NM_031003 | a, u | | 4-aminobutyrate aminotransferase, RIKEN cDNA 1300019H02 gene, RIKEN cDNA 2900006B13 gene, ornithine aminotransferase |
| 1856 | 25461 | NM_031009 | o | | |
| 1857 | 1845 | NM_031010 | t | | ARACHIDONATE 12-LIPOXYGENASE [*R. norvegicus*], arachidonate 12-lipoxygenase, arachidonate 12-lipoxygenase pseudogene 2, arachidonate 15-lipoxygenase, expressed sequence AW259591 |
| 1857 | 25517 | NM_031010 | c, t | | ARACHIDONATE 12-LIPOXYGENASE [*R. norvegicus*], arachidonate 12-lipoxygenase, arachidonate 12-lipoxygenase pseudogene 2, arachidonate 15-lipoxygenase, expressed sequence AW259591 |
| 1858 | 16562 | NM_031020 | f | | ESTs, Weakly similar to MK14 RAT MITOGEN-ACTIVATED PROTEIN KINASE 14 [*R. norvegicus*], mitogen activated protein kinase 14, mitogen-activated protein kinase 11, mitogen-activated protein kinase 14 |
| 1859 | 1480 | NM_031021 | f | | casein kinase 2, beta polypeptide, casein kinase II, beta subunit |
| 1860 | 1719 | NM_031024 | n | drebrin 1 | ESTs, Moderately similar to T30989 serine/threonine protein kinase NIK - mouse [*M. musculus*], RIKEN cDNA 1500031A17 gene, drebrin 1, drebrin-like, hypothetical protein FLJ13154, mitogen-activated protein kinase kinase kinase kinase 4, mitogen-activated protein kinase kinase kinase kinase 6, src homology 3 domain-containing protein HIP-55 |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 1861 | 1350 | NM_031030 | h | | DnaJ (Hsp40) homolog, subfamily B, member 6, EST, Moderately similar to NEK1 MOUSE SERINE/THREONINE-PROTEIN KINASE NEK1 [*M. musculus*], EST, Moderately similar to T31096 cyclin G-associated kinase GAK - rat [*R. norvegicus*], EST, Weakly similar to T31096 cyclin G-associated kinase GAK - rat [*R. norvegicus*], ESTs, Moderately similar to NEK1 MOUSE SERINE/THREONINE-PROTEIN KINASE NEK1 [*M. musculus*], KIAA1048 protein, *Mus musculus*, Similar to cyclin G associated kinase, clone IMAGE. 3487931, mRNA, partial cds, NIMA (never in mitosis gene a)-related expressed kinase 1, RIKEN cDNA 4632401F23 gene, cyclin G associated kinase, hypothetical protein DKFZp434P0116, serine/threonine kinase 16 |
| 1862 | 16775 | NM_031031 | General | | ESTs, Highly similar to GLYCINE AMIDINOTRANSFERASE PRECURSOR [*R. norvegicus*], RIKEN cDNA 1810003P21 gene, glycine amidinotransferase (L-arginine glycine amidinotransferase) |
| 1863 | 691 | NM_031034 | w | | ESTs, Highly similar to GB12 RAT GUANINE NUCLEOTIDE-BINDING PROTEIN, ALPHA-12 SUBUNIT [*R. norvegicus*], guanine nucleotide binding protein (G protein) alpha 12, guanine nucleotide binding protein (G protein), alpha 13, guanine nucleotide binding protein, alpha 12, guanine nucleotide binding protein, alpha 13 |
| 1864 | 15886 | NM_031035 | z | | guanine nucleotide binding protein (G protein), alpha inhibiting activity polypeptide 2, guanine nucleotide binding protein, alpha inhibiting 2, guanine nucleotide binding protein, alpha inhibiting 3 |
| 1866 | 3608 | NM_031044 | k, General | | *Homo sapiens*, Similar to histamine N-methyltransferase, clone MGC. 14500 IMAGE: 4249496, mRNA, complete cds, expressed sequence AI788969, histamine N-methyltransferase |
| 1866 | 3610 | NM_031044 | d, General | | *Homo sapiens*, Similar to histamine N-methyltransferase, clone MGC. 14500 IMAGE: 4249496, mRNA, complete cds, expressed sequence AI788969, histamine N-methyltransferase |
| 1867 | 15137 | NM_031051 | s | | EST, Highly similar to C Chain C, Macrophage Migration Inhibitory Factor [*H. sapiens*], EST, Moderately similar to C Chain C, Macrophage Migration Inhibitory Factor [*H. sapiens*], EST, Moderately similar to MIF RAT MACROPHAGE MIGRATION INHIBITORY FACTOR [*R. norvegicus*], macrophage migration inhibitory factor, macrophage migration inhibitory factor (glycosylation-inhibiting factor) |
| 1868 | 514 | NM_031056 | General | | matrix metalloproteinase 14 (membrane-inserted), matrix metalloproteinase 19, vitronectin |
| 1869 | 17269 | NM_031057 | General | | RIKEN cDNA 1110038I05 gene, aldehyde dehydrogenase family 1, subfamily A4, expressed sequence AI427784, hypothetical protein FLJ23189, methylmalonate-semialdehyde dehydrogenase |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
| --- | --- | --- | --- | --- | --- |
| 1870 | 11849 | NM_031065 | a | | EST, Moderately similar to R10A MOUSE 60S RIBOSOMAL PROTEIN L10A [*M. musculus*], EST, Weakly similar to 60S RIBOSOMAL PROTEIN L10A [*R. norvegicus*], ESTs, Highly similar to R10A_HUMAN 60S RIBOSOMAL PROTEIN L10A [*H. sapiens*], ribosomal protein L10A, ribosomal protein L10a |
| 1871 | 1855 | NM_031074 | h | nucleoporin 98, nucleoporin 98 kD | EST, Highly similar to NU98 RAT NUCLEAR PORE COMPLEX PROTEIN NUP98 [*R. norvegicus*], ESTs, Weakly similar to NU98 RAT NUCLEAR PORE COMPLEX PROTEIN NUP98 [*R. norvegicus*], RIKEN cDNA 0610038H21 gene, RIKEN cDNA 4930432K09 gene, RIKEN cDNA 5430432N15 gene, melanoma antigen, family D, 3, nucleoporin 98 kD, plasma membrane associated protein, S3-12, trophinin |
| 1872 | 4683 | NM_031083 | d | | phosphatidylinositol 3-kinase, catalytic, alpha polypeptide, phosphatidylinositol 4-kinase, catalytic, beta polypeptide, phosphoinositide-3-kinase, catalytic, gamma polypeptide |
| 1873 | 15202 | NM_031093 | a, | | EST, Weakly similar to RALA MOUSE RAS-RELATED PROTEIN RAL-A [*M. musculus*], *Homo sapiens* cDNA: FLJ23197 fis, clone REC00917, RIKEN cDNA 1110065D03 gene, v-ral simian leukemia viral oncogene homolog A (ras related), v-ral simian leukemia viral oncogene homolog B (ras related) |
| 1873 | 15201 | NM_031093 | a, n | | EST, Weakly similar to RALA MOUSE RAS-RELATED PROTEIN RAL-A [*M. musculus*], *Homo sapiens* cDNA. FLJ23197 fis, clone REC00917, RIKEN cDNA 1110065D03 gene, v-ral simian leukemia viral oncogene homolog A (ras related), v-ral simian leukemia viral oncogene homolog B (ras related) |
| 1874 | 12639 | NM_031099 | aa | | ESTs, Weakly similar to S55912 ribosomal protein L5, cytosolic [*H. sapiens*], ribosomal protein L5 |
| 1875 | 20812 | NM_031100 | a | | EST, Moderately similar to 60S RIBOSOMAL PROTEIN L10 [*M. musculus*], EST, Moderately similar to 60S RIBOSOMAL PROTEIN L10 [*R. norvegicus*], ESTs, Highly similar to A42735 ribosomal protein L10, cytosolic [*H. sapiens*], *Homo sapiens*, Similar to ribosomal protein L10, clone MGC. 22634 IMAGE. 3935452, mRNA, complete cds, Human DNA sequence from clone RP3-334F4 on chromosome 6 Contains ESTs, STSs and GSSs. Contains a LAMR1 (laminin receptor 1, ribosomal protein SA) pseudogene and an RPL10 (ribosomal protein L10) pseudogene, Mouse 24 6 kda protein mRNA, complete cds, ribosomal protein L10 |
| 1876 | 16938 | NM_031103 | w | | ESTs, Weakly similar to 60S RIBOSOMAL PROTEIN L19 [*R. norvegicus*], *Homo sapiens* mRNA, cDNA DKFZp434D115 (from clone DKFZp434D115), ribosomal protein L19 |
| 1877 | 19268 | NM_031104 | q | | ESTs, Highly similar to JC2120 heparin-binding protein 15 [*H. sapiens*], |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 1878 | 16929 | NM_031108 | q | | ESTs, Moderately similar to RL22 RAT 60S RIBOSOMAL PROTEIN L22 [*R. norvegicus*], *Homo sapiens* mRNA; cDNA DKFZp586E0524 (from clone DKFZp586E0524), Human DNA sequence from clone 581F12 on chromosome Xq21. Contains Eukaryotic Translation Initiation Factor EIF3 P35 Subunit and 60S Ribosomal protein L22 pseudogenes Contains ESTs, RIKEN cDNA 2700038K18 gene, RIKEN cDNA 3110001N18 gene, expressed sequence AU041196, ribosomal protein L22 |
| 1879 | 10878 | NM_031110 | q, bb | | EST, Weakly similar to RS9 RAT 40S RIBOSOMAL PROTEIN S9 [*R. norvegicus*], EST, Weakly similar to S55917 ribosomal protein S9, cytosolic [*H. sapiens*], *Homo sapiens*, clone IMAGE: 4500773, mRNA, partial cds, RIKEN cDNA 3010033P07 gene, expressed sequence AL022771, expressed sequence AL022885, mitochondrial ribosomal protein S4, ribosomal protein S9 |
| 1880 | 19162 | NM_031111 | aa | | EST, Weakly similar to 40S RIBOSOMAL PROTEIN S11 [*R. norvegicus*], *Homo sapiens* mRNA; cDNA DKFZp434A0326 (from clone DKFZp434A0326), Human DNA sequence from clone RP5-1060K6 on chromosome 20p 12.1-13. Contains an RPS11 (40S ribosomal protein S11) pseudogene, ESTs, STSs and GSSs, RAD21 homolog (*S. pombe*), ribosomal protein S11 |
| 1880 | 19161 | NM_031111 | a, bb | | EST, Moderately similar to 40S RIBOSOMAL PROTEIN S21 [*R. norvegicus*], Human DNA sequence from clone RP5-1116H23 on chromosome 20 Contains a novel gene, a 40S ribosomal protein S21 pseudogene, 2 CpG islands, ESTs, STSs and GSSs, RIKEN cDNA 1810049N11 gene, RIKEN cDNA 2410030A14 gene, ribosomal protein S21 |
| 1881 | 24615 | NM_031112 | a, y | | EST, Moderately similar to 40S RIBOSOMAL PROTEIN S21 [*R. norvegicus*], Human DNA sequence from clone RP5-1116H23 on chromosome 20 Contains a novel gene, a 40S ribosomal protein S21 pseudogene, 2 CpG islands, ESTs, STSs and GSSs, RIKEN cDNA 1810049N11 gene, RIKEN cDNA 2410030A14 gene, ribosomal protein S21 |
| 1882 | 20839 | NM_031113 | a, q | | EST, Highly similar to 40S RIBOSOMAL PROTEIN S24 [*R. norvegicus*], EST, Weakly similar to JH0213 ribosomal protein S24, cytosolic [*H. sapiens*], EST, Weakly similar to RS24_HUMAN 40S RIBOSOMAL PROTEIN S24 [*M. musculus*], ESTs, Highly similar to JH0213 ribosomal protein S24, cytosolic [*H. sapiens*], ESTs, Weakly similar to RS24_HUMAN 40S RIBOSOMAL PROTEIN S24 [*H. sapiens*], ribosomal protein S24 |
| | | | | | EST, Moderately similar to S12583 polyubiquitin 4 - mouse [*M. musculus*], |

TABLE 3-continued

HUMAN HOMOLOGUE ANNOTATIONS

| Seq. ID No. | GenBank Acc./ Identifier Ref. Seq. ID No. | Model Code | Homologous Gene Name | Homologous Cluster Name |
|---|---|---|---|---|
| | | | | EST, Moderately similar to ubiquitin/ ribosomal protein S27a [*R. norvegicus*], EST, Weakly similar to R27A_HUMAN 40S RIBOSOMAL PROTEIN S27A {SUB 77-156 [*H. sapiens*], *Homo sapiens* cDNA FLJ11603 fis, clone HEMBA1003926, RIKEN cDNA 0610006J14 gene, expressed sequence AI132487, ribosomal protein S27a, ubiquitin C |
| 1883 | 19040 NM_031114 | l, m, General | S100 calcium binding protein A10(calgizzarin), S100 calcium-binding protein A10 (annexin II ligand, calpactin I, light polypeptide (p11)) | EST, Moderately similar to A Chain A, P11 [*H. sapiens*], EST, Moderately similar to CALPACTIN I LIGHT CHAIN [*R. norvegicus*], S100 calcium-binding protein A10 (annexin II ligand, calpactin I, light polypeptide (p11)). calcium binding protein A11 (calgizzarin) |
| 1884 | 16349 NM_031115 | u | | ESTs, Highly similar to 2111411A secretin receptor [*H. sapiens*], ESTs, Weakly similar to vasoactive intestinal polypeptide 1 [*M. musculus*], adenylate cyclase activating polypeptide 1 receptor 1, secretin receptor, vasoactive intestinal peptide receptor 1 |
| 1885 | 14970 NM_031127 | General | | ESTs, Highly similar to SUOX RAT SULFITE OXIDASE PRECURSOR [*R. norvegicus*], RIKEN cDNA 0610009N12 gene, RIKEN cDNA 1810044O22 gene, RIKEN cDNA 2810034J18 gene, fatty acid desaturase 2, sulfite oxidase |
| 1886 | 1814 NM_031134 | n, q | thyroid hormone receptor alpha, thyroid hormone receptor, alpha (avian erythroblastic leukemia viral (v-erb-a) oncogene homolog) | EST, Weakly similar to A30893 thyroid hormone receptor alpha, splice form 2 [*H. sapiens*], expressed sequence AW259572, expressed sequence R75201, thyroid hormone receptor; alpha (avian erythroblastic leukemia viral (v-erb-a) oncogene homolog) |
| 1887 | 13359 NM_031135 | General | | Kruppel-like factor 15 (kidney), Kruppel like factor 9, RIKEN cDNA 4930480I16 gene, TGFB inducible early growth response, basic transcription element binding protein 1, trans-acting transcription factor 3, trans-acting transcription factor 6 |
| 1888 | 15052 NM_031136 | a | | ESTs, Highly similar to A38682 thymosin beta-4 [*H. sapiens*], ESTs, Highly similar to TYB4 MOUSE THYMOSIN BETA-4 [*M. musculus*], ESTs, Highly similar to TYB4_HUMAN THYMOSIN BETA-4 [*H. sapiens*], Human interferon-inducible mRNA (cDNA 6-26), expressed sequence AW544206, thymosin, beta 10, thymosin, beta 4, X chromosome, thymosin, beta 4, Y chromosome |
| 1888 | 19359 NM_031136 | a | | |
| 1889 | 15185 NM_031140 | General | | EST, Moderately similar to A25074 vimentin [*H. sapiens*], EST, Weakly similar to A25074 vimentin [*H. sapiens*], ESTs, Moderately similar to VIME RAT VIMENTIN [*R. norvegicus*], ESTs, Weakly similar to A25074 vimentin [*H. sapiens*], ESTs, Weakly similar to VIME RAT VIMENTIN [*R. norvegicus*], vimentin |
| 1890 | 21625 NM_031144 | a, e | | EST, Weakly similar to ACTB_HUMAN ACTIN, CYTOPLASMIC 1 [*R. norvegicus*], ESTs, Highly similar to ATHUB actin beta [*H. sapiens*], ESTs, Weakly similar to ACTB_HUMAN ACTIN, CYTOPLASMIC 1 |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 1891 | 238 | NM_031152 | bb | | [*R. norvegicus*], *Homo sapiens* FKSG30 (FKSG30) mRNA, complete cds, RIKEN cDNA 1700052K15 gene, RIKEN cDNA 1700061J02 gene, actin, beta, actin-like 7a, actin-related protein 3-beta, melanoma X-actin CATX-8 protein, ESTs, Weakly similar to R11A_HUMAN RAS-RELATED PROTEIN RAB-11A [*R. norvegicus*], RAB, member of RAS oncogene family like 2A, RAB11A, member RAS oncogene family, RAB11a, member RAS oncogene family, RAB25, member RAS oncogene family, RIKEN cDNA 2700023P08 gene |
| 1891 | 240 | NM_031152 | bb | | CATX-8 protein, ESTs, Weakly similar to R11A_HUMAN RAS-RELATED PROTEIN RAB-11A [*R. norvegicus*], RAB, member of RAS oncogene family like 2A, RAB11A, member RAS oncogene family, RAB11a, member RAS oncogene family, RAB25, member RAS oncogene family, RIKEN cDNA 2700023P08 gene |
| 1892 | 15277 | NM_031237 | g | | EST, Moderately similar to UB5B_HUMAN UBIQUITIN-CONJUGATING ENZYME E2-17 KD 2 [*R. norvegicus*], ESTs, Moderately similar to I59365 ubiquitin conjugating enzyme [*H. sapiens*], ESTs, Moderately similar to UB5B_HUMAN UBIQUITIN-CONJUGATING ENZYME E2-17 KD 2 [*M. musculus*], RIKEN cDNA 1100001F19 gene, RIKEN cDNA 1600028I17 gene, RIKEN cDNA 2700084L22 gene, *Rattus norvegicus* clone ubc2e ubiquitin conjugating enzyme (E217kB) mRNA, complete cds, expressed sequence AL022654, ubiquitin-conjugating enzyme E2D 1 (homologous to yeast UBC4/5), ubiquitin-conjugating enzyme E2D 2, ubiquitin-conjugating enzyme E2D 2 (homologous to yeast UBC4/5), ubiquitin-conjugating enzyme E2D 3 (homologous to yeast UBC4/5) |
| 1893 | 18083 | NM_031315 | q | | ESTs, Weakly similar to YZ28_HUMAN HYPOTHETICAL PROTEIN ZAP128 [*H. sapiens*], *Mus musculus*, Similar to cytosolic acyl-CoA thioesterase 1, clone MGC: 27572 IMAGE: 4485973, mRNA, complete cds |
| 1893 | 1858 | NM_031315 | q | cytosolic acyl-CoA thioesterase 1, peroxisomal long-chain acyl-coA thioesterase | PTE2_HUMAN PEROXISOMAL ACYL-COENZYME A THIOESTER HYDROLASE 2 (PEROXISOMAL LONG-CHAIN ACYL-COA THIOESTERASE 2) (ZAP128) [*H. sapiens*], ESTs, Moderately similar to JE0267 long-chain fatty-acyl-CoA hydrolase (EC 3.1.2 - ) peroxisome proliferator-inducible - rat [*R. norvegicus*], ESTs, Moderately similar to PTE2_HUMAN PEROXISOMAL ACYL-COENZYME A THIOESTER HYDROLASE 2 (PEROXISOMAL LONG-CHAIN ACYL-COA THIOESTERASE 2) (ZAP128) [*H. sapiens*], ESTs, Weakly similar to PTE2_HUMAN PEROXISOMAL ACYL-COENZYME A THIOESTER HYDROLASE 2 (PEROXISOMAL LONG-CHAIN ACYL-COA THIOESTERASE 2) (ZAP128) |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 1894 | 15663 | NM_031318 | General | | [*H. sapiens*], ESTs, Weakly similar to YZ28_HUMAN HYPOTHETICAL PROTEIN ZAP128 [*H. sapiens*], *Mus musculus*, Similar to cytosolic acyl-CoA thioesterase 1, clone MGC: 27572 IMAGE. 4485973, mRNA, complete cds, RIKEN cDNA 4632408A20 gene, cytosolic acyl-CoA thioesterase 1, expressed sequence AW108394, peroxisomal long-chain acyl-coA t-complex testis expressed 1, t-complex-associated-testis-expressed 1 like 1 |
| 1895 | 1422 | NM_031324 | bb, General | | ESTs, Moderately similar to I38134 prolyl oligopeptidase [*H. sapiens*], prolyl endopeptidase |
| 1896 | 18597 | NM_031325 | g, bb | | UDP-glucose dehydrogenase |
| 1897 | 11259 | NM_031327 | i, cc, General | | ESTs, Moderately similar to CYR6 MOUSE CYR61 PROTEIN PRECURSOR [*M. musculus*], cysteine rich protein 61, cysteine-rich, angiogenic inducer, 61 |
| 1898 | 4235 | NM_031330 | General | heterogeneous nuclear ribonucleoprotein A/B | ESTs, Highly similar to WZHURS argininosuccinate lyase [*H. sapiens*], ESTs, Weakly similar to 1601424A argininosuccinate lyase [*R. norvegicus*], *Homo sapiens* cDNA FLJ14312 fis, clone PLACE3000322, Musashi-1 homolog (Drosophila), RIKEN cDNA 2510006M18 gene, RIKEN cDNA 4933434H11 gene, argininosuccinate lyase, heterogeneous nuclear ribonucleoprotein A/B, heterogeneous nuclear ribonucleoprotein D-like |
| 1899 | 18375 | NM_031331 | l, m | | EST, Weakly similar to PSD4_HUMAN 26S PROTEASOME REGULATORY SUBUNIT S5A [*H. sapiens*], ESTs, Moderately similar to PSD4_HUMAN 26S PROTEASOME REGULATORY SUBUNIT S5A [*H. sapiens*], proteasome (prosome, macropain) 26S subunit, non-ATPase, 4 |
| 1900 | 3519 | NM_031334 | cc | cadherin 1, cadherin 1, type 1, E-cadherin (epithelial) | ESTs, Weakly similar to I49556 cadherin-11 - mouse [*M. musculus*], RIKEN cDNA 2610005L07 gene, cadherin 1, type 1, E-cadherin (epithelial), cadherin 6, cadherin 6, type 2, K-cadherin (fetal kidney) |
| 1901 | 20698 | NM_031357 | b | | |
| 1903 | 634 | NM_031509 | n | | EST, Moderately similar to GTC MOUSE GLUTATHIONE S-TRANSFERASE YC [*M. musculus*], glutathione S-transferase A3, glutathione S-transferase, alpha 3 |
| 1903 | 25525 | NM_031509 | n | | |
| 1903 | 25069 | NM_031509 | b, n, w | | |
| 1903 | 635 | NM_031509 | z | | EST, Moderately similar to GTC MOUSE GLUTATHIONE S-TRANSFERASE YC [*M. musculus*], glutathione S-transferase A3, glutathione S-transferase, alpha 3 |
| 1904 | 848 | NM_031517 | t | met proto-oncogene, met proto-oncogene (hepatocyte growth factor receptor) | EST, Highly similar to RON_HUMAN MACROPHAGE-STIMULATING PROTEIN RECEPTOR PRECURSOR [*H. sapiens*], ESTs, Highly similar to TVHUME hepatocyte growth factor receptor precursor [*H. sapiens*], *Mus musculus* D86 mRNA, complete cds, *Rattus norvegicus* ryk mRNA for tyrosine kinase-related protein, partial cds, macrophage stimulating 1 receptor (c-met-related tyrosine |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 1905 | 1872 | NM_031523 | a | | kinase), met proto-oncogene, met proto-oncogene (hepatocyte growth factor receptor) RIKEN cDNA 0610007D04 gene, kallikrein 1, renal/pancreas/salivary, kallikrein 5, kallikrein 9, nerve growth factor, alpha, nerve growth factor, gamma |
| 1905 | 16245 | NM_031523 | a, d, u | | EST, Moderately similar to epidermal growth factor binding protein type 1 [*M. musculus*], EST, Weakly similar to pre-pro-protein for kallikrein [*H. sapiens*] |
| 1905 | 16244 | NM_031523 | a | | EST, Moderately similar to epidermal growth factor binding protein type 1 [*M. musculus*], EST, Weakly similar to pre-pro-protein for kallikrein [*H. sapiens*] |
| 1906 | 9370 | NM_031527 | w | protein phosphatase 1, catalytic subunit, alpha isoform | EST, Weakly similar to JN0723 phosphoprotein phosphatase [*H. sapiens*], protein phosphatase 1, catalytic subunit, alpha isoform |
| 1907 | 20448 | NM_031530 | General | small inducible cytokine A2, small inducible cytokine A2 (monocyte chemotactic protein 1, homologous to mouse Sigje) | EST, Weakly similar to SY02 RAT SMALL INDUCIBLE CYTOKINE A2 PRECURSOR [*R. norvegicus*], expressed sequence AI323594, expressed sequence AW987545, small inducible cytokine A2, small inducible cytokine A24, small inducible cytokine A7 (monocyte chemotactic protein 3), small inducible cytokine subfamily A (Cys-Cys), member 17 |
| 1907 | 20449 | NM_031530 | General | small inducible cytokine A2, small inducible cytokine A2 (monocyte chemotactic protein 1, homologous to mouse Sigje) | EST, Weakly similar to SY02 RAT SMALL INDUCIBLE CYTOKINE A2 PRECURSOR [*R. norvegicus*], expressed sequence AI323594, expressed sequence AW987545, small inducible cytokine A2, small inducible cytokine A24, small inducible cytokine A7 (monocyte chemotactic protein 3), small inducible cytokine subfamily A (Cys-Cys), member 17 |
| 1908 | 14633 | NM_031533 | u | | ESTs, Moderately similar to UDP-GLUCURONOSYLTRANSFERASE 2B5 PRECURSOR, MICROSOMAL [*M. musculus*], ESTs, Weakly similar to UDB7_HUMAN UDP-GLUCURONOSYLTRANSFERASE 2B7 PRECURSOR, MICROSOMAL [*H. sapiens*], ESTs, Weakly similar to UDBH_HUMAN UDP-GLUCURONOSYLTRANSFERASE 2B17 PRECURSOR, MICROSOMAL [*H. sapiens*], RIKEN cDNA 0610033E06 gene, UDP glycosyltransferase 2 family, polypeptide B17, UDP-glucuronosyltransferase 2 family, member 5, expressed sequence AA986709 |
| 1909 | 16048 | NM_031541 | f | CD36 antigen (collagen type I receptor, thrombospondin receptor)-like 1, scavenger receptor class B1 | CD36 antigen (collagen type I receptor, thrombospondin receptor)-like 1, CD36 antigen (collagen type I receptor, thrombospondin receptor)-like 2, ESTs, Weakly similar to JC5533 scavenger receptor class B type I precursor - rat [*R. norvegicus*], *Homo sapiens* scavenger receptor class B type III SR-BIII mRNA, partial cds, scavenger receptor class B1 |
| 1910 | 4011 | NM_031543 | c, q | cytochrome P450, 2e1, ethanol inducible, cytochrome P450, | cytochrome P450, 2e1, ethanol inducible, cytochrome P450, subfamily IIE (ethanol-inducible) |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 1910 | 4010 | NM_031543 | c, q | cytochrome P450, 2e1, ethanol inducible, cytochrome P450, subfamily IIE (ethanol-inducible) | cytochrome P450, 2e1, ethanol inducible, cytochrome P450, subfamily IIE (ethanol-inducible) |
| 1910 | 4012 | NM_031543 | q | cytochrome P450, 2e1, ethanol inducible, cytochrome P450, subfamily IIE (ethanol-inducible) | cytochrome P450, 2e1, ethanol inducible, cytochrome P450, subfamily IIE (ethanol-inducible) |
| 1911 | 28 | NM_031546 | General | regucalcin, regucalcin (senescence marker protein-30) | regucalcin, regucalcin (senescence marker protein-30) |
| 1912 | 24640 | NM_031548 | h, cc | sodium channel, nonvoltage-gated 1 alpha, sodium channel, nonvoltage-gated, type I, alpha polypeptide | expressed sequence AW742291, sodium channel, nonvoltage-gated 1 alpha, sodium channel, nonvoltage-gated 1, delta, sodium channel, nonvoltage-gated, type I, alpha polypeptide |
| 1913 | 17149 | NM_031549 | x | transgelin | transgelin |
| 1913 | 17151 | NM_031549 | x | transgelin | transgelin |
| 1914 | 13105 | NM_031552 | w | adducin 3 (gamma) | ESTs, Moderately similar to ADDG_MOUSE GAMMA ADDUCIN (ADDUCIN-LIKE PROTEIN 70) [*M. musculus*], adducin 3 (gamma) |
| 1915 | 15411 | NM_031559 | d, r | carnitine palmitoyltransferase 1, liver, carnitine palmitoyltransferase I, liver | ESTs, Weakly similar to CPT1 MOUSE CARNITINE O-PALMITOYLTRANSFERASE I, MITOCHONDRIAL LIVER ISOFORM [*M. musculus*], ESTs, Weakly similar to I59351 carnitine O-palmitoyltransferase [*H. sapiens*], ESTs, Weakly similar to MITOCHONDRIAL CARNITINE O-PALMITOYLTRANSFERASE I, LIVER ISOFORM [*R. norvegicus*], carnitine palmitoyltransferase 1, liver, carnitine palmitoyltransferase 1, muscle, carnitine palmitoyltransferase I, liver |
| 1916 | 16164 | NM_031563 | a, y | Y box protein 1, nuclease sensitive element binding protein 1 | ESTs, Highly similar to I39382 Y box-binding protein 1 - human [*H. sapiens*], RIKEN cDNA 1700102N10 gene |
| 1917 | 9621 | NM_031570 | bb | ribosomal protein S7 | EST, Moderately similar to 40S RIBOSOMAL PROTEIN S7 [*R. norvegicus*], EST, Weakly similar to 40S RIBOSOMAL PROTEIN S7 [*R. norvegicus*], EST, Weakly similar to RS7_HUMAN 40S RIBOSOMAL PROTEIN S7 [*M. musculus*], ESTs, Highly similar to JC4388 ribosomal protein S7, cytosolic [*H. sapiens*], ESTs, Highly similar to RS7_HUMAN 40S RIBOSOMAL PROTEIN S7 [*H. sapiens*], nuclear factor of kappa light polypeptide gene enhancer in B-cells inhibitor-like 2, ribosomal protein S7 |
| 1917 | 9620 | NM_031570 | w, bb | ribosomal protein S7 | EST, Moderately similar to 40S RIBOSOMAL PROTEIN S7 [*R. norvegicus*], EST, Weakly similar to 40S RIBOSOMAL PROTEIN S7 [*R. norvegicus*], EST, Weakly similar to RS7_HUMAN 40S RIBOSOMAL PROTEIN S7 [*M. musculus*], ESTs, Highly similar to JC4388 ribosomal protein S7, cytosolic [*H. sapiens*], ESTs, Highly similar to RS7_HUMAN 40S RIBOSOMAL PROTEIN S7 [*H. sapiens*], nuclear factor of kappa light polypeptide gene enhancer in B- |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| | | | | | cells inhibitor-like 2, ribosomal protein S7 |
| 1918 | 546 | NM_031573 | f | phosphorylase kinase gamma, phosphorylase kinase, gamma 1 (muscle) | ESTs, Moderately similar to KPBG_HUMAN PHOSPHORYLASE B KINASE GAMMA CATALYTIC CHAIN, SKELETAL MUSCLE ISOFORM [H. sapiens], ESTs, Moderately similar to PHOSPHORYLASE B KINASE GAMMA CATALYTIC CHAIN, SKELETAL MUSCLE ISOFORM [R. norvegicus], RIKEN cDNA 1500017I02 gene, endoplasmic reticulum (ER) to nucleus signalling 2, phosphorylase kinase gamma, phosphorylase kinase, gamma 1 (muscle) |
| 1919 | 1921 | NM_031576 | f | P450 (cytochrome) oxidoreductase | ESTs, Highly similar to A Chain A, Crystal Structure Of The Fmn-Binding Domain Of Human Cytochrome P450 Reductase At 1 93a Resolution {SUB 61-241 [H. sapiens], NADPH-dependent FMN and FAD containing oxidoreductase, P450 (cytochrome) oxidoreductase, RIKEN cDNA 4930447P04 gene, hypothetical protein FLJ10900 |
| 1919 | 1920 | NM_031576 | r | P450 (cytochrome) oxidoreductase | ESTs, Highly similar to A Chain A, Crystal Structure Of The Fmn-Binding Domain Of Human Cytochrome P450 Reductase At 1.93a Resolution {SUB 61-241 [H. sapiens], NADPH-dependent FMN and FAD containing oxidoreductase, P450 (cytochrome) oxidoreductase, RIKEN cDNA 4930447P04 gene, hypothetical protein FLJ10900 |
| 1920 | 24219 | NM_031579 | i, General | protein tyrosine phosphatase 4a1, protein tyrosine phosphatase type IVA, member 1 | protein tyrosine phosphatase 4a1, protein tyrosine phosphatase 4a2, protein tyrosine phosphatase type IVA, member 1, protein tyrosine phosphatase type IVA, member 2, protein tyrosine phosphatase type IVA, member 3 |
| 1921 | 770 | NM_031584 | k, x | solute carrier family 22 (organic cation transporter), member 2 | EST, Moderately similar to JC4884 organic cation transporter protein 2 - rat [R. norvegicus], EST, Weakly similar to OCN2 MOUSE ORGANIC CATION/CARNITINE TRANSPORTER 2 [M. musculus], ESTs, Highly similar to OCN2_HUMAN ORGANIC CATION/CARNITINE TRANSPORTER 2 [H. sapiens], ESTs, Highly similar to organic cation transporter [H. sapiens], organic cationic transporter-like 1, solute carrier family 22 (organic cation transporter), member 1, solute carrier family 22 (organic cation transporter), member 4, solute carrier family 22 (organic cation transporter), member 5, solute carrier family 22 (organic cation transporter), member 9, solute carrier family 22, member 3 |
| 1922 | 18008 | NM_031588 | cc | | ESTs, Highly similar to NRG2_MOUSE PRO-NEUREGULIN-2 PRECURSOR (PRO-NRG2) [CONTAINS: NEUREGULIN-2 (NRG-2) (DIVERGENT OF NEUREGULIN 1) (DON-1)] [M. musculus], ESTs, Weakly similar to NRG2_MOUSE PRO-NEUREGULIN-2 PRECURSOR (PRO-NRG2) [CONTAINS: NEUREGULIN-2 (NRG-2) (DIVERGENT OF |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 1922 | 18005 | NM_031588 | h | | NEUREGULIN 1) (DON-1)] [*M. musculus*], neuregulin 1 ESTs, Highly similar to NRG2_MOUSE PRO-NEUREGULIN-2 PRECURSOR (PRO-NRG2) [CONTAINS NEUREGULIN-2 (NRG-2) (DIVERGENT OF NEUREGULIN 1) (DON-1)] [*M. musculus*], ESTs, Weakly similar to NRG2_MOUSE PRO-NEUREGULIN-2 PRECURSOR (PRO-NRG2) [CONTAINS: NEUREGULIN-2 (NRG-2) (DIVERGENT OF NEUREGULIN 1) (DON-1)] [*M. musculus*], neuregulin 1 |
| 1922 | 18011 | NM_031588 | cc, General | | ESTs, Highly similar to NRG2_MOUSE PRO-NEUREGULIN-2 PRECURSOR (PRO-NRG2) [CONTAINS: NEUREGULIN-2 (NRG-2) (DIVERGENT OF NEUREGULIN 1) (DON-1)] [*M. musculus*], ESTs, Weakly similar to NRG2_MOUSE PRO-NEUREGULIN-2 PRECURSOR (PRO-NRG2) [CONTAINS: NEUREGULIN-2 (NRG-2) (DIVERGENT OF NEUREGULIN 1) (DON-1)] [*M. musculus*], neuregulin 1 |
| 1923 | 1584 | NM_031595 | k | proteasome (prosome, macropain) 26S subunit, ATPase 3, proteasome (prosome, macropain) 26S subunit, ATPase, 3 | EST, Moderately similar to PRSA RAT 26S PROTEASE REGULATORY SUBUNIT 6A [*R. norvegicus*], EST, Weakly similar to PRS4 MOUSE 26S PROTEASE REGULATORY SUBUNIT 4 [*M. musculus*], EST, Weakly similar to PRSA RAT 26S PROTEASE REGULATORY SUBUNIT 6A [*R. norvegicus*], ESTs, Moderately similar to PRSA RAT 26S PROTEASE REGULATORY SUBUNIT 6A [*R. norvegicus*], expressed sequence AI325227, protease (prosome, macropain) 26S subunit, ATPase 1, proteasome (prosome, macropain) 26S subunit, ATPase 3, proteasome (prosome, macropain) 26S subunit, ATPase, 3 |
| 1924 | 24235 | NM_031614 | v | thioredoxin reductase 1 | *Mus musculus* adult male small intestine cDNA, RIKEN full-length enriched library, clone 2010001F03, full insert sequence, glutathione reductase 1, thioredoxin reductase 1, thioredoxin reductase 2, thioredoxin reductase beta |
| 1924 | 24234 | NM_031614 | General | thioredoxin reductase 1 | *Mus musculus* adult male small intestine cDNA, RIKEN full-length enriched library, clone: 2010001F03, full insert sequence, glutathione reductase 1, thioredoxin reductase 1, thioredoxin reductase 2, thioredoxin reductase beta |
| 1925 | 1639 | NM_031627 | j, l, v | nuclear receptor subfamily 1, group H, member 3 | EST, Moderately similar to A56043 steroid hormone receptor-like protein RLD-1 - rat [*R. norvegicus*], expressed sequence AU018371, nuclear receptor subfamily 1, group H, member 3, nuclear receptor subfamily 1, group H, member 4 |
| 1926 | 1727 | NM_031642 | m, General | core promoter element binding protein | EST, Moderately similar to CPBP RAT CORE PROMOTER ELEMENT-BINDING PROTEIN [*R. norvegicus*], ESTs, Moderately similar to CPBP RAT CORE PROMOTER ELEMENT-BINDING PROTEIN [*R. norvegicus*], Kruppel-like factor 3 (basic), Kruppel-like factor 5, Kruppel-like factor 7 |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 1927 | 20766 | NM_031643 | y | mitogen activated protein kinase kinase 2, mitogen-activated protein kinase kinase 2 | (ubiquitous), core promoter element binding protein ESTs, Highly similar to MPK1 MOUSE DUAL SPECIFICITY MITOGEN-ACTIVATED PROTEIN KINASE KINASE 1 [*M. musculus*], ESTs, Moderately similar to MPK1_HUMAN DUAL SPECIFICITY MITOGEN-ACTIVATED PROTEIN KINASE KINASE 1 [*H. sapiens*], *Mus musculus* 12 days embryo head cDNA, RIKEN full-length enriched library, clone: 3000002B10, full insert sequence, mitogen activated protein kinase kinase 1, mitogen activated protein kinase kinase 3, mitogen activated protein kinase kinase 7, mitogen-activated protein kinase kinase 1, mitogen-activated protein kinase kinase 7 |
| 1929 | 1993 | NM_031655 | k, l, m, General | latexin, latexin protein | latexin, latexin protein, retinoic acid receptor responder (tazarotene induced) 1 |
| 1930 | 2057 | NM_031660 | e | | Human DNA sequence from clone RP5-822J19 on chromosome 20 Contains an alpha-endosulfine pseudogene, STSs and GSSs, cyclic AMP phosphoprotein, 19 kD, cyclic AMP phosphoprotein, 19 kD, endosulfine alpha |
| 1931 | 15039 | NM_031672 | k, General | solute carrier family 15 (H+/peptide transporter), member 2 | EST, Moderately similar to PET2 RAT OLIGOPEPTIDE TRANSPORTER, KIDNEY ISOFORM. [*R. norvegicus*], EST, Moderately similar to PET2_HUMAN OLIGOPEPTIDE TRANSPORTER, KIDNEY ISOFORM [*H. sapiens*], expressed sequence C78862, solute carrier family 15 (H+/peptide transporter), member 2 |
| 1932 | 15175 | NM_031682 | bb | | 2-4-dienoyl-Coenzyme A reductase 2, peroxisomal, ESTs, Weakly similar to HCD2 RAT 3-HYDROXYACYL-COA DEHYDROGENASE TYPE II [*R. norvegicus*], H2-K region expressed gene 6, hydroxyacyl-Coenzyme A dehydrogenase, type II, hydroxyprostaglandin dehydrogenase 15 (NAD), hydroxysteroid (17-beta) dehydrogenase 10, hypothetical protein FLJ14431, retinal short-chain dehydrogenase/reductase retSDR3 |
| 1933 | 1004 | NM_031685 | v | golgi SNAP receptor complex member 2 | golgi SNAP receptor complex member 2 |
| 1934 | 19727 | NM_031687 | a, q, s | ubiquitin A-52 residue ribosomal protein fusion product 1 | EST, Moderately similar to I65237 ubiquitin/ribosomal protein L40 - rat [*R. norvegicus*], *Homo sapiens* ubiquitin-like fusion protein mRNA, complete cds, RIKEN cDNA 0610006J14 gene, *Rattus norvegicus* RSD-7 mRNA, complete cds, ubiquitin A-52 residue ribosomal protein fusion product 1 |
| 1935 | 20404 | NM_031700 | j, r, y | claudin 3 | ESTs, Weakly similar to A39484 androgen-withdrawal apoptosis protein RVP1, prostatic - rat [*R. norvegicus*], claudin 12, claudin 3, expressed sequence AI182374 |
| 1935 | 20405 | NM_031700 | o, r | claudin 3 | ESTs, Weakly similar to A39484 androgen-withdrawal apoptosis protein RVP1, prostatic - rat [*R. norvegicus*], claudin 12, claudin 3, expressed sequence AI182374 |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 1936 | 811 | NM_031705 | General | dihydropyrimidinase | PRO0195 protein, collapsin response mediator protein 5, collapsin response mediator protein-5; CRMP3-associated molecule, dihydropyrimidinase, dihydropyrimidinase-like 2, dihydropyrimidinase-related protein |
| 1936 | 812 | NM_031705 | o, v, bb, General | dihydropyrimidinase | PRO0195 protein, collapsin response mediator protein 5, collapsin response mediator protein-5, CRMP3-associated molecule, dihydropyrimidinase, dihydropyrimidinase-like 2, dihydropyrimidinase-related protein |
| 1937 | 16204 | NM_031706 | q, bb | | EST, Moderately similar to RS8_HUMAN 40S RIBOSOMAL PROTEIN S [*H. sapiens*], EST, Weakly similar to 40S RIBOSOMAL PROTEIN S8 [*M. musculus*], EST, Weakly similar to 40S RIBOSOMAL PROTEIN S8 [*R. norvegicus*], ESTs, Moderately similar to RS8_HUMAN 40S RIBOSOMAL PROTEIN S [*H. sapiens*], RIKEN cDNA 1110008P08 gene, ribosomal protein S8 |
| 1937 | 16205 | NM_031706 | a, y | | EST, Moderately similar to RS8_HUMAN 40S RIBOSOMAL PROTEIN S [*H. sapiens*], EST, Weakly similar to 40S RIBOSOMAL PROTEIN S8 [*M. musculus*], EST, Weakly similar to 40S RIBOSOMAL PROTEIN S8 [*R. norvegicus*], ESTs, Moderately similar to RS8_HUMAN 40S RIBOSOMAL PROTEIN S [*H. sapiens*], RIKEN cDNA 1110008P08 gene, ribosomal protein S8 |
| 1938 | 24081 | NM_031708 | m | | ESTs, Weakly similar to G100_HUMAN 110 KDA CELL MEMBRANE GLYCOPROTEIN [*H. sapiens*], cell membrane glycoprotein, 110000M(r) (surface antigen) |
| 1939 | 16918 | NM_031709 | a, q | | ESTs, Highly similar to R3HU12 ribosomal protein S12, cytosolic [*H. sapiens*], mitochondrial ribosomal protein L50, ribosomal protein S12 |
| 1940 | 1081 | NM_031712 | General | PDZ domain containing 1 | ESTs, Weakly similar to T30259 multiple PDZ domain protein - mouse [*M. musculus*], ESTs, Weakly similar to T46612 multi PDZ domain protein 1 - rat [*R. norvegicus*], PDZ domain containing 1, channel-interacting PDZ domain protein, hypothetical protein FLJ22756, multiple PDZ domain protein, semaF cytoplasmic domain associated protein 3, solute carrier family 9 (sodium/hydrogen exchanger), isoform 3 regulatory factor 1, solute carrier family 9 (sodium/hydrogen exchanger), isoform 3 regulatory factor 2, syntaxin binding protein 4 |
| 1941 | 1340 | NM_031715 | b, n, u, cc, General | phosphofructokinase, muscle | ESTs, Highly similar to S71429 phosphofructokinase, muscle - rat [*R. norvegicus*], *Mus musculus* adult male stomach cDNA, RIKEN full-length enriched library, clone.2210403E17, full insert sequence, expressed sequence AA407869, phosphofructokinase, liver, B-type, phosphofructokinase, muscle |
| 1942 | 23884 | NM_031731 | j, s | aldehyde dehydrogenase 3 family, member A2, aldehyde dehydrogenase family 3, subfamily A2 | ESTs, Weakly similar to DHA4 RAT FATTY ALDEHYDE DEHYDROGENASE [*R. norvegicus*], RIKEN cDNA 1700001N19 gene, RIKEN cDNA 1700055N04 gene, |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 1943 | 10241 | NM_031740 | d | UDP-Gal: betaGlcNAc beta 1,4-galactosyltransferase, polypeptide 6, UDP-Gal.betaGlcNAc beta 1,4-galactosyltransferase, polypeptide 6 | aldehyde dehydrogenase 3 family, member A2, aldehyde dehydrogenase family 3, subfamily A2, expressed sequence AI848594 ESTs, Highly similar to N-ACETYLLACTOSAMINE SYNTHASE [*M. musculus*], UDP-Gal.betaGlcNAc beta 1,4-galactosyltransferase, polypeptide 1, UDP-Gal: betaGlcNAc beta 1,4-galactosyltransferase, polypeptide 2, UDP-Gal: betaGlcNAc beta 1,4-galactosyltransferase, polypeptide 3, UDP-Gal.betaGlcNAc beta 1,4-galactosyltransferase, polypeptide 4, UDP-Gal: betaGlcNAc beta 1,4-galactosyltransferase, polypeptide 5, UDP-Gal.betaGlcNAc beta 1,4-galactosyltransferase, polypeptide 6, UDP-Gal: betaGlcNAc beta 1,4-galactosyltransferase, polypeptide 3 |
| 1944 | 1214 | NM_031741 | r | solute carrier family 2 (facilitated glucose transporter), member 5, solute carrier family 2 (facilitated glucose/fructose transporter), member 5 | *Mus musculus*, clone MGC: 8298 IMAGE: 3593581, mRNA, complete cds, glucose transporter protein 11, solute carrier family 2 (facilitated glucose transporter), member 5, solute carrier family 2 (facilitated glucose transporter), member 9, solute carrier family 2 (facilitated glucose/fructose transporter), member 5 |
| 1944 | 1215 | NM_031741 | r | solute carrier family 2 (facilitated glucose transporter), member 5, solute carrier family 2 (facilitated glucose/fructose transporter), member 5 | *Mus musculus*, clone MGC: 8298 IMAGE: 3593581, mRNA, complete cds, glucose transporter protein 11, solute carrier family 2 (facilitated glucose transporter), member 5, solute carrier family 2 (facilitated glucose transporter), member 9, solute carrier family 2 (facilitated glucose/fructose transporter), member 5 |
| 1945 | 20724 | NM_031753 | h | | ESTs, Highly similar to C166_HUMAN CD166 ANTIGEN PRECURSOR [*H. sapiens*], Lutheran blood group (Auberger b antigen included), activated leucocyte cell adhesion molecule, activated leukocyte cell adhesion molecule, advanced glycosylation end product-specific receptor, melanoma cell adhesion molecule |
| 1946 | 20753 | NM_031763 | h | | EST, Weakly similar to LIS1 MOUSE PLATELET-ACTIVATING FACTOR ACETYLHYDROLASE IB ALPHA SUBUNIT [*R. norvegicus*], ESTs, Weakly similar to LIS1 MOUSE PLATELET-ACTIVATING FACTOR ACETYLHYDROLASE IB ALPHA SUBUNIT [*R. norvegicus*], ESTs, Weakly similar to LIS1_HUMAN PLATELET-ACTIVATING FACTOR ACETYLHYDROLASE IB ALPHA SUBUNIT [*H. sapiens*], F-box protein FBW7, KIAA0007 protein, U3 snoRNP-associated 55-kDa protein, f-box and WD-40 domain protein 2, platelet-activating factor acetylhydrolase, isoform 1b, beta1 subunit, platelet-activating factor acetylhydrolase, isoform 1b, alpha subunit (45 kD) |
| 1946 | 20752 | NM_031763 | y | | EST, Weakly similar to LIS1 MOUSE PLATELET-ACTIVATING FACTOR ACETYLHYDROLASE IB ALPHA SUBUNIT [*R. norvegicus*], ESTs, Weakly similar to LIS1 MOUSE |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| | | | | | PLATELET-ACTIVATING FACTOR ACETYLHYDROLASE IB ALPHA SUBUNIT [*R. norvegicus*], ESTs, Weakly similar to LIS1_HUMAN PLATELET-ACTIVATING FACTOR ACETYLHYDROLASE IB ALPHA SUBUNIT [*H. sapiens*], F-box protein FBW7, KIAA0007 protein, U3 snoRNP-associated 55-kDa protein, f-box and WD-40 domain protein 2, platelet-activating factor acetylhydrolase, isoform 1b, beta1 subunit, platelet-activating factor acetylhydrolase, isoform lb, alpha subunit (45 kD) |
| 1947 | 14953 | NM_031774 | p | Rab acceptor 1 (prenylated) | |
| 1948 | 14184 | NM_031776 | t, General | | guanine deaminase |
| 1948 | 14185 | NM_031776 | d, o, t, General | | guanine deaminase |
| 1949 | 1169 | NM_031789 | c | | ESTs, Highly similar to NFL2 RAT NUCLEAR FACTOR ERYTHROID 2 RELATED FACTOR 2 [*R. norvegicus*], ESTs, Weakly similar to NFL2 RAT NUCLEAR FACTOR ERYTHROID 2 RELATED FACTOR 2 [*R. norvegicus*], nuclear factor (erythroid-derived 2)-like 2, nuclear, factor, erythroid derived 2, like 2 |
| 1950 | 16155 | NM_031810 | d, z | | defensin beta 1, defensin beta 2, defensin, beta 1 |
| 1950 | 16156 | NM_031810 | d | | defensin beta 1, defensin beta 2, defensin, beta 1 |
| 1951 | 17194 | NM_031814 | z | G protein-coupled receptor kinase-interactor 1 | EST, Weakly similar to T42627 ADP-ribosylation factor-directed GTPase activating protein, isoform a - mouse [*M. musculus*], ESTs, Highly similar to T42627 ADP-ribosylation factor-directed GTPase activating protein, isoform a - mouse [*M. musculus*], G protein-coupled receptor kinase-interactor 1, G protein-coupled receptor kinase-interactor 2, *Homo sapiens* p95 paxillin-kinase linker mRNA, complete cds, RIKEN cDNA 1700030C10 gene, development and differentiation enhancing |
| 1952 | 17535 | NM_031816 | bb | | ESTs, Weakly similar to GBLP_HUMAN GUANINE NUCLEOTIDE-BINDING PROTEIN BETA SUBUNIT-LIKE PROTEIN 12.3 [*R. norvegicus*], *Homo sapiens* cDNA FLJ21913 fis, clone HEP03888, *Homo sapiens*, clone IMAGE 3502107, mRNA, partial cds, RAE1 (RNA export 1, *S. pombe*) homolog, WD repeat domain 10, expressed sequence AI173248, expressed sequence AI504353, guanine nucleotide binding protein (G protein), beta polypeptide 2-like 1, guanine nucleotide binding protein, beta 2, related sequence 1, retinoblastoma binding protein 7, retinoblastoma-binding protein 7, transducin (beta)-like 2 |
| 1953 | 2655 | NM_031821 | i, l, m, aa | serum-inducible kinase | ESTs, Highly similar to A57286 probable serine/threonine protein kinase [*M. musculus*], ESTs, Highly similar to SNK_RAT SERINE/THREONINE-PROTEIN KINASE SNK (SERUM INDUCIBLE KINASE) [*R. norvegicus*], ESTs, Weakly similar to SNK_RAT SERINE/THREONINE-PROTEIN KINASE SNK (SERUM INDUCIBLE |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 1954 | 10167 | NM_031830 | i | | KINASE) [*R. norvegicus*], cytokine-inducible kinase, serine/threonine kinase 18, serum-inducible kinase, tousled-like kinase 2 (Arabidopsis) flotillin 1, flotillin 2 |
| 1955 | 22321 | NM_031832 | o, t, u, General | lectin, galactose binding, soluble 3, lectin, galactoside-binding, soluble, 3 (galectin 3) | EST, Weakly similar to X-Ray Crystal Structure Of The Human Galectin-3 Carbohydrate Recognition Domain [*H. sapiens*], galectin-related inter-fiber protein |
| 1956 | 4748 | NM_031834 | e, t | | expressed sequence AI266890, expressed sequence AI853643, sulfotransferase family 1A, phenol-preferring, member 1, sulfotransferase family 4A, member 1, sulfotransferase family, cytosolic, 1A, phenol-preferring, member 1, sulfotransferase family, cytosolic, 1A, phenol-preferring, member 2, sulfotransferase family, cytosolic, 1A, phenol-preferring, member 3 |
| 1956 | 4749 | NM_031834 | e, t | | expressed sequence AI266890, expressed sequence AI853643, sulfotransferase family 1A, phenol-preferring, member 1, sulfotransferase family 4A, member 1, sulfotransferase family, cytosolic, 1A, phenol-preferring, member 1, sulfotransferase family, cytosolic, 1A, phenol-preferring, member 2, sulfotransferase family, cytosolic, 1A, phenol-preferring, member 3 |
| 1957 | 7914 | NM_031835 | e | | ESTs, Weakly similar to AGT2 RAT ALANINE - GLYOXYLATE AMINOTRANSFERASE 2 PRECURSOR [*R. norvegicus*], RIKEN cDNA 1300019H02 gene, RIKEN cDNA 2900006B13 gene, alanine-glyoxylate aminotransferase 2, alanine glyoxylate aminotransferase 2-like 1, ornithine aminotransferase |
| 1958 | 8385 | NM_031836 | h | | c-fos induced growth factor (vascular endothelial growth factor D), vascular endothelial growth factor, vascular endothelial growth factor B |
| 1958 | 8384 | NM_031836 | h | | c-fos induced growth factor (vascular endothelial growth factor D), vascular endothelial growth factor, vascular endothelial growth factor B |
| 1959 | 10268 | NM_031838 | a | | EST, Highly similar to 40S RIBOSOMAL PROTEIN S2 [*M. musculus*], EST, Highly similar to 40S RIBOSOMAL PROTEIN S2 [*R. norvegicus*], EST, Moderately similar to S08228 ribosomal protein S2, cytosolic [*H. sapiens*], EST, Weakly similar to S08228 ribosomal protein S2, cytosolic [*H. sapiens*], ESTs, Highly similar to RS2_HUMAN 40S RIBOSOMAL PROTEIN S2 [*H. sapiens*], ESTs, Moderately similar to 40S RIBOSOMAL PROTEIN S2 [*M. musculus*], repeat family 3 gene, ribosomal protein S2 |
| 1959 | 10269 | NM_031838 | aa | | EST, Highly similar to 40S RIBOSOMAL PROTEIN S2 [*M. musculus*], EST, Highly similar to 40S RIBOSOMAL PROTEIN S2 [*R. norvegicus*], EST, Moderately similar to S08228 ribosomal protein S2, cytosolic [*H. sapiens*], EST, Weakly similar to S08228 ribosomal protein S2, cytosolic [*H. sapiens*], ESTs, Highly |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 1959 | 10267 | NM_031838 | n, aa | | similar to RS2_HUMAN 40S RIBOSOMAL PROTEIN S2 [*H. sapiens*], ESTs, Moderately similar to 40S RIBOSOMAL PROTEIN S2 [*M. musculus*], repeat family 3 gene, ribosomal protein S2 EST, Highly similar to 40S RIBOSOMAL PROTEIN S2 [*M. musculus*], EST, Highly similar to 40S RIBOSOMAL PROTEIN S2 [*R. norvegicus*], EST, Moderately similar to S08228 ribosomal protein S2, cytosolic [*H. sapiens*], EST, Weakly similar to S08228 ribosomal protein S2, cytosolic [*H. sapiens*], ESTs, Highly similar to RS2_HUMAN 40S RIBOSOMAL PROTEIN S2 [*H. sapiens*], ESTs, Moderately similar to 40S RIBOSOMAL PROTEIN S2 [*M. musculus*], repeat family 3 gene, ribosomal protein S2 |
| 1960 | 15077 | NM_031841 | b | | expressed sequence AU022220, hypothetical protein FLJ21032, stearoyl-CoA desaturase (delta-9-desaturase), stearoyl-Coenzyme A desaturase 1, stearoyl-Coenzyme A desaturase 2, stearoyl-coenzyme A desaturase 3 |
| 1961 | 16726 | NM_031855 | x | ketohexokinase, ketohexokinase (fructokinase) | ketohexokinase, ketohexokinase (fructokinase) |
| 1962 | 25802 | NM_031969 | a | calmodulin 1, calmodulin 1 (phosphorylase kinase, delta) | |
| 1962 | 19191 | NM_031969 | c | calmodulin 1, calmodulin 1 (phosphorylase kinase, delta) | Calmodulin III, ESTs, Highly similar to A Chain A, Calmodulin Complexed With Calmodulin-Binding Peptide From Smooth Muscle Myosin Light Chain Kinase {SUB 2-148 [*H. sapiens*], *R. norvegicus* CaMII retropseudogene (clone lambda SC27), RIKEN cDNA 2310068O22 gene, calmodulin, calmodulin 1, calmodulin 1 (phosphorylase kinase, delta), calmodulin 2, calmodulin 2 (phosphorylase kinase, delta), calmodulin 3, calmodulin-like 3 |
| 1962 | 19195 | NM_031969 | r | calmodulin 1, calmodulin 1 (phosphorylase kinase, delta) | Calmodulin III, ESTs, Highly similar to A Chain A, Calmodulin Complexed With Calmodulin-Binding Peptide From Smooth Muscle Myosin Light Chain Kinase {SUB 2-148 [*H. sapiens*], *R. norvegicus* CaMII retropseudogene (clone lambda SC27), RIKEN cDNA 2310068O22 gene, calmodulin, calmodulin 1, calmodulin 1 (phosphorylase kinase, delta), calmodulin 2, calmodulin 2 (phosphorylase kinase, delta), calmodulin 3, calmodulin-like 3 |
| 1962 | 19190 | NM_031969 | p | calmodulin 1, calmodulin 1 (phosphorylase kinase, delta) | Calmodulin III, ESTs, Highly similar to A Chain A, Calmodulin Complexed With Calmodulin-Binding Peptide From Smooth Muscle Myosin Light Chain Kinase {SUB 2-148 [*H. sapiens*], *R. norvegicus* CaMII retropseudogene (clone lambda SC27), RIKEN cDNA 2310068O22 gene, calmodulin, calmodulin 1, calmodulin 1 (phosphorylase kinase, delta), calmodulin 2, calmodulin 2 (phosphorylase kinase, delta), calmodulin 3, calmodulin-like 3 |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 1963 | 17734 | NM_031970 | v, General | | EST, Weakly similar to HHHU27 heat shock protein 27 [*H. sapiens*], ESTs, Moderately similar to HHHU27 heat shock protein 27 [*H. sapiens*], crystallin, alpha C, heat shock 27 kD protein 1, heat shock 27 kD protein 3 |
| 1964 | 1475 | NM_031971 | v | heat shock 70 kD protein 1B, heat shock protein, 70 kDa 1 | ESTs, Weakly similar to BCHUIA S-100 protein alpha chain [*H. sapiens*], ESTs, Weakly similar to S10A MOUSE S-100 PROTEIN, ALPHA CHAIN [*M. musculus*], *Homo sapiens* cDNA FLJ10018 fis, clone HEMBA1000531, RIKEN cDNA B230217N24 gene, S100 calcium binding protein A1, S100 calcium binding protein A11, S100 calcium-binding protein A1, S100 calcium-binding protein A11 (calgizzarin), S100 calcium-binding protein P, expressed sequence AI266795, heat shock 70 kD protein 1A, heat shock 70 kD protein 1B |
| 1965 | 15470 | NM_031978 | f | | proteasome (prosome, macropain) 26S subunit, non-ATPase, 1 |
| 1966 | 18502 | NM_031984 | c | calbindin 1, (28 kD), calbindin-28K | ESTs, Moderately similar to CALBINDIN [*M. musculus*], calbindin 1, (28 kD), calbindin-28K |
| 1967 | 19768 | NM_031986 | v, aa, General | | ESTs, Highly similar to APB1 RAT AMYLOID BETA A4 PRECURSOR PROTEIN-BINDING FAMILY A MEMBER 1 [*R. norvegicus*], *Mus musculus*, Similar to hypothetical protein, clone MGC: 11704 IMAGE.3964815, mRNA, complete cds, RIKEN cDNA 2310008D10 gene, amyloid beta (A4) precursor protein-binding, family A, APBA1: amyloid beta (A4) precursor protein-binding, family A, member 1 (X11), amyloid beta (A4) precursor protein-binding, family A, member 1 (X11), amyloid beta (A4) precursor protein-binding, family A, member 3, syndecan binding protein, syndecan binding protein (syntenin), syntenin-2 protein |
| 1968 | 723 | NM_032084 | n | | ESTs, Weakly similar to T42724 p190-B protein - mouse [*M. musculus*], PTPL1-associated RhoGAP 1, RIKEN cDNA 1700026N20 gene, RIKEN cDNA 1700112L09 gene, chimerin (chimaerin) 2, minor histocompatibility antigen HA-1, oligophrenin 1, rho GTPase activating protein 5 |
| 1969 | 17935 | NM_032615 | a | membrane interacting protein of RGS16 | hypothetical protein FLJ20207, membrane interacting protein of RGS16 |
| 1970 | 16831 | NM_033095 | n | | |
| 1971 | 25468 | NM_033234 | c, z | | |
| 1971 | 25469 | NM_033234 | c | | |
| 1971 | 17832 | NM_033234 | c, p | hemoglobin beta chain complex, hemoglobin, beta | |
| 1971 | 17829 | NM_033234 | c, z | hemoglobin beta chain complex, hemoglobin, beta | |
| 1972 | 4723 | NM_033235 | z | | ESTs, Highly similar to LDHH_HUMAN L-LACTATE DEHYDROGENASE H CHAIN [*H. sapiens*], Lactate dehydrogenase B, RIKEN cDNA 1700124B08 gene, lactate dehydrogenase 2, B chain, lactate dehydrogenase B, malate dehydrogenase 1, NAD (soluble), malate dehydrogenase, soluble |
| 1973 | 1409 | NM_033349 | p, General | glyoxylase 2, hydroxyacyl glutathione hydrolase | *Mus musculus*, Similar to hydroxyacyl glutathione hydrolase, clone |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| | | | | | MGC: 6697 IMAGE.3583919, mRNA, complete cds, RIKEN cDNA 1500017E18 gene, RIKEN cDNA 2810014I23 gene, RIKEN cDNA C330022E15 gene, hydroxyacyl glutathione hydrolase, hypothetical protein MGC2605, protein expressed in thyroid |
| 1974 | 19998 | NM_033352 | General | PDZ domain containing 1 | ESTs, Weakly similar to T30259 multiple PDZ domain protein - mouse [*M. musculus*], ESTs, Weakly similar to T46612 multi PDZ domain protein 1 - rat [*R. norvegicus*], PDZ domain containing 1, channel-interacting PDZ domain protein, hypothetical protein FLJ22756, multiple PDZ domain protein, semaF cytoplasmic domain associated protein 3, solute carrier family 9 (sodium/hydrogen exchanger), isoform 3 regulatory factor 1, solute carrier family 9 (sodium/hydrogen exchanger), isoform 3 regulatory factor 2, syntaxin binding protein 4 |
| 1975 | 1410 | NM_052798 | d | zinc finger protein 354A | ESTs, Moderately similar to S47073 finger protein HZF2, Krueppel-related [*H. sapiens*], ESTs, Moderately similar to T12489 hypothetical protein DKFZp572P0920.1 [*H. sapiens*], ESTs, Weakly similar to TC17 MOUSE TRANSCRIPTION FACTOR 17 [*M. musculus*], ESTs, Weakly similar to Z184_HUMAN ZINC FINGER PROTEIN 184 [*H. sapiens*], expressed sequence AI875089, transcription factor 17, transcription factor 17-like 1, transcription factor 17-like 2 |
| 1976 | 15028 | NM_052809 | f | cysteine dioxygenase 1, cytosolic, cysteine dioxygenase, type I | RIKEN cDNA 2900092E17 gene, cysteine dioxygenase 1, cytosolic, cysteine dioxygenase, type I |
| 1977 | 5176 | NM_053297 | u | pyruvate kinase 3, pyruvate kinase, muscle | |
| 1978 | 7660 | NM_053299 | i | diubiquitin, ubiquitin D | EST, Moderately similar to S12583 polyubiquitin 4 - mouse [*M. musculus*], *Homo sapiens* UBBP2 pseudogene for ubiquitin UBB, RIKEN cDNA 2700054O04 gene, diubiquitin, expressed sequence AI194771, expressed sequence AL033289, ubiquitin B, ubiquitin C |
| 1979 | 5117 | NM_053310 | p | Homer, neuronal immediate early gene, 3, homer, neuronal immediate early gene, 3 | CAT56 protein, EST, Weakly similar to A28996 proline-rich protein M14 precursor - mouse [*M. musculus*], EST, Weakly similar to JE0291 FB19 protein [*H. sapiens*], Homer, neuronal immediate early gene, 1B, RuvB-like protein 1, homer, neuronal immediate early gene, 1, homer, neuronal immediate early gene, 2, proline rich protein, proline rich protein 2, protein phosphatase 1, regulatory subunit 10 |
| 1981 | 17473 | NM_053319 | a, v | dynein, cytoplasmic, light chain 1, dynein, cytoplasmic, light polypeptide | ESTs, Moderately similar to protein inhibitor of nitric oxide synthase [*M. musculus*], RIKEN cDNA 6720463E02 gene, *Rattus norvegicus* dynein light chain-2 (DIc2) mRNA, complete cds, dynein, cytoplasmic, light chain 1, dynein, cytoplasmic, light polypeptide |
| 1982 | 25480 | NM_053329 | g | insulin-like growth factor binding protein, acid labile subunit | |
| 1982 | 21977 | NM_053329 | y | insulin-like growth factor binding protein, acid labile | ESTs, Weakly similar to ALS RAT INSULIN-LIKE GROWTH FACTOR |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| | | | | subunit | BINDING PROTEIN COMPLEX ACID LABILE CHAIN PRECURSOR [*R. norvegicus*], ESTs, Weakly similar to JC6128 insulin-like growth factor binding complex acid labile chain - mouse [*M. musculus*], ESTs, Weakly similar to membrane glycoprotein [*M. musculus*], KIAA0644 gene product, glycoprotein 1a, alpha polypeptide, hypothetical protein FLJ20156, insulin-like growth factor binding protein, acid labile subunit, nogo receptor, reticulon 4 receptor, toll-like receptor 6, tumor endothelial marker 5 precursor |
| 1983 | 14926 | NM_053330 | f | ribosomal protein L21 | EST, Moderately similar to 2113200B ribosomal protein L21 [*H. sapiens*], EST, Moderately similar to RL21 MOUSE 60S RIBOSOMAL PROTEIN L21 [*M. musculus*], EST, Weakly similar to 2113200B ribosomal protein L21 [*H. sapiens*], EST, Weakly similar to RL21 MOUSE 60S RIBOSOMAL PROTEIN L21 [*M. musculus*], EST, Weakly similar to RL21_HUMAN 60S RIBOSOMAL PROTEIN L21 [*H. sapiens*], ESTs, Moderately similar to RL21 RAT 60S RIBOSOMAL PROTEIN L21 [*R. norvegicus*], RIKEN cDNA 2700085M18 gene, ribosomal protein L21 |
| 1983 | 14929 | NM_053330 | e, General | ribosomal protein L21 | EST, Moderately similar to 2113200B ribosomal protein L21 [*H. sapiens*], EST, Moderately similar to RL21 MOUSE 60S RIBOSOMAL PROTEIN L21 [*M. musculus*], EST, Weakly similar to 2113200B ribosomal protein L21 [*H. sapiens*], EST, Weakly similar to RL21 MOUSE 60S RIBOSOMAL PROTEIN L21 [*M. musculus*], EST, Weakly similar to RL21_HUMAN 60S RIBOSOMAL PROTEIN L21 [*H. sapiens*], ESTs, Moderately similar to RL21 RAT 60S RIBOSOMAL PROTEIN L21 [*R. norvegicus*], RIKEN cDNA 2700085M18 gene, ribosomal protein L21 |
| 1984 | 16407 | NM_053332 | c, e | cubilin (intrinsic factor-cobalamin receptor | DNA segment, Chr 2, Wayne State University 88, expressed, EST, Weakly similar to T09456 intrinsic factor-B12 receptor Cubilin precursor [*H. sapiens*], ESTs, Moderately similar to T09456 intrinsic factor-B12 receptor Cubilin precursor [*H. sapiens*], *Homo sapiens* cDNA FLJ12558 fis, clone NT2RM4000787, bone morphogenetic protein 1, cubilin (intrinsic factor-cobalamin receptor), expressed sequence AL022750, platelet-derived growth factor, C polypeptide, tolloid-like, tolloid-like 2, tumor necrosis factor induced protein 6, tumor necrosis factor, alpha-induced protein 6 |
| 1985 | 15790 | NM_053341 | j, x | chromosome 19 open reading frame 3, regulator of G-protein signaling 19 interacting protein 1 | chromosome 19 open reading frame 3, hypothetical protein FLJ20075 |
| 1986 | 6154 | NM_053356 | p | collagen, type I, alpha 2, procollagen, type I, alpha 2 | ESTs, Weakly similar to CGHU2S collagen alpha 2(I) chain precursor [*H. sapiens*], KIAA1026 protein, RIKEN cDNA 1110030G05 gene, RIKEN cDNA 9030409G11 gene, collagen, type I, alpha 1, collagen, type I, alpha |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 1987 | 9215 | NM_053374 | i | | 2, collagen, type II, alpha 1 (primary osteoarthritis, spondyloepiphyseal dysplasia, congenital), hypothetical protein FLJ20654, nischarin, procollagen, type I, alpha 1, procollagen, type I, alpha 2, procollagen, type II, alpha 1 interleukin 18 binding protein |
| 1988 | 6416 | NM_053380 | General | | ESTs, Weakly similar to NPT2 RAT RENAL SODIUM-DEPENDENT PHOSPHATE TRANSPORT PROTEIN 2 [*R. norvegicus*], ESTs, Weakly similar to NPT2_HUMAN RENAL SODIUM-DEPENDENT PHOSPHATE TRANSPORT PROTEIN 2 [*H. sapiens*], *Homo sapiens*, Similar to solute carrier family 34 (sodium phosphate), member 1, clone MGC. 18179 IMAGE 4155326, mRNA, complete cds, *Rattus norvegicus* mRNA for NaPi-2 alpha, complete cds, Solute carrier family 17 (sodium/hydrogen exchanger), member 2, expressed sequence AI649385, solute carrier family 34 (sodium phosphate), member 1, solute carrier family 34 (sodium phosphate), member 2 |
| 1989 | 19113 | NM_053395 | a | small muscle protein, X-linked | small muscle protein, X-linked |
| 1990 | 2242 | NM_053433 | n, General | | ESTs, Highly similar to FMO3_HUMAN DIMETHYLANILINE MONOOXYGENASE [*H. sapiens*], Flavin-containing monooxygenase 1, *Homo sapiens* DNA sequence from PAC 127D3 on chromosome 1q23-25. Contains FMO2 and FMO3 genes for Flavin-containing Monooxygenase 2 and Flavin-containing Monooxygenase 3 (Dimethylaniline Monooxygenase (N-Oxide 3, EC1.14.13.8, Dimethylaniline Oxidase 3, FMO II, FMO 3), and a gene for another, unknown, Flavin-containing Monooxygenase family protein Contains ESTs and GSSs, flavin containing monooxygenase 1, flavin containing monooxygenase 2, flavin containing monooxygenase 3, hypothetical protein PRO1257 |
| 1991 | 5561 | NM_053438 | y | | RIKEN cDNA 1700065B19 gene, RIKEN cDNA 5730408C10 gene, zinc finger protein 103, zinc finger protein homologous to Zfp 103 in mouse |
| 1992 | 14670 | NM_053439 | n, General | | ESTs, Highly similar to RAB7 RAT RAS-RELATED PROTEIN RAB-7 [*R. norvegicus*], RAB7, member RAS oncogene family, RAN, member RAS oncogene family, RIKEN cDNA 1700009N14 gene |
| 1993 | 17102 | NM_053440 | w | stathmin-like 2, superiorcervical ganglia, neural specific 10 | stathmin-like 2, stathmin-like 4, superiorcervical ganglia, neural specific 10 |
| 1994 | 24762 | NM_053442 | General | | ESTs, Weakly similar to 1615347A ras p21 GTPase activating protein [*M. musculus*], KIAA1938 protein, *Mus musculus*, Similar to RAS p21 protein activator, clone MGC. 7759 IMAGE: 3498774, mRNA, complete cds, RAS protein activator like 2, *Rattus norvegicus* DOC2/DAB2 interactive protein mRNA, complete cds, expressed sequence BB079060, hypothetical protein FLJ21438 |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 1995 | 8085 | NM_053453 | General | | ESTs, Moderately similar to RGS8 RAT REGULATOR OF G-PROTEIN SIGNALING 8 [*R. norvegicus*], regulator of G-protein signaling 18, regulator of G-protein signaling 2, regulator of G-protein signaling 8, regulator of G-protein signalling 13, regulator of G-protein signalling 2, 24 kD, regulator of G-protein signalling 8 |
| 1996 | 4622 | NM_053463 | d | | NEFA precursor, expressed sequence AI607786, nucleobindin, nucleobindin 1, nucleobindin 2 |
| 1997 | 21866 | NM_053472 | p | cytochrome c oxidase subunit IV isoform 2, cytochrome c oxidase, subunit IVb | EST, Weakly similar to COX4_HUMAN CYTOCHROME C OXIDASE POLYPEPTIDE IV PRECURSO [*H. sapiens*], cytochrome c oxidase subunit IV, cytochrome c oxidase subunit IV isoform 2, cytochrome c oxidase, subunit IV, cytochrome c oxidase, subunit IVa, cytochrome c oxidase, subunit IVb, expressed sequence AL024441 |
| 1998 | 9573 | NM_053475 | h | | protein tyrosine phosphatase 4a1, protein tyrosine phosphatase 4a2, protein tyrosine phosphatase type IVA, member 1, protein tyrosine phosphatase type IVA, member 2, protein tyrosine phosphatase type IVA, member 3 |
| 1999 | 16137 | NM_053480 | k | | DNA polymerase alpha 2, 68 kDa, *Mus musculus*, Similar to DNA polymerase alpha 2, 68 kDa, clone MGC: 11533 IMAGE: 3602559, mRNA, complete cds, expressed sequence AI573378, polymerase (DNA-directed), alpha (70 kD) |
| 2000 | 15556 | NM_053483 | y | | ESTs, Weakly similar to A Chain A, Importin Alpha, Mouse [*M. musculus*], expressed sequence AW146299, karyopherin (importin) alpha 2, karyopherin alpha 2 (RAG cohort 1, importin alpha 1) |
| 2001 | 16394 | NM_053485 | General | | EST, Moderately similar to CALCYCLIN [*R. norvegicus*], S100 calcium-binding protein A6 (calcyclin), calcium binding protein A6 (calcyclin) |
| 2002 | 4290 | NM_053487 | j, y | | peroxisomal biogenesis factor 11A, peroxisomal biogenesis factor 11B |
| 2004 | 18826 | NM_053523 | d | | EST, Moderately similar to Y025_HUMAN HYPOTHETICAL PROTEIN KIAA0025 [*H. sapiens*], RIKEN cDNA 5031400M07 gene, homocysteine-inducible, endoplasmic reticulum stress-inducible, ubiquitin-like domain member 1, hypothetical protein FLJ22313 |
| 2005 | 7764 | NM_053525 | aa | | DEAD/H (Asp-Glu-Ala-Asp/His) box polypeptide, Y chromosome, DNA segment, Chr 1, Pasteur Institute 1, ESTs, Moderately similar to DDXY_HUMAN DEAD BOX PROTEIN 3, Y-CHROMOSOMAL [*H. sapiens*], KIAA0801 gene product, RNA helicase, Rattus norvegicus RNA helicase with arginine-serine-rich domain mRNA, complete cds, expressed sequence AI324246, expressed sequence AI325430, expressed sequence C86129 |
| 2006 | 14199 | NM_053538 | c | | Lysosomal-associated multispanning membrane protein-5, lysosomal-associated protein transmembrane 5 |
| 2007 | 1058 | NM_053539 | c, d | | |

TABLE 3-continued

HUMAN HOMOLOGUE ANNOTATIONS

| Seq. ID No. | GenBank Acc./ Identifier Ref. Seq. ID No. | | Model Code | Homologous Gene Name | Homologous Cluster Name |
|---|---|---|---|---|---|
| 2008 | 4327 | NM_053563 | General | | DNA segment, Chr 17, human D6S81E 1, EST, Weakly similar to HE47 RAT PROBABLE ATP-DEPENDENT RNA HELICASE P47 [*R. norvegicus*], HLA-B associated transcript 1, KIAA0111 gene product, *Mus musculus*, clone MGC. 6664 IMAGE: 3498954, mRNA, complete cds, RIKEN cDNA 2610307C23 gene, eukaryotic translation initiation factor 4A, isoform 2, eukaryotic translation initiation factor 4A1, eukaryotic translation initiation factor 4A2, nuclear RNA helicase, DECD variant of DEAD box family |
| 2009 | 1342 | NM_053573 | h | | ESTs, Weakly similar to JE0096 myocilin - mouse [*M. musculus*], *Homo sapiens* NOE3- 4 (NOE3) mRNA, complete cds, alternatively spliced, expressed sequence AW742568, olfactomedin related ER localized protein |
| 2010 | 19254 | NM_053576 | h, s | anti-oxidant protein 2 (non-selenium glutathione peroxidase, acidic calcium-independent phospholipase A2), peroxiredoxin 5 | ESTs, Moderately similar to AOP2_HUMAN ANTIOXIDANT PROTEIN 2 [*H. sapiens*], anti-oxidant protein 2 (non-selenium glutathione peroxidase, acidic calcium-independent phospholipase A2), peroxiredoxin 5 |
| 2010 | 19253 | NM_053576 | h | anti-oxidant protein 2 (non-selenium glutathione peroxidase, acidic calcium-independent phospholipase A2), peroxiredoxin 5 | ESTs, Moderately similar to AOP2_HUMAN ANTIOXIDANT PROTEIN 2 [*H. sapiens*], anti-oxidant protein 2 (non-selenium glutathione peroxidase, acidic calcium-independent phospholipase A2), peroxiredoxin 5 |
| 2011 | 3049 | NM_053582 | p, cc, General | | ESTs, Highly similar to JC7189 tubulointerstitial nephritis antigen [*H. sapiens*], P3ECSL, cathepsin B, lipocalin 7, tubulointerstitial nephritis antigen |
| 2011 | 3050 | NM_053582 | o, General | | ESTs, Highly similar to JC7189 tubulointerstitial nephritis antigen [*H. sapiens*], P3ECSL, cathepsin B, lipocalin 7, tubulointerstitial nephritis antigen |
| 2012 | 21423 | NM_053586 | s, y | | EST, Moderately similar to CYTOCHROME C OXIDASE POLYPEPTIDE VB PRECURSOR [*R. norvegicus*], cytochrome c oxidase subunit Vb, cytochrome c oxidase, subunit Vb |
| 2013 | 21445 | NM_053587 | t, v | | |
| 2014 | 20871 | NM_053591 | j, l | | ESTs, Weakly similar to MDP1 MOUSE MICROSOMAL DIPEPTIDASE PRECURSOR [*M. musculus*], ESTs, Weakly similar to S33757 membrane dipeptidase [*M. musculus*], RIKEN cDNA 1700018F16 gene, dipeptidase 1 (renal), putative dipeptidase, putative metallopeptidase (family M19) |
| 2014 | 20870 | NM_053591 | l | | ESTs, Weakly similar to MDP1 MOUSE MICROSOMAL DIPEPTIDASE PRECURSOR [*M. musculus*], ESTs, Weakly similar to S33757 membrane dipeptidase [*M. musculus*], RIKEN cDNA 1700018F16 gene, dipeptidase 1 (renal), putative dipeptidase, putative metallopeptidase (family M19) |
| 2015 | 21044 | NM_053594 | d | | protein tyrosine phosphatase, receptor type, R |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 2016 | 21709 | NM_053596 | k | | KIAA0604 gene product, endothelin converting enzyme 1, endothelin converting enzyme-like 1, expressed sequence AW322500, expressed sequence BB127715, mel transforming oncogene-like 1, membrane metallo endopeptidase |
| 2016 | 21708 | NM_053596 | z | | KIAA0604 gene product, endothelin converting enzyme 1, endothelin converting enzyme-like 1, expressed sequence AW322500, expressed sequence BB127715, mel transforming oncogene-like 1, membrane metallo endopeptidase |
| 2017 | 1597 | NM_053611 | t | nuclear proten 1, p8 protein (candidate of metastasis 1) | ESTs, Weakly similar to Gene product with similarity to Rat P8 [*H. sapiens*] |
| 2018 | 5565 | NM_053618 | General | Bardet-Biedl syndrome 2, Bardet-Biedl syndrome 2 (human) | |
| 2019 | 13004 | NM_053623 | t | fatty acid-Coenzyme A ligase, long chain 4, fatty-acid-Coenzyme A ligase, long-chain 4 | |
| 2020 | 1127 | NM_053626 | g | | D-amino acid oxidase, D-amino-acid oxidase, D-aspartate oxidase, EST, Weakly similar to OXDA RAT D-AMINO ACID OXIDASE [*R. norvegicus*], ESTs, Highly similar to OXDA RAT D-AMINO ACID OXIDASE [*R. norvegicus*], RIKEN cDNA 5330420D20 gene, RIKEN cDNA 5730402C02 gene |
| 2021 | 18644 | NM_053648 | n | beta-carotene 15, 15'-dioxygenase, beta-carotene 15,15'-dioxygenase | EST, Moderately similar to 0806162D protein COII [*M. musculus*], EST, Weakly similar to 810024D cytochrome oxidase II [*H. sapiens*] |
| 2022 | 21637 | NM_053653 | p | | c-fos induced growth factor, c-fos induced growth factor (vascular endothelial growth factor D), vascular endothelial growth factor, vascular endothelial growth factor B, vascular endothelial growth factor C |
| 2023 | 3454 | NM_053662 | cc | | ESTs, Highly similar to CG1C RAT G1/S-SPECIFIC CYCLIN C [*R. norvegicus*], Homo sapiens, clone IMAGE: 3537447, mRNA, partial cds, RIKEN cDNA 1810009O10 gene, cyclin C, cyclin K, cyclin L, cyclin L ania-6a, cyclin T2 |
| 2024 | 16121 | NM_053698 | h, j, z | | with Glu/Asp-rich carboxy-terminal domain, 2, Cbp/p300-interacting transactivator, with Glu/Asp-rich carboxy-terminal domain, 4, ESTs, Weakly similar to MRG1_HUMAN MSG-RELATED PROTEIN 1 [*H. sapiens*], expressed sequence AW742964 |
| 2024 | 16122 | NM_053698 | h, j, z | | with Glu/Asp-rich carboxy-terminal domain, 2, Cbp/p300-interacting transactivator, with Glu/Asp-rich carboxy-terminal domain, 4, ESTs, Weakly similar to MRG1_HUMAN MSG-RELATED PROTEIN 1 [*H. sapiens*], expressed sequence AW742964 |
| 2025 | 25379 | NM_053713 | General | | |
| 2025 | 13622 | NM_053713 | General | | ESTs, Moderately similar to CPBP RAT CORE PROMOTER ELEMENT-BINDING PROTEIN [*R. norvegicus*], Kruppel-like factor 4 (gut), RIKEN cDNA 7420700M05 gene, core promoter element binding protein |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 2026 | 15376 | NM_053747 | h | ubiquilin 1 | |
| 2027 | 1218 | NM_053748 | b | | expressed sequence C86324, hypothetical protein FLJ23590 |
| 2028 | 1137 | NM_053763 | y | | cytochrome P450, 40 (25-hydroxyvitamin D3 1 alpha-hydroxylase), cytochrome P450, subfamily XXVIIB (25-hydroxyvitamin D-1-alpha-hydroxylase), polypeptide 1 |
| 2029 | 15996 | NM_053769 | cc | dual specificity phosphatase 1, protein tyrosine phosphatase, non-receptor type 16 | MKP-1 like protein tyrosine phosphatase, dual specificity phosphatase 1, dual specificity phosphatase 13, dual specificity phosphatase 14, dual specificity phosphatase 2, expressed sequence BB104621, protein tyrosine phosphatase, non-receptor type 16 |
| 2030 | 8652 | NM_053774 | g | ubiquitin specific protease 2 | KIAA1453 protein, RIKEN cDNA 4930511O11 gene, expressed sequence AA409661, ubiquitin specific protease 2, ubiquitin specific protease 8 |
| 2031 | 14664 | NM_053806 | General | | |
| 2032 | 4361 | NM_053812 | k | | B cell lymphoma 2 like, BCL2-antagonist/killer 1, BCL2-like 1, Bcl-w protein, Bcl2-like, *Mus musculus* N-BAK1 (Bak1) mRNA, complete cds, alternatively spliced, RIKEN cDNA 0610031G08 gene |
| 2034 | 15002 | NM_053819 | b, x, bb, General | | EST, Moderately similar to TIM1 RAT METALLOPROTEINASE INHIBITOR 1 PRECURSOR [*R. norvegicus*], EST, Weakly similar to TIM1 RAT METALLOPROTEINASE INHIBITOR 1 PRECURSOR [*R. norvegicus*], tissue inhibitor of metalloproteinase, tissue inhibitor of metalloproteinase 1 (erythroid potentiating activity, collagenase inhibitor) |
| 2034 | 15003 | NM_053819 | b, l, x, bb, General | | EST, Moderately similar to TIM1 RAT METALLOPROTEINASE INHIBITOR 1 PRECURSOR [*R. norvegicus*], EST, Weakly similar to TIM1 RAT METALLOPROTEINASE INHIBITOR 1 PRECURSOR [*R. norvegicus*], tissue inhibitor of metalloproteinase, tissue inhibitor of metalloproteinase 1 (erythroid potentiating activity, collagenase inhibitor) |
| 2035 | 16173 | NM_053822 | t | | |
| 2036 | 17154 | NM_053835 | j, z | | |
| 2037 | 20868 | NM_053843 | t | | |
| 2037 | 20869 | NM_053843 | t | | |
| 2040 | 714 | NM_053863 | y | | ESTs, Highly similar to CNT1_HUMAN SODIUM/NUCLEOSIDE COTRANSPORTER 1 [*H. sapiens*], ESTs, Moderately similar to A54892 Na+-dependent nucleoside transport Protein cNT1 - rat [*R. norvegicus*] |
| 2041 | 19781 | NM_053883 | b | | ESTs, Moderately similar to DUS6 RAT DUAL SPECIFICITY PROTEIN PHOSPHATASE 6 [*R. norvegicus*], ESTs, Weakly similar to DUS6 RAT DUAL SPECIFICITY PROTEIN PHOSPHATASE 6 [*R. norvegicus*], dual specificity phosphatase 10, dual specificity phosphatase 13, dual specificity phosphatase 14, dual specificity phosphatase 6, dual specificity phosphatase 9, expressed sequence BB104621, mitogen-activated protein kinase phosphatase x, protein tyrosine phosphatase, non-receptor type 16 |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 2041 | 19780 | NM_053883 | b | | ESTs, Moderately similar to DUS6 RAT DUAL SPECIFICITY PROTEIN PHOSPHATASE 6 [*R. norvegicus*], ESTs, Weakly similar to DUS6 RAT DUAL SPECIFICITY PROTEIN PHOSPHATASE 6 [*R. norvegicus*], dual specificity phosphatase 10, dual specificity phosphatase 13, dual specificity phosphatase 14, dual specificity phosphatase 6, dual specificity phosphatase 9, expressed sequence BB104621, mitogen-activated protein kinase phosphatase x, protein tyrosine phosphatase, non-receptor type 16 |
| 2042 | 1454 | NM_053887 | General | | |
| 2043 | 1660 | NM_053891 | g | | ESTs, Moderately similar to CD5R MOUSE CYCLIN-DEPENDENT KINASE 5 ACTIVATOR 1 PRECURSOR [*R. norvegicus*], cyclin-dependent kinase 5, regulatory subunit (p35), cyclin-dependent kinase 5, regulatory subunit 1 (p35), cyclin-dependent kinase 5, regulatory subunit 2 (p39) |
| 2044 | 712 | NM_053896 | k | | |
| 2045 | 753 | NM_053897 | k | | coagulation factor II (thrombin) receptor-like 1, coagulation factor II (thrombin) receptor-like 2 |
| 2046 | 794 | NM_053902 | General | | RIKEN cDNA 4432411A05 gene, kynureninase (L-kynurenine hydrolase) |
| 2047 | 17937 | NM_053911 | f | | ESTs, Weakly similar to ARNO_HUMAN ARF NUCLEOTIDE-BINDING SITE OPENER [*H. sapiens*] |
| 2048 | 8188 | NM_053927 | General | | DNA segment, Chr 10, ERATO Doi 398, expressed, ESTs, Weakly similar to PTNL RAT PROTEIN TYROSINE PHOSPHATASE, NON-RECEPTOR TYPE 21 [*R. norvegicus*], *Homo sapiens*, Similar to erythrocyte membrane protein band 4.1-like 3, clone MGC: 12343 IMAGE: 4044866, mRNA, complete cds, *Mus musculus* adult male pituitary gland cDNA, RIKEN full-length enriched library, clone: 5330430I10, full insert sequence, *Rattus norvegicus* protein tyrosine phosphatase 2E (PTP2E) mRNA, complete cds, erythrocyte membrane protein band 4.1 (elliptocytosis 1, RH-linked), erythrocyte membrane protein band 4.1-like 1, erythrocyte membrane protein band 4.1-like 3, erythrocyte protein band 4.1-like 1, erythrocyte protein band 4.1-like 3, protein tyrosine phosphatase, non-receptor type 21 |
| 2050 | 1628 | NM_053936 | h | | endothelial differentiation, lysophosphatidic acid G-protein-coupled receptor 4, endothelial differentiation, lysophosphatidic acid G-protein-coupled receptor 7, endothelial differentiation, lysophosphatidic acid G-protein-coupled receptor, 2, endothelial differentiation, lysophosphatidic acid G-protein-coupled receptor, 4, endothelial differentiation, lysophosphatidic acid G-protein-coupled receptor, 7, putative G protein-coupled receptor snGPCR32 |
| 2051 | 13954 | NM_053955 | General | | ESTs, Highly similar to B46290 mu-crystallin [*H. sapiens*], crystallin, mu |
| 2052 | 408 | NM_053961 | General | | |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 2052 | 19991 | NM_053961 | a | | DNA segment, Chr 9, ERATO Doi 85, expressed, *Homo sapiens* aconitase precursor (ACON) mRNA, nuclear gene encoding mitochondrial protein, partial cds, RIKEN cDNA 5031409G22 gene, aconitase 1, aconitase 1, soluble, aconitase 2, mitochondrial, iron-responsive element-binding protein |
| 2052 | 16190 | NM_053961 | q | | *Homo sapiens* hepatocellular carcinoma-associated antigen 64 (HCA64) mRNA, complete cds, RIKEN cDNA 1300014E15 gene, RIKEN cDNA 1300017C12 gene, RIKEN cDNA 1810022C23 gene, RIKEN cDNA 2610009M20 gene, RIKEN cDNA 4933417A18 gene, enoyl Coenzyme A hydratase, short chain, 1, mitochondrial, peroxisomal D3, D2-enoyl-CoA isomerase, peroxisomal delta3, delta2-enoyl-Coenzyme A isomerase |
| 2052 | 21355 | NM_053961 | j, l, y, z | | |
| 2055 | 15136 | NM_053971 | aa | | EST, Moderately similar to I51803 TAXREB107 [*H. sapiens*], ESTs, Highly similar to I51803 TAXREB107 [*H. sapiens*], ribosomal protein L6 |
| 2055 | 15135 | NM_053971 | d | | EST, Moderately similar to I51803 TAXREB107 [*H. sapiens*], ESTs, Highly similar to I51803 TAXREB107 [*H. sapiens*], ribosomal protein L6 |
| 2056 | 1764 | NM_053974 | h | | ESTs, Highly similar to A26411 translation initiation factor eIF-4E [*H. sapiens*], RIKEN cDNA 2700069E09 gene, eukaryotic translation initiation factor 4E |
| 2057 | 1292 | NM_053980 | l | | ADP-ribosylation factor related protein 1, RIKEN cDNA 1500006I01 gene |
| 2058 | 15468 | NM_053982 | q | | EST, Highly similar to 40S RIBOSOMAL PROTEIN S15A [*R. norvegicus*], EST, Weakly similar to RS1A_HUMAN 40S RIBOSOMAL PROTEIN S15A [*R. norvegicus*], ESTs, Weakly similar to RS1A_HUMAN 40S RIBOSOMAL PROTEIN S15A [*H. sapiens*] |
| 2059 | 15642 | NM_053985 | General | | ESTs, Highly similar to HISTONE H3.3 [*R. norvegicus*], H3 histone, family 3A, H3 histone, family 3B, H3 histone, family 3B (H3.3B) |
| 2060 | 21066 | NM_054001 | t | | CD36 antigen (collagen type I receptor, thrombospondin receptor)-like 2 (lysosomal integral membrane protein II), EST, Moderately similar to LYII_HUMAN LYSOSOME MEMBRANE PROTEIN II [*H. sapiens*] |
| 2061 | 17326 | NM_054008 | o | | RGC32 protein, RIKEN cDNA 1190002H23 gene |
| 2061 | 17327 | NM_054008 | cc | | RGC32 protein, RIKEN cDNA 1190002H23 gene |
| 2061 | 17329 | NM_054008 | g, o, cc | | RGC32 protein, RIKEN cDNA 1190002H23 gene |
| 2062 | 25253 | NM_057099 | j, l, m, p, z | proteasome (prosome, macropain) subunit, beta type 6, proteasome subunit, beta type, 6 | EST, Weakly similar to S17522 multicatalytic endopeptidase complex [*H. sapiens*], ESTs, Weakly similar to PROTEASOME DELTA CHAIN PRECURSOR [*R. norvegicus*], proteasome (prosome, macropain) subunit, beta type 6, proteasome (prosome, macropain) subunit, beta type 7, proteasome (prosome, macropain) subunit, beta type, 6, |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 2062 | 22849 | NM_057099 | j, l | proteasome (prosome, macropain) subunit, beta type 6, proteasome (prosome, macropain) subunit, beta type, 6 | proteasome (prosome, macropain) subunit, beta type, 7 EST, Weakly similar to S17522 multicatalytic endopeptidase complex [*H. sapiens*], ESTs, Weakly similar to PROTEASOME DELTA CHAIN PRECURSOR [*R. norvegicus*], proteasome (prosome, macropain) subunit, beta type 6, proteasome (prosome, macropain) subunit, beta type 7, proteasome (prosome, macropain) subunit, beta type, 6, proteasome (prosome, macropain) subunit, beta type, 7 |
| 2063 | 19657 | NM_057103 | b, cc | A kinase (PRKA) anchor protein (gravin) 12 | |
| 2064 | 5492 | NM_057105 | w | UDP glycosyltransferase 1 family, polypeptide A cluster, UDP glycosyltransferase 1 family, polypeptide A6, UDP-glucuronosyltransferase 1 family, member 1 | |
| 2064 | 15126 | NM_057105 | r | UDP glycosyltransferase 1 family, polypeptide A cluster, UDP glycosyltransferase 1 family, polypeptide A6, UDP-glucuronosyltransferase 1 family, member 1 | |
| 2064 | 15125 | NM_057105 | s | UDP glycosyltransferase 1 family, polypeptide A cluster, UDP-glucuronosyltransferase 1 family, member 1 | |
| 2066 | 15391 | NM_057114 | n | | EST, Moderately similar to TDX2__HUMAN THIOREDOXIN PEROXIDASE 2 [*H. sapiens*], EST, Weakly similar to TDX2__HUMAN THIOREDOXIN PEROXIDASE 2 [*H. sapiens*], peroxiredoxin 1 |
| 2067 | 727 | NM_057123 | m | | BCS1 (yeast homolog)-like, ESTs, Highly similar to PRS4__HUMAN 26S PROTEASE REGULATORY SUBUNIT 4 [*H. sapiens*], ESTs, Weakly similar to A44468 26S proteasome regulatory chain 4 [*H. sapiens*], expressed sequence AI325227, protease (prosome, macropain) 26S subunit, ATPase 1, proteasome (prosome, macropain) 26S subunit, ATPase, 1 |
| 2068 | 915 | NM_057124 | s | | ESTs, Weakly similar to P2UR MOUSE P2U PURINOCEPTOR 1 [*M. musculus*], G protein-coupled receptor 35, purinergic receptor P2Y, G-protein coupled 2, pyrimidinergic receptor P2Y, G-protein coupled, 4, pyrimidinergic receptor P2Y, G-protein coupled, 6 |
| 2069 | 15151 | NM_057131 | k | | |
| 2070 | 1892 | NM_057144 | b | | cysteine and glycine-rich protein 3 (cardiac LIM protein), cysteine rich protein, cysteine-rich protein 2, cysteine-rich protein 3, thymus LIM protein |
| 2071 | 12333 | NM_057155 | f | | |
| 2071 | 12331 | NM_057155 | v, General | | |
| 2071 | 12332 | NM_057155 | f, General | | |
| 2072 | 17477 | NM_057194 | a, General | | EST, Weakly similar to B36298 proline-rich protein PRB3S [*H. sapiens*], EST, Weakly similar to CGHU3B collagen |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| | | | | | alpha 3(IV) chain precursor, long splice form [*H. sapiens*], EST, Weakly similar to D40750 proline-rich protein PRB1/2S [*H. sapiens*], EST, Weakly similar to JE0284 Mm-1 cell derived transplantability-associated protein 1b [*H. sapiens*], galectin-related inter-fiber protein, murine leukemia viral (bmi-1) oncogene homolog, phospholipid scramblase 1, phospholipid scramblase 2, phospholipid scramblase 3 |
| 2073 | 15408 | NM_057197 | p, t | | 2,4-dienoyl CoA reductase 1, mitochondrial, 2,4-dienoyl CoA reductase 2, peroxisomal, peroxisomal trans 2-enoyl CoA reductase, putative short chain alcohol dehydrogenase |
| 2073 | 15409 | NM_057197 | t | | 2,4-dienoyl CoA reductase 1, mitochondrial, 2,4-dienoyl CoA reductase 2, peroxisomal, peroxisomal trans 2-enoyl CoA reductase; putative short chain alcohol dehydrogenase |
| 2074 | 7866 | NM_057198 | h | | ESTs, Highly similar to PUR1_HUMAN AMIDOPHOSPHORIBOSYLTRANS- FERASE PRECURSOR [*H. sapiens*], ESTs, Moderately similar to PUR1_HUMAN AMIDOPHOSPHORIBOSYLTRANS- FERASE PRECURSOR [*H. sapiens*], RIKEN cDNA 5730454C12 gene, expressed sequence AA675351, expressed sequence C79945, glutamine fructose-6-phosphate transaminase 2, glutamine-fructose-6- phosphate transaminase 2, phosphoribosyl pyrophosphate amidotransferase |
| 2075 | 14125 | NM_057208 | h, j, y, z | | ESTs, Highly similar to A25530 tropomyosin, fibroblast [*H. sapiens*] |
| 2076 | 1743 | NM_057210 | k, s | | |
| 2077 | 10498 | NM_078617 | a | | EST, Moderately similar to RS23_HUMAN 40S RIBOSOMAL PROTEIN S2 [*R. norvegicus*], EST, Weakly similar to RS23_HUMAN 40S RIBOSOMAL PROTEIN S2 [*R. norvegicus*], ESTs, Weakly similar to RS23_HUMAN 40S RIBOSOMAL PROTEIN S2 [*R. norvegicus*], *Mus musculus*, Similar to mitochondrial ribosomal protein S12, clone MGC.13892 IMAGE: 4209358, mRNA, complete cds, RIKEN cDNA 2410044J15 gene, expressed sequence AI327385, mitochondrial ribosomal protein S12, ribosomal protein S23 |
| 2078 | 8820 | NM_080399 | n | | |
| 2079 | 15701 | NM_080581 | j, m, y, z | | ATP-binding cassette, sub-family C (CFTR/MRP), member 1 (multiple drug resistance-associated protein), ATP- binding cassette, sub-family C (CFTR/MRP), member 1a, ATP- binding cassette, sub-family C (CFTR/MRP), member 1b, ATP- binding cassette, sub-family C (CFTR/MRP), member 2, ATP-binding cassette, sub-family C (CFTR/MRP), member 3, ATP-binding cassette, sub- family C (CFTR/MRP), member 6, ESTs, Moderately similar to JE0336 canalicular multispecific organic anion transporter [*H. sapiens*], RIKEN cDNA 1700019L09 gene |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 2079 | 20105 | NM_080581 | aa | | |
| 2080 | 16109 | NM_080585 | c | | |
| 2081 | 1757 | NM_080766 | d | | |
| 2082 | 7108 | NM_080778 | y | | ESTs, Highly similar to COT2 RAT COUP TRANSCRIPTION FACTOR 2 [*R. norvegicus*], *Homo sapiens* cDNA: FLJ22189 fis, clone HRC01043, RIKEN cDNA 2700033K02 gene, nuclear receptor subfamily 2, group E, member 3, nuclear receptor subfamily 2, group F, member 2 |
| 2083 | 132 | NM_080782 | k | | cyclin-dependent kinase inhibitor 1A (P21), cyclin-dependent kinase inhibitor 1A (p21, Cip1), cyclin-dependent kinase inhibitor 1B (p27, kip1), cyclin-dependent kinase inhibitor 1B (p27, Kip1) |
| 2083 | 133 | NM_080782 | l | | cyclin-dependent kinase inhibitor 1A (P21), cyclin-dependent kinase inhibitor 1A (p21, Cip1), cyclin-dependent kinase inhibitor 1B (p27, kip1), cyclin-dependent kinase inhibitor 1B (p27, Kip1) |
| 2084 | 20122 | NM_080887 | General | | HT014, *Homo sapiens* thioredoxin delta 3 (TXN delta 3) mRNA, partial cds, RIKEN cDNA 4930429J24 gene, expressed sequence AU021712, thioredoxin, thioredoxin domain-containing 2 (spermatozoa), thioredoxin-like (32 kD), thioredoxin-like, 32 kD |
| 2085 | 6143 | NM_080892 | e | | *Homo sapiens*, Similar to selenium binding protein 1, clone MGC: 17268 IMAGE: 4155238, mRNA, complete cds, selenium binding protein 1, selenium binding protein 2 |
| 2086 | 9952 | NM_080902 | h | | |
| 2087 | 17546 | NM_130401 | b | | epithelial protein up-regulated in carcinoma, membrane associated protein 17 |
| 2088 | 21695 | NM_130411 | c, x | | ESTs, Weakly similar to CO1A_MOUSE CORONIN-LIKE PROTEIN P57 (CORONIN 1A) [*M. musculus*], coronin, actin binding protein 1A, coronin, actin binding protein 1B, coronin, actin binding protein 1C, coronin, actin-binding protein, 1A, hypothetical protein DKFZp762I166 |
| 2089 | 21391 | NM_130416 | x, General | | annexin VII, long form [*H. sapiens*], ESTs, Moderately similar to ANX4 MOUSE ANNEXIN IV [*M. musculus*], ZAP 36/annexin IV, annexin A4, annexin A7 |
| 2090 | 20694 | NM_130430 | General | | |
| 2090 | 19818 | NM_130430 | cc | | |
| 2090 | 18810 | NM_130430 | e, s | | ATP synthase, H+ transporting, mitochondrial F1 complex, alpha subunit, isoform 1, ATP synthase, H+ transporting, mitochondrial F1 complex, alpha subunit, isoform 1, cardiac muscle, EST, Moderately similar to ATPA RAT ATP SYNTHASE ALPHA CHAIN, MITOCHONDRIAL PRECURSOR [*R. norvegicus*], expressed sequence AL022851, expressed sequence AL023067 |
| 2091 | 18293 | NM_130433 | q | | |
| 2092 | 25064 | S45392 | a, n | | |
| 2093 | 3244 | S63519 | u | | |
| 2094 | 25501 | S63521 | q | | |
| 2095 | 16248 | S68135 | h | | |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 2096 | 18647 | S69316 | q | | EST, Weakly similar to ENPL_HUMAN ENDOPLASMIN PRECURSOR [*H. sapiens*], ESTs, Highly similar to HS9B RAT HEAT SHOCK PROTEIN HSP 90-BETA [*R. norvegicus*], ESTs, Weakly similar to ENPL_HUMAN ENDOPLASMIN PRECURSOR [*H. sapiens*], *Homo sapiens* mRNA, cDNA DKFZp564F053 (from clone DKFZp564F053), RIKEN cDNA 1810014B01 gene, RIKEN cDNA 2410002K23 gene, expressed sequence C81438, heat shock 90 kD protein 1, beta, heat shock protein, 84 kDa 1, tumor rejection antigen (gp96) 1, tumor rejection antigen gp96 |
| 2097 | 24351 | S74257 | v | | ATP-binding cassette, sub-family D (ALD), member 4, ESTs, Highly similar to JC5604 ABC-transporting peroxisomal membrane protein 69 [*H. sapiens*], ESTs, Moderately similar to JC5604 ABC-transporting peroxisomal membrane protein 69 [*H. sapiens*] |
| 2098 | 25066 | S75280 | d | | |
| 2099 | 1460 | S76054 | j, l, m, x, y, General | | DNA segment, Chr 15, Wayne State University 77, expressed, EST, Moderately similar to K2C8 RAT KERATIN, TYPE II CYTOSKELETAL 8 [*R. norvegicus*], EST, Weakly similar to I37982 Keratin 8 [*H. sapiens*], ESTs, Moderately similar to I37982 Keratin 8 [*H. sapiens*], ESTs, Weakly similar to I37982 Keratin 8 [*H. sapiens*], *Homo sapiens* mRNA; cDNA DKFZp434C107 (from clone DKFZp434C107), RIKEN cDNA 1200016G03 gene, expressed sequence AL022697, expressed sequence AU019895, keratin 8, keratin complex 2, basic, gene 8 |
| 2100 | 25539 | S76742 | v | | |
| 2101 | 16400 | S76779 | c | | |
| 2102 | 24469 | S77858 | n | | EST, Weakly similar to MOHU6N myosin alkali light chain 6, nonmuscle form [*H. sapiens*], myosin light chain, alkali, nonmuscle, myosin, light polypeptide 6, alkali, smooth muscle and non-muscle |
| 2103 | 25545 | S77900 | k, s | | |
| 2103 | 21583 | S77900 | k | | EST, Weakly similar to MOHULP myosin regulatory light chain, placental [*H. sapiens*], ESTs, Moderately similar to MOHULP myosin regulatory light chain, placental [*H. sapiens*], myosin regulatory light chain, myosin, light polypeptide, regulatory, non-sarcomeric (20 kD) |
| 2104 | 10260 | S81497 | s | lipase A, lysosomal acid, cholesterol esterase (Wolman disease), lysosomal acid lipase 1 | |
| 2105 | 3609 | S82579 | k | | *Homo sapiens*, Similar to histamine N-methyltransferase, clone MGC: 14500 IMAGE. 4249496, mRNA, complete cds, expressed sequence AI788969, histamine N-methyltransferase |
| 2106 | 111 | U02506 | u | | |
| 2107 | 14959 | U03390 | a, q, General | | EST, Moderately similar to GBLP_HUMAN GUANINE NUCLEOTIDE-BINDING PROTEIN BETA SUBUNIT-LIKE PROTEIN 12 3 [*R. norvegicus*], EST, Weakly similar to B33928 GTP-binding protein beta |

TABLE 3-continued

HUMAN HOMOLOGUE ANNOTATIONS

| Seq. ID No. | GenBank Acc./ Identifier Ref. Seq. ID No. | | Model Code | Homologous Gene Name | Homologous Cluster Name |
|---|---|---|---|---|---|
| | | | | | chain homolog [*H. sapiens*], ESTs, Weakly similar to A36986 activated protein kinase C receptor RACK1 - rat [*R. norvegicus*], *Homo sapiens* cDNA: FLJ21913 fis, clone HEP03888, *Homo sapiens*, Similar to guanine nucleotide binding protein (G protein), beta polypeptide 2-like 1, clone MGC: 17239 IMAGE: 4155303, mRNA, complete cds, expressed sequence AW544865, guanine nucleotide binding protein (G protein), beta polypeptide 2-like 1, guanine nucleotide binding protein, beta 2, related sequence 1 |
| 2109 | 2010 | U05675 | b, x, bb | | EST, Weakly similar to beta-fibrinogen precursor [*H. sapiens*], ESTs, Moderately similar to AF125176 1 angiopoietin-related protein-2 [*M. musculus*], ESTs, Weakly similar to FIBB RAT FIBRINOGEN BETA CHAIN PRECURSOR [*R. norvegicus*], expressed sequence AI256424, fibrinogen, B beta polypeptide |
| 2110 | 15462 | U06230 | d | | |
| 2112 | 1583 | U07201 | s, General | asparagine synthetase | |
| 2113 | 627 | U09229 | h | | ESTs, Highly similar to CDP_HUMAN CCAAT DISPLACEMENT PROTEIN [*H. sapiens*], Hepatocyte nuclear factor 6, Human chromosome 17q21 mRNA clone 1046: 1-1, KIAA0293 protein, cut (Drosophila)-like 1, cut (Drosophila)-like 1 (CCAAT displacement protein), cut (Drosophila)-like 2, one cut domain, family member 1 |
| 2114 | 809 | U17035 | General | | |
| 2115 | 16675 | U17565 | k, x, bb | mini chromosome maintenance deficient 6 (*S cerevisiae*), minichromosome maintenance deficient (mis5, *S. pombe*) 6 | mini chromosome maintenance deficient 6 (*S. cerevisiae*), minichromosome maintenance deficient (mis5, *S. pombe*) 6 |
| 2116 | 25587 | U20110 | r | | |
| 2117 | 90 | U20796 | r | | *Mus musculus*, Similar to nuclear receptor subfamily 1, group D, member 1, clone MGC: 6402 IMAGE 3585478, mRNA, complete cds, nuclear receptor subfamily 1, group D, member 2, thyroid hormone receptor alpha |
| 2118 | 25589 | U21718 | h, aa | | |
| 2119 | 22196 | U21719 | h | | |
| 2120 | 17118 | U25746 | s | | DEAD (aspartate-glutamate-alanine-aspartate) box polypeptide 5, ESTs, Moderately similar to A57514 RNA helicase HEL117 - rat [*R. norvegicus*], KIAA0801 gene product, RIKEN cDNA 2610007K22 gene, RIKEN cDNA 4921506D17 gene, RIKEN cDNA 9130430L19 gene, RNA helicase, expressed sequence AI325430 |
| 2121 | 1537 | U27518 | g, h, n | | |
| 2122 | 1558 | U28504 | bb | | EST, Weakly similar to NPT1 RAT RENAL SODIUM-DEPENDENT PHOSPHATE TRANSPORT PROTEIN 1 [*R. norvegicus*], ESTs, Weakly similar to NPT1 MOUSE RENAL SODIUM-DEPENDENT PHOSPHATE TRANSPORT PROTEIN 1 [*M. musculus*], expressed sequence AW261723, solute carrier family 17 (sodium phosphate), member 1, solute carrier family 17 (sodium phosphate), member 3, solute carrier family 17 (sodium phosphate), member 4, solute |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 2123 | 16193 | U30831 | n | | carrier family 17 (sodium/hydrogen exchanger), member 1 B/K protein, EST, Moderately similar to S68695 B/K protein - rat [*R. norvegicus*], *Mus musculus* B/K mRNA for B/K protein, complete cds, strain: BALB/c, RIKEN cDNA C030008B15 gene, synaptotagmin 1, synaptotagmin 5 |
| 2124 | 17480 | U31598 | z | | |
| 2125 | 18302 | U33500 | General | | |
| 2126 | 25599 | U34897 | y | | |
| 2127 | 1394 | U37099 | h | | *Homo sapiens*, clone MGC 4711 IMAGE: 3534915, mRNA, complete cds, RAB23, member RAS oncogene family, RAB3A, member RAS oncogene family, RAB3C, member RAS oncogene family, expressed sequence AI850886 |
| 2128 | 244 | U38376 | n | | ESTs, Highly similar to FGD1_HUMAN PUTATIVE RHO/RAC GUANINE NUCLEOTIDE EXCHANGE FACTOR [*H. sapiens*], ESTs, Weakly similar to B39898 phospholipase A2 [*M. musculus*], ESTs, Weakly similar to FGD1 MOUSE PUTATIVE RHO/RAC GUANINE NUCLEOTIDE EXCHANGE FACTOR [*M. musculus*], ESTs, Weakly similar to FGD1_HUMAN PUTATIVE RHO/RAC GUANINE NUCLEOTIDE EXCHANGE FACTOR [*H. sapiens*], FGD1 family, member 3, RIKEN cDNA 5830461L01 gene, faciogenital dysplasia (Aarskog-Scott syndrome), faciogenital dysplasia homolog, faciogenital dysplasia homolog 2 (human) |
| 2129 | 1623 | U41164 | h | | ESTs, Weakly similar to AF167320 1 zinc finger protein ZFP113 [*M. musculus*], ESTs, Weakly similar to Z135_HUMAN ZINC FINGER PROTEIN 13 [*H. sapiens*], ESTs, Weakly similar to ZF29 MOUSE ZINC FINGER PROTEIN 29 [*M. musculus*], RIKEN cDNA 2310040I01 gene, expressed sequence AI835008 |
| 2130 | 15851 | U42719 | f, t, x, General | complement component 4 (within H-2S), complement component 4B | EST, Weakly similar to complement component C4A [*H. sapiens*] |
| 2131 | 17886 | U47315 | s, z | | |
| 2132 | 21654 | U53184 | i, t, General | | |
| 2133 | 1439 | U57391 | w | | |
| 2134 | 725 | U62316 | bb | | expressed sequence AW146050, monocarboxylate transporter, solute carrier family 16 (monocarboxylic acid transporters), member 3, solute carrier family 16 (monocarboxylic acid transporters), member 7 |
| 2137 | 2153 | U75404 | b, cc, General | A kinase (PRKA) anchor protein (gravin) 12 | |
| 2139 | 4956 | U76714 | j, y | | |
| 2140 | 4477 | U77829 | l, m | | |
| 2141 | 21703 | U82591 | z | | expressed sequence C76683, putative c-Myc-responsive |
| 2142 | 977 | U89744 | s | | KIAA1683 protein, KIAA1802 protein, expressed sequence AA407558, lymphocyte antigen 64, polymerase (RNA) II (DNA directed) polypeptide A (220 kD), suppressor of Ty (*S. cerevisiae*) 5 homolog |
| 2143 | 23282 | U90725 | h | | high density lipoprotein binding protein (vigilin) |
| 2144 | 22005 | U96490 | m | | |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 2146 | 819 | X02284 | j, z | | |
| 2147 | 818 | X02291 | e, j, z | aldolase 2, B isoform, aldolase B, fructose-bisphosphate | |
| 2148 | 20818 | X02904 | n, q | | |
| 2149 | 16401 | X04979 | c | | |
| 2150 | 20513 | X05684 | o, r | pyruvate kinase liver and red blood cell, pyruvate kinase, liver and RBC | |
| 2151 | 25084 | X06769 | cc | | |
| 2152 | 672 | X13722 | h | | |
| 2153 | 25675 | X14181 | n | | |
| 2153 | 20810 | X14181 | n, q, w | | EST, Moderately similar to RL1X_HUMAN 60S RIBOSOMAL PROTEIN L18A [*H. sapiens*], EST, Weakly similar to RL1X_HUMAN 60S RIBOSOMAL PROTEIN L18A [*H. sapiens*], EST, Weakly similar to S47353 ribosomal protein L18a, cytosolic [*H. sapiens*], ESTs, Highly similar to RL1X_HUMAN 60S RIBOSOMAL PROTEIN L18A [*H. sapiens*], RIKEN cDNA 2510019J09 gene, ribosomal protein L18a |
| 2154 | 18541 | X14671 | y | | ESTs, Highly similar to RL26_HUMAN 60S RIBOSOMAL PROTEIN L26 [*H. sapiens*], ESTs, Highly similar to S33713 ribosomal protein L26, cytosolic [*H. sapiens*], ESTs, Weakly similar to 60S RIBOSOMAL PROTEIN L26 [*R. norvegicus*], ribosomal protein L26, ribosomal protein L26 pseudogene 1 |
| 2155 | 25679 | X15013 | q | | |
| 2155 | 19244 | X15013 | c, q, w | | EST, Weakly similar to 60S RIBOSOMAL PROTEIN L7A [*M. musculus*], ESTs, Highly similar to R5HU7A ribosomal protein L7a, cytosolic [*H. sapiens*], *Homo sapiens* rpL7a pseudogene, clone 3a, Human DNA sequence from clone RP1-189G13 on chromosome 20. Contains an RPL7A (60S ribosomal protein L7A) (SURF3) pseudogene, an RPS4 (40S ribosomal protein S4) pseudogene, ESTs, STSs and GSSs, RIKEN cDNA 4632404N19 gene, ribosomal protein L7a |
| 2156 | 15626 | X17665 | a | | EST AI317031, EST, Weakly similar to R3HU16 ribosomal protein S16, cytosolic [*H. sapiens*], expressed sequence AA420385, ribosomal protein S16 |
| 2157 | 1893 | X51529 | t | phospholipase A2, group IIA (platelets, synovial fluid) | |
| 2158 | 25686 | X51536 | bb | | |
| 2158 | 10819 | X51536 | aa, bb | | EST, Moderately similar to R3RT3 ribosomal protein S3 - rat [*R. norvegicus*], EST, Weakly similar to R3RT3 ribosomal protein S3 - rat [*R. norvegicus*], hypothetical protein FLJ23059, ribosomal protein S3 |
| 2159 | 18250 | X51706 | a, q, w | ribosomal protein L9 | EST, Weakly similar to 60S RIBOSOMAL PROTEIN L9 [*R. norvegicus*], EST, Weakly similar to S42106 ribosomal protein L9 homolog [*H. sapiens*], ESTs, Highly similar to S42106 ribosomal protein L9 homolog [*H. sapiens*], ESTs, Moderately similar to 60S RIBOSOMAL PROTEIN L9 [*R. norvegicus*], RIKEN cDNA |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 2160 | 20872 | X51707 | a | ribosomal protein S19 | 4930401B11 gene, ribosomal protein L9 EST, Moderately similar to 40S RIBOSOMAL PROTEIN S19 [*R. norvegicus*], EST, Weakly similar to RS19_HUMAN 40S RIBOSOMAL PROTEIN S19 [*H. sapiens*], ribosomal protein S19 |
| 2161 | 516 | X52711 | c | | myxovirus (influenza virus) resistance 1, myxovirus (influenza) resistance 1, homolog of murine (interferon-inducible protein p78) |
| 2162 | 25689 | X52815 | g | | |
| 2163 | 20427 | X53378 | w | | ESTs, Highly similar to RS13_HUMAN 40S RIBOSOMAL PROTEIN S13 [*H. sapiens*], ESTs, Moderately similar to RS13_HUMAN 40S RIBOSOMAL PROTEIN S13 [*H. sapiens*] |
| 2164 | 18606 | X53504 | General | | EST, Moderately similar to S35531 ribosomal protein L12, cytosolic [*H. sapiens*], EST, Weakly similar to 60S RIBOSOMAL PROTEIN L12 [*R. norvegicus*], hypothetical protein, ribosomal protein L12 |
| 2165 | 1463 | X54467 | d, u, General | | |
| 2166 | 24577 | X55153 | a, v | | EST, Weakly similar to 60S ACIDIC RIBOSOMAL PROTEIN P2 [*R. norvegicus*], EST, Weakly similar to R6HUP2 acidic ribosomal protein P2, cytosolic [*H. sapiens*], ESTs, Highly similar to 60S ACIDIC RIBOSOMAL PROTEIN P2 [*R. norvegicus*], ESTs, Highly similar to MTJ1 MOUSE DNAJ PROTEIN HOMOLOG MTJ1 [*M. musculus*], Human DNA sequence from clone RP3-408B20 on chromosome 6 Contains ESTs, STSs and GSSs. Contains a gene and two pseudogenes for novel 7 transmembrane receptors (olfactory family) and a gene for a novel protein similar to 60S acidic ribosomal protein P2 (RPLP2), RIKEN cDNA 2700049I22 gene, ribosomal protein, large P2, ribosomal protein, large, P1 |
| 2167 | 10344 | X57405 | j, m | Notch (Drosophila) homolog 1 (translocation-associated), Notch gene homolog 1, (Drosophila) | EST, Highly similar to A40043 notch protein homolog TAN-1 precursor [*H. sapiens*], EST, Weakly similar to A40043 notch protein homolog TAN-1 precursor [*H. sapiens*], ESTs, Weakly similar to NEUROGENIC LOCUS NOTCH HOMOLOG PROTEIN 1 PRECURSOR [*M. musculus*], *Homo sapiens* mRNA; cDNA DKFZp761G02121 (from clone DKFZp761G02121), partial cds, Notch (Drosophila) homolog 1 (translocation-associated), Notch (Drosophila) homolog 2, Notch (Drosophila) homolog 3, Notch 3, Notch gene homolog 1, (Drosophila), Notch gene homolog 3, (Drosophila), jagged 1 |
| 2168 | 15106 | X57529 | g, n, q | | EST, Weakly similar to S30393 ribosomal protein S18, cytosolic [*H. sapiens*], ESTs, Highly similar to S30393 ribosomal protein S18, cytosolic [*H. sapiens*], ribosomal protein S18 |
| 2169 | 5667 | X58200 | q, bb | ribosomal protein L23 | |
| 2169 | 18611 | X58200 | a, v | ribosomal protein L29 | EST, Moderately similar to 60S RIBOSOMAL PROTEIN L29 [*R. norvegicus*], EST, Weakly similar to S65784 ribosomal protein L29, |

TABLE 3-continued

HUMAN HOMOLOGUE ANNOTATIONS

Atty. Docket No. 44921-5089US
Doc. No. 1803440.1

| Seq. ID No. | Identifier | GenBank Acc./ Ref. Seq. ID No. | Model Code | Homologous Gene Name | Homologous Cluster Name |
|---|---|---|---|---|---|
| 2170 | 17175 | X58389 | w | | cytosolic [*H. sapiens*], ESTs, Highly similar to S65784 ribosomal protein L29, cytosolic [*H. sapiens*], ESTs, Weakly similar to 60S RIBOSOMAL PROTEIN L29 [*M. musculus*], Human DNA sequence from clone RP4-595K12 on chromosome 1p31.2-31.3 Contains a pseudogene similar to 60S RPL29 (ribosomal protein L29 (cell surface heparin binding protein HIP)), a chromosome 1 specific mRNA (KIAA0499), a novel mRNA (KIAA0433), ESTs, STSs, GSSs and a CpG Island, ribosomal protein L29 EST, Moderately similar to RL17_HUMAN 60S RIBOSOMAL PROTEIN L17 [*H. sapiens*], EST, Weakly similar to RL17 RAT 60S RIBOSOMAL PROTEIN L17 [*R. norvegicus*], EST, Weakly similar to RL17_HUMAN 60S RIBOSOMAL PROTEIN L17 [*H. sapiens*], ESTs, Weakly similar to R5HU22 ribosomal protein L17, cytosolic [*H. sapiens*] |
| 2171 | 25702 | X58465 | w | ribosomal protein S5 | EST, Moderately similar to 40S RIBOSOMAL PROTEIN S5 [*R. norvegicus*], ESTs, Weakly similar to S55916 ribosomal protein S5, cytosolic [*H. sapiens*], ribosomal protein S5 |
| 2171 | 10109 | X58465 | c, q | ribosomal protein S5 | EST, Moderately similar to 40S RIBOSOMAL PROTEIN S5 [*R. norvegicus*], ESTs, Weakly similar to S55916 ribosomal protein S5, cytosolic [*H. sapiens*], ribosomal protein S5 |
| 2172 | 25705 | X59375 | c, i, aa, General | | |
| 2173 | 25709 | X59737 | u | creatine kinase, mitochondrial 1 (ubiquitous), creatine kinase, mitochondrial 1, ubiquitous | |
| 2174 | 18354 | X59859 | General | decorin | ESTs, Moderately similar to dJ63G5 3 [*H. sapiens*], RIKEN cDNA 1700034K16 gene, RIKEN cDNA 5530600M07 gene, decorin |
| 2174 | 18355 | X59859 | t | decorin | ESTs, Moderately similar to dJ63G5 3 [*H. sapiens*], RIKEN cDNA 1700034K16 gene, RIKEN cDNA 5530600M07 gene, decorin |
| 2175 | 21657 | X61381 | General | | ESTs, Moderately similar to S17182 interferon-induced protein 1-8U [*H. sapiens*], ESTs, Weakly similar to putative haemopoietic membrane protein [*M. musculus*], Human DNA sequence from clone RP4-781L3 on chromosome 1p34.3-36.11 Contains a pseudogene similar to IFITM3 (interferon inducedntransmembrane protein 3 (1-8U)), STSs and GSSs, RIKEN cDNA 1110004C05 gene, interferon induced transmembrane protein 3 (1-8U), interferon induced transmembrane protein 3-like, interferon-inducible protein 16 |
| 2176 | 25718 | X62145 | bb, General | | |
| 2176 | 15875 | X62145 | a, q, v | | EST, Highly similar to 60S RIBOSOMAL PROTEIN L8 [*R. norvegicus*], EST, Moderately similar to 60S RIBOSOMAL PROTEIN L8 [*R. norvegicus*], EST, Weakly similar to JN0923 ribosomal protein L8, cytosolic [*H. sapiens*], ESTs, Highly |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| 2177 | 13646 | X62166 | bb | | similar to 60S RIBOSOMAL PROTEIN L8 [*R. norvegicus*], ESTs, Highly similar to RL8_HUMAN 60S RIBOSOMAL PROTEIN L [*M. musculus*], ESTs, Moderately similar to RL8_HUMAN 60S RIBOSOMAL PROTEIN L [*M. musculus*], expressed sequence AL024098, ribosomal protein L8 |
| 2178 | 25721 | X62325 | p | | EST, Weakly similar to 60S RIBOSOMAL PROTEIN L3 [*R. norvegicus*], EST, Weakly similar to I84501 ribosomal protein L3 [*H. sapiens*], ESTs, Moderately similar to 60S RIBOSOMAL PROTEIN L3 [*R. norvegicus*], ESTs, Moderately similar to I84501 ribosomal protein L3 [*H. sapiens*], ESTs, Weakly similar to RL3 MOUSE 60S RIBOSOMAL PROTEIN L3 [*M. musculus*], RIKEN cDNA 1110057H16 gene, ribosomal protein L3, ribosomal protein L3-like |
| 2179 | 16012 | X62875 | m, s, z | | high mobility group AT-hook 1, high-mobility group (nonhistone chromosomal) protein isoforms I and Y |
| 2180 | 25730 | X63369 | cc | | |
| 2181 | 25089 | X63594 | General | | |
| 2181 | 25090 | X63594 | cc, General | | |
| 2182 | 20844 | X65228 | n, w | | EST, Highly similar to 60S RIBOSOMAL PROTEIN L23A [*R. norvegicus*], ESTs, Highly similar to RL2B_HUMAN 60S RIBOSOMAL PROTEIN L23A [*H. sapiens*], ribosomal protein L23a |
| 2183 | 20879 | X65296 | j, y | | EST, Weakly similar to JC5408 carboxylesterase [*H. sapiens*], ESTs, Moderately similar to ES22 MOUSE LIVER CARBOXYLESTERASE 22 PRECURSOR [*M. musculus*], T-complex expressed gene 5, carboxylesterase 1, carboxylesterase 1 (monocyte/macrophage serine esterase 1), carboxylesterase 3, carboxylesterase 3 (brain) |
| 2184 | 25736 | X68782 | c | | |
| 2185 | 16426 | X70369 | c | collagen, type III, alpha 1 (Ehlers-Danlos syndrome type IV, autosomal dominant), procollagen, type III, alpha 1 | EST, Highly similar to CA13_HUMAN COLLAGEN ALPHA 1(III) CHAIN PRECURSOR [*H. sapiens*], EST, Moderately similar to CA13_HUMAN COLLAGEN ALPHA 1(III) CHAIN PRECURSOR [*H. sapiens*], EST, Weakly similar to CGHU7L collagen alpha 1(III) chain precursor [*H. sapiens*], ESTs, Highly similar to CA21_HUMAN COLLAGEN ALPHA 2(I) CHAIN PRECURSOR [*H. sapiens*], collagen type V, alpha 2, collagen, type III, alpha 1 (Ehlers-Danlos syndrome type IV, autosomal dominant), macrophage receptor with collagenous structure, procollagen, type III, alpha 1 |
| 2186 | 16300 | X70706 | u | | ESTs, Highly similar to A34789 T-plastin [*H. sapiens*], ESTs, Highly similar to PLSI_HUMAN I-PLASTIN [*H. sapiens*], expressed sequence AI115446, expressed sequence AI427122, expressed sequence AL024105, plastin 2, L |
| 2187 | 24232 | X75207 | c | | B-cell CLL/lymphoma 1, EST, Moderately similar to CGD1 RAT G1/S-SPECIFIC CYCLIN D1 [*R. norvegicus*], ESTs, Weakly similar to 1709356A |

TABLE 3-continued

HUMAN HOMOLOGUE ANNOTATIONS

| Seq. ID No. | Identifier | GenBank Acc./ Ref. Seq. ID No. | Model Code | Homologous Gene Name | Homologous Cluster Name |
|---|---|---|---|---|---|
| | | | | | cyclin PRAD1 [*H. sapiens*], cyclin D1, cyclin D1 (PRAD1 parathyroid adenomatosis 1), expressed sequence AI327039 |
| 2188 | 16272 | X76456 | n, p | | ESTs, Highly similar to alpha-albumin protein [*M. musculus*], *Mus musculus* mRNA for alpha-albumin protein, afamin |
| 2189 | 25741 | X76489 | u | | |
| 2190 | 23302 | X78949 | h | | ESTs, Weakly similar to DAHUA1 procollagen-proline dioxygenase [*H. sapiens*], expressed sequence AI853847, expressed sequence C76437, procollagen-proline, 2-oxoglutarate 4-dioxygenase (proline 4-hydroxylase), alpha 1 polypeptide, procollagen-proline, 2-oxoglutarate 4-dioxygenase (proline 4-hydroxylase), alpha polypeptide I, procollagen-proline, 2-oxoglutarate 4-dioxygenase (proline 4-hydroxylase), alpha polypeptide II |
| 2191 | 25747 | X81448 | General | | |
| 2192 | 24115 | X81449 | u | | EST, Weakly similar to KERATIN, TYPE I CYTOSKELETAL 19 [*M. musculus*], ESTs, Moderately similar to K1CJ_HUMAN KERATIN. TYPE I CYTOSKELETAL 10 [*H. sapiens*], ESTs, Weakly similar to S30433 keratin 17, type I, cytoskeletal [*H. sapiens*], *Homo sapiens* mRNA for keratin 19, partial cds, isolate K19-141, keratin 19, keratin complex 1, acidic, gene 19, type I intermediate filament cytokeratin |
| 2193 | 25754 | X89696 | g | | |
| 2194 | 25097 | X90642 | y, z | | |
| 2195 | 12978 | X96437 | cc, General | | immediate early response 3 |
| 2197 | 4594 | Y07704 | c | | |
| 2198 | 25777 | Y08355 | g, p, General | | |
| 2199 | 15986 | Y09945 | bb, General | | EST, Weakly similar to OCN2 MOUSE ORGANIC CATION/CARNITINE TRANSPORTER 2 [*M. musculus*], ESTs, Highly similar to OCN2_HUMAN ORGANIC CATION/CARNITINE TRANSPORTER 2 [*H. sapiens*], ESTs, Weakly similar to JE0346 high-affinity carntine transporter, CT1 - rat [*R. norvegicus*], ion transporter protein, solute carrier family 22 (organic cation transporter), member 1, solute carrier family 22 (organic cation transporter), member 4, solute carrier family 22 (organic cation transporter), member 5, solute carrier family 22 (organic cation transporter), member 9 |
| 2200 | 20890 | Y13275 | k | | CD9 antigen, RIKEN cDNA 6330415F13 gene, RIKEN cDNA B230119D02 gene, expressed sequence C76990. transmembrane 4 superfamily member 3 |
| 2201 | 21914 | Y13336 | d | | ESTs, Weakly similar to DAD1_HUMAN DEFENDER AGAINST CELL DEATH 1 [*R. norvegicus*], defender against cell death 1, expressed sequence AI323713 |
| 2202 | 406 | Z11995 | o, General | | |
| 2203 | 18352 | Z12298 | t | decorin | ESTs, Moderately similar to dJ63G5.3 [*H. sapiens*], RIKEN cDNA 1700034K16 gene, RIKEN cDNA 5530600M07 gene, decorin |
| 2204 | 17481 | Z49761 | k | | |
| 2205 | 8664 | Z75029 | r, v | | ESTs, Highly similar to T17342 |

TABLE 3-continued

HUMAN HOMOLOGUE ANNOTATIONS

Atty. Docket No. 44921-5089US
Doc. No. 1803440.1

| Seq. ID No. | Identifier | GenBank Acc./ Ref. Seq. ID No. | Model Code | Homologous Gene Name | Homologous Cluster Name |
|---|---|---|---|---|---|
| | | | | | hypothetical protein DKFZp586K1924.1 [*H. sapiens*], ESTs, Moderately similar to T17342 hypothetical protein DKFZp586K1924.1 [*H. sapiens*] |
| 2206 | 2459 | AA964755 | cc | | |
| 2207 | 23830 | AA956638 | aa | | |
| 2208 | 6100 | X73524 | x | | |
| 2209 | 439 | Z22607 | w | bone morphogenetic protein 4 | bone morphogenetic protein 15, bone morphogenetic protein 4, endometrial bleeding associated factor, endometrial bleeding associated factor (left-right determination, factor A; transforming growth factor beta superfamily), growth differentiation factor 2, growth differentiation factor 5, hypothetical protein FLJ10314 |
| 2210 | 8665 | AI071965 | v | | ESTs, Highly similar to T17342 hypothetical protein DKFZp586K1924.1 [*H. sapiens*], ESTs, Moderately similar to T17342 hypothetical protein DKFZp586K1924.1 [*H. sapiens*] |
| 2211 | 155 | U32681 | t | crp-ductin, deleted in malignant brain tumors 1 | CD163 antigen, ESTs, Highly similar to I38005 M130 antigen precursor, splice form 4 [*H. sapiens*], KIAA1822 protein, apoptosis inhibitory 6, crp-ductin, deleted in malignant brain tumors 1, lectin, galactoside-binding, soluble, 3 binding protein, macrophage scavenger receptor 2, peptidylprolyl isomerase C-associated protein |
| 2212 | 19252 | AA892041 | s | anti-oxidant protein 2 (non-selenium glutathione peroxidase, acidic calcium-independent phospholipase A2), peroxiredoxin 5 | ESTs, Moderately similar to AOP2__HUMAN ANTIOXIDANT PROTEIN 2 [*H. sapiens*], anti-oxidant protein 2 (non-selenium glutathione peroxidase, acidic calcium-independent phospholipase A2), peroxiredoxin 5 |
| 2213 | 15582 | AI232320 | q | | |
| 2214 | 17541 | M26125 | n | epoxide hydrolase 1, microsomal, epoxide hydrolase 1, microsomal (xenobiotic) | EST, Moderately similar to HYEP__HUMAN EPOXIDE HYDROLASE 1 [*H. sapiens*], ESTs, Highly similar to HYEP__HUMAN EPOXIDE HYDROLASE 1 [*H. sapiens*], epoxide hydrolase 1, microsomal, epoxide hydrolase 1, microsomal (xenobiotic) |
| 2215 | 18609 | M30689 | i | | |
| 2216 | 6262 | AI177125 | g | | |
| 2217 | 23859 | AI072161 | f | | |
| 2218 | 21011 | H32189 | e | glutathione S-transferase M2 (muscle), glutathione S-transferase, mu 2 | ESTs, Moderately similar to GLUTATHIONE S-TRANSFERASE YB1 [*R. norvegicus*], glutathione S-S-transferase M1, glutathione S-transferase, mu 1 |
| 2220 | 2572 | AI177143 | b | | |
| 2221 | 25419 | M22922 | a | | |

TABLE 4

Atty. Docket No. 44921-5089US
Doc. No. 1803440.1

CODE KEY

| | Time(hrs) | Code |
|---|---|---|
| GENERAL TOXICITY | | |
| ACYCLOVIR | 24, 168 | General a |
| ACYCLOVIR | 6 | b |
| ADR | 120, 168 | c |

TABLE 4-continued

CODE KEY

| | Time(hrs) | Code |
|---|---|---|
| AY | 360 | d |
| BEA | 6, 24 | e |
| CAPTOPRIL | 336 | f |
| CARBOPLATIN | 6 | g |
| CEPHALORIDINE | 6, 24 | h |
| CIDOFOVIR | 120 | i |
| CISPANcombined | 6, 24 | j |
| CISPLATIN | 168 | k |
| CISPLATIN | 6, 24 | l |
| CISPLATIN | 6, 24, 168 | m |
| CITRININ | 6, 24 | n |
| COLCHICINE | 6, 24, 48 | o |
| CYCLOPHOSPHAMIDE | 6 | p |
| DIFLUNISAL | 24 | q |
| HYDRALAZINE | 6 | r |
| IFOSFAMIDE | 6, 24, 48, 144 | s |
| INDOMETHACIN | 48, 72 | t |
| LITHIUMCHLORIDE | 120 | u |
| MERCURICCHLORIDE | 3, 6, 24 | v |
| PAMIDRONATE | 24 | w |
| PAN | 168 | x |
| PAN | 6, 24 | y |
| PAN | 6, 24, 168 | z |
| SEMUSTINE | 168 | aa |
| SULFADIAZINE | 24 | bb |
| SULFADIAZINE | 3, 6 | cc |

TABLE 5

GENERAL

| Identifier | NonToxMean | NonToxSD | ToxMean | ToxSD | LDAScore |
|---|---|---|---|---|---|
| 12979 | 326.05 | 98.48 | 729.13 | 345.15 | 83.46 |
| 23314 | −7.57 | 63.50 | 480.54 | 528.59 | 83.43 |
| 5461 | 161.65 | 48.19 | 368.42 | 210.09 | 82.70 |
| 9583 | 40.60 | 17.67 | 158.01 | 127.01 | 82.56 |
| 16982 | 59.51 | 36.53 | 506.74 | 577.57 | 81.34 |
| 1809 | 5.28 | 13.85 | 191.53 | 265.23 | 81.21 |
| 19184 | 59.98 | 26.06 | 191.02 | 128.18 | 81.04 |
| 24200 | 382.07 | 78.91 | 618.97 | 199.18 | 80.18 |
| 15003 | 13.42 | 14.74 | 154.63 | 217.73 | 79.83 |
| 2629 | 18.92 | 8.93 | 58.17 | 43.50 | 79.72 |
| 22321 | 82.69 | 25.99 | 192.94 | 130.47 | 79.58 |
| 15301 | 20.84 | 20.65 | 124.72 | 132.03 | 79.47 |
| 15032 | 280.18 | 50.93 | 183.93 | 78.32 | 79.33 |
| 7489 | 89.81 | 28.30 | 47.02 | 25.94 | 79.28 |
| 2242 | 2431.04 | 453.24 | 1658.86 | 711.96 | 79.26 |
| 3050 | 77.80 | 26.29 | 166.37 | 91.49 | 79.22 |
| 22681 | 170.38 | 56.88 | 497.37 | 377.15 | 79.20 |
| 24042 | 4.31 | 9.28 | 112.52 | 198.98 | 79.06 |
| 14425 | 191.57 | 51.38 | 315.84 | 117.32 | 79.05 |
| 15300 | 104.10 | 41.29 | 305.26 | 261.16 | 79.01 |
| 23651 | 487.82 | 171.51 | 1473.41 | 1227.36 | 78.44 |
| 15964 | 1274.63 | 262.79 | 824.24 | 343.96 | 78.27 |
| 16312 | 44.81 | 17.42 | 107.40 | 60.46 | 78.21 |
| 16168 | 305.21 | 53.33 | 588.32 | 425.68 | 78.12 |
| 5384 | 28.68 | 24.27 | 102.33 | 70.63 | 78.08 |
| 12978 | 92.29 | 28.22 | 178.30 | 79.32 | 77.90 |
| 21654 | 332.77 | 53.62 | 518.29 | 196.63 | 77.78 |
| 3874 | 934.64 | 159.07 | 672.84 | 188.60 | 77.60 |
| 3049 | 176.71 | 56.69 | 334.05 | 163.05 | 77.39 |
| 16314 | 33.02 | 22.70 | 103.37 | 64.81 | 77.39 |
| 23299 | 345.71 | 73.26 | 514.49 | 166.24 | 77.35 |
| 9166 | 13.09 | 10.08 | 40.42 | 28.18 | 77.33 |
| 14763 | 1.59 | 39.67 | 228.03 | 268.46 | 77.30 |
| 4479 | 133.60 | 62.59 | 233.57 | 86.27 | 77.27 |
| 15928 | 142.69 | 34.11 | 244.10 | 90.89 | 77.08 |
| 3941 | 229.39 | 59.58 | 325.62 | 88.12 | 76.99 |
| 28 | 540.29 | 128.18 | 342.30 | 188.50 | 76.94 |
| 14929 | 687.79 | 150.66 | 1358.82 | 807.54 | 76.87 |
| 22885 | 1229.56 | 342.00 | 1987.11 | 703.59 | 76.84 |
| 22765 | 15.12 | 10.37 | 52.20 | 40.27 | 76.68 |
| 19040 | 158.12 | 34.83 | 333.27 | 212.49 | 76.68 |
| 21239 | 98.57 | 31.29 | 190.62 | 93.31 | 76.57 |
| 2555 | 83.76 | 25.31 | 159.42 | 79.77 | 76.51 |
| 15051 | 558.01 | 156.42 | 953.70 | 424.38 | 76.38 |
| 22569 | 701.48 | 148.25 | 468.05 | 181.60 | 76.33 |
| 15299 | 73.40 | 22.15 | 164.49 | 121.44 | 76.17 |
| 20116 | 1.36 | 12.44 | 53.19 | 60.94 | 76.12 |
| 7299 | 141.75 | 59.67 | 363.99 | 279.53 | 75.86 |
| 11618 | 445.83 | 108.35 | 290.61 | 162.81 | 75.81 |
| 23868 | 113.35 | 64.90 | 514.43 | 654.54 | 75.65 |
| 812 | 164.76 | 29.18 | 118.06 | 38.83 | 75.63 |
| 23166 | 116.47 | 37.76 | 215.89 | 104.73 | 75.55 |
| 19723 | 63.30 | 24.96 | 147.23 | 109.39 | 75.53 |
| 2161 | 10.89 | 22.79 | 40.17 | 28.34 | 75.53 |
| 22592 | 195.01 | 88.25 | 453.16 | 291.73 | 75.50 |
| 21683 | 27.66 | 14.45 | 65.00 | 37.84 | 75.44 |
| 7540 | 135.61 | 39.51 | 269.18 | 167.73 | 75.42 |
| 3121 | 1387.78 | 270.45 | 970.56 | 410.36 | 75.23 |
| 17325 | 37.68 | 26.79 | 190.12 | 198.72 | 75.23 |
| 4049 | 8.16 | 14.26 | 100.05 | 143.11 | 75.21 |
| 24219 | 294.84 | 62.68 | 415.01 | 115.05 | 75.14 |
| 7101 | 266.61 | 65.47 | 1024.56 | 1594.33 | 75.14 |
| 21462 | 246.43 | 47.45 | 320.88 | 67.53 | 75.11 |
| 21458 | 203.89 | 61.93 | 345.78 | 139.58 | 75.01 |
| 1460 | 178.45 | 37.93 | 302.50 | 171.15 | 74.92 |
| 23957 | 57.89 | 29.03 | 120.87 | 65.67 | 74.89 |
| 12921 | 92.69 | 31.09 | 174.99 | 86.55 | 74.88 |
| 24237 | 46.61 | 22.12 | 105.68 | 71.47 | 74.84 |
| 20830 | 482.35 | 118.55 | 717.12 | 282.77 | 74.80 |
| 14185 | 181.85 | 52.63 | 307.94 | 156.98 | 74.74 |
| 3091 | 821.34 | 154.51 | 616.81 | 215.94 | 74.73 |
| 6046 | 221.77 | 64.88 | 141.08 | 71.40 | 74.73 |
| 10818 | 509.63 | 159.26 | 301.00 | 207.18 | 74.63 |
| 18906 | 270.92 | 73.69 | 171.86 | 79.69 | 74.60 |
| 17361 | 160.53 | 54.00 | 92.22 | 55.73 | 74.60 |
| 574 | 297.07 | 48.04 | 543.78 | 340.56 | 74.58 |
| 1529 | 305.18 | 51.69 | 224.24 | 69.41 | 74.56 |
| 20161 | 30.38 | 21.73 | 80.33 | 56.50 | 74.54 |
| 22152 | −0.67 | 16.93 | 51.48 | 64.42 | 74.54 |
| 21391 | 183.11 | 55.68 | 391.43 | 249.63 | 74.34 |
| 20056 | 319.93 | 46.22 | 248.41 | 81.57 | 74.34 |
| 5711 | 402.83 | 114.80 | 268.76 | 100.84 | 74.34 |
| 16169 | 126.24 | 66.19 | 419.86 | 462.11 | 74.32 |
| 7196 | 160.17 | 37.22 | 297.55 | 159.08 | 74.29 |
| 13634 | 754.99 | 133.63 | 1123.83 | 475.68 | 74.29 |
| 10659 | 111.21 | 38.66 | 239.07 | 166.99 | 74.28 |
| 15089 | 162.94 | 57.42 | 271.19 | 109.36 | 74.26 |
| 2628 | 8.82 | 14.55 | 37.93 | 39.15 | 74.22 |
| 1521 | 7.84 | 37.91 | 80.00 | 74.26 | 74.20 |
| 17524 | 1225.79 | 235.19 | 927.05 | 284.85 | 74.20 |
| 14677 | 64.57 | 22.56 | 114.45 | 54.63 | 74.04 |
| 17357 | 284.47 | 66.73 | 189.90 | 103.16 | 73.97 |
| 15382 | 79.92 | 58.73 | 367.62 | 435.18 | 73.94 |
| 1141 | 226.12 | 47.74 | 315.88 | 93.78 | 73.94 |
| 3995 | 643.39 | 131.36 | 476.67 | 160.12 | 73.88 |
| 6804 | 1354.29 | 374.19 | 830.60 | 415.24 | 73.82 |
| 20694 | 1004.30 | 200.48 | 773.76 | 246.63 | 73.81 |
| 8477 | 493.77 | 117.87 | 724.70 | 226.98 | 73.80 |
| 13332 | 440.18 | 81.35 | 336.07 | 113.36 | 73.79 |
| 2912 | 2775.27 | 619.46 | 2040.05 | 590.49 | 73.79 |
| 8143 | 30.96 | 28.78 | 105.91 | 87.78 | 73.79 |
| 8639 | 351.67 | 79.66 | 468.70 | 121.28 | 73.78 |
| 354 | 191.57 | 43.15 | 335.31 | 175.98 | 73.77 |
| 2702 | 261.10 | 53.61 | 363.77 | 115.07 | 73.74 |
| 13411 | 857.90 | 304.76 | 508.64 | 242.77 | 73.71 |
| 23261 | 1651.29 | 316.95 | 1185.07 | 374.72 | 73.69 |

TABLE 5-continued

GENERAL

| Identifier | NonToxMean | NonToxSD | ToxMean | ToxSD | LDAScore |
|---|---|---|---|---|---|
| 16775 | 1092.58 | 348.47 | 732.47 | 398.39 | 73.66 |
| 10016 | 191.31 | 45.71 | 298.01 | 134.57 | 73.59 |
| 353 | 154.16 | 43.72 | 275.53 | 149.36 | 73.59 |
| 5295 | 199.26 | 56.55 | 318.50 | 126.31 | 73.55 |
| 10015 | 215.25 | 41.54 | 323.40 | 147.43 | 73.54 |
| 20458 | 377.19 | 83.99 | 283.38 | 95.28 | 73.52 |
| 23869 | 24.11 | 23.82 | 132.98 | 190.30 | 73.49 |
| 20848 | 474.69 | 80.77 | 708.43 | 261.80 | 73.46 |
| 9067 | 645.45 | 126.00 | 841.67 | 201.55 | 73.45 |
| 923 | 10.66 | 7.41 | 32.76 | 27.77 | 73.40 |
| 4291 | 317.92 | 87.25 | 202.30 | 99.83 | 73.38 |
| 18529 | 184.43 | 47.69 | 306.78 | 139.66 | 73.35 |
| 22626 | 66.24 | 25.65 | 191.03 | 161.08 | 73.32 |
| 3823 | 488.87 | 101.91 | 709.19 | 233.23 | 73.30 |
| 15663 | 179.56 | 40.22 | 269.94 | 97.24 | 73.29 |
| 22929 | 927.47 | 283.23 | 548.56 | 310.91 | 73.27 |
| 373 | 20.21 | 24.84 | 107.75 | 123.23 | 73.25 |
| 4952 | 97.10 | 31.18 | 160.25 | 66.14 | 73.23 |
| 2905 | 221.02 | 70.67 | 379.00 | 165.35 | 73.23 |
| 7127 | 301.01 | 84.77 | 195.82 | 87.14 | 73.22 |
| 20035 | 157.82 | 53.67 | 318.27 | 196.89 | 73.21 |
| 14424 | 40.56 | 38.11 | 216.48 | 294.45 | 73.19 |
| 1501 | 46.55 | 22.43 | 125.28 | 104.55 | 73.19 |
| 811 | 268.35 | 42.34 | 201.54 | 69.48 | 73.14 |
| 3610 | 1272.79 | 264.85 | 879.10 | 411.90 | 73.12 |
| 9053 | 249.79 | 41.36 | 192.96 | 58.86 | 73.09 |
| 23538 | 85.95 | 40.73 | 190.24 | 133.78 | 73.07 |
| 18337 | 1699.33 | 315.35 | 1236.46 | 390.84 | 73.06 |
| 15002 | 119.96 | 26.12 | 252.22 | 220.20 | 73.06 |
| 21147 | 365.33 | 62.56 | 285.83 | 76.45 | 73.05 |
| 8721 | 208.57 | 63.43 | 132.86 | 65.90 | 73.01 |
| 1462 | 364.98 | 75.98 | 659.63 | 429.84 | 73.01 |
| 11483 | 54.82 | 19.42 | 118.04 | 81.85 | 72.90 |
| 2348 | 545.81 | 197.73 | 349.07 | 201.06 | 72.86 |
| 1564 | 6.71 | 7.78 | 209.28 | 375.95 | 72.86 |
| 12467 | 60.46 | 20.47 | 103.84 | 48.93 | 72.85 |
| 6638 | 104.00 | 28.03 | 76.61 | 32.45 | 72.83 |
| 19031 | 50.08 | 27.00 | 116.79 | 84.17 | 72.83 |
| 1246 | 98.28 | 29.26 | 60.78 | 37.90 | 72.82 |
| 23872 | 30.55 | 27.67 | 146.46 | 207.24 | 72.80 |
| 19678 | 121.25 | 48.99 | 54.47 | 69.08 | 72.78 |
| 23512 | 1086.33 | 216.78 | 839.09 | 240.27 | 72.77 |
| 6321 | 458.69 | 127.59 | 644.50 | 219.13 | 72.75 |
| 22596 | 57.04 | 17.25 | 81.28 | 26.16 | 72.75 |
| 24431 | 50.52 | 15.50 | 151.16 | 210.56 | 72.73 |
| 15110 | 663.97 | 145.61 | 479.15 | 149.17 | 72.73 |
| 15892 | 12.32 | 15.49 | 44.12 | 34.64 | 72.71 |
| 14458 | 29.92 | 20.00 | 71.32 | 39.77 | 72.67 |
| 6641 | 402.83 | 66.65 | 309.63 | 82.93 | 72.53 |
| 1422 | 315.77 | 80.70 | 215.58 | 83.38 | 72.53 |
| 21443 | 90.59 | 31.63 | 155.73 | 92.87 | 72.53 |
| 8829 | 264.33 | 62.24 | 350.44 | 106.21 | 72.51 |
| 21632 | 27.74 | 33.70 | 87.38 | 68.91 | 72.48 |
| 24388 | 173.36 | 44.15 | 275.21 | 119.72 | 72.47 |
| 15851 | 171.96 | 68.96 | 332.47 | 267.49 | 72.38 |
| 15042 | 55.43 | 27.40 | 117.95 | 81.96 | 72.32 |
| 17908 | 49.38 | 21.99 | 125.19 | 121.11 | 72.32 |
| 15618 | 90.24 | 22.13 | 124.19 | 32.66 | 72.27 |
| 21318 | 41.50 | 23.94 | 72.71 | 32.13 | 72.27 |
| 6054 | 18.00 | 9.60 | 85.39 | 126.27 | 72.24 |
| 1727 | 30.19 | 25.05 | 113.76 | 121.46 | 72.19 |
| 23202 | 169.96 | 36.51 | 126.76 | 36.17 | 72.16 |
| 22248 | 216.64 | 78.55 | 393.59 | 188.26 | 72.15 |
| 22612 | 487.17 | 110.76 | 359.48 | 126.14 | 72.14 |
| 17734 | 106.27 | 34.17 | 214.91 | 182.70 | 72.12 |
| 19235 | 1112.95 | 271.69 | 810.00 | 308.94 | 72.06 |
| 13618 | 96.22 | 26.36 | 137.62 | 45.79 | 72.04 |
| 19525 | 23.64 | 12.50 | 46.38 | 27.18 | 72.03 |
| 4584 | 76.41 | 22.50 | 109.66 | 36.31 | 71.98 |
| 22197 | 112.68 | 34.33 | 178.88 | 75.61 | 71.98 |
| 24762 | 1064.07 | 310.38 | 755.53 | 273.04 | 71.97 |
| 10985 | 1189.01 | 218.09 | 885.13 | 290.39 | 71.96 |
| 3145 | 466.94 | 133.08 | 330.71 | 144.92 | 71.93 |
| 20828 | 278.75 | 83.71 | 482.02 | 272.83 | 71.89 |
| 2395 | 172.58 | 47.67 | 175.81 | 100.28 | 71.86 |
| 13609 | 252.08 | 52.43 | 186.04 | 64.47 | 71.86 |
| 21339 | 29.51 | 15.60 | 53.28 | 32.70 | 71.78 |
| 3079 | 27.52 | 22.01 | 67.24 | 49.93 | 71.78 |
| 16321 | 219.91 | 42.72 | 273.17 | 55.96 | 71.77 |
| 4944 | 100.32 | 33.19 | 177.16 | 86.89 | 71.77 |
| 24568 | 162.64 | 51.57 | 105.85 | 46.68 | 71.75 |
| 3875 | 539.59 | 120.20 | 389.50 | 146.06 | 71.75 |
| 6382 | 117.04 | 33.24 | 171.65 | 55.00 | 71.73 |
| 3959 | 329.28 | 86.36 | 451.00 | 151.79 | 71.73 |
| 8795 | 14.06 | 10.71 | 26.30 | 13.30 | 71.72 |
| 17477 | 102.32 | 22.97 | 156.34 | 68.17 | 71.71 |
| 7700 | 74.32 | 20.26 | 138.95 | 92.87 | 71.68 |
| 17550 | 1380.51 | 319.12 | 1028.40 | 363.64 | 71.63 |
| 410 | 1155.16 | 215.31 | 918.14 | 252.51 | 71.63 |
| 17682 | 706.42 | 143.23 | 505.72 | 215.80 | 71.63 |
| 5897 | 20.54 | 16.83 | 45.41 | 23.66 | 71.63 |
| 4661 | 288.80 | 58.15 | 408.62 | 120.87 | 71.59 |
| 16521 | 266.79 | 60.39 | 378.60 | 127.02 | 71.59 |
| 13610 | 371.99 | 53.12 | 283.18 | 88.22 | 71.55 |
| 22554 | 565.54 | 122.08 | 428.04 | 154.62 | 71.49 |
| 11910 | 25.51 | 35.83 | -5.43 | 31.38 | 71.47 |
| 15588 | -4.65 | 25.14 | 33.98 | 37.77 | 71.42 |
| 5601 | 1014.34 | 210.01 | 731.23 | 341.39 | 71.42 |
| 5780 | -23.15 | 27.07 | 32.19 | 62.08 | 71.38 |
| 21546 | -79.60 | 43.55 | 44.91 | 170.38 | 71.38 |
| 15039 | 285.29 | 65.31 | 206.99 | 101.12 | 71.38 |
| 18300 | 483.67 | 133.71 | 307.50 | 148.77 | 71.38 |
| 14970 | 215.37 | 35.86 | 161.84 | 54.69 | 71.32 |
| 13151 | 635.29 | 173.43 | 1103.53 | 626.81 | 71.31 |
| 7197 | 180.11 | 57.15 | 296.88 | 139.25 | 71.28 |
| 21238 | -24.44 | 33.42 | 22.20 | 43.34 | 71.27 |
| 25090 | 74.42 | 33.18 | 128.49 | 62.02 | 71.24 |
| 18564 | 225.23 | 44.60 | 181.56 | 58.17 | 71.23 |
| 1409 | 441.80 | 78.21 | 357.51 | 91.06 | 71.20 |
| 7903 | 526.91 | 184.33 | 331.16 | 186.75 | 71.18 |
| 24109 | 231.59 | 87.11 | 172.36 | 143.80 | 71.18 |
| 6416 | 108.18 | 41.02 | 234.59 | 190.53 | 71.17 |
| 2250 | 1462.04 | 256.17 | 1165.90 | 304.84 | 71.12 |
| 5867 | 157.83 | 35.87 | 210.76 | 63.63 | 71.11 |
| 17771 | 710.83 | 199.94 | 1089.58 | 460.00 | 71.09 |
| 5494 | 62.28 | 23.39 | 104.89 | 53.79 | 71.08 |
| 18269 | 729.55 | 160.51 | 578.31 | 143.90 | 71.07 |
| 14996 | 459.09 | 95.27 | 332.24 | 132.64 | 71.03 |
| 24617 | 27.48 | 28.57 | -0.27 | 26.14 | 71.02 |
| 23195 | 323.13 | 74.62 | 242.16 | 107.55 | 71.01 |
| 22656 | 113.29 | 44.19 | 184.20 | 80.34 | 70.99 |
| 8728 | 114.64 | 32.58 | 163.70 | 57.48 | 70.99 |
| 14664 | 56.90 | 24.89 | 82.06 | 31.36 | 70.98 |
| 22698 | 286.73 | 90.38 | 147.82 | 160.71 | 70.97 |
| 24053 | 35.17 | 15.83 | 56.32 | 29.72 | 70.97 |
| 6796 | 190.54 | 59.10 | 259.72 | 68.76 | 70.97 |
| 5474 | 783.73 | 210.50 | 556.59 | 211.13 | 70.96 |
| 22820 | 199.69 | 49.08 | 296.30 | 123.01 | 70.89 |
| 21796 | 666.75 | 117.72 | 898.08 | 374.38 | 70.88 |
| 25747 | 41.52 | 18.23 | 88.80 | 66.31 | 70.85 |
| 5443 | 12.36 | 13.98 | 34.29 | 27.55 | 70.84 |
| 12965 | 104.50 | 38.53 | 152.54 | 54.48 | 70.80 |
| 12332 | 602.96 | 147.89 | 428.95 | 204.34 | 70.77 |
| 3773 | 20.24 | 15.61 | 47.49 | 38.34 | 70.75 |
| 5990 | 310.53 | 65.78 | 375.84 | 76.70 | 70.73 |
| 18302 | 132.49 | 67.39 | 63.56 | 100.58 | 70.70 |
| 23964 | 9.67 | 12.94 | 24.20 | 18.71 | 70.68 |
| 9468 | 65.20 | 31.76 | 38.22 | 29.36 | 70.68 |
| 16631 | 14.50 | 12.00 | 57.40 | 80.51 | 70.66 |
| 21653 | 224.19 | 41.69 | 303.28 | 104.55 | 70.63 |
| 9097 | 272.42 | 76.73 | 194.27 | 78.59 | 70.61 |
| 11259 | 79.73 | 54.95 | 259.20 | 287.87 | 70.60 |
| 1081 | 515.94 | 100.86 | 394.77 | 126.28 | 70.58 |
| 18360 | 214.50 | 54.30 | 161.55 | 58.13 | 70.58 |

TABLE 5-continued

GENERAL

| Identifier | NonToxMean | NonToxSD | ToxMean | ToxSD | LDAScore |
|---|---|---|---|---|---|
| 4789 | 35.91 | 18.80 | 60.76 | 25.85 | 70.56 |
| 1798 | 346.08 | 90.64 | 258.66 | 95.94 | 70.56 |
| 25089 | 69.92 | 34.04 | 119.62 | 57.66 | 70.55 |
| 24234 | 170.64 | 48.79 | 257.81 | 150.22 | 70.55 |
| 23270 | 197.31 | 46.26 | 264.06 | 80.46 | 70.54 |
| 8339 | 457.12 | 115.09 | 336.46 | 156.58 | 70.52 |
| 4119 | 104.13 | 29.50 | 142.73 | 41.65 | 70.50 |
| 18581 | 239.39 | 63.97 | 323.89 | 102.81 | 70.48 |
| 8188 | 429.99 | 130.68 | 311.19 | 123.41 | 70.46 |
| 17950 | 60.85 | 21.71 | 84.23 | 24.05 | 70.45 |
| 11967 | 1829.61 | 479.72 | 1293.20 | 638.27 | 70.45 |
| 5252 | 13.79 | 9.94 | 24.05 | 13.59 | 70.44 |
| 22928 | 235.05 | 79.02 | 162.79 | 64.64 | 70.38 |
| 16684 | 483.85 | 102.78 | 662.86 | 218.95 | 70.37 |
| 1463 | 562.00 | 123.95 | 959.70 | 610.46 | 70.36 |
| 8495 | 174.57 | 44.41 | 233.96 | 68.66 | 70.36 |
| 2195 | 94.72 | 37.50 | 60.02 | 37.89 | 70.35 |
| 3042 | 289.42 | 130.30 | 458.48 | 192.79 | 70.34 |
| 15330 | 96.55 | 24.69 | 69.31 | 26.59 | 70.32 |
| 12399 | 80.36 | 27.26 | 110.73 | 35.05 | 70.32 |
| 16351 | 67.79 | 22.25 | 109.53 | 54.61 | 70.27 |
| 3822 | 871.73 | 175.65 | 1184.82 | 469.53 | 70.26 |
| 21025 | 483.29 | 121.39 | 358.54 | 123.38 | 70.26 |
| 6548 | 93.61 | 35.75 | 138.74 | 52.86 | 70.23 |
| 12561 | 159.96 | 46.53 | 108.93 | 51.49 | 70.19 |
| 5481 | 36.03 | 51.29 | 102.88 | 72.89 | 70.19 |
| 3430 | 414.54 | 95.45 | 587.65 | 251.37 | 70.17 |
| 26335 | 940.03 | 330.95 | 625.84 | 337.88 | 70.16 |
| 352 | 77.57 | 33.06 | 132.92 | 75.36 | 70.14 |
| 23044 | 213.44 | 34.48 | 253.69 | 53.74 | 70.13 |
| 17161 | 1069.69 | 220.67 | 1639.92 | 740.76 | 70.11 |
| 14352 | 179.82 | 26.18 | 211.25 | 38.48 | 70.10 |
| 21993 | 71.93 | 19.33 | 98.79 | 30.29 | 70.09 |
| 16756 | 165.09 | 40.66 | 231.09 | 68.53 | 70.09 |
| 7537 | 240.15 | 64.50 | 185.74 | 68.65 | 70.09 |
| 15986 | 336.87 | 70.00 | 240.73 | 102.05 | 70.07 |
| 17256 | 428.03 | 84.39 | 329.02 | 149.16 | 70.04 |
| 18151 | 1182.11 | 241.37 | 915.26 | 244.04 | 70.03 |
| 18354 | 372.44 | 129.56 | 548.59 | 224.71 | 70.03 |
| 19152 | 155.28 | 37.87 | 219.58 | 85.40 | 70.01 |
| 8314 | 44.66 | 24.23 | 401.40 | 1027.58 | 70.01 |
| 13222 | 132.87 | 25.87 | 162.46 | 38.58 | 69.99 |
| 3808 | 157.93 | 29.12 | 224.59 | 103.04 | 69.99 |
| 25705 | 432.30 | 81.33 | 560.17 | 181.12 | 69.98 |
| 4360 | 341.32 | 51.71 | 279.62 | 90.37 | 69.97 |
| 15904 | 48.14 | 15.72 | 70.45 | 28.37 | 69.96 |
| 3733 | 307.48 | 109.96 | 502.42 | 242.20 | 69.95 |
| 12349 | 248.84 | 51.51 | 206.79 | 57.13 | 69.94 |
| 6039 | 293.57 | 52.57 | 404.95 | 147.79 | 69.94 |
| 16394 | 529.95 | 207.80 | 998.31 | 642.96 | 69.92 |
| 1340 | 194.50 | 26.68 | 172.82 | 51.16 | 69.92 |
| 13393 | 68.65 | 39.60 | 120.92 | 67.73 | 69.91 |
| 26119 | 115.29 | 35.39 | 165.90 | 63.73 | 69.91 |
| 21471 | −15.71 | 27.91 | 21.66 | 45.38 | 69.91 |
| 498 | 513.15 | 100.54 | 694.75 | 220.14 | 69.89 |
| 19 | 324.56 | 59.40 | 415.19 | 125.18 | 69.89 |
| 22599 | 40.60 | 18.16 | 65.55 | 34.14 | 69.84 |
| 7427 | 235.31 | 43.69 | 295.43 | 88.56 | 69.83 |
| 16520 | 82.42 | 40.09 | 151.39 | 91.91 | 69.83 |
| 15642 | 389.37 | 82.84 | 518.22 | 172.58 | 69.83 |
| 1430 | 171.08 | 83.75 | 102.96 | 99.73 | 69.82 |
| 7918 | 36.73 | 13.76 | 61.83 | 31.90 | 69.82 |
| 13633 | 276.86 | 77.72 | 463.55 | 259.47 | 69.80 |
| 7936 | 155.24 | 33.42 | 122.46 | 38.98 | 69.79 |
| 15004 | 132.61 | 42.50 | 344.40 | 385.03 | 69.78 |
| 15955 | 791.51 | 166.06 | 571.10 | 228.60 | 69.77 |
| 1478 | 366.90 | 66.96 | 278.05 | 99.94 | 69.75 |
| 7622 | 55.21 | 18.42 | 74.69 | 23.71 | 69.75 |
| 22796 | 7.01 | 12.41 | 21.99 | 21.24 | 69.73 |
| 17401 | 821.97 | 205.41 | 1398.10 | 790.55 | 69.73 |
| 7888 | 262.03 | 59.59 | 349.92 | 94.63 | 69.72 |
| 13392 | 181.47 | 36.33 | 245.35 | 76.20 | 69.70 |
| 22101 | 199.60 | 77.45 | 118.24 | 102.76 | 69.70 |
| 18 | 61.29 | 34.62 | 98.91 | 45.09 | 69.69 |
| 21657 | 407.16 | 79.73 | 529.18 | 177.19 | 69.69 |
| 20414 | 124.45 | 34.92 | 93.89 | 36.15 | 69.68 |
| 3652 | 40.90 | 23.02 | 80.54 | 43.90 | 69.64 |
| 12436 | 40.94 | 17.34 | 63.44 | 29.74 | 69.64 |
| 15011 | 90.81 | 29.75 | 122.02 | 40.98 | 69.63 |
| 3434 | 300.37 | 104.25 | 456.96 | 211.34 | 69.62 |
| 21444 | 10.25 | 27.61 | 65.55 | 77.70 | 69.62 |
| 3493 | 56.09 | 16.33 | 78.09 | 27.67 | 69.58 |
| 13727 | 133.95 | 49.99 | 86.22 | 54.51 | 69.58 |
| 17339 | 2512.73 | 596.97 | 1882.04 | 680.16 | 69.56 |
| 6518 | 108.28 | 26.66 | 143.55 | 38.12 | 69.55 |
| 14484 | 468.99 | 102.51 | 371.12 | 113.87 | 69.50 |
| 45 | 184.62 | 61.15 | 131.00 | 98.51 | 69.50 |
| 4235 | 383.35 | 65.78 | 479.39 | 109.87 | 69.47 |
| 2350 | 631.18 | 75.04 | 733.81 | 127.04 | 69.47 |
| 20816 | 359.20 | 71.33 | 589.66 | 361.06 | 69.47 |
| 20448 | 51.14 | 15.80 | 96.53 | 91.69 | 69.45 |
| 3608 | 354.31 | 96.17 | 240.45 | 122.08 | 69.45 |
| 20829 | 754.23 | 187.16 | 1139.64 | 525.74 | 69.43 |
| 14388 | 133.84 | 46.32 | 189.57 | 73.63 | 69.41 |
| 13974 | 269.51 | 60.19 | 455.96 | 331.84 | 69.41 |
| 13611 | 289.40 | 97.62 | 194.81 | 124.78 | 69.39 |
| 9452 | 109.85 | 33.54 | 243.69 | 304.19 | 69.39 |
| 19679 | 744.23 | 156.00 | 548.50 | 220.11 | 69.38 |
| 23471 | 80.62 | 27.27 | 134.19 | 61.98 | 69.38 |
| 15596 | 200.04 | 61.45 | 269.73 | 83.16 | 69.38 |
| 17159 | 662.06 | 139.21 | 916.50 | 373.05 | 69.37 |
| 9114 | 907.26 | 198.07 | 711.93 | 216.95 | 69.36 |
| 7690 | 188.30 | 76.58 | 286.44 | 101.61 | 69.30 |
| 4462 | 896.55 | 240.26 | 700.53 | 283.12 | 69.30 |
| 15146 | 117.66 | 45.74 | 219.43 | 151.19 | 69.28 |
| 4747 | 52.09 | 18.56 | 76.30 | 30.54 | 69.28 |
| 4463 | 171.78 | 48.48 | 116.71 | 64.25 | 69.26 |
| 21275 | 208.39 | 53.25 | 293.29 | 120.48 | 69.26 |
| 22537 | 314.16 | 116.85 | 217.64 | 134.70 | 69.24 |
| 21015 | 224.01 | 149.40 | 523.06 | 502.39 | 69.21 |
| 14184 | 104.95 | 35.03 | 152.30 | 77.88 | 69.21 |
| 16859 | 113.00 | 39.98 | 171.46 | 70.52 | 69.20 |
| 13359 | 18.79 | 19.20 | 41.55 | 29.30 | 69.17 |
| 24192 | 65.10 | 27.46 | 107.06 | 63.04 | 69.17 |
| 22357 | 537.91 | 143.42 | 683.30 | 219.11 | 69.15 |
| 22540 | 1928.78 | 500.80 | 1396.93 | 518.89 | 69.15 |
| 15111 | 1008.00 | 256.31 | 739.45 | 278.04 | 69.15 |
| 23128 | 629.03 | 117.68 | 522.92 | 126.85 | 69.13 |
| 9905 | 702.23 | 115.37 | 558.07 | 156.97 | 69.13 |
| 23387 | 23.75 | 24.01 | 57.01 | 48.92 | 69.12 |
| 21797 | 316.03 | 77.43 | 447.83 | 179.03 | 69.12 |
| 20457 | 401.15 | 78.89 | 312.93 | 100.71 | 69.12 |
| 13954 | 1425.24 | 337.03 | 1039.20 | 391.69 | 69.12 |
| 2059 | 134.19 | 33.99 | 173.66 | 52.56 | 69.11 |
| 21125 | 163.43 | 45.61 | 120.34 | 59.14 | 69.08 |
| 4048 | −12.32 | 8.61 | 25.98 | 74.75 | 69.08 |
| 13349 | 122.00 | 33.87 | 171.03 | 54.95 | 69.08 |
| 20086 | 103.42 | 54.54 | 186.02 | 112.44 | 69.07 |
| 7414 | 177.49 | 39.38 | 246.64 | 72.25 | 69.07 |
| 4327 | 84.49 | 26.30 | 133.01 | 68.89 | 69.07 |
| 19011 | 389.45 | 84.42 | 492.01 | 130.94 | 69.04 |
| 6384 | 55.77 | 19.77 | 79.31 | 27.28 | 69.03 |
| 8221 | 192.95 | 91.60 | 123.84 | 72.63 | 69.02 |
| 11876 | 100.42 | 32.61 | 145.49 | 59.19 | 69.00 |
| 275 | 540.79 | 117.63 | 450.26 | 289.26 | 69.00 |
| 19940 | 19.25 | 13.33 | 32.95 | 17.53 | 68.99 |
| 21895 | 415.77 | 107.68 | 527.63 | 122.68 | 68.99 |
| 6674 | 2589.26 | 592.43 | 1970.28 | 559.33 | 68.97 |
| 4330 | 519.93 | 146.26 | 393.68 | 177.88 | 68.97 |
| 1698 | 59.46 | 33.76 | 154.33 | 156.35 | 68.96 |
| 6927 | 351.13 | 88.63 | 276.07 | 87.17 | 68.95 |
| 15879 | 389.05 | 88.44 | 309.88 | 89.07 | 68.94 |
| 17269 | 669.21 | 164.65 | 510.44 | 183.69 | 68.94 |
| 809 | 38.57 | 18.55 | 73.18 | 50.10 | 68.93 |

TABLE 5-continued

GENERAL

| Identifier | NonToxMean | NonToxSD | ToxMean | ToxSD | LDAScore |
|---|---|---|---|---|---|
| 25567 | 429.75 | 132.83 | 636.76 | 280.62 | 68.91 |
| 6711 | 46.47 | 22.83 | 68.95 | 25.01 | 68.91 |
| 25777 | 370.17 | 112.15 | 585.45 | 351.28 | 68.90 |
| 22801 | 1309.01 | 233.61 | 1102.68 | 241.27 | 68.88 |
| 17447 | 912.03 | 226.33 | 708.62 | 297.79 | 68.88 |
| 1603 | 652.04 | 149.41 | 516.80 | 165.06 | 68.85 |
| 20460 | 363.41 | 114.33 | 257.61 | 112.54 | 68.84 |
| 21145 | 216.97 | 60.61 | 173.14 | 61.10 | 68.83 |
| 25453 | 225.18 | 45.75 | 181.00 | 63.32 | 68.81 |
| 14670 | 1156.99 | 219.65 | 1505.97 | 540.37 | 68.80 |
| 19623 | 56.27 | 29.98 | 87.15 | 39.31 | 68.80 |
| 12716 | 167.13 | 43.68 | 133.50 | 41.78 | 68.80 |
| 24236 | 75.95 | 22.54 | 104.28 | 32.01 | 68.79 |
| 15617 | 18.52 | 33.89 | 39.26 | 21.38 | 68.79 |
| 3925 | 498.78 | 107.84 | 390.92 | 113.69 | 68.77 |
| 20449 | 39.97 | 25.35 | 119.71 | 151.16 | 68.76 |
| 21390 | 89.77 | 28.23 | 115.10 | 33.69 | 68.76 |
| 23514 | 434.32 | 164.14 | 307.02 | 151.33 | 68.74 |
| 20849 | 259.38 | 58.40 | 370.11 | 145.72 | 68.74 |
| 794 | 224.09 | 52.71 | 162.86 | 64.32 | 68.71 |
| 4592 | 183.27 | 30.19 | 222.63 | 53.46 | 68.70 |
| 13614 | 325.22 | 70.14 | 423.70 | 138.23 | 68.70 |
| 12673 | 32.94 | 15.97 | 60.47 | 35.35 | 68.69 |
| 3125 | 347.43 | 89.73 | 270.34 | 103.82 | 68.67 |
| 4232 | 131.63 | 36.97 | 170.35 | 127.98 | 68.67 |
| 1399 | 187.08 | 41.04 | 289.41 | 156.72 | 68.66 |
| 13930 | 114.32 | 44.14 | 212.08 | 140.70 | 68.65 |
| 5689 | 9.09 | 13.75 | 27.68 | 24.99 | 68.63 |
| 2370 | 1158.46 | 172.59 | 949.24 | 224.94 | 68.63 |
| 4933 | 93.92 | 113.34 | 358.13 | 386.59 | 68.63 |
| 406 | 374.38 | 68.18 | 306.59 | 91.47 | 68.62 |
| 22957 | 165.92 | 62.59 | 266.91 | 150.55 | 68.62 |
| 2768 | 2026.25 | 370.26 | 1657.86 | 463.04 | 68.61 |
| 24197 | 243.13 | 77.12 | 185.53 | 85.84 | 68.60 |
| 16650 | 242.10 | 65.10 | 338.01 | 127.40 | 68.57 |
| 8085 | 36.42 | 17.42 | 58.09 | 26.97 | 68.57 |
| 1712 | 167.50 | 36.63 | 216.60 | 72.08 | 68.57 |
| 5565 | 407.17 | 100.35 | 305.41 | 133.21 | 68.56 |
| 16883 | 1543.18 | 301.38 | 1229.72 | 308.97 | 68.55 |
| 13622 | 45.42 | 26.78 | 87.87 | 76.11 | 68.55 |
| 17807 | 711.63 | 133.84 | 948.59 | 316.04 | 68.55 |
| 8496 | 39.06 | 20.93 | 64.65 | 32.09 | 68.53 |
| 11559 | 615.91 | 118.47 | 505.06 | 115.82 | 68.53 |
| 19094 | 1013.42 | 192.17 | 1274.36 | 327.89 | 68.53 |
| 7584 | 99.66 | 69.21 | 216.92 | 170.84 | 68.53 |
| 457 | 268.02 | 49.06 | 378.26 | 164.79 | 68.53 |
| 21105 | 323.39 | 54.03 | 270.87 | 64.06 | 68.52 |
| 18900 | 449.75 | 84.06 | 557.56 | 130.48 | 68.48 |
| 16709 | 858.46 | 172.57 | 709.82 | 176.49 | 68.46 |
| 1993 | 26.13 | 15.23 | 53.08 | 37.27 | 68.43 |
| 13348 | 116.50 | 39.71 | 170.35 | 84.06 | 68.43 |
| 11454 | 223.14 | 54.78 | 315.07 | 133.93 | 68.43 |
| 18606 | 608.53 | 116.39 | 789.92 | 267.15 | 68.43 |
| 2986 | 39.62 | 12.73 | 54.78 | 18.98 | 68.41 |
| 15644 | 1338.83 | 225.09 | 1588.45 | 345.24 | 68.39 |
| 22541 | 3613.59 | 853.73 | 2681.23 | 879.66 | 68.39 |
| 17905 | 902.96 | 243.00 | 654.49 | 232.60 | 68.38 |
| 408 | 201.66 | 67.43 | 144.70 | 78.36 | 68.37 |
| 21409 | 86.43 | 35.21 | 119.21 | 45.92 | 68.37 |
| 22543 | 721.16 | 195.27 | 540.47 | 258.13 | 68.36 |
| 3863 | 214.88 | 78.45 | 158.64 | 93.71 | 68.36 |
| 21596 | 100.77 | 27.25 | 132.16 | 47.14 | 68.33 |
| 1583 | 25.58 | 12.08 | 46.81 | 25.12 | 68.32 |
| 8917 | 41.59 | 14.82 | 56.19 | 17.88 | 68.31 |
| 17324 | 371.15 | 66.13 | 297.98 | 105.05 | 68.30 |
| 5199 | 641.61 | 169.29 | 484.54 | 199.84 | 68.29 |
| 11164 | 532.49 | 129.79 | 382.15 | 153.36 | 68.28 |
| 10887 | 76.37 | 24.73 | 54.29 | 25.72 | 68.28 |
| 15540 | 36.28 | 11.51 | 64.56 | 42.69 | 68.27 |
| 4949 | 1162.93 | 273.54 | 892.52 | 329.00 | 68.26 |
| 21024 | 596.29 | 101.41 | 489.27 | 121.68 | 68.26 |
| 19085 | 70.29 | 20.84 | 101.53 | 44.09 | 68.25 |
| 25718 | 380.48 | 63.33 | 465.71 | 138.80 | 68.25 |
| 3981 | 53.40 | 27.49 | 166.56 | 218.99 | 68.25 |
| 19939 | 176.96 | 53.69 | 235.92 | 70.52 | 68.24 |
| 21305 | 438.34 | 113.88 | 332.58 | 104.75 | 68.23 |
| 22833 | 431.45 | 106.61 | 540.94 | 147.67 | 68.23 |
| 13310 | 116.08 | 48.35 | 197.32 | 125.83 | 68.22 |
| 19187 | 102.48 | 30.70 | 135.61 | 50.44 | 68.21 |
| 18011 | 27.06 | 22.52 | 56.30 | 38.43 | 68.21 |
| 24895 | 78.92 | 42.28 | 60.83 | 59.54 | 68.21 |
| 11563 | 52.55 | 31.11 | 94.44 | 49.63 | 68.20 |
| 2506 | 78.97 | 20.73 | 98.29 | 25.44 | 68.20 |
| 10434 | 30.66 | 16.63 | 56.30 | 35.67 | 68.19 |
| 23546 | 749.61 | 138.38 | 631.19 | 195.15 | 68.19 |
| 17104 | 430.01 | 79.30 | 558.85 | 188.65 | 68.18 |
| 12587 | 236.86 | 55.30 | 189.70 | 64.51 | 68.17 |
| 17316 | 70.29 | 31.03 | 47.27 | 32.31 | 68.17 |
| 10464 | 136.34 | 32.97 | 104.50 | 38.05 | 68.15 |
| 15185 | 154.81 | 45.05 | 251.81 | 139.06 | 68.15 |
| 22689 | 44.68 | 18.28 | 64.87 | 29.10 | 68.14 |
| 5855 | 74.85 | 27.42 | 52.36 | 35.41 | 68.14 |
| 2140 | 160.37 | 40.29 | 131.23 | 57.33 | 68.11 |
| 1510 | 780.11 | 196.05 | 591.05 | 213.64 | 68.11 |
| 15313 | 6.84 | 9.54 | 24.57 | 23.36 | 68.10 |
| 8972 | 26.33 | 18.24 | 47.84 | 25.93 | 68.10 |
| 2888 | 2111.78 | 515.11 | 1569.20 | 595.26 | 68.10 |
| 23834 | 68.94 | 19.78 | 90.90 | 31.53 | 68.09 |
| 3082 | 244.35 | 47.01 | 302.78 | 72.37 | 68.09 |
| 3467 | 738.89 | 191.34 | 549.12 | 221.95 | 68.09 |
| 16476 | 738.64 | 159.14 | 630.49 | 196.22 | 68.09 |
| 5819 | 230.72 | 47.15 | 189.99 | 56.21 | 68.08 |
| 1942 | 12.95 | 13.20 | 45.54 | 48.73 | 68.08 |
| 514 | 4.47 | 50.55 | 52.66 | 58.22 | 68.08 |
| 19768 | 683.61 | 138.87 | 883.43 | 263.72 | 68.06 |
| 5183 | 204.36 | 51.85 | 284.20 | 109.64 | 68.06 |
| 24375 | 107.65 | 26.73 | 157.63 | 66.73 | 68.05 |
| 6059 | 199.74 | 47.55 | 169.09 | 54.88 | 68.04 |
| 12937 | 20.23 | 21.04 | 62.89 | 58.77 | 68.04 |
| 3245 | 97.45 | 32.09 | 132.43 | 48.29 | 68.02 |
| 19469 | 376.00 | 72.62 | 300.86 | 98.78 | 68.02 |
| 22696 | 72.56 | 48.08 | 25.09 | 39.70 | 68.02 |
| 4355 | 116.49 | 44.14 | 163.32 | 82.62 | 68.01 |
| 21579 | 110.85 | 35.32 | 153.51 | 68.22 | 68.00 |
| 1431 | 521.93 | 166.42 | 374.89 | 194.57 | 67.99 |
| 9673 | 66.91 | 27.02 | 44.90 | 26.55 | 67.99 |
| 20257 | 137.10 | 42.30 | 102.53 | 48.53 | 67.99 |
| 12961 | 185.53 | 42.22 | 151.73 | 41.05 | 67.97 |
| 22538 | 338.12 | 80.15 | 255.39 | 90.87 | 67.97 |
| 7243 | 56.76 | 22.51 | 79.45 | 28.02 | 67.96 |
| 5634 | 64.78 | 29.00 | 96.85 | 47.59 | 67.96 |
| 17438 | 62.59 | 33.01 | 31.95 | 40.59 | 67.96 |
| 1581 | 70.58 | 17.49 | 93.61 | 30.37 | 67.96 |
| 25379 | 75.47 | 18.52 | 100.15 | 31.59 | 67.95 |
| 2153 | 153.35 | 49.73 | 361.58 | 346.41 | 67.94 |
| 7499 | 17.61 | 8.98 | 28.61 | 16.07 | 67.94 |
| 6102 | 150.29 | 40.49 | 187.75 | 46.70 | 67.94 |
| 3878 | 479.08 | 106.98 | 389.02 | 107.79 | 67.93 |
| 20122 | 174.65 | 39.83 | 214.44 | 52.37 | 67.93 |
| 6828 | 122.12 | 53.45 | 207.48 | 104.75 | 67.92 |
| 11455 | 106.22 | 31.64 | 162.96 | 86.72 | 67.92 |
| 16058 | 146.84 | 40.61 | 225.40 | 102.56 | 67.92 |
| 23567 | 42.81 | 36.02 | 114.42 | 124.08 | 67.90 |
| 19998 | 290.74 | 86.07 | 214.07 | 102.16 | 67.90 |
| 24054 | 25.17 | 14.49 | 39.46 | 20.61 | 67.89 |
| 22352 | 139.84 | 54.27 | 253.98 | 211.46 | 67.89 |
| 21146 | 119.46 | 36.34 | 92.66 | 39.95 | 67.89 |
| 11791 | 136.74 | 46.57 | 173.47 | 50.00 | 67.88 |
| 19086 | 102.38 | 32.93 | 153.92 | 65.34 | 67.87 |
| 13111 | 235.97 | 68.33 | 187.10 | 77.46 | 67.86 |
| 14959 | 595.43 | 107.90 | 761.75 | 241.85 | 67.86 |
| 22103 | 222.38 | 50.69 | 294.15 | 83.02 | 67.84 |
| 1454 | 110.82 | 42.51 | 160.57 | 70.87 | 67.83 |
| 1844 | 167.38 | 35.91 | 216.33 | 60.90 | 67.83 |

TABLE 5-continued

Atty. Docket No. 44921-5089US
Doc. No. 1803440.1

GENERAL

| Identifier | NonToxMean | NonToxSD | ToxMean | ToxSD | LDAScore |
|---|---|---|---|---|---|
| 13023 | 110.03 | 149.11 | 607.48 | 946.55 | 67.81 |
| 22487 | 34.23 | 15.90 | 60.56 | 35.71 | 67.80 |
| 7543 | 268.34 | 96.90 | 185.92 | 86.13 | 67.80 |
| 3107 | 779.30 | 164.38 | 696.29 | 236.36 | 67.80 |
| 8975 | 102.89 | 42.50 | 68.46 | 48.06 | 67.80 |
| 825 | 59.44 | 21.82 | 42.35 | 25.50 | 67.80 |
| 4473 | 192.83 | 43.69 | 148.92 | 66.25 | 67.78 |
| 18109 | 15.28 | 14.01 | 39.23 | 36.39 | 67.78 |
| 2845 | 651.40 | 103.22 | 768.87 | 160.95 | 67.76 |
| 11974 | 247.17 | 76.60 | 176.82 | 86.10 | 67.73 |
| 3547 | 14.36 | 11.57 | 25.42 | 14.68 | 67.73 |
| 22931 | 87.38 | 47.83 | 52.96 | 42.09 | 67.72 |
| 7161 | 46.95 | 14.21 | 64.96 | 24.05 | 67.69 |
| 9061 | 1135.34 | 236.25 | 942.16 | 326.87 | 67.69 |
| 12331 | 618.37 | 134.26 | 483.61 | 182.86 | 67.69 |
| 13962 | 523.52 | 110.90 | 438.13 | 148.62 | 67.68 |
| 24277 | 134.73 | 41.18 | 181.65 | 55.29 | 67.67 |
| 14790 | 176.36 | 78.47 | 102.86 | 72.99 | 67.67 |
| 18528 | 361.23 | 136.11 | 589.25 | 331.81 | 67.66 |
| 19665 | 81.08 | 33.19 | 142.12 | 76.68 | 67.66 |
| 14242 | 32.67 | 14.37 | 49.07 | 20.85 | 67.64 |
| 17407 | 1713.79 | 374.66 | 1443.40 | 337.67 | 67.64 |
| 6765 | 820.06 | 183.88 | 653.70 | 231.97 | 67.62 |
| 9514 | 675.01 | 129.64 | 570.37 | 132.48 | 67.62 |
| 22602 | 334.13 | 94.17 | 237.80 | 117.01 | 67.57 |
| 19822 | 1669.92 | 376.25 | 1281.37 | 430.75 | 67.56 |
| 9699 | 58.47 | 18.16 | 42.68 | 19.82 | 67.55 |
| 12812 | 99.34 | 33.83 | 74.64 | 38.83 | 67.55 |
| 24566 | 200.15 | 82.45 | 135.98 | 77.12 | 67.54 |
| 17499 | 24.56 | 23.09 | 55.11 | 35.51 | 67.53 |
| 18447 | 1233.88 | 274.38 | 958.23 | 329.75 | 67.53 |
| 21014 | 142.85 | 40.94 | 210.35 | 117.97 | 67.52 |
| 2536 | 406.73 | 114.26 | 323.04 | 150.73 | 67.51 |

TABLE 5A

Atty. Docket No. 44921-5089US
Doc. No. 1803440.1

ACYCLOVIR
Timepoint(s): 24, 168 hrs

| Identifier | NonToxMean | NonToxSD | ToxMean | ToxSD | LDAScore |
|---|---|---|---|---|---|
| 25419 | 159.17 | 64.32 | 38.16 | 8.66 | 99.48 |
| 25415 | 169.94 | 67.00 | 36.68 | 10.41 | 99.48 |
| 1872 | 723.76 | 219.40 | 812.16 | 67.65 | 99.36 |
| 17198 | 814.88 | 264.22 | 145.60 | 82.51 | 99.14 |
| 17567 | 1172.88 | 345.04 | 2623.71 | 250.73 | 98.97 |
| 14959 | 616.48 | 139.00 | 1288.62 | 137.24 | 98.84 |
| 20945 | 896.18 | 242.10 | 1896.41 | 180.47 | 98.80 |
| 16245 | 387.31 | 114.23 | 41.23 | 45.70 | 98.80 |
| 10887 | 73.83 | 25.90 | 17.83 | 4.94 | 98.67 |
| 4222 | 544.00 | 97.71 | 1042.92 | 176.22 | 98.67 |
| 19161 | 1064.06 | 296.13 | 2360.57 | 327.19 | 98.63 |
| 15626 | 1281.17 | 347.65 | 3250.17 | 648.92 | 98.58 |
| 11849 | 701.03 | 165.94 | 1608.51 | 320.36 | 98.50 |
| 20872 | 832.75 | 216.84 | 1896.38 | 376.01 | 98.50 |
| 15875 | 1175.87 | 375.74 | 2630.93 | 347.24 | 98.45 |
| 10498 | 1085.24 | 333.50 | 2568.66 | 334.73 | 98.45 |
| 20884 | 639.33 | 257.31 | 46.55 | 54.58 | 98.37 |
| 13151 | 702.17 | 319.88 | 2212.94 | 511.24 | 98.32 |
| 18611 | 1409.99 | 440.83 | 2945.57 | 350.22 | 98.28 |
| 20885 | 538.89 | 188.67 | 83.65 | 54.88 | 98.28 |
| 16244 | 40.33 | 21.14 | -0.26 | 5.01 | 98.24 |
| 16918 | 1172.71 | 382.43 | 2977.59 | 742.16 | 98.15 |
| 3027 | 1121.82 | 319.93 | 2267.04 | 262.71 | 98.15 |
| 20056 | 309.42 | 59.71 | 118.77 | 41.29 | 98.11 |
| 16205 | 932.31 | 252.05 | 1896.76 | 307.48 | 98.02 |

TABLE 5A-continued

Atty. Docket No. 44921-5089US
Doc. No. 1803440.1

ACYCLOVIR
Timepoint(s): 24, 168 hrs

| Identifier | NonToxMean | NonToxSD | ToxMean | ToxSD | LDAScore |
|---|---|---|---|---|---|
| 20812 | 1107.00 | 305.73 | 2296.29 | 293.56 | 97.98 |
| 14384 | 375.87 | 76.79 | 604.80 | 58.76 | 97.94 |
| 24615 | 809.56 | 214.82 | 1799.64 | 368.34 | 97.94 |
| 17524 | 1175.90 | 282.46 | 541.39 | 119.09 | 97.85 |
| 20839 | 1037.63 | 274.92 | 2191.65 | 391.42 | 97.85 |
| 18250 | 1088.85 | 307.06 | 2058.50 | 257.28 | 97.77 |
| 22846 | 1492.71 | 284.92 | 855.87 | 120.77 | 97.68 |
| 3026 | 512.85 | 99.35 | 933.31 | 159.19 | 97.64 |
| 13647 | 864.69 | 256.24 | 2095.09 | 431.00 | 97.64 |
| 17563 | 1195.18 | 331.95 | 2542.06 | 387.04 | 97.59 |
| 17473 | 422.91 | 93.66 | 796.08 | 169.41 | 97.59 |
| 20746 | 673.25 | 126.38 | 1181.14 | 211.43 | 97.59 |
| 19359 | 1061.61 | 314.08 | 2336.47 | 601.88 | 97.51 |
| 15201 | 1478.32 | 513.09 | 3558.35 | 808.75 | 97.47 |
| 15052 | 1433.93 | 492.46 | 3597.61 | 980.31 | 97.42 |
| 4490 | 76.73 | 73.42 | 270.49 | 135.30 | 97.42 |
| 2696 | 773.00 | 225.06 | 1860.28 | 390.37 | 97.42 |
| 22552 | 313.47 | 90.91 | 645.46 | 155.87 | 97.38 |
| 1694 | 1139.80 | 326.74 | 2255.77 | 345.62 | 97.38 |
| 19824 | 224.99 | 67.29 | 73.65 | 27.54 | 97.34 |
| 16333 | 133.41 | 38.84 | 45.56 | 15.40 | 97.16 |
| 16150 | 495.73 | 119.09 | 217.15 | 50.78 | 97.16 |
| 15928 | 157.91 | 59.34 | 354.44 | 52.65 | 97.16 |
| 15335 | 424.77 | 103.56 | 772.54 | 127.56 | 96.99 |
| 15202 | 788.60 | 313.98 | 1866.58 | 266.92 | 96.99 |
| 18749 | 116.41 | 42.26 | 34.59 | 11.87 | 96.95 |
| 16164 | 1075.08 | 276.06 | 1925.19 | 293.15 | 96.86 |
| 20088 | 384.13 | 78.71 | 185.57 | 40.67 | 96.78 |
| 23989 | 1057.77 | 294.07 | 466.66 | 116.46 | 96.74 |
| 24048 | 695.95 | 214.73 | 269.65 | 68.66 | 96.65 |
| 4254 | 144.21 | 377.79 | 15.39 | 14.62 | 96.65 |
| 24577 | 1170.09 | 364.08 | 2400.41 | 380.56 | 96.65 |

TABLE 5B

Atty. Docket No. 44921-5089US
Doc. No. 1803440.1

ACYCLOVIR
Timepoint(s): 6 hrs

| Identifier | NonToxMean | NonToxSD | ToxMean | ToxSD | LDAScore |
|---|---|---|---|---|---|
| 2572 | 1079.22 | 272.72 | 292.63 | 34.53 | 99.96 |
| 657 | 325.86 | 85.70 | 825.82 | 55.34 | 99.96 |
| 15174 | 582.65 | 154.01 | 1160.30 | 40.29 | 99.96 |
| 22060 | 120.39 | 46.22 | 489.85 | 39.32 | 99.87 |
| 21151 | 108.89 | 64.20 | 1068.35 | 133.62 | 99.87 |
| 17546 | 542.45 | 131.44 | 1300.18 | 82.92 | 99.83 |
| 8477 | 528.52 | 158.91 | 1301.77 | 46.70 | 99.83 |
| 16993 | 147.03 | 72.47 | 5.04 | 12.16 | 99.79 |
| 10667 | 41.39 | 38.71 | -236.50 | 27.34 | 99.79 |
| 3822 | 915.99 | 266.90 | 2473.92 | 69.91 | 99.74 |
| 17157 | 50.71 | 97.99 | 182.37 | 23.19 | 99.70 |
| 4532 | 266.41 | 75.57 | 62.22 | 7.77 | 99.70 |
| 15004 | 160.24 | 140.85 | 1576.85 | 132.63 | 99.70 |
| 4832 | 149.39 | 47.92 | 32.65 | 11.70 | 99.70 |
| 11836 | 219.06 | 64.52 | 69.22 | 8.46 | 99.61 |
| 24390 | 165.64 | 111.19 | -250.24 | 60.63 | 99.61 |
| 24200 | 421.04 | 138.48 | 1131.90 | 38.93 | 99.61 |
| 15002 | 137.74 | 85.32 | 904.65 | 69.55 | 99.61 |
| 3713 | 1141.71 | 271.69 | 457.32 | 36.48 | 99.57 |
| 6778 | 109.70 | 31.47 | 262.53 | 25.12 | 99.57 |
| 7936 | 149.06 | 36.24 | 49.64 | 5.41 | 99.57 |
| 13542 | 446.95 | 133.65 | 59.60 | 28.78 | 99.57 |
| 22385 | 107.82 | 53.29 | 22.50 | 3.64 | 99.57 |
| 20700 | 74.63 | 363.62 | 3153.73 | 549.12 | 99.57 |
| 15190 | 1801.09 | 1118.86 | 7715.59 | 404.27 | 99.53 |

TABLE 5B-continued

ACYCLOVIR  
Timepoint(s): 6 hrs

| Identifier | NonToxMean | NonToxSD | ToxMean | ToxSD | LDAScore |
|---|---|---|---|---|---|
| 20698 | −0.10 | 63.70 | 407.01 | 114.99 | 99.53 |
| 9757 | 408.35 | 98.75 | 159.69 | 13.35 | 99.53 |
| 15077 | 87.92 | 41.66 | 6.25 | 3.82 | 99.53 |
| 12301 | 58.09 | 29.22 | 219.75 | 30.79 | 99.53 |
| 3304 | 881.73 | 218.32 | 247.94 | 48.65 | 99.53 |
| 24041 | 11.98 | 28.98 | 230.57 | 61.01 | 99.53 |
| 19780 | 47.97 | 40.89 | 251.97 | 31.79 | 99.53 |
| 12899 | −9.55 | 17.51 | 146.15 | 30.06 | 99.49 |
| 23387 | 29.40 | 30.63 | 203.21 | 32.17 | 99.49 |
| 20699 | 86.60 | 192.11 | 2061.40 | 288.42 | 99.49 |
| 606 | −48.26 | 30.91 | 77.22 | 17.44 | 99.49 |
| 8874 | 118.63 | 59.95 | 395.15 | 33.95 | 99.49 |
| 5475 | 445.78 | 146.14 | 115.95 | 22.16 | 99.49 |
| 985 | 21.00 | 43.98 | 281.44 | 50.96 | 99.49 |
| 24243 | 258.96 | 69.54 | 71.35 | 13.38 | 99.44 |
| 6057 | 104.47 | 44.96 | 358.76 | 52.20 | 99.44 |
| 1892 | −6.30 | 35.30 | 58.25 | 24.52 | 99.40 |
| 275 | 519.62 | 162.35 | 80.95 | 30.90 | 99.40 |
| 2695 | 210.32 | 124.89 | 613.77 | 27.62 | 99.40 |
| 7804 | 1764.46 | 393.34 | 898.61 | 69.66 | 99.40 |
| 20701 | 32.96 | 54.09 | 404.95 | 132.78 | 99.40 |
| 12420 | 23.45 | 48.04 | −131.74 | 28.29 | 99.36 |
| 15003 | 33.26 | 83.63 | 776.16 | 111.38 | 99.36 |
| 24564 | 568.95 | 174.41 | 66.56 | 19.02 | 99.36 |
| 24246 | 300.44 | 96.46 | 678.79 | 40.80 | 99.36 |
| 9423 | 939.03 | 252.01 | 2035.02 | 137.31 | 99.36 |
| 23151 | 380.64 | 125.08 | 82.73 | 15.55 | 99.36 |
| 9071 | 48.03 | 25.31 | 2.95 | 1.90 | 99.36 |
| 2905 | 244.95 | 103.58 | 780.68 | 56.20 | 99.36 |
| 20856 | 55.56 | 46.37 | −5.93 | 3.53 | 99.36 |
| 5931 | 182.37 | 66.37 | 9.61 | 8.36 | 99.36 |
| 24042 | 18.74 | 67.93 | 772.42 | 198.67 | 99.36 |
| 17765 | 1285.78 | 452.80 | 2557.67 | 63.52 | 99.31 |
| 17470 | 102.21 | 54.04 | 410.26 | 61.20 | 99.31 |
| 2010 | 32.91 | 314.74 | 355.60 | 90.97 | 99.31 |
| 20848 | 510.27 | 150.82 | 1095.65 | 24.39 | 99.31 |
| 17591 | 385.36 | 90.44 | 744.25 | 62.21 | 99.27 |
| 1340 | 192.09 | 49.88 | 96.02 | 6.73 | 99.27 |
| 7806 | 51.84 | 19.09 | 122.32 | 8.65 | 99.27 |
| 7493 | 78.12 | 36.73 | 174.58 | 4.92 | 99.27 |
| 20035 | 180.04 | 101.54 | 817.96 | 80.03 | 99.23 |
| 19657 | 3.30 | 17.67 | 125.30 | 19.29 | 99.23 |
| 24563 | 309.99 | 99.44 | 4.82 | 17.01 | 99.23 |
| 22453 | 171.10 | 46.39 | 60.55 | 10.10 | 99.23 |
| 23995 | 161.66 | 57.89 | 380.58 | 31.88 | 99.23 |
| 15191 | 1989.62 | 1126.31 | 8988.79 | 1157.81 | 99.23 |
| 11326 | 332.40 | 95.69 | 94.87 | 14.33 | 99.23 |
| 7586 | 793.77 | 201.98 | 306.02 | 29.21 | 99.23 |
| 2392 | 154.00 | 87.41 | 1138.50 | 400.02 | 99.23 |
| 4205 | 222.66 | 72.63 | 591.81 | 54.59 | 99.23 |
| 8245 | 54.69 | 20.70 | 113.91 | 5.63 | 99.23 |
| 16324 | 194.65 | 61.24 | 42.04 | 11.21 | 99.23 |
| 12404 | 105.63 | 62.52 | 662.04 | 167.20 | 99.23 |
| 7639 | 753.14 | 166.01 | 339.14 | 44.82 | 99.23 |
| 20895 | 331.67 | 100.56 | 50.78 | 24.52 | 99.19 |
| 22018 | 158.66 | 41.98 | 360.67 | 50.74 | 99.19 |
| 3823 | 524.10 | 147.80 | 1250.81 | 97.60 | 99.14 |
| 6477 | 13.58 | 161.23 | 99.71 | 26.48 | 99.14 |
| 223 | 11.18 | 17.65 | 124.61 | 25.10 | 99.14 |
| 15146 | 130.31 | 69.77 | 744.71 | 139.52 | 99.14 |
| 25069 | 134.29 | 60.66 | 25.21 | 12.36 | 99.14 |
| 3431 | 1503.29 | 617.93 | 3867.63 | 202.46 | 99.14 |
| 3271 | 576.75 | 119.79 | 239.69 | 44.71 | 99.14 |
| 6054 | 26.29 | 47.50 | 386.77 | 134.53 | 99.14 |
| 20202 | 627.69 | 194.14 | 49.29 | 62.88 | 99.14 |
| 25546 | 473.74 | 139.13 | 145.63 | 40.29 | 99.14 |
| 19781 | 113.50 | 55.43 | 454.62 | 115.29 | 99.14 |
| 22488 | 58.52 | 53.30 | 334.10 | 50.62 | 99.10 |
| 10281 | 168.73 | 157.24 | 1702.50 | 591.27 | 99.10 |
| 9452 | 125.58 | 75.70 | 1560.61 | 720.48 | 99.10 |
| 2153 | 182.83 | 143.86 | 1201.51 | 175.46 | 99.10 |
| 13745 | 27.62 | 27.50 | 297.57 | 96.36 | 99.10 |
| 1218 | 198.28 | 37.55 | 92.30 | 12.70 | 99.10 |
| 15042 | 63.76 | 42.44 | 353.57 | 60.19 | 99.10 |
| 9521 | 95.05 | 24.96 | 222.10 | 33.80 | 99.10 |

TABLE 5C

ADR  
Timepoint(s): 120, 168 hrs

| Identifier | NonToxMean | NonToxSD | ToxMean | ToxSD | LDAScore |
|---|---|---|---|---|---|
| 1688 | 5353.71 | 3830.70 | 26.75 | 39.23 | 99.44 |
| 25469 | 1577.10 | 747.53 | 25.91 | 13.98 | 99.44 |
| 1684 | 2831.22 | 1612.49 | 24.53 | 31.27 | 99.44 |
| 17829 | 2235.92 | 1102.19 | 68.14 | 58.70 | 99.44 |
| 25468 | 2186.32 | 1123.33 | 11.47 | 13.96 | 99.44 |
| 26150 | 783.82 | 532.35 | −38.06 | 15.15 | 99.40 |
| 1687 | 1894.26 | 855.11 | 45.95 | 32.94 | 99.31 |
| 1685 | 9226.22 | 7079.05 | 58.61 | 94.83 | 99.31 |
| 1689 | 4411.94 | 2221.14 | 43.26 | 28.59 | 99.31 |
| 17832 | 1976.64 | 870.20 | 17.22 | 14.67 | 99.18 |
| 19358 | 792.56 | 328.04 | 6.04 | 46.93 | 99.71 |
| 18907 | 102.84 | 49.44 | 17.51 | 7.82 | 97.33 |
| 25467 | 636.86 | 169.13 | 1263.84 | 257.87 | 97.25 |
| 4011 | 457.30 | 195.33 | 953.88 | 244.47 | 96.78 |
| 14199 | 71.52 | 35.30 | 26.74 | 5.48 | 96.09 |
| 2852 | 49.29 | 27.79 | 19.72 | 2.87 | 95.92 |
| 21140 | 109.12 | 47.83 | 38.53 | 9.71 | 95.83 |
| 4594 | 63.32 | 30.73 | 22.33 | 5.88 | 95.44 |
| 7089 | 102.25 | 41.59 | 48.02 | 7.26 | 95.40 |
| 2984 | 582.52 | 185.78 | 258.99 | 70.15 | 95.27 |
| 1831 | 49.81 | 23.36 | 10.63 | 6.34 | 94.67 |
| 25705 | 455.64 | 115.95 | 612.52 | 59.36 | 94.45 |
| 16109 | 414.49 | 75.48 | 556.38 | 45.14 | 94.28 |
| 11165 | 529.31 | 155.76 | 250.39 | 51.44 | 93.98 |
| 19237 | 77.59 | 39.42 | 10.97 | 14.64 | 93.68 |
| 16401 | 1239.09 | 805.30 | 2322.72 | 497.80 | 93.68 |
| 109 | 547.11 | 293.37 | 1681.21 | 571.81 | 93.63 |
| 4312 | 77.34 | 39.04 | 127.17 | 10.27 | 93.51 |
| 16400 | 580.43 | 474.95 | 1090.34 | 298.55 | 93.42 |
| 18794 | 138.50 | 77.18 | 48.95 | 11.54 | 93.38 |
| 7489 | 81.80 | 32.11 | 25.62 | 12.02 | 93.34 |
| 2586 | 52.04 | 30.18 | 14.65 | 5.97 | 93.04 |
| 17742 | 1059.53 | 304.09 | 1669.92 | 253.17 | 92.99 |
| 956 | 54.64 | 39.22 | 1.90 | 10.80 | 92.78 |
| 17563 | 1201.38 | 349.79 | 1590.38 | 101.68 | 92.69 |
| 2125 | 78.10 | 82.13 | −4.59 | 19.58 | 92.69 |
| 24844 | 32.09 | 22.37 | 8.57 | 2.19 | 92.65 |
| 16676 | 38.73 | 27.29 | 17.84 | 2.42 | 92.61 |
| 19189 | 60.60 | 62.41 | 14.86 | 7.74 | 92.61 |
| 16521 | 285.39 | 89.91 | 428.27 | 70.75 | 92.56 |
| 14430 | 34.74 | 32.18 | 3.43 | 3.27 | 92.48 |
| 1301 | 325.54 | 286.68 | 14.24 | 17.87 | 92.43 |
| 21006 | 55.98 | 36.26 | 16.33 | 6.58 | 92.39 |
| 23778 | 69.71 | 34.49 | 24.74 | 8.89 | 92.26 |
| 2812 | 193.71 | 46.19 | 284.99 | 38.81 | 92.22 |
| 16407 | 459.56 | 105.59 | 825.37 | 208.72 | 92.12 |
| 16426 | 280.85 | 109.78 | 118.35 | 49.48 | 91.79 |
| 24232 | 160.98 | 60.26 | 72.06 | 20.28 | 91.66 |
| 6059 | 193.61 | 50.50 | 116.52 | 21.50 | 91.40 |
| 17234 | 634.83 | 173.83 | 432.41 | 36.23 | 91.27 |
| 13025 | 335.88 | 84.38 | 224.82 | 24.51 | 91.23 |
| 20757 | 411.95 | 220.62 | 771.74 | 157.51 | 91.09 |
| 10076 | 105.84 | 50.96 | 140.17 | 10.04 | 91.06 |

TABLE 5C-continued

ADR
Timepoint(s): 120, 168 hrs

| Identifier | NonToxMean | NonToxSD | ToxMean | ToxSD | LDAScore |
|---|---|---|---|---|---|
| 4010 | 961.35 | 403.18 | 2024.17 | 546.67 | 91.05 |
| 22220 | 147.73 | 137.94 | 463.05 | 162.91 | 90.96 |
| 9644 | −4.86 | 27.32 | 39.61 | 11.58 | 90.93 |
| 8597 | 240.84 | 58.03 | 315.06 | 30.21 | 90.89 |
| 16582 | 56.67 | 19.30 | 29.31 | 5.28 | 90.89 |
| 1321 | 510.50 | 316.91 | 1496.60 | 371.84 | 90.88 |
| 14337 | 211.54 | 44.52 | 148.64 | 18.05 | 90.84 |
| 19191 | 1011.62 | 281.12 | 631.62 | 94.67 | 90.76 |
| 20716 | 652.51 | 142.58 | 1029.68 | 128.61 | 90.75 |
| 8017 | 188.58 | 76.89 | 406.11 | 152.05 | 90.66 |
| 18502 | 670.14 | 243.60 | 313.44 | 111.24 | 90.63 |
| 2782 | 214.23 | 97.42 | 522.66 | 132.70 | 90.62 |
| 13354 | 88.85 | 57.76 | 34.85 | 9.49 | 90.50 |
| 22696 | 62.39 | 50.49 | −5.66 | 12.94 | 90.50 |
| 4242 | 749.55 | 193.32 | 1337.17 | 268.80 | 90.49 |
| 12660 | 71.28 | 22.64 | 44.42 | 5.74 | 90.46 |
| 15892 | 18.01 | 22.79 | 36.39 | 7.65 | 90.46 |
| 25517 | 39.47 | 33.13 | 2.75 | 7.99 | 90.41 |
| 22697 | 59.68 | 40.43 | 15.77 | 10.73 | 90.33 |
| 16448 | 129.58 | 38.04 | 43.90 | 19.88 | 90.32 |
| 1058 | 75.84 | 35.86 | 30.65 | 8.83 | 90.24 |
| 7863 | 1200.90 | 307.30 | 1386.51 | 55.05 | 90.24 |
| 11967 | 1725.17 | 550.50 | 1088.97 | 237.35 | 90.20 |
| 516 | 55.59 | 33.01 | 17.20 | 9.40 | 90.11 |
| 25736 | 24.77 | 16.54 | 7.84 | 4.16 | 89.98 |
| 6544 | 53.15 | 110.52 | 379.03 | 173.46 | 89.89 |
| 21651 | 32.42 | 26.38 | 7.38 | 3.39 | 89.85 |
| 16581 | 39.86 | 19.57 | 17.01 | 3.68 | 89.72 |
| 2607 | 218.90 | 50.79 | 175.06 | 11.54 | 89.55 |
| 15247 | 637.26 | 192.10 | 1113.60 | 210.08 | 89.41 |
| 6691 | 119.56 | 54.62 | 32.51 | 16.76 | 89.41 |
| 20702 | 300.67 | 70.50 | 198.62 | 33.60 | 89.38 |
| 10109 | 1044.97 | 289.50 | 1362.38 | 117.72 | 89.34 |
| 24040 | 557.97 | 233.98 | 196.88 | 87.97 | 89.29 |
| 1169 | 90.18 | 28.72 | 92.58 | 4.98 | 89.21 |
| 5421 | 279.85 | 96.20 | 162.53 | 31.31 | 89.21 |
| 19244 | 1224.80 | 382.60 | 1678.75 | 173.86 | 89.17 |
| 3015 | 2307.62 | 994.19 | 2930.38 | 184.09 | 89.12 |
| 21695 | 60.82 | 36.14 | 4.02 | 14.39 | 89.03 |
| 11218 | 102.70 | 37.49 | 47.65 | 19.31 | 88.95 |
| 21766 | 286.32 | 76.11 | 204.08 | 26.91 | 88.95 |
| 494 | 698.84 | 215.82 | 1186.69 | 207.80 | 88.86 |
| 24528 | 61.08 | 25.93 | 19.77 | 8.13 | 88.81 |

TABLE 5D

AY
Timepoint(s): 360 hrs

| Identifier | NonToxMean | NonToxSD | ToxMean | ToxSD | LDAScore |
|---|---|---|---|---|---|
| 6360 | 7.76 | 5.80 | 30.12 | 3.08 | 99.36 |
| 18826 | 1069.51 | 321.45 | 473.21 | 31.01 | 99.32 |
| 24886 | 1264.06 | 371.77 | 2165.64 | 63.29 | 99.27 |
| 6517 | 233.00 | 158.96 | 437.46 | 12.19 | 99.19 |
| 16576 | 111.85 | 41.47 | 67.47 | 0.61 | 99.19 |
| 22846 | 1490.00 | 287.46 | 852.52 | 44.29 | 99.10 |
| 2708 | 383.37 | 87.00 | 425.82 | 1.07 | 98.97 |
| 14349 | 413.99 | 144.50 | 244.25 | 2.46 | 98.97 |
| 13023 | 187.03 | 420.11 | −22.68 | 5.86 | 98.85 |
| 6585 | 653.17 | 368.20 | 239.73 | 12.54 | 98.76 |
| 15093 | 35.54 | 16.49 | −7.39 | 3.34 | 98.76 |
| 25066 | 136.51 | 58.55 | 34.09 | 4.82 | 98.72 |
| 21796 | 696.51 | 210.24 | 1145.40 | 47.75 | 98.67 |
| 3610 | 1195.23 | 334.91 | 780.10 | 28.06 | 98.67 |

TABLE 5D-continued

AY
Timepoint(s): 360 hrs

| Identifier | NonToxMean | NonToxSD | ToxMean | ToxSD | LDAScore |
|---|---|---|---|---|---|
| 24236 | 80.80 | 27.74 | 39.65 | 1.30 | 98.67 |
| 16156 | 858.19 | 319.87 | 3220.95 | 1137.23 | 98.59 |
| 17672 | 2630.76 | 734.18 | 3325.88 | 12.22 | 98.59 |
| 472 | 658.60 | 175.52 | 1275.16 | 135.82 | 98.59 |
| 15462 | 86.01 | 35.25 | 28.41 | 2.70 | 98.55 |
| 10159 | 7.63 | 18.34 | 30.64 | 0.79 | 98.55 |
| 457 | 284.29 | 87.14 | 421.47 | 22.09 | 98.42 |
| 22093 | −21.77 | 38.66 | 56.32 | 5.98 | 98.37 |
| 5212 | 189.25 | 67.72 | 0.93 | 13.47 | 98.33 |
| 11368 | 20.04 | 24.02 | 29.17 | 0.30 | 98.29 |
| 22731 | 24.04 | 24.97 | 9.37 | 0.65 | 98.29 |
| 23313 | 404.59 | 87.09 | 292.34 | 2.67 | 98.29 |
| 25178 | 4.72 | 6.91 | 30.15 | 9.22 | 98.25 |
| 11561 | 389.44 | 87.17 | 225.68 | 12.21 | 98.25 |
| 14120 | 740.64 | 221.38 | 1485.37 | 218.95 | 98.20 |
| 4622 | 608.46 | 110.69 | 956.12 | 79.60 | 98.20 |
| 12894 | 141.35 | 34.03 | 72.48 | 5.99 | 98.12 |
| 3447 | 33.98 | 17.04 | 11.74 | 0.97 | 98.03 |
| 1410 | 99.49 | 46.40 | 23.57 | 5.02 | 97.99 |
| 22103 | 235.14 | 64.79 | 449.04 | 43.64 | 97.99 |
| 14185 | 204.58 | 95.56 | 321.83 | 10.61 | 97.99 |
| 24770 | 233.44 | 86.68 | 44.57 | 16.38 | 97.95 |
| 21044 | 24.56 | 22.71 | −11.37 | 2.16 | 97.95 |
| 24721 | 203.93 | 53.62 | 144.06 | 2.18 | 97.95 |
| 20184 | 11.29 | 9.18 | 20.17 | 0.35 | 97.95 |
| 6062 | 182.74 | 59.18 | 106.49 | 1.72 | 97.90 |
| 16172 | 467.00 | 120.07 | 308.58 | 10.28 | 97.86 |
| 19731 | 225.58 | 214.69 | 63.47 | 15.21 | 97.82 |
| 16155 | 1075.32 | 410.99 | 3024.24 | 951.97 | 97.82 |
| 5425 | 85.43 | 33.27 | 153.80 | 5.81 | 97.82 |
| 1463 | 620.25 | 296.25 | 1592.90 | 460.18 | 97.78 |
| 2696 | 777.90 | 238.27 | 1766.44 | 260.04 | 97.78 |
| 2126 | 223.21 | 75.66 | 478.73 | 56.24 | 97.78 |
| 16245 | 384.42 | 117.13 | 589.67 | 20.00 | 97.73 |
| 4683 | 211.56 | 40.44 | 323.17 | 13.38 | 97.73 |
| 11590 | 276.38 | 78.94 | 238.32 | 1.35 | 97.69 |
| 556 | 82.41 | 35.72 | 33.35 | 5.40 | 97.69 |
| 10241 | 67.50 | 27.73 | 4.65 | 11.47 | 97.69 |
| 275 | 516.42 | 162.40 | 1038.56 | 193.69 | 97.65 |
| 10784 | 24.89 | 30.12 | −21.79 | 6.29 | 97.65 |
| 6523 | 30.10 | 14.87 | 8.53 | 1.41 | 97.60 |
| 4467 | 656.82 | 156.93 | 1236.28 | 198.60 | 97.60 |
| 24042 | 21.86 | 84.61 | 58.64 | 10.50 | 97.56 |
| 15135 | 706.76 | 182.37 | 1034.39 | 31.17 | 97.52 |
| 6790 | 63.12 | 24.62 | 19.35 | 3.71 | 97.52 |
| 6743 | 1405.82 | 280.92 | 2262.37 | 206.08 | 97.52 |
| 6351 | 45.29 | 26.36 | 88.65 | 2.94 | 97.48 |
| 18942 | −11.45 | 10.37 | 24.19 | 16.98 | 97.43 |
| 6726 | 393.51 | 104.57 | 242.70 | 10.50 | 97.43 |
| 9808 | 30.77 | 14.74 | 50.69 | 1.63 | 97.39 |
| 21078 | 567.53 | 143.04 | 363.30 | 11.51 | 97.39 |
| 22619 | 371.47 | 90.93 | 316.17 | 2.78 | 97.39 |
| 1058 | 75.62 | 35.90 | 24.89 | 3.27 | 97.39 |
| 22692 | 209.08 | 63.65 | 106.95 | 5.50 | 97.39 |
| 21914 | 404.11 | 71.79 | 635.41 | 66.12 | 97.39 |
| 22063 | 68.58 | 25.03 | 47.50 | 0.52 | 97.35 |
| 1162 | 10.60 | 37.16 | 138.81 | 40.04 | 97.35 |
| 15224 | 689.92 | 152.18 | 1138.23 | 103.80 | 97.35 |
| 24178 | 2.75 | 9.42 | 20.42 | 4.02 | 97.31 |
| 20891 | 140.77 | 49.29 | 78.20 | 3.12 | 97.31 |
| 17393 | 145.61 | 59.87 | 87.56 | 1.63 | 97.31 |
| 17061 | 557.85 | 95.17 | 904.28 | 161.35 | 97.22 |
| 21656 | 54.49 | 25.08 | 22.60 | 1.43 | 97.18 |
| 23651 | 656.34 | 623.55 | 2317.09 | 936.44 | 97.18 |
| 2357 | 76.01 | 23.05 | 69.48 | 0.72 | 97.13 |
| 18130 | 378.79 | 74.65 | 591.90 | 50.88 | 97.13 |
| 23898 | 10.17 | 6.54 | 30.37 | 7.27 | 97.13 |
| 9363 | 89.83 | 29.45 | 164.93 | 13.77 | 97.09 |
| 2920 | 78.42 | 29.88 | 124.28 | 3.10 | 97.09 |
| 21930 | 597.55 | 127.69 | 1108.70 | 256.19 | 97.05 |
| 12770 | 600.59 | 229.99 | 230.85 | 29.99 | 97.05 |

TABLE 5D-continued

Atty. Docket No. 44921-5089US
Doc. No. 1803440.1

AY
Timepoint(s): 360 hrs

| Identifier | NonToxMean | NonToxSD | ToxMean | ToxSD | LDAScore |
|---|---|---|---|---|---|
| 23799 | 146.92 | 43.68 | 75.83 | 5.19 | 97.05 |
| 1757 | 23.41 | 13.46 | −0.34 | 3.13 | 97.05 |
| 18419 | 1317.37 | 373.39 | 2669.33 | 536.46 | 97.05 |
| 7023 | 364.44 | 77.23 | 413.76 | 3.42 | 97.01 |
| 5811 | 35.76 | 18.86 | 52.44 | 0.86 | 97.01 |
| 1529 | 290.79 | 62.32 | 164.72 | 18.30 | 97.01 |
| 15259 | 227.54 | 56.59 | 163.79 | 2.45 | 97.01 |
| 14095 | 379.89 | 98.99 | 246.75 | 8.11 | 97.01 |
| 17107 | 2200.10 | 722.73 | 4177.24 | 487.81 | 96.96 |
| 13393 | 76.83 | 46.83 | 166.60 | 16.98 | 96.96 |
| 15411 | 305.14 | 91.59 | 162.75 | 9.40 | 96.96 |

TABLE 5E

Atty. Docket No. 44921-5089US
Doc. No. 1803440.1

BEA
Timepoint(s): 6, 24 hrs

| Identifier | NonToxMean | NonToxSD | ToxMean | ToxSD | LDAScore |
|---|---|---|---|---|---|
| 21011 | 154.85 | 315.31 | 689.68 | 175.67 | 98.32 |
| 21015 | 271.80 | 338.52 | 933.97 | 202.57 | 97.98 |
| 21013 | 214.58 | 340.35 | 710.95 | 153.21 | 97.68 |
| 22057 | 349.60 | 55.08 | 477.85 | 22.42 | 97.33 |
| 8477 | 529.15 | 164.21 | 876.56 | 49.54 | 97.03 |
| 23849 | 285.73 | 136.63 | 521.70 | 61.30 | 96.65 |
| 15969 | 339.58 | 71.02 | 574.34 | 94.47 | 96.47 |
| 5901 | 92.67 | 50.17 | 176.54 | 31.37 | 96.43 |
| 17034 | 885.84 | 144.51 | 1193.98 | 93.26 | 95.36 |
| 23140 | 172.19 | 53.17 | 288.43 | 107.64 | 94.67 |
| 6143 | 560.24 | 135.28 | 861.03 | 122.25 | 94.20 |
| 22931 | 79.76 | 48.36 | 19.97 | 4.03 | 94.15 |
| 13608 | 21.70 | 23.78 | 64.61 | 13.40 | 94.07 |
| 3167 | 308.80 | 70.69 | 438.24 | 41.83 | 94.07 |
| 17771 | 769.01 | 307.47 | 1086.30 | 71.95 | 93.98 |
| 10477 | 87.73 | 37.06 | 137.33 | 14.74 | 93.42 |
| 17563 | 1206.59 | 350.63 | 917.80 | 32.07 | 92.99 |
| 3551 | 440.44 | 98.71 | 307.06 | 31.45 | 92.69 |
| 22885 | 1347.43 | 493.33 | 2161.55 | 380.96 | 92.61 |
| 8515 | 262.49 | 109.22 | 415.39 | 29.53 | 92.52 |
| 20745 | 471.03 | 70.08 | 354.88 | 30.48 | 92.30 |
| 4748 | 110.75 | 127.98 | 202.78 | 32.60 | 92.18 |
| 8639 | 368.78 | 99.86 | 530.10 | 59.33 | 91.92 |
| 14874 | 50.39 | 17.11 | 78.62 | 12.99 | 91.66 |
| 21625 | 2492.78 | 1106.79 | 1806.41 | 173.96 | 91.53 |
| 2729 | 638.00 | 170.57 | 841.33 | 45.73 | 91.53 |
| 6844 | 124.24 | 58.33 | 32.11 | 26.05 | 91.53 |
| 19993 | 2317.82 | 568.48 | 3182.90 | 249.42 | 91.36 |
| 10742 | 62.40 | 27.77 | 27.67 | 6.47 | 91.32 |
| 8205 | 398.00 | 113.24 | 583.05 | 83.76 | 91.23 |
| 17400 | 121.53 | 78.34 | 254.55 | 53.39 | 91.23 |
| 1698 | 73.83 | 75.94 | 197.90 | 43.39 | 91.22 |
| 3557 | 107.65 | 39.24 | 177.58 | 40.40 | 91.14 |
| 18905 | 1365.13 | 302.42 | 1751.48 | 71.12 | 91.06 |
| 7276 | 72.89 | 27.71 | 30.30 | 10.38 | 91.01 |
| 15111 | 954.53 | 281.39 | 581.40 | 91.29 | 90.97 |
| 14929 | 800.42 | 430.77 | 1096.37 | 215.26 | 90.80 |
| 18077 | 2620.17 | 1190.40 | 1912.67 | 180.40 | 90.28 |
| 14862 | 181.12 | 72.28 | 270.61 | 28.36 | 90.28 |
| 10636 | 369.25 | 95.44 | 241.19 | 39.11 | 90.24 |
| 2057 | 291.01 | 74.63 | 398.13 | 39.83 | 90.15 |
| 21014 | 155.16 | 80.93 | 268.20 | 58.44 | 90.15 |
| 4232 | 137.37 | 62.35 | 64.91 | 22.20 | 90.07 |
| 5687 | 189.73 | 55.56 | 278.09 | 42.24 | 90.03 |
| 13614 | 342.46 | 95.82 | 447.07 | 32.82 | 90.03 |
| 11605 | 98.56 | 37.96 | 208.10 | 79.38 | 89.97 |

TABLE 5E-continued

Atty. Docket No. 44921-5089US
Doc. No. 1803440.1

BEA
Timepoint(s): 6, 24 hrs

| Identifier | NonToxMean | NonToxSD | ToxMean | ToxSD | LDAScore |
|---|---|---|---|---|---|
| 17107 | 2202.25 | 730.97 | 2581.41 | 115.51 | 89.72 |
| 14069 | 29.03 | 14.66 | 50.58 | 9.56 | 89.68 |
| 16407 | 463.39 | 111.03 | 329.66 | 41.65 | 89.68 |
| 3014 | 29.07 | 15.66 | 43.28 | 5.07 | 89.64 |
| 4731 | 119.24 | 35.99 | 215.47 | 51.98 | 89.63 |
| 14718 | 38.97 | 27.26 | 103.83 | 29.32 | 89.63 |
| 818 | 4123.05 | 2816.44 | 2751.13 | 405.49 | 89.60 |
| 17545 | 74.49 | 49.29 | 192.85 | 48.58 | 89.59 |
| 17695 | 728.25 | 203.79 | 1236.56 | 236.71 | 89.59 |
| 5811 | 35.97 | 18.81 | 13.37 | 6.74 | 89.47 |
| 3081 | 387.79 | 84.55 | 253.14 | 37.34 | 89.46 |
| 7895 | 997.72 | 308.71 | 1503.83 | 263.73 | 89.46 |
| 3924 | 183.13 | 68.64 | 101.62 | 16.04 | 89.34 |
| 24181 | 85.08 | 27.22 | 145.70 | 16.84 | 89.33 |
| 2752 | 405.86 | 139.92 | 593.99 | 60.88 | 89.33 |
| 1159 | 886.55 | 231.02 | 611.65 | 64.43 | 89.29 |
| 24388 | 188.48 | 72.47 | 251.08 | 30.81 | 89.29 |
| 3926 | 176.00 | 56.73 | 103.17 | 18.22 | 89.25 |
| 18981 | 231.55 | 65.64 | 189.11 | 9.52 | 89.21 |
| 7838 | 19.58 | 15.00 | 21.80 | 3.33 | 89.17 |
| 24537 | 528.52 | 104.62 | 396.25 | 38.65 | 89.08 |
| 2688 | 173.21 | 54.36 | 243.95 | 28.16 | 89.08 |
| 19484 | 184.45 | 70.04 | 320.46 | 37.72 | 89.03 |
| 22855 | 561.72 | 144.30 | 886.81 | 141.20 | 89.03 |
| 12979 | 391.37 | 216.96 | 627.81 | 88.47 | 88.94 |
| 7223 | 88.64 | 27.62 | 152.72 | 24.63 | 88.94 |
| 23159 | 416.48 | 85.49 | 537.44 | 47.74 | 88.91 |
| 13563 | 1028.27 | 255.15 | 1603.62 | 170.06 | 88.86 |
| 3696 | 42.57 | 32.72 | 106.32 | 10.80 | 88.86 |
| 2855 | 920.64 | 212.77 | 1412.67 | 261.05 | 88.77 |
| 3580 | 9.48 | 10.46 | 22.09 | 6.90 | 88.74 |
| 12629 | 65.11 | 30.82 | 27.44 | 7.55 | 88.61 |
| 18810 | 1188.71 | 319.49 | 906.85 | 60.20 | 88.52 |
| 18770 | 1131.01 | 331.57 | 887.70 | 58.94 | 88.48 |
| 19577 | 494.98 | 92.34 | 376.82 | 38.52 | 88.48 |
| 18891 | 1378.10 | 409.91 | 1823.58 | 193.46 | 88.48 |
| 7914 | 1537.05 | 507.11 | 1256.25 | 91.53 | 88.44 |

TABLE 5F

Atty. Docket No. 44921-5089US
Doc. No. 1803440.1

CAPTOPRIL (336 hrs)

| Identifier | NonToxMean | NonToxSD | ToxMean | ToxSD | LDAScore |
|---|---|---|---|---|---|
| 23859 | −10.09 | 17.25 | 58.28 | 12.00 | 99.70 |
| 1522 | 181.53 | 92.60 | −79.60 | 14.77 | 99.40 |
| 24668 | 76.16 | 46.93 | 1110.08 | 605.52 | 99.10 |
| 19287 | 161.27 | 40.70 | 265.00 | 9.72 | 98.84 |
| 735 | 125.45 | 37.81 | 123.72 | 0.37 | 98.50 |
| 1348 | 29.21 | 17.75 | 0.23 | 1.09 | 98.12 |
| 16260 | 66.53 | 18.90 | 82.33 | 0.49 | 98.07 |
| 24696 | 69.96 | 48.08 | −11.83 | 7.33 | 98.07 |
| 826 | 182.43 | 53.09 | 63.46 | 18.28 | 97.90 |
| 15851 | 203.67 | 153.22 | 36.02 | 16.84 | 97.69 |
| 19120 | 32.71 | 25.65 | −8.80 | 2.19 | 97.43 |
| 1480 | 253.73 | 66.75 | 112.96 | 18.69 | 97.43 |
| 18659 | 51.26 | 29.25 | 80.08 | 1.30 | 97.43 |
| 15420 | 59.26 | 52.41 | −14.25 | 3.04 | 97.39 |
| 2830 | 654.10 | 146.54 | 933.86 | 42.78 | 96.92 |
| 2658 | 891.04 | 236.04 | 443.07 | 41.79 | 96.88 |
| 17937 | 86.63 | 42.53 | −12.26 | 22.60 | 96.83 |
| 10108 | 146.26 | 35.48 | 61.17 | 17.32 | 96.70 |
| 1223 | 191.43 | 47.65 | 289.39 | 15.78 | 96.66 |
| 16048 | 28.62 | 52.28 | −8.09 | 3.07 | 96.66 |
| 10774 | 26.49 | 16.73 | 40.49 | 1.17 | 96.62 |

TABLE 5F-continued

CAPTOPRIL (336 hrs)

| Identifier | NonToxMean | NonToxSD | ToxMean | ToxSD | LDAScore |
|---|---|---|---|---|---|
| 16944 | 848.22 | 191.45 | 550.56 | 29.83 | 96.58 |
| 546 | 173.90 | 50.96 | 217.42 | 13.74 | 96.53 |
| 12819 | 184.28 | 47.07 | 239.54 | 3.32 | 96.53 |
| 5735 | 56.51 | 21.12 | 63.63 | 0.57 | 96.45 |
| 7956 | 27.42 | 11.15 | 39.67 | 0.69 | 96.40 |
| 12332 | 567.22 | 177.99 | 328.76 | 21.43 | 96.32 |
| 18346 | 273.04 | 62.53 | 138.13 | 21.45 | 96.32 |
| 16425 | 20.91 | 30.81 | −13.41 | 3.05 | 96.23 |
| 8426 | 54.76 | 23.35 | 27.91 | 1.50 | 96.19 |
| 9964 | 14.13 | 28.09 | 41.16 | 1.54 | 96.15 |
| 15395 | 797.12 | 155.79 | 610.46 | 12.19 | 96.02 |
| 21458 | 229.75 | 104.67 | 360.26 | 20.40 | 95.93 |
| 15259 | 227.63 | 56.54 | 154.42 | 4.47 | 95.93 |
| 11057 | 33.19 | 29.92 | 61.96 | 3.13 | 95.89 |
| 397 | 116.22 | 33.32 | 88.25 | 1.44 | 95.89 |
| 20429 | 108.55 | 34.07 | 193.71 | 39.16 | 95.85 |
| 12333 | 218.47 | 76.94 | 109.09 | 10.32 | 95.85 |
| 12629 | 64.58 | 30.66 | 134.34 | 14.35 | 95.76 |
| 20833 | 1255.87 | 351.77 | 1350.26 | 16.51 | 95.68 |
| 10673 | 62.50 | 35.24 | 48.56 | 1.93 | 95.63 |
| 9518 | 29.88 | 23.15 | 73.23 | 8.73 | 95.59 |
| 5630 | 77.86 | 48.50 | 150.84 | 8.45 | 95.59 |
| 16036 | 64.27 | 20.66 | 37.81 | 2.46 | 95.55 |
| 23773 | 214.43 | 85.23 | 94.48 | 13.72 | 95.51 |
| 11817 | 64.91 | 20.17 | 98.04 | 3.96 | 95.46 |
| 13976 | 459.29 | 377.97 | 122.98 | 19.90 | 95.46 |
| 14926 | 95.90 | 28.06 | 158.69 | 14.69 | 95.46 |
| 21633 | 302.73 | 119.13 | 151.23 | 11.45 | 95.42 |
| 910 | 58.30 | 22.93 | 35.87 | 1.63 | 95.42 |
| 11203 | 75.66 | 25.37 | 58.05 | 1.05 | 95.38 |
| 16562 | 188.78 | 45.14 | 125.67 | 5.83 | 95.29 |
| 6362 | 63.63 | 39.69 | −15.88 | 19.50 | 95.25 |
| 23237 | 89.94 | 41.57 | 97.86 | 1.24 | 95.25 |
| 5384 | 41.70 | 44.55 | 1.71 | 2.18 | 95.25 |
| 22665 | 128.49 | 29.89 | 159.98 | 3.47 | 95.21 |
| 6581 | 76.47 | 26.45 | 43.08 | 2.63 | 95.12 |
| 260 | 417.04 | 114.29 | 636.83 | 72.47 | 95.12 |
| 24814 | 171.62 | 33.74 | 127.03 | 5.19 | 95.12 |
| 13682 | 178.68 | 62.82 | 61.54 | 20.17 | 95.08 |
| 15028 | 346.53 | 107.46 | 569.31 | 126.83 | 95.08 |
| 17439 | 218.65 | 47.89 | 292.03 | 10.02 | 94.99 |
| 15797 | 20.60 | 17.76 | −7.25 | 4.56 | 94.95 |
| 17549 | 1304.87 | 367.92 | 1416.98 | 24.18 | 94.95 |
| 17923 | 66.78 | 23.31 | 48.46 | 1.01 | 94.95 |
| 23360 | 178.74 | 46.59 | 218.52 | 2.99 | 94.91 |
| 20099 | 81.73 | 30.45 | 123.33 | 3.88 | 94.91 |
| 19327 | 89.68 | 29.52 | 50.76 | 3.50 | 94.86 |
| 5786 | 125.64 | 46.92 | 48.44 | 13.78 | 94.86 |
| 9929 | 531.71 | 124.53 | 680.04 | 14.58 | 94.82 |
| 2831 | 619.77 | 172.12 | 917.69 | 61.75 | 94.82 |
| 10477 | 88.24 | 37.19 | 51.43 | 2.96 | 94.82 |
| 21013 | 217.62 | 342.33 | 442.35 | 95.19 | 94.82 |
| 21651 | 32.33 | 26.35 | 2.01 | 3.21 | 94.78 |
| 19527 | 47.24 | 56.67 | 112.09 | 11.81 | 94.78 |
| 1921 | 178.67 | 59.48 | 97.23 | 10.49 | 94.73 |
| 8988 | 56.52 | 38.39 | 8.71 | 5.65 | 94.73 |
| 6766 | 481.24 | 157.08 | 653.99 | 16.43 | 94.73 |
| 18862 | 47.30 | 24.54 | 31.00 | 1.20 | 94.69 |
| 15470 | 328.11 | 71.27 | 198.29 | 29.91 | 94.69 |
| 3288 | 10.56 | 13.80 | 41.78 | 12.82 | 94.69 |
| 23109 | 2081.66 | 927.64 | 2211.62 | 60.64 | 94.61 |
| 7197 | 197.55 | 84.70 | 290.53 | 17.88 | 94.56 |
| 7279 | 201.88 | 88.54 | 108.84 | 9.39 | 94.52 |
| 19581 | 48.08 | 32.46 | 66.08 | 3.68 | 94.48 |

TABLE 5G

CARBOPLATIN
Timepoint(s): 6 hrs

| Identifier | NonToxMean | NonToxSD | ToxMean | ToxSD | LDAScore |
|---|---|---|---|---|---|
| 6262 | 739.41 | 208.31 | 1532.53 | 76.80 | 99.61 |
| 24048 | 689.96 | 212.19 | 1411.28 | 55.30 | 99.36 |
| 17089 | 1547.81 | 626.59 | 4737.22 | 696.74 | 98.93 |
| 16081 | 115.61 | 379.88 | 645.20 | 213.95 | 98.54 |
| 25777 | 403.77 | 181.40 | 901.96 | 112.12 | 98.37 |
| 4933 | 134.08 | 204.01 | 525.52 | 82.57 | 98.20 |
| 7476 | 90.92 | 58.14 | 272.77 | 23.70 | 98.11 |
| 15171 | 241.90 | 97.44 | 403.05 | 21.96 | 98.03 |
| 24049 | 1518.47 | 439.97 | 2590.21 | 123.80 | 98.03 |
| 16080 | 44.66 | 251.23 | 378.60 | 161.27 | 97.99 |
| 10093 | 342.04 | 117.93 | 656.06 | 50.76 | 97.86 |
| 1069 | 1820.60 | 698.77 | 1513.87 | 16.71 | 97.64 |
| 25480 | 92.27 | 34.63 | 148.37 | 3.30 | 97.43 |
| 6647 | 510.34 | 159.21 | 1020.51 | 105.54 | 97.39 |
| 7247 | 504.54 | 113.43 | 793.61 | 51.11 | 97.34 |
| 18532 | 285.39 | 90.75 | 560.36 | 75.34 | 97.04 |
| 4067 | 123.93 | 59.96 | 232.57 | 36.85 | 96.92 |
| 23449 | 124.24 | 104.63 | 362.40 | 83.14 | 96.83 |
| 8314 | 95.89 | 403.64 | 202.84 | 47.87 | 96.79 |
| 14159 | 87.59 | 36.45 | 200.11 | 36.34 | 96.74 |
| 18280 | 584.52 | 131.77 | 819.56 | 51.87 | 96.70 |
| 23314 | 71.21 | 275.95 | 495.11 | 153.82 | 96.70 |
| 3816 | 326.31 | 77.12 | 471.75 | 21.93 | 96.66 |
| 17329 | 215.35 | 107.06 | 443.46 | 37.86 | 96.62 |
| 5461 | 193.57 | 116.65 | 442.55 | 77.30 | 96.57 |
| 22501 | 257.26 | 67.93 | 377.18 | 25.53 | 96.53 |
| 15277 | 900.30 | 154.78 | 1210.05 | 42.20 | 96.49 |
| 23538 | 101.09 | 71.79 | 256.02 | 74.72 | 96.44 |
| 8849 | 222.08 | 71.82 | 422.51 | 61.76 | 96.36 |
| 17779 | 1949.63 | 787.42 | 1501.46 | 41.41 | 96.36 |
| 23574 | 2277.50 | 970.11 | 1768.74 | 46.20 | 96.23 |
| 1127 | 1190.78 | 434.96 | 1227.98 | 24.14 | 96.14 |
| 4154 | 247.57 | 87.35 | 387.82 | 17.78 | 95.80 |
| 3471 | 80.41 | 35.57 | 126.92 | 4.34 | 95.76 |
| 22211 | 768.41 | 165.76 | 1038.58 | 34.89 | 95.72 |
| 21815 | 248.67 | 55.97 | 320.59 | 9.43 | 95.67 |
| 18597 | 521.69 | 163.32 | 851.48 | 104.45 | 95.63 |
| 2196 | 564.46 | 104.22 | 713.81 | 13.18 | 95.54 |
| 13598 | 350.22 | 110.18 | 570.66 | 47.31 | 95.46 |
| 16895 | 2022.10 | 903.47 | 1796.87 | 31.07 | 95.42 |
| 6522 | 571.58 | 153.62 | 693.92 | 15.58 | 95.42 |
| 8652 | 228.95 | 114.23 | 482.75 | 43.58 | 95.37 |
| 20026 | 64.36 | 24.25 | 120.87 | 11.23 | 95.33 |
| 15192 | 169.06 | 132.74 | 389.95 | 89.37 | 95.29 |
| 1622 | 2067.46 | 903.52 | 1573.48 | 71.56 | 95.29 |
| 3823 | 526.02 | 154.25 | 801.75 | 71.28 | 95.20 |
| 5989 | 269.96 | 71.53 | 419.90 | 36.98 | 95.12 |
| 3434 | 324.23 | 140.30 | 584.57 | 69.17 | 95.07 |
| 3156 | 1279.17 | 207.18 | 1810.46 | 187.54 | 95.03 |
| 10818 | 464.74 | 186.59 | 181.34 | 44.19 | 95.03 |
| 5575 | 86.94 | 36.56 | 34.41 | 8.85 | 94.99 |
| 11174 | 54.05 | 51.84 | 117.20 | 14.24 | 94.99 |
| 14425 | 213.74 | 79.18 | 349.63 | 37.59 | 94.94 |
| 16417 | 72.79 | 29.59 | 142.55 | 15.55 | 94.90 |
| 17771 | 769.30 | 306.35 | 1273.57 | 156.68 | 94.86 |
| 5208 | 1055.01 | 435.10 | 2101.50 | 490.32 | 94.82 |
| 3431 | 1514.30 | 636.90 | 1297.11 | 34.77 | 94.82 |
| 21462 | 258.49 | 59.82 | 358.44 | 18.51 | 94.77 |
| 3822 | 921.02 | 284.55 | 1300.83 | 99.42 | 94.73 |
| 15190 | 1824.97 | 1183.78 | 2141.03 | 82.58 | 94.69 |
| 19111 | 1604.90 | 429.51 | 2027.13 | 89.10 | 94.64 |
| 14906 | 383.54 | 73.03 | 535.04 | 39.09 | 94.47 |
| 13144 | −27.27 | 17.64 | −54.47 | 5.38 | 94.43 |
| 18142 | 1995.09 | 839.14 | 1819.48 | 43.33 | 94.39 |
| 13634 | 827.03 | 282.41 | 1137.48 | 107.16 | 94.34 |
| 2350 | 646.60 | 103.17 | 832.07 | 60.88 | 94.30 |
| 1537 | 31.35 | 46.10 | 59.58 | 13.80 | 94.26 |
| 13239 | 110.05 | 49.12 | 151.36 | 7.79 | 94.17 |
| 20864 | 1582.67 | 662.32 | 1722.73 | 33.76 | 94.13 |
| 12402 | 540.97 | 155.59 | 755.78 | 32.87 | 94.13 |
| 2424 | 585.64 | 132.80 | 807.06 | 45.48 | 94.13 |

TABLE 5G-continued

Atty. Docket No. 44921-5089US
Doc. No. 1803440.1

CARBOPLATIN
Timepoint(s): 6 hrs

| Identifier | NonToxMean | NonToxSD | ToxMean | ToxSD | LDAScore |
|---|---|---|---|---|---|
| 15106 | 1894.10 | 713.95 | 1463.01 | 37.13 | 94.09 |
| 12569 | 402.63 | 145.28 | 719.92 | 106.90 | 94.04 |
| 2022 | 270.40 | 55.81 | 378.75 | 24.92 | 93.83 |
| 13633 | 310.40 | 151.71 | 490.70 | 80.01 | 93.79 |
| 22197 | 123.97 | 52.28 | 217.39 | 36.02 | 93.79 |
| 13874 | 42.03 | 18.39 | 51.72 | 2.31 | 93.74 |
| 3533 | 212.11 | 64.89 | 298.00 | 11.86 | 93.74 |
| 5985 | 44.47 | 68.11 | 62.07 | 10.39 | 93.74 |
| 21643 | 1185.08 | 370.10 | 960.79 | 22.49 | 93.74 |
| 5089 | 70.77 | 28.48 | 123.98 | 19.48 | 93.74 |
| 17211 | 1445.11 | 555.30 | 1017.49 | 34.14 | 93.70 |
| 15772 | 28.16 | 13.60 | 23.47 | 26.74 | 93.66 |
| 25689 | 1435.28 | 508.41 | 1360.96 | 40.18 | 93.66 |
| 22545 | 252.03 | 89.09 | 444.84 | 127.61 | 93.62 |
| 11954 | 3134.66 | 1692.86 | 2572.78 | 105.71 | 93.57 |
| 8634 | 343.04 | 96.04 | 542.29 | 61.79 | 93.53 |
| 13771 | 91.36 | 32.90 | 152.72 | 14.45 | 93.53 |
| 14871 | 688.13 | 217.01 | 1066.71 | 67.36 | 93.53 |
| 25435 | 69.69 | 23.87 | 116.39 | 11.28 | 93.49 |
| 18076 | 2539.23 | 1190.89 | 2104.90 | 81.41 | 93.49 |
| 1660 | 6.16 | 20.59 | 24.43 | 41.71 | 93.44 |
| 20817 | 1076.80 | 681.07 | 1252.44 | 51.53 | 93.36 |
| 22923 | 57.85 | 40.50 | 3.36 | 7.47 | 93.32 |
| 20508 | 16.41 | 9.30 | 22.98 | 0.98 | 93.27 |
| 14304 | 95.81 | 30.28 | 138.83 | 9.76 | 93.23 |
| 23005 | 911.26 | 224.88 | 1191.71 | 45.14 | 93.23 |
| 16375 | 1004.76 | 291.14 | 1452.05 | 94.00 | 93.23 |
| 25754 | 73.97 | 20.01 | 103.72 | 4.72 | 93.19 |
| 820 | 2460.91 | 1164.05 | 2043.71 | 81.32 | 93.19 |

TABLE 5H

Atty. Docket No. 44921-5089US
Doc. No. 1803440.1

CEPHALORIDINE
Timepoint(s): 6, 24 hrs

| Identifier | NonToxMean | NonToxSD | ToxMean | ToxSD | LDAScore |
|---|---|---|---|---|---|
| 1698 | 72.61 | 72.54 | 355.15 | 57.50 | 98.88 |
| 25057 | −16.00 | 13.42 | 28.61 | 15.15 | 98.84 |
| 23302 | 115.35 | 36.99 | 250.40 | 26.19 | 98.45 |
| 25098 | 44.75 | 40.56 | 161.77 | 39.01 | 98.45 |
| 7022 | 6.54 | 19.86 | 87.07 | 26.85 | 98.45 |
| 18005 | 16.30 | 11.61 | 71.95 | 28.31 | 97.64 |
| 16318 | 111.73 | 57.76 | 214.34 | 48.82 | 97.59 |
| 15849 | 181.68 | 73.50 | 381.77 | 34.83 | 97.29 |
| 23283 | 520.93 | 94.30 | 765.95 | 70.15 | 97.25 |
| 651 | 12.40 | 11.40 | 69.75 | 44.55 | 97.16 |
| 16112 | 56.89 | 23.53 | 146.28 | 35.70 | 97.12 |
| 25198 | 33.14 | 18.60 | 104.50 | 28.93 | 97.12 |
| 8879 | 109.65 | 35.18 | 198.92 | 13.77 | 97.03 |
| 19253 | 280.76 | 74.42 | 450.66 | 32.07 | 97.03 |
| 15376 | 140.99 | 45.51 | 267.24 | 27.71 | 96.90 |
| 21038 | 113.15 | 45.28 | 284.43 | 88.01 | 96.82 |
| 20917 | 114.76 | 34.55 | 219.65 | 37.89 | 96.69 |
| 650 | 17.69 | 13.01 | 74.86 | 36.83 | 96.47 |
| 11411 | 252.17 | 76.16 | 422.51 | 26.01 | 96.35 |
| 343 | 28.78 | 32.80 | 129.29 | 21.40 | 96.35 |
| 16248 | 128.59 | 52.73 | 293.26 | 99.85 | 96.30 |
| 20843 | 165.02 | 37.03 | 274.00 | 60.23 | 96.30 |
| 18995 | 61.26 | 23.28 | 126.99 | 20.34 | 96.17 |
| 7050 | 68.24 | 24.46 | 116.13 | 10.21 | 95.92 |
| 20753 | 128.41 | 31.77 | 231.50 | 37.70 | 95.83 |
| 18084 | 36.85 | 19.15 | 95.80 | 24.41 | 95.83 |
| 1764 | 97.37 | 32.56 | 181.11 | 28.78 | 95.83 |
| 22413 | 73.51 | 35.54 | 155.12 | 24.23 | 95.74 |
| 12162 | 313.72 | 69.35 | 466.55 | 53.66 | 95.57 |

TABLE 5H-continued

Atty. Docket No. 44921-5089US
Doc. No. 1803440.1

CEPHALORIDINE
Timepoint(s): 6, 24 hrs

| Identifier | NonToxMean | NonToxSD | ToxMean | ToxSD | LDAScore |
|---|---|---|---|---|---|
| 9573 | 313.16 | 70.67 | 449.88 | 24.42 | 95.53 |
| 5458 | 521.55 | 111.52 | 766.69 | 82.52 | 95.49 |
| 23889 | 170.87 | 60.58 | 320.41 | 74.89 | 95.49 |
| 1623 | 84.54 | 20.77 | 130.31 | 10.23 | 95.44 |
| 19254 | 240.06 | 74.71 | 400.30 | 44.56 | 95.31 |
| 1628 | 13.93 | 10.20 | 37.44 | 6.38 | 95.27 |
| 672 | −2.45 | 13.09 | 33.39 | 16.62 | 95.27 |
| 1855 | 13.51 | 8.02 | 32.00 | 4.11 | 95.18 |
| 3900 | 83.63 | 36.44 | 170.88 | 42.74 | 95.14 |
| 15281 | 172.53 | 45.57 | 282.14 | 34.03 | 95.10 |
| 1582 | 16.73 | 13.23 | 46.93 | 7.97 | 95.10 |
| 25589 | 154.39 | 37.33 | 240.89 | 33.81 | 95.10 |
| 627 | 63.31 | 19.85 | 119.93 | 25.90 | 95.06 |
| 17434 | 163.74 | 49.10 | 263.86 | 22.79 | 95.01 |
| 21063 | 75.00 | 25.88 | 144.62 | 27.06 | 94.97 |
| 14353 | 61.97 | 20.12 | 119.73 | 30.32 | 94.93 |
| 6850 | 87.12 | 29.12 | 157.80 | 23.31 | 94.93 |
| 2059 | 139.66 | 39.69 | 243.75 | 48.13 | 94.84 |
| 16333 | 132.19 | 38.88 | 212.16 | 19.97 | 94.71 |
| 25377 | 31.75 | 20.09 | 77.51 | 19.81 | 94.50 |
| 23282 | 277.48 | 51.59 | 385.61 | 37.11 | 94.50 |
| 12058 | 109.37 | 35.93 | 194.17 | 43.87 | 94.45 |
| 9952 | 163.81 | 35.63 | 235.14 | 38.00 | 94.37 |
| 22196 | 58.71 | 24.71 | 123.83 | 37.19 | 94.37 |
| 16121 | 110.03 | 60.28 | 208.77 | 16.39 | 94.33 |
| 24640 | 177.93 | 59.42 | 295.24 | 35.00 | 94.33 |
| 1946 | 46.78 | 14.37 | 67.25 | 3.13 | 94.28 |
| 12259 | −0.17 | 9.62 | 21.16 | 7.74 | 94.15 |
| 6790 | 62.58 | 24.20 | 118.33 | 27.25 | 94.07 |
| 21802 | 45.94 | 21.21 | 103.13 | 35.44 | 94.07 |
| 14125 | 128.30 | 50.32 | 211.96 | 15.22 | 94.07 |
| 18183 | 31.28 | 14.65 | 67.29 | 14.30 | 94.02 |
| 17225 | 162.76 | 46.10 | 264.51 | 40.73 | 93.94 |
| 20514 | 83.93 | 25.89 | 146.04 | 21.67 | 93.94 |
| 1342 | 31.31 | 15.65 | 72.08 | 26.80 | 93.81 |
| 16616 | 88.26 | 37.98 | 165.12 | 31.68 | 93.77 |
| 4386 | 55.88 | 26.02 | 117.38 | 28.79 | 93.77 |
| 13464 | 30.34 | 17.92 | 75.47 | 19.34 | 93.68 |
| 11358 | 82.35 | 33.88 | 151.50 | 27.12 | 93.59 |
| 7866 | 43.15 | 16.17 | 81.51 | 16.07 | 93.51 |
| 22967 | 163.95 | 54.65 | 241.59 | 15.86 | 93.47 |
| 8385 | 57.15 | 28.33 | 114.53 | 19.32 | 93.42 |
| 24748 | −23.01 | 37.80 | 49.31 | 11.34 | 93.38 |
| 16059 | 50.12 | 14.86 | 84.72 | 17.27 | 93.38 |
| 16122 | 117.41 | 41.42 | 186.27 | 14.87 | 93.34 |
| 1350 | 143.74 | 30.94 | 209.15 | 28.63 | 93.34 |
| 8384 | 39.05 | 17.03 | 73.91 | 10.64 | 93.29 |
| 18259 | 216.96 | 155.49 | 545.75 | 138.45 | 93.28 |
| 20724 | 48.65 | 21.46 | 90.26 | 16.90 | 93.25 |
| 352 | 87.58 | 53.82 | 157.16 | 24.98 | 93.21 |
| 10740 | 26.94 | 24.94 | 69.61 | 15.31 | 93.12 |
| 1394 | 24.70 | 11.31 | 42.23 | 3.80 | 93.12 |
| 22466 | 462.31 | 92.72 | 638.40 | 68.34 | 92.99 |
| 13684 | 467.12 | 135.55 | 762.39 | 150.04 | 92.99 |
| 14768 | 85.99 | 47.21 | 225.50 | 66.59 | 92.98 |
| 13285 | 71.32 | 19.47 | 109.95 | 16.43 | 92.91 |
| 1537 | 29.82 | 40.75 | 245.05 | 131.87 | 92.90 |
| 18442 | 38.53 | 17.21 | 75.30 | 16.45 | 92.86 |
| 1183 | 52.85 | 29.47 | 214.38 | 101.63 | 92.85 |
| 127 | 19.05 | 14.19 | 48.31 | 9.93 | 92.73 |
| 1399 | 200.20 | 80.01 | 449.25 | 95.96 | 92.68 |
| 11203 | 75.19 | 24.99 | 127.88 | 16.58 | 92.65 |
| 870 | 22.03 | 9.87 | 40.53 | 4.22 | 92.61 |
| 4415 | 38.66 | 18.55 | 77.02 | 14.75 | 92.61 |
| 373 | 32.60 | 56.68 | 306.93 | 119.81 | 92.60 |
| 22524 | 112.62 | 47.12 | 195.09 | 26.00 | 92.56 |
| 6951 | 88.94 | 34.80 | 155.83 | 27.94 | 92.56 |
| 13023 | 176.39 | 400.42 | 1491.81 | 754.76 | 92.55 |
| 17836 | 102.26 | 27.02 | 156.20 | 28.41 | 92.48 |
| 7051 | 62.10 | 22.11 | 105.49 | 19.48 | 92.48 |
| 18749 | 115.18 | 42.04 | 202.78 | 33.94 | 92.39 |

TABLE 5I

Atty. Docket No. 44921-5089US  
Doc. No. 1803440.1

CIDOFOVIR  
Timepoint(s): 120 hrs

| Identifier | NonToxMean | NonToxSD | ToxMean | ToxSD | LDAScore |
|---|---|---|---|---|---|
| 18609 | 203.96 | 70.15 | 541.22 | 19.78 | 99.70 |
| 20674 | 83.03 | 21.84 | 203.76 | 22.76 | 99.61 |
| 4312 | 76.73 | 35.26 | 365.78 | 59.40 | 99.57 |
| 24041 | 12.84 | 32.48 | 31.93 | 0.33 | 99.53 |
| 5733 | 10.73 | 30.54 | 617.55 | 122.19 | 99.44 |
| 2768 | 1962.14 | 417.45 | 933.17 | 95.15 | 99.32 |
| 2410 | 11.13 | 10.13 | 64.03 | 13.02 | 99.32 |
| 14289 | 62.53 | 19.54 | 95.56 | 0.76 | 99.27 |
| 5689 | 12.82 | 19.88 | 85.25 | 13.41 | 99.23 |
| 14594 | −17.87 | 24.41 | 86.07 | 17.70 | 99.23 |
| 24000 | 64.13 | 33.98 | 157.59 | 7.48 | 99.19 |
| 8027 | 0.11 | 26.38 | 29.41 | 3.47 | 99.19 |
| 18322 | 2666.91 | 812.51 | 1165.22 | 99.03 | 99.06 |
| 7324 | 97.12 | 49.43 | 271.43 | 20.08 | 99.06 |
| 20903 | 70.06 | 46.59 | 288.96 | 29.37 | 99.06 |
| 20757 | 410.75 | 211.87 | 1571.32 | 228.32 | 98.97 |
| 1599 | 22.63 | 26.70 | 62.22 | 8.06 | 98.97 |
| 5183 | 215.17 | 70.24 | 445.78 | 24.68 | 98.97 |
| 4856 | 122.81 | 48.54 | 241.75 | 6.99 | 98.97 |
| 2655 | 42.27 | 39.82 | 529.96 | 152.39 | 98.97 |
| 10167 | 189.75 | 100.26 | 305.25 | 11.81 | 98.97 |
| 21275 | 225.36 | 80.40 | 666.87 | 94.23 | 98.93 |
| 22722 | 73.37 | 39.40 | 290.14 | 53.00 | 98.93 |
| 20082 | 75.76 | 32.27 | 258.55 | 44.96 | 98.93 |
| 912 | 474.15 | 83.63 | 764.00 | 33.56 | 98.84 |
| 8002 | 13.99 | 15.79 | 47.18 | 4.09 | 98.84 |
| 13158 | 463.87 | 106.89 | 360.87 | 1.60 | 98.80 |
| 10200 | 41.90 | 30.39 | 92.98 | 6.46 | 98.76 |
| 5572 | 332.45 | 146.31 | 611.55 | 14.40 | 98.67 |
| 410 | 1097.88 | 255.30 | 605.30 | 42.31 | 98.63 |
| 20755 | 145.36 | 116.99 | 986.50 | 562.94 | 98.63 |
| 23376 | 14.61 | 16.79 | 37.95 | 1.52 | 98.63 |
| 1600 | 44.38 | 66.08 | 114.35 | 13.26 | 98.63 |
| 25705 | 454.53 | 109.40 | 1132.56 | 152.81 | 98.59 |
| 13609 | 240.24 | 60.23 | 98.11 | 9.83 | 98.59 |
| 24219 | 315.68 | 82.27 | 692.16 | 77.33 | 98.59 |
| 26184 | 204.20 | 70.54 | 454.10 | 35.35 | 98.54 |
| 16081 | 117.80 | 381.49 | 136.30 | 8.26 | 98.54 |
| 7660 | 57.70 | 87.65 | 653.31 | 318.06 | 98.54 |
| 22681 | 222.75 | 194.18 | 580.89 | 50.39 | 98.54 |
| 9215 | 90.03 | 33.75 | 158.07 | 6.56 | 98.50 |
| 25699 | 137.08 | 68.59 | −11.79 | 8.27 | 98.50 |
| 4048 | −6.15 | 31.92 | 56.08 | 15.06 | 98.50 |
| 2729 | 640.63 | 170.18 | 328.03 | 37.57 | 98.50 |
| 15981 | 75.77 | 29.60 | 148.46 | 12.15 | 98.46 |
| 133 | −43.58 | 39.29 | 55.82 | 20.14 | 98.37 |
| 24707 | 47.32 | 82.24 | 10.71 | 1.68 | 98.37 |
| 6193 | 192.02 | 179.55 | 250.16 | 3.55 | 98.37 |
| 3981 | 72.52 | 103.32 | 368.64 | 91.18 | 98.37 |
| 21893 | 51.03 | 33.90 | 172.83 | 32.83 | 98.37 |
| 16168 | 350.38 | 204.48 | 829.66 | 132.95 | 98.37 |
| 4262 | 43.72 | 51.67 | 193.22 | 27.67 | 98.33 |
| 10289 | 14.87 | 14.48 | 127.47 | 59.89 | 98.24 |
| 17161 | 1157.45 | 414.68 | 2144.64 | 136.59 | 98.24 |
| 26150 | 780.06 | 534.26 | 32.24 | 49.38 | 98.24 |
| 3916 | 737.83 | 188.48 | 383.68 | 38.35 | 98.24 |
| 5839 | 5.98 | 20.99 | 59.41 | 8.18 | 98.16 |
| 26084 | 113.22 | 92.96 | 448.40 | 70.70 | 98.16 |
| 21654 | 362.77 | 114.65 | 543.47 | 30.13 | 98.12 |
| 26119 | 124.48 | 46.50 | 204.85 | 9.09 | 98.12 |
| 17314 | 6.10 | 12.64 | 43.93 | 7.10 | 98.07 |
| 353 | 173.67 | 81.62 | 475.77 | 74.64 | 98.07 |
| 16756 | 177.77 | 53.62 | 345.26 | 28.00 | 98.07 |
| 11437 | 555.26 | 125.28 | 290.62 | 37.25 | 98.07 |
| 24433 | 35.92 | 17.39 | 77.13 | 4.05 | 98.03 |
| 5464 | 225.07 | 67.79 | 427.41 | 46.05 | 97.99 |
| 15416 | 49.65 | 20.05 | 91.41 | 3.94 | 97.99 |
| 21948 | 203.26 | 65.91 | 33.57 | 32.91 | 97.99 |
| 18361 | 460.95 | 159.60 | 865.38 | 68.10 | 97.95 |
| 4049 | 22.90 | 64.75 | 174.30 | 49.09 | 97.90 |
| 6765 | 788.37 | 204.50 | 462.53 | 19.06 | 97.90 |
| 17401 | 910.82 | 424.91 | 1651.59 | 134.17 | 97.90 |
| 20830 | 519.62 | 176.96 | 850.57 | 34.74 | 97.86 |
| 12908 | 40.69 | 40.63 | 135.60 | 42.31 | 97.86 |
| 19762 | 4.99 | 10.67 | 25.14 | 2.42 | 97.82 |
| 20457 | 382.89 | 90.62 | 215.96 | 13.41 | 97.82 |
| 5430 | 136.50 | 60.64 | 401.60 | 97.31 | 97.82 |
| 15300 | 137.15 | 130.99 | 496.58 | 110.00 | 97.73 |
| 11259 | 107.70 | 137.96 | 508.22 | 165.85 | 97.73 |
| 3808 | 168.07 | 57.61 | 297.97 | 55.59 | 97.73 |
| 22050 | 3164.11 | 929.00 | 1779.72 | 124.06 | 97.73 |
| 4451 | 290.06 | 65.29 | 164.79 | 13.86 | 97.73 |
| 16170 | 38.98 | 26.45 | 97.44 | 18.88 | 97.69 |
| 13332 | 420.04 | 95.61 | 169.12 | 30.12 | 97.69 |
| 15861 | 460.82 | 148.89 | 174.40 | 29.65 | 97.69 |
| 6606 | 251.17 | 124.12 | 178.93 | 1.98 | 97.65 |
| 19370 | 308.88 | 74.48 | 551.57 | 63.31 | 97.65 |
| 3874 | 883.32 | 205.24 | 530.31 | 28.27 | 97.65 |
| 20991 | 224.15 | 69.07 | 195.44 | 2.64 | 97.60 |
| 18811 | 46.63 | 26.47 | 80.60 | 1.75 | 97.60 |
| 5881 | 103.14 | 35.12 | 184.15 | 16.55 | 97.60 |
| 354 | 214.95 | 93.98 | 490.19 | 69.08 | 97.56 |
| 11454 | 238.74 | 78.96 | 470.27 | 65.91 | 97.56 |
| 12873 | 122.01 | 67.80 | 366.63 | 64.37 | 97.56 |
| 20829 | 813.56 | 302.89 | 1539.75 | 129.65 | 97.56 |
| 17807 | 753.81 | 228.33 | 1314.67 | 146.81 | 97.56 |
| 8585 | 289.56 | 118.65 | 190.91 | 6.78 | 97.56 |
| 8215 | 1680.14 | 394.54 | 881.26 | 110.65 | 97.56 |
| 14763 | 38.37 | 132.57 | 554.64 | 221.30 | 97.52 |

TABLE 5J

Atty. Docket No. 44921-5089US  
Doc. No. 1803440.1

CISPAN combined  
Timepoint(s): 6, 24 hrs

| Identifier | NonToxMean | NonToxSD | ToxMean | ToxSD | LDAScore |
|---|---|---|---|---|---|
| 8990 | 276.73 | 75.18 | 522.76 | 68.28 | 96.93 |
| 1460 | 198.36 | 85.83 | 320.23 | 42.90 | 95.60 |
| 16853 | 67.12 | 22.69 | 121.67 | 21.69 | 95.08 |
| 13239 | 108.86 | 47.65 | 222.86 | 33.91 | 94.73 |
| 21355 | 373.47 | 117.15 | 627.82 | 92.43 | 94.69 |
| 6454 | 238.70 | 77.20 | 419.87 | 47.88 | 94.69 |
| 1247 | 1313.77 | 499.48 | 559.96 | 117.97 | 94.56 |
| 6506 | 233.04 | 59.13 | 375.55 | 54.15 | 94.34 |
| 1585 | 67.19 | 32.77 | 140.57 | 23.52 | 94.26 |
| 1962 | 33.04 | 26.70 | 76.49 | 11.48 | 94.17 |
| 18433 | 18.64 | 45.96 | 123.81 | 42.15 | 94.13 |
| 15050 | 638.79 | 181.52 | 459.28 | 26.53 | 94.04 |
| 17693 | 1261.20 | 375.03 | 651.01 | 91.79 | 93.87 |
| 4956 | 78.53 | 37.78 | 155.47 | 25.21 | 93.65 |
| 16233 | 68.67 | 88.34 | 117.42 | 12.47 | 93.18 |
| 11445 | 435.55 | 103.48 | 642.14 | 86.21 | 92.62 |
| 8004 | 125.10 | 43.16 | 255.80 | 43.43 | 92.37 |
| 1811 | 10.62 | 25.84 | 83.04 | 26.96 | 92.28 |
| 1542 | 929.09 | 263.76 | 560.16 | 66.12 | 91.97 |
| 16591 | 151.89 | 47.44 | 236.90 | 29.21 | 91.84 |
| 18694 | 52.90 | 48.32 | 176.24 | 47.08 | 91.68 |
| 11524 | −14.63 | 24.06 | 46.43 | 29.33 | 91.59 |
| 19080 | 75.03 | 55.99 | 212.58 | 72.04 | 91.20 |
| 20514 | 83.88 | 26.10 | 127.69 | 12.79 | 91.19 |
| 15701 | 37.45 | 16.42 | 79.72 | 13.34 | 91.16 |
| 16122 | 116.73 | 39.95 | 217.85 | 62.09 | 90.99 |
| 2079 | 303.23 | 81.83 | 406.18 | 33.43 | 90.98 |
| 19327 | 88.79 | 28.83 | 152.22 | 21.27 | 90.86 |
| 335 | 95.54 | 44.88 | 191.73 | 23.12 | 90.86 |
| 14003 | 817.87 | 211.94 | 491.17 | 61.11 | 90.86 |

TABLE 5J-continued

Atty. Docket No. 44921-5089US
Doc. No. 1803440.1

CISPAN combined
Timepoint(s): 6, 24 hrs

| Identifier | NonToxMean | NonToxSD | ToxMean | ToxSD | LDAScore |
|---|---|---|---|---|---|
| 9104 | 138.43 | 38.55 | 221.59 | 41.76 | 90.69 |
| 25253 | 291.50 | 63.92 | 430.49 | 54.59 | 90.69 |
| 23322 | 1169.44 | 284.23 | 807.96 | 73.20 | 90.67 |
| 24696 | 68.34 | 46.61 | 180.46 | 53.14 | 90.60 |
| 1552 | 71.02 | 83.66 | 121.56 | 15.30 | 90.54 |
| 19120 | 31.87 | 24.91 | 90.61 | 26.26 | 90.51 |
| 17411 | 78.54 | 53.72 | 189.16 | 45.14 | 90.51 |
| 16121 | 109.00 | 58.08 | 258.63 | 87.07 | 90.47 |
| 1639 | 96.38 | 22.51 | 149.03 | 17.77 | 90.43 |
| 1622 | 2080.70 | 896.54 | 796.36 | 153.89 | 90.41 |
| 9882 | 487.60 | 181.11 | 245.48 | 60.74 | 90.41 |
| 23852 | 261.73 | 101.88 | 487.29 | 97.17 | 90.38 |
| 13684 | 465.64 | 134.08 | 778.77 | 108.34 | 90.38 |
| 7857 | 51.80 | 45.32 | 150.23 | 38.24 | 90.38 |
| 6281 | 232.74 | 67.04 | 343.63 | 49.82 | 90.34 |
| 15790 | 45.82 | 25.45 | 87.17 | 18.57 | 90.24 |
| 23884 | 40.55 | 32.64 | 101.67 | 19.55 | 90.21 |
| 17682 | 673.97 | 178.07 | 455.67 | 77.33 | 90.16 |
| 16581 | 39.15 | 19.04 | 83.46 | 15.21 | 90.12 |
| 24390 | 161.41 | 112.42 | 367.16 | 79.88 | 90.08 |
| 3886 | 57.66 | 28.30 | 124.53 | 24.81 | 90.08 |
| 13682 | 176.78 | 61.74 | 302.10 | 50.60 | 90.04 |
| 7262 | 1113.30 | 393.42 | 1879.06 | 245.81 | 90.00 |
| 11954 | 3158.62 | 1682.02 | 952.13 | 425.90 | 89.98 |
| 818 | 4151.32 | 2802.74 | 902.92 | 257.41 | 89.94 |
| 819 | 3116.95 | 1659.72 | 925.18 | 255.80 | 89.90 |
| 16211 | 2269.84 | 1132.19 | 853.70 | 212.63 | 89.90 |
| 1521 | 20.42 | 50.86 | 117.89 | 40.21 | 89.78 |
| 23125 | 4625.10 | 2534.40 | 1935.15 | 332.35 | 89.77 |
| 9109 | 1022.92 | 338.20 | 736.62 | 48.42 | 89.77 |
| 10141 | 53.73 | 45.97 | 150.14 | 52.96 | 89.69 |
| 152 | 72.28 | 26.46 | 108.76 | 14.84 | 89.68 |
| 17154 | 198.73 | 57.61 | 281.13 | 33.91 | 89.59 |
| 6362 | 62.35 | 38.95 | 146.74 | 29.87 | 89.56 |
| 10540 | 19.51 | 18.83 | 64.08 | 25.25 | 89.52 |
| 651 | 12.58 | 12.76 | 33.89 | 11.18 | 89.52 |
| 17086 | 151.38 | 43.21 | 214.56 | 21.12 | 89.51 |
| 12020 | 167.06 | 60.45 | 260.26 | 34.23 | 89.51 |
| 4121 | 62.05 | 23.29 | 113.40 | 19.65 | 89.43 |
| 8211 | 2875.40 | 1605.55 | 956.21 | 247.45 | 89.38 |
| 20404 | 53.25 | 45.78 | 130.86 | 32.28 | 89.35 |
| 7522 | 31.59 | 18.74 | 75.54 | 18.10 | 89.30 |
| 20879 | 87.24 | 50.13 | 179.14 | 40.07 | 89.26 |
| 17550 | 1318.67 | 366.65 | 860.58 | 175.55 | 89.25 |
| 21950 | 727.03 | 149.84 | 534.23 | 70.97 | 89.21 |
| 25405 | 77.77 | 28.49 | 139.55 | 22.89 | 89.17 |
| 14125 | 127.72 | 49.56 | 229.81 | 40.28 | 89.17 |
| 1611 | 8.22 | 23.65 | 52.29 | 18.59 | 89.13 |
| 21685 | 122.94 | 42.72 | 207.33 | 33.76 | 89.13 |
| 17524 | 1176.52 | 284.08 | 761.61 | 160.07 | 89.09 |
| 10611 | 10.59 | 27.29 | 104.61 | 49.13 | 89.06 |
| 22849 | 197.26 | 50.25 | 298.83 | 40.93 | 89.00 |
| 1608 | 12.43 | 29.83 | 56.08 | 17.26 | 89.00 |
| 4312 | 76.57 | 37.18 | 172.28 | 72.36 | 88.97 |
| 1396 | 47.24 | 18.54 | 84.98 | 24.01 | 88.92 |
| 20871 | 52.42 | 25.81 | 108.86 | 22.74 | 88.92 |
| 10344 | 22.14 | 21.48 | 62.29 | 12.19 | 88.83 |
| 15587 | 38.29 | 19.07 | 66.30 | 11.60 | 88.82 |
| 9096 | 9634.12 | 6768.62 | 2697.48 | 901.04 | 88.82 |
| 4290 | 94.06 | 28.34 | 144.64 | 19.10 | 88.79 |
| 24143 | 192.56 | 96.48 | 385.57 | 70.47 | 88.74 |
| 12174 | 80.77 | 29.46 | 139.07 | 31.48 | 88.74 |
| 17336 | 65.85 | 21.84 | 107.99 | 13.40 | 88.74 |
| 25257 | 101.83 | 34.03 | 168.25 | 31.38 | 88.74 |
| 20350 | 154.58 | 49.68 | 245.00 | 41.28 | 88.70 |
| 11335 | 661.49 | 162.55 | 459.38 | 57.71 | 88.64 |
| 24146 | 219.42 | 50.91 | 370.23 | 55.30 | 88.63 |
| 16254 | 5.55 | 11.81 | 26.92 | 12.39 | 88.61 |
| 20876 | 1683.23 | 611.09 | 940.93 | 123.03 | 88.60 |
| 9312 | 31.90 | 15.15 | 74.64 | 21.22 | 88.58 |

TABLE 5K

Atty. Docket No. 44921-5089US
Doc. No. 1803440.1

CISPLATIN
Timepoint(s): 168 hrs

| Identifier | NonToxMean | NonToxSD | ToxMean | ToxSD | LDAScore |
|---|---|---|---|---|---|
| 14458 | 36.84 | 28.40 | 100.33 | 0.26 | 99.96 |
| 22385 | 106.64 | 51.70 | 345.64 | 8.69 | 99.87 |
| 11731 | 43.29 | 24.10 | 393.30 | 43.69 | 99.87 |
| 23745 | 201.94 | 65.06 | 823.60 | 110.42 | 99.83 |
| 12903 | 53.64 | 18.74 | 124.32 | 6.90 | 99.83 |
| 15503 | 124.27 | 37.32 | 319.29 | 21.43 | 99.79 |
| 8235 | 43.83 | 34.77 | 145.95 | 18.00 | 99.79 |
| 16756 | 177.83 | 53.82 | 327.44 | 3.02 | 99.74 |
| 16119 | 15.30 | 15.19 | 84.22 | 6.17 | 99.74 |
| 11967 | 1725.18 | 546.07 | 289.45 | 25.19 | 99.74 |
| 3608 | 333.84 | 110.50 | 62.62 | 5.74 | 99.70 |
| 18729 | 19.92 | 29.07 | 174.49 | 19.16 | 99.61 |
| 5891 | −53.03 | 47.69 | 106.02 | 18.28 | 99.61 |
| 2048 | 31.69 | 20.74 | 125.19 | 16.43 | 99.61 |
| 4490 | 76.73 | 72.26 | 462.55 | 50.86 | 99.61 |
| 1743 | 29.35 | 16.21 | 72.89 | 1.22 | 99.61 |
| 1584 | 162.19 | 43.70 | 307.85 | 8.25 | 99.57 |
| 16137 | 6.75 | 397.82 | 87.49 | 8.36 | 99.53 |
| 23778 | 68.99 | 34.04 | 179.58 | 9.21 | 99.53 |
| 23261 | 1568.96 | 389.70 | 925.80 | 13.87 | 99.53 |
| 808 | 468.33 | 143.61 | 160.94 | 9.90 | 99.53 |
| 1962 | 33.33 | 26.74 | 101.07 | 4.72 | 99.53 |
| 21789 | 34.67 | 30.58 | 177.40 | 21.84 | 99.53 |
| 23769 | −6.24 | 8.69 | 33.99 | 6.30 | 99.53 |
| 23070 | 125.37 | 31.23 | 218.44 | 4.95 | 99.49 |
| 12400 | 13.19 | 10.48 | 74.60 | 11.18 | 99.49 |
| 16676 | 38.33 | 26.96 | 110.79 | 5.32 | 99.49 |
| 23780 | 25.07 | 35.93 | 95.20 | 12.81 | 99.44 |
| 25545 | 94.29 | 48.16 | 306.94 | 34.66 | 99.44 |
| 15254 | 209.66 | 67.16 | 447.21 | 21.22 | 99.44 |
| 23992 | 5.39 | 7.25 | 34.45 | 3.17 | 99.44 |
| 14430 | 34.19 | 31.78 | 125.29 | 8.54 | 99.40 |
| 11969 | 96.84 | 38.48 | 303.71 | 38.83 | 99.40 |
| 4312 | 77.16 | 37.99 | 241.97 | 24.41 | 99.40 |
| 4967 | 33.46 | 19.94 | 94.30 | 3.72 | 99.36 |
| 2079 | 303.69 | 81.26 | 527.92 | 20.78 | 99.32 |
| 22816 | 23.12 | 15.17 | 89.33 | 8.69 | 99.32 |
| 3609 | 407.50 | 148.70 | 67.97 | 9.33 | 99.32 |
| 4361 | 90.16 | 30.77 | 193.28 | 10.19 | 99.32 |
| 13682 | 177.74 | 62.54 | 333.83 | 4.20 | 99.32 |
| 15504 | 129.02 | 50.62 | 447.33 | 63.50 | 99.27 |
| 633 | 271.13 | 101.41 | 110.07 | 15.08 | 99.27 |
| 21183 | 22.62 | 26.03 | 134.40 | 19.53 | 99.27 |
| 24222 | 101.20 | 52.50 | 460.48 | 61.63 | 99.27 |
| 8548 | 63.06 | 30.22 | 6.09 | 1.52 | 99.27 |
| 24301 | 109.26 | 35.74 | 248.67 | 13.48 | 99.27 |
| 18442 | 38.61 | 17.15 | 99.87 | 5.14 | 99.27 |
| 14370 | 32.54 | 45.58 | 189.80 | 11.25 | 99.23 |
| 21500 | 80.36 | 76.69 | 471.24 | 73.44 | 99.23 |
| 24211 | 148.45 | 87.73 | 552.73 | 49.74 | 99.23 |
| 770 | 798.02 | 219.52 | 248.56 | 33.80 | 99.23 |
| 21791 | 84.31 | 36.00 | 242.62 | 24.88 | 99.23 |
| 24651 | 100.74 | 23.52 | 203.14 | 12.02 | 99.23 |
| 17897 | 53.72 | 25.98 | 111.75 | 3.84 | 99.23 |
| 20890 | 101.09 | 46.35 | 342.52 | 50.55 | 99.19 |
| 712 | 1.36 | 9.08 | 60.25 | 14.12 | 99.19 |
| 18553 | 54.23 | 33.42 | 166.80 | 12.30 | 99.19 |
| 15884 | 183.00 | 57.89 | 383.85 | 23.01 | 99.19 |
| 19722 | 168.71 | 55.03 | 336.25 | 15.95 | 99.19 |
| 17481 | 26.11 | 28.66 | 137.39 | 13.89 | 99.19 |
| 5733 | 12.25 | 46.24 | 172.15 | 34.99 | 99.19 |
| 4895 | 232.18 | 95.74 | 44.77 | 8.48 | 99.14 |
| 15151 | 153.83 | 39.15 | 302.83 | 29.57 | 99.14 |
| 14759 | 21.72 | 15.86 | 78.25 | 9.50 | 99.14 |
| 15039 | 272.18 | 79.33 | 101.53 | 6.80 | 99.14 |
| 12782 | 20.00 | 43.24 | 135.93 | 6.16 | 99.14 |
| 23121 | 19.80 | 13.92 | 60.40 | 2.66 | 99.14 |
| 26292 | 22.82 | 12.83 | 85.01 | 11.49 | 99.14 |
| 2154 | 59.03 | 121.05 | 244.16 | 33.75 | 99.14 |
| 21583 | 125.87 | 40.62 | 270.04 | 27.65 | 99.14 |
| 3006 | 26.57 | 35.44 | 81.75 | 9.18 | 99.10 |

TABLE 5K-continued

Atty. Docket No. 44921-5089US
Doc. No. 1803440.1

CISPLATIN
Timepoint(s): 168 hrs

| Identifier | NonToxMean | NonToxSD | ToxMean | ToxSD | LDAScore |
|---|---|---|---|---|---|
| 1203 | 5.08 | 18.58 | 86.62 | 14.26 | 99.10 |
| 24472 | 234.56 | 47.65 | 380.85 | 13.16 | 99.10 |
| 5729 | 87.49 | 38.35 | 274.95 | 40.90 | 99.10 |
| 132 | −24.93 | 23.56 | 50.93 | 12.76 | 99.10 |
| 1801 | 97.64 | 29.41 | 197.50 | 14.44 | 99.10 |
| 1993 | 30.09 | 21.86 | 117.89 | 9.03 | 99.10 |
| 16675 | 33.74 | 34.04 | 112.81 | 11.29 | 99.10 |
| 1382 | 57.80 | 21.22 | 127.59 | 5.60 | 99.10 |
| 17586 | 115.18 | 35.27 | 246.61 | 21.48 | 99.06 |
| 21666 | 22.81 | 17.92 | 87.38 | 6.42 | 99.06 |
| 2125 | 76.55 | 80.69 | 345.60 | 72.31 | 99.06 |
| 21709 | 142.70 | 29.95 | 215.46 | 6.19 | 99.06 |
| 16538 | 132.96 | 36.43 | 245.73 | 9.25 | 99.06 |
| 2845 | 667.61 | 123.51 | 1098.14 | 42.15 | 99.02 |
| 753 | 42.04 | 16.33 | 120.03 | 23.17 | 99.02 |
| 21893 | 50.92 | 33.48 | 203.93 | 25.50 | 99.02 |
| 21836 | 29.24 | 16.81 | 91.95 | 8.44 | 99.02 |
| 21817 | 10.63 | 13.30 | 59.28 | 7.00 | 99.02 |
| 6517 | 231.85 | 156.64 | 721.49 | 128.57 | 99.02 |
| 1588 | 61.92 | 22.15 | 122.71 | 6.97 | 99.02 |
| 14564 | 48.33 | 23.27 | 104.89 | 3.20 | 99.02 |
| 3079 | 34.64 | 46.77 | 152.78 | 26.18 | 98.97 |
| 7602 | 193.69 | 43.89 | 364.34 | 31.12 | 98.97 |
| 20816 | 393.33 | 173.56 | 774.42 | 37.69 | 98.97 |
| 6322 | 18.88 | 17.54 | 122.95 | 22.89 | 98.97 |
| 17337 | 510.70 | 139.07 | 253.28 | 6.67 | 98.97 |
| 18161 | 114.11 | 43.86 | 244.42 | 22.79 | 98.97 |
| 4057 | 64.54 | 20.73 | 139.42 | 12.02 | 98.97 |
| 22552 | 314.43 | 92.85 | 696.18 | 70.05 | 98.93 |

TABLE 5L

Atty. Docket No. 44921-5089US
Doc. No. 1803440.1

CISPLATIN
Timepoint(s): 6, 24 hrs

| Identifier | NonToxMean | NonToxSD | ToxMean | ToxSD | LDAScore |
|---|---|---|---|---|---|
| 20082 | 75.47 | 31.84 | 228.60 | 43.28 | 98.84 |
| 1598 | 47.75 | 56.92 | 133.89 | 25.63 | 98.58 |
| 15313 | 11.08 | 24.34 | 53.59 | 5.89 | 98.54 |
| 2655 | 43.13 | 48.31 | 177.30 | 66.12 | 98.20 |
| 14424 | 66.72 | 130.96 | 272.03 | 63.86 | 97.85 |
| 17314 | 5.89 | 11.89 | 63.70 | 27.83 | 97.85 |
| 21275 | 225.06 | 80.71 | 528.11 | 144.80 | 97.68 |
| 4047 | 85.85 | 50.33 | 190.04 | 23.02 | 97.60 |
| 20116 | 9.55 | 31.45 | 124.39 | 50.70 | 97.38 |
| 15382 | 122.93 | 203.50 | 341.43 | 85.17 | 97.34 |
| 1521 | 20.82 | 51.01 | 148.25 | 24.41 | 97.30 |
| 24146 | 220.17 | 51.83 | 396.31 | 40.61 | 97.30 |
| 8990 | 278.10 | 77.14 | 540.97 | 69.47 | 97.21 |
| 1884 | 178.33 | 37.79 | 272.14 | 18.27 | 97.17 |
| 4933 | 134.55 | 205.15 | 335.87 | 89.54 | 97.04 |
| 6506 | 233.65 | 59.50 | 415.92 | 45.52 | 97.04 |
| 4944 | 112.31 | 56.05 | 264.36 | 39.37 | 96.95 |
| 8004 | 125.79 | 44.06 | 271.11 | 40.68 | 96.95 |
| 1993 | 30.02 | 21.93 | 91.88 | 19.85 | 96.91 |
| 20506 | 21.57 | 7.97 | 46.99 | 7.30 | 96.82 |
| 21462 | 257.92 | 58.72 | 424.63 | 52.75 | 96.78 |
| 6974 | 129.50 | 46.90 | 236.12 | 28.32 | 96.78 |
| 11549 | 243.07 | 64.12 | 425.53 | 38.72 | 96.74 |
| 2905 | 245.79 | 107.78 | 488.69 | 56.33 | 96.74 |
| 1811 | 10.99 | 26.26 | 94.19 | 25.01 | 96.70 |
| 10839 | 313.60 | 67.83 | 533.54 | 83.77 | 96.70 |
| 2468 | 252.35 | 62.46 | 433.73 | 70.78 | 96.61 |
| 373 | 33.94 | 61.41 | 162.88 | 51.32 | 96.57 |
| 19040 | 186.25 | 107.25 | 258.19 | 19.20 | 96.57 |

TABLE 5L-continued

Atty. Docket No. 44921-5089US
Doc. No. 1803440.1

CISPLATIN
Timepoint(s): 6, 24 hrs

| Identifier | NonToxMean | NonToxSD | ToxMean | ToxSD | LDAScore |
|---|---|---|---|---|---|
| 15299 | 87.98 | 61.10 | 206.62 | 59.64 | 96.57 |
| 13684 | 467.21 | 135.45 | 831.58 | 69.76 | 96.52 |
| 910 | 57.76 | 21.93 | 136.53 | 45.93 | 96.35 |
| 4477 | 11.91 | 8.60 | 37.00 | 7.79 | 96.27 |
| 20871 | 52.68 | 25.99 | 122.97 | 14.46 | 96.22 |
| 16853 | 67.36 | 22.84 | 136.28 | 21.27 | 96.18 |
| 23473 | 156.94 | 56.94 | 338.21 | 73.37 | 96.18 |
| 2536 | 393.91 | 124.60 | 585.25 | 20.89 | 96.14 |
| 10015 | 232.29 | 77.80 | 340.64 | 28.00 | 96.14 |
| 18694 | 53.51 | 48.91 | 198.02 | 43.87 | 96.09 |
| 16284 | 40.93 | 27.58 | 129.79 | 27.84 | 96.09 |
| 18375 | 121.97 | 28.16 | 198.57 | 23.40 | 96.05 |
| 23314 | 70.46 | 275.32 | 498.55 | 211.58 | 96.05 |
| 651 | 12.67 | 12.78 | 40.79 | 8.43 | 95.97 |
| 3266 | 133.11 | 36.44 | 247.88 | 45.93 | 95.97 |
| 1460 | 198.97 | 85.95 | 340.15 | 49.64 | 95.97 |
| 20065 | 86.81 | 30.90 | 170.50 | 27.85 | 95.97 |
| 15301 | 38.37 | 68.10 | 96.58 | 21.67 | 95.92 |
| 23448 | 169.78 | 101.84 | 327.19 | 44.52 | 95.92 |
| 15003 | 36.27 | 96.97 | 63.65 | 10.34 | 95.88 |
| 26184 | 203.75 | 69.61 | 423.29 | 118.85 | 95.88 |
| 8336 | 26.96 | 37.28 | 139.71 | 61.60 | 95.79 |
| 6362 | 62.77 | 39.27 | 160.35 | 23.77 | 95.75 |
| 14003 | 815.94 | 212.81 | 484.61 | 51.19 | 95.67 |
| 9339 | 357.63 | 88.22 | 598.27 | 74.10 | 95.62 |
| 6384 | 60.88 | 59.65 | 127.67 | 27.22 | 95.54 |
| 15345 | 201.66 | 67.69 | 322.91 | 40.01 | 95.45 |
| 22849 | 197.75 | 50.59 | 318.11 | 30.11 | 95.41 |
| 23868 | 178.04 | 289.84 | 277.77 | 47.26 | 95.41 |
| 16233 | 68.93 | 88.14 | 123.52 | 11.88 | 95.36 |
| 6454 | 239.80 | 78.37 | 418.57 | 35.68 | 95.36 |
| 21061 | 58.86 | 27.77 | 128.21 | 17.87 | 95.36 |
| 24143 | 193.56 | 97.20 | 413.12 | 53.39 | 95.32 |
| 15296 | 137.87 | 56.84 | 269.21 | 33.23 | 95.32 |
| 22374 | 148.45 | 41.20 | 247.50 | 28.04 | 95.28 |
| 13239 | 109.46 | 48.17 | 236.67 | 36.75 | 95.28 |
| 8768 | 64.97 | 26.90 | 141.33 | 30.56 | 95.28 |
| 1542 | 927.15 | 264.71 | 512.83 | 50.15 | 95.28 |
| 22352 | 156.66 | 103.69 | 254.35 | 25.00 | 95.24 |
| 14051 | 133.17 | 35.29 | 219.32 | 28.80 | 95.24 |
| 9343 | 189.65 | 67.21 | 349.25 | 44.44 | 95.24 |
| 1247 | 1309.30 | 501.39 | 550.75 | 103.22 | 95.19 |
| 7857 | 52.35 | 45.86 | 156.83 | 28.07 | 95.19 |
| 11727 | 230.50 | 78.02 | 409.08 | 59.02 | 95.19 |
| 1639 | 96.67 | 22.79 | 153.44 | 17.91 | 95.11 |
| 15374 | 138.74 | 36.97 | 231.57 | 31.99 | 95.02 |
| 3899 | 141.45 | 61.33 | 242.19 | 14.71 | 94.98 |
| 25405 | 78.08 | 28.73 | 149.92 | 18.38 | 94.98 |
| 23872 | 49.59 | 92.93 | 101.10 | 24.53 | 94.98 |
| 24368 | 244.08 | 80.76 | 439.99 | 52.18 | 94.98 |
| 10818 | 465.48 | 185.96 | 140.29 | 49.38 | 94.98 |
| 17693 | 1257.86 | 376.37 | 596.02 | 96.76 | 94.98 |
| 25253 | 292.22 | 64.49 | 449.51 | 58.18 | 94.89 |
| 11708 | 319.92 | 92.39 | 486.60 | 46.21 | 94.89 |
| 17908 | 63.14 | 60.90 | 124.23 | 27.40 | 94.89 |
| 24028 | 407.75 | 96.21 | 644.04 | 67.17 | 94.85 |
| 11455 | 115.78 | 48.10 | 202.56 | 32.14 | 94.85 |
| 20870 | 19.10 | 29.21 | 92.31 | 26.59 | 94.81 |
| 3931 | 94.55 | 29.06 | 155.45 | 15.94 | 94.68 |
| 6581 | 76.02 | 26.19 | 132.63 | 10.11 | 94.68 |
| 1447 | 208.86 | 37.67 | 272.57 | 11.93 | 94.64 |
| 22501 | 257.01 | 67.60 | 383.79 | 63.10 | 94.64 |
| 10720 | 153.08 | 43.55 | 217.97 | 97.98 | 94.64 |
| 20591 | 25.22 | 22.60 | 68.79 | 11.62 | 94.59 |
| 1292 | 62.12 | 24.60 | 116.95 | 15.58 | 94.55 |
| 21355 | 374.95 | 118.50 | 635.77 | 102.99 | 94.51 |
| 23852 | 262.89 | 102.86 | 519.85 | 100.21 | 94.51 |
| 18689 | 360.99 | 81.71 | 541.28 | 55.93 | 94.51 |
| 4426 | 222.88 | 38.63 | 305.45 | 29.97 | 94.51 |
| 23563 | 24.57 | 33.24 | 96.80 | 28.33 | 94.46 |

TABLE 5M

CISPLATIN
Timepoint(s): 6, 24, 168 hrs

| Identifier | NonToxMean | NonToxSD | ToxMean | ToxSD | LDAScore |
|---|---|---|---|---|---|
| 1521 | 20.35 | 50.42 | 152.11 | 27.16 | 97.37 |
| 1884 | 178.00 | 37.40 | 272.66 | 21.76 | 97.03 |
| 16284 | 40.57 | 26.94 | 134.66 | 25.22 | 96.99 |
| 18694 | 52.96 | 48.08 | 203.55 | 35.96 | 96.77 |
| 10839 | 312.93 | 66.86 | 524.22 | 78.99 | 96.77 |
| 11549 | 242.48 | 63.43 | 420.82 | 36.27 | 96.73 |
| 8990 | 277.44 | 76.38 | 515.35 | 72.77 | 96.60 |
| 6362 | 62.37 | 38.73 | 167.05 | 23.05 | 96.60 |
| 1811 | 10.74 | 25.96 | 89.58 | 21.97 | 96.60 |
| 4477 | 11.83 | 8.50 | 36.45 | 6.35 | 96.55 |
| 4047 | 85.57 | 50.18 | 181.03 | 26.48 | 96.55 |
| 16853 | 67.12 | 22.50 | 136.44 | 18.16 | 96.55 |
| 3266 | 132.70 | 35.81 | 249.33 | 37.38 | 96.47 |
| 13684 | 466.14 | 134.44 | 811.93 | 63.86 | 96.47 |
| 2905 | 244.60 | 105.83 | 525.71 | 99.02 | 96.43 |
| 1460 | 198.53 | 85.75 | 335.50 | 43.05 | 96.38 |
| 23314 | 69.18 | 274.82 | 477.84 | 185.93 | 96.25 |
| 17693 | 1260.38 | 374.54 | 570.60 | 88.76 | 96.21 |
| 15301 | 38.18 | 68.12 | 96.20 | 20.88 | 96.12 |
| 17894 | 46.77 | 18.63 | 103.03 | 28.25 | 96.08 |
| 10015 | 231.46 | 76.52 | 389.17 | 82.89 | 95.99 |
| 19040 | 185.68 | 106.97 | 292.78 | 52.89 | 95.95 |
| 18375 | 121.75 | 27.96 | 193.24 | 20.67 | 95.74 |
| 4426 | 222.53 | 38.25 | 311.48 | 25.65 | 95.74 |
| 7857 | 51.97 | 45.46 | 159.10 | 25.13 | 95.65 |
| 6454 | 239.16 | 77.72 | 421.14 | 34.72 | 95.65 |
| 15296 | 137.17 | 55.52 | 295.99 | 61.04 | 95.56 |
| 10818 | 467.00 | 184.46 | 97.87 | 70.28 | 95.52 |
| 23852 | 261.84 | 101.45 | 536.68 | 85.55 | 95.52 |
| 1542 | 928.65 | 263.36 | 505.79 | 51.94 | 95.48 |
| 20090 | 122.37 | 27.65 | 178.94 | 11.38 | 95.31 |
| 1247 | 1312.52 | 499.20 | 486.71 | 136.84 | 95.31 |
| 13682 | 176.87 | 61.56 | 326.18 | 46.83 | 95.26 |
| 14003 | 817.40 | 211.66 | 451.12 | 81.85 | 95.26 |
| 12478 | 82.11 | 29.97 | 149.88 | 36.04 | 95.22 |
| 1585 | 67.31 | 32.78 | 148.67 | 23.18 | 95.22 |
| 9339 | 357.01 | 87.72 | 575.84 | 68.74 | 95.13 |
| 23868 | 177.77 | 290.29 | 269.73 | 44.26 | 95.09 |
| 20591 | 25.06 | 22.48 | 69.25 | 11.11 | 95.05 |
| 3352 | 439.29 | 115.94 | 757.04 | 153.95 | 95.00 |
| 6974 | 129.29 | 46.84 | 219.21 | 32.67 | 94.88 |
| 8888 | 58.70 | 29.09 | 133.86 | 26.30 | 94.88 |
| 21061 | 58.67 | 27.62 | 123.00 | 16.55 | 94.83 |
| 7262 | 1114.68 | 393.99 | 1942.97 | 210.00 | 94.83 |
| 24368 | 243.52 | 80.33 | 427.84 | 45.50 | 94.70 |
| 25253 | 291.81 | 64.18 | 436.10 | 53.03 | 94.53 |
| 20921 | 26.87 | 19.97 | 73.82 | 15.18 | 94.44 |
| 15438 | 65.27 | 31.97 | 154.80 | 42.05 | 94.36 |
| 12174 | 80.78 | 29.36 | 153.45 | 25.53 | 94.32 |
| 808 | 469.71 | 142.88 | 210.55 | 55.06 | 94.23 |
| 19667 | 34.63 | 16.92 | 74.26 | 11.91 | 94.19 |
| 3886 | 57.79 | 28.39 | 128.86 | 25.08 | 94.19 |
| 20082 | 75.08 | 31.10 | 214.13 | 47.37 | 94.08 |
| 14051 | 132.96 | 35.15 | 209.45 | 29.46 | 94.01 |
| 5073 | 188.58 | 69.99 | 346.14 | 69.21 | 93.93 |
| 10344 | 22.23 | 21.56 | 63.33 | 9.18 | 93.84 |
| 15386 | 93.23 | 133.87 | 380.59 | 101.27 | 93.76 |
| 9882 | 486.99 | 181.36 | 244.23 | 35.18 | 93.76 |
| 4443 | 259.36 | 71.87 | 429.91 | 75.00 | 93.76 |
| 16080 | 44.85 | 252.23 | 176.73 | 162.58 | 93.76 |
| 22005 | 63.42 | 50.09 | 187.23 | 39.58 | 93.71 |
| 15313 | 10.94 | 24.26 | 52.72 | 7.91 | 93.65 |
| 6384 | 60.76 | 59.71 | 117.04 | 26.05 | 93.63 |
| 15701 | 37.60 | 16.66 | 75.18 | 12.81 | 93.58 |
| 22257 | 33.56 | 15.61 | 61.03 | 7.13 | 93.54 |
| 2655 | 42.88 | 48.17 | 155.13 | 62.85 | 93.52 |
| 4198 | 698.17 | 161.70 | 448.59 | 56.51 | 93.50 |
| 6522 | 569.21 | 150.95 | 877.20 | 111.47 | 93.28 |
| 19128 | 112.63 | 38.66 | 180.82 | 19.01 | 93.15 |
| 17314 | 5.74 | 11.53 | 57.89 | 29.34 | 93.13 |
| 22871 | 101.59 | 29.83 | 165.82 | 22.84 | 93.11 |
| 21275 | 224.35 | 79.76 | 492.77 | 134.59 | 93.09 |
| 1727 | 43.38 | 60.84 | 96.90 | 23.97 | 93.07 |
| 19249 | 264.62 | 60.02 | 356.76 | 20.60 | 93.07 |
| 1993 | 29.72 | 21.35 | 101.33 | 20.81 | 93.04 |
| 4584 | 82.33 | 29.05 | 125.60 | 12.25 | 92.98 |
| 24162 | 523.84 | 133.30 | 788.13 | 85.20 | 92.94 |
| 7522 | 31.71 | 18.92 | 74.24 | 15.00 | 92.89 |
| 17713 | 134.82 | 29.04 | 191.13 | 21.86 | 92.85 |
| 1428 | −7.27 | 15.96 | 40.03 | 16.58 | 92.83 |
| 14776 | 99.41 | 35.18 | 153.67 | 26.50 | 92.81 |
| 3418 | 333.44 | 86.68 | 495.74 | 46.58 | 92.81 |
| 4199 | 529.94 | 132.34 | 301.96 | 61.95 | 92.64 |
| 21685 | 123.15 | 42.92 | 207.52 | 32.56 | 92.64 |
| 7023 | 363.44 | 76.61 | 483.68 | 29.43 | 92.55 |
| 4420 | 40.76 | 32.16 | 92.81 | 27.98 | 92.48 |
| 4121 | 62.21 | 23.49 | 110.83 | 18.20 | 92.42 |
| 18995 | 61.31 | 23.53 | 109.28 | 20.56 | 92.42 |
| 14665 | 151.38 | 37.30 | 219.57 | 23.41 | 92.33 |
| 11404 | 134.16 | 54.82 | 304.44 | 53.63 | 92.14 |
| 910 | 57.47 | 21.40 | 138.17 | 36.81 | 92.10 |
| 24081 | 117.08 | 63.79 | 235.77 | 50.20 | 92.03 |
| 22351 | 45.44 | 32.53 | 86.73 | 20.28 | 91.99 |
| 16012 | 72.47 | 31.00 | 153.59 | 33.17 | 91.97 |
| 22211 | 766.80 | 164.47 | 1061.59 | 90.34 | 91.95 |
| 727 | 210.80 | 38.94 | 274.04 | 15.91 | 91.90 |
| 9104 | 138.35 | 38.03 | 253.38 | 40.14 | 91.88 |
| 10417 | 43.82 | 25.97 | 125.71 | 32.61 | 91.88 |
| 10611 | 10.74 | 27.42 | 115.20 | 49.23 | 91.84 |
| 1314 | 262.03 | 49.07 | 394.88 | 48.07 | 91.79 |

TABLE 5N

CITRININ
Timepoint(s): 6, 24 hrs

| Identifier | NonToxMean | NonToxSD | ToxMean | ToxSD | LDAScore |
|---|---|---|---|---|---|
| 17541 | 622.47 | 209.71 | 2524.98 | 697.44 | 98.92 |
| 6108 | 533.46 | 112.70 | 1024.58 | 102.59 | 98.62 |
| 25064 | 962.08 | 317.37 | 2651.31 | 379.95 | 98.58 |
| 1698 | 70.27 | 55.64 | 598.98 | 232.89 | 98.49 |
| 8820 | 130.72 | 105.90 | 755.03 | 221.60 | 98.41 |
| 23917 | 725.54 | 174.69 | 1782.62 | 536.25 | 98.36 |
| 20817 | 1043.62 | 545.12 | 5020.35 | 2088.07 | 98.32 |
| 15391 | 756.64 | 170.28 | 1510.23 | 272.65 | 98.24 |
| 20864 | 1562.02 | 620.45 | 4051.37 | 596.98 | 98.19 |
| 24192 | 70.11 | 37.23 | 212.99 | 53.54 | 97.93 |
| 20818 | 665.29 | 354.08 | 2965.76 | 1254.63 | 97.93 |
| 1340 | 192.34 | 49.85 | 114.30 | 11.66 | 97.76 |
| 20035 | 180.50 | 107.18 | 446.34 | 61.98 | 97.72 |
| 25525 | 1057.73 | 339.31 | 2228.58 | 326.32 | 97.55 |
| 18989 | 782.09 | 261.73 | 1560.14 | 205.30 | 97.46 |
| 3431 | 1496.13 | 608.90 | 3517.88 | 499.00 | 97.42 |
| 13723 | 734.46 | 282.33 | 1643.16 | 339.11 | 97.29 |
| 353 | 173.42 | 82.57 | 323.18 | 43.00 | 97.25 |
| 15848 | 1318.65 | 418.94 | 2622.73 | 442.07 | 97.16 |
| 634 | 1135.42 | 374.65 | 2281.52 | 441.32 | 96.86 |
| 354 | 214.25 | 93.76 | 406.34 | 75.12 | 96.77 |
| 7681 | 101.15 | 43.91 | 212.89 | 41.46 | 96.64 |
| 13610 | 357.22 | 70.16 | 213.99 | 29.24 | 96.56 |
| 5601 | 970.57 | 259.22 | 473.69 | 102.75 | 96.47 |
| 3876 | 30.44 | 14.34 | 1.17 | 8.63 | 96.13 |
| 24375 | 115.03 | 40.98 | 208.88 | 57.88 | 96.04 |
| 8212 | 2232.57 | 1104.98 | 5289.94 | 717.26 | 95.96 |
| 15106 | 1878.08 | 698.66 | 3540.36 | 359.29 | 95.74 |

TABLE 5N-continued

CITRININ
Timepoint(s): 6, 24 hrs

| Identifier | NonToxMean | NonToxSD | ToxMean | ToxSD | LDAScore |
|---|---|---|---|---|---|
| 14670 | 1214.56 | 325.29 | 1917.56 | 318.04 | 95.70 |
| 15189 | 1735.59 | 1153.61 | 4557.38 | 1226.17 | 95.70 |
| 24496 | 122.73 | 40.31 | 47.99 | 15.89 | 95.57 |
| 20895 | 332.13 | 100.81 | 137.61 | 37.56 | 95.52 |
| 20876 | 1661.97 | 599.79 | 3113.86 | 382.39 | 95.52 |
| 18533 | 35.68 | 17.84 | 5.09 | 4.52 | 95.52 |
| 6630 | 1393.25 | 256.89 | 913.59 | 112.68 | 95.48 |
| 20844 | 837.88 | 286.57 | 1606.81 | 216.13 | 95.44 |
| 15850 | 1209.74 | 343.26 | 2046.05 | 316.40 | 95.44 |
| 7315 | −13.72 | 19.65 | 37.49 | 20.35 | 95.44 |
| 9254 | 247.89 | 49.11 | 157.69 | 17.49 | 95.44 |
| 15363 | 443.12 | 132.07 | 716.96 | 123.62 | 95.31 |
| 18359 | 245.00 | 113.72 | 546.56 | 83.87 | 95.22 |
| 8211 | 2822.70 | 1582.68 | 6312.46 | 772.17 | 95.22 |
| 16831 | 42.34 | 13.79 | 13.06 | 7.30 | 95.22 |
| 18644 | 2209.11 | 1246.61 | 5017.03 | 698.10 | 95.14 |
| 15190 | 1803.71 | 1156.33 | 4453.59 | 1177.82 | 95.09 |
| 15201 | 1480.71 | 527.22 | 2864.67 | 616.92 | 95.09 |
| 18205 | 277.90 | 58.81 | 408.93 | 34.56 | 95.09 |
| 19094 | 1054.85 | 243.62 | 1623.72 | 219.27 | 95.05 |
| 17108 | 219.63 | 44.77 | 132.90 | 13.45 | 95.01 |
| 10464 | 131.59 | 35.74 | 68.61 | 13.81 | 94.84 |
| 9409 | 102.66 | 32.91 | 171.76 | 24.78 | 94.84 |
| 7586 | 795.05 | 201.44 | 401.14 | 109.74 | 94.79 |
| 18800 | 2701.84 | 1144.69 | 5340.05 | 791.36 | 94.79 |
| 25675 | 688.20 | 206.46 | 1130.86 | 172.21 | 94.75 |
| 2697 | 1222.06 | 354.81 | 1908.51 | 176.60 | 94.75 |
| 10267 | 2101.59 | 872.11 | 4127.29 | 650.25 | 94.71 |
| 22773 | 230.97 | 52.31 | 131.59 | 26.18 | 94.54 |
| 1651 | 880.31 | 240.55 | 631.98 | 31.80 | 94.19 |
| 17494 | 219.24 | 41.89 | 138.20 | 23.13 | 94.15 |
| 244 | 51.19 | 35.18 | 14.03 | 8.20 | 94.15 |
| 17693 | 1247.25 | 372.94 | 2027.18 | 231.36 | 94.10 |
| 6946 | 389.05 | 103.41 | 200.78 | 37.64 | 94.02 |
| 23783 | 436.13 | 76.56 | 298.50 | 28.57 | 93.93 |
| 19408 | 1997.30 | 674.69 | 2937.88 | 154.93 | 93.89 |
| 20088 | 383.97 | 79.45 | 244.56 | 32.48 | 93.89 |
| 16272 | 192.25 | 63.76 | 102.37 | 22.94 | 93.89 |
| 2866 | 642.47 | 211.99 | 276.00 | 84.07 | 93.85 |
| 16954 | 48.70 | 79.17 | 202.92 | 44.32 | 93.80 |
| 21685 | 124.50 | 43.36 | 59.69 | 10.37 | 93.72 |
| 1719 | 145.21 | 38.11 | 80.93 | 12.30 | 93.67 |
| 20810 | 1256.69 | 398.25 | 2088.75 | 313.45 | 93.63 |
| 5049 | 298.40 | 65.65 | 175.28 | 28.59 | 93.63 |
| 1814 | 172.31 | 47.40 | 99.15 | 13.17 | 93.63 |
| 16193 | 101.42 | 30.67 | 44.23 | 15.12 | 93.59 |
| 15017 | 1007.41 | 395.69 | 2150.20 | 484.37 | 93.58 |
| 17686 | 1014.59 | 265.55 | 1558.32 | 151.72 | 93.50 |
| 20803 | 432.89 | 100.25 | 912.31 | 140.76 | 93.49 |
| 1537 | 29.21 | 35.65 | 294.59 | 185.42 | 93.45 |
| 1399 | 198.89 | 71.28 | 576.63 | 288.99 | 93.45 |
| 22583 | 26.67 | 14.48 | 3.43 | 7.60 | 93.37 |
| 3091 | 784.77 | 186.23 | 457.77 | 105.80 | 93.37 |
| 9029 | 430.46 | 93.52 | 614.72 | 63.36 | 93.37 |
| 16849 | 114.53 | 44.11 | 44.12 | 13.14 | 93.33 |
| 22414 | 58.52 | 33.14 | 101.78 | 22.01 | 93.33 |
| 8283 | 122.89 | 43.92 | 338.56 | 122.17 | 93.32 |
| 20918 | 440.21 | 126.29 | 269.42 | 29.15 | 93.29 |
| 25069 | 131.62 | 55.06 | 390.27 | 136.77 | 93.28 |
| 19067 | 175.20 | 51.04 | 88.87 | 21.48 | 93.24 |
| 7022 | 6.12 | 16.94 | 127.93 | 68.30 | 93.24 |
| 723 | 32.80 | 15.28 | 8.05 | 5.98 | 93.20 |
| 2242 | 2295.34 | 607.45 | 1325.08 | 393.96 | 93.16 |
| 24390 | 165.35 | 113.57 | −9.44 | 39.74 | 93.07 |
| 17211 | 1434.51 | 548.50 | 2462.85 | 274.87 | 93.03 |
| 22406 | 79.97 | 30.24 | 31.26 | 10.08 | 92.90 |
| 24469 | 1169.56 | 333.98 | 1827.58 | 165.96 | 92.86 |

TABLE 5O

COLCHICINE
Timepoint(s): 6, 24, 48 hrs

| Identifier | NonToxMean | NonToxSD | ToxMean | ToxSD | LDAScore |
|---|---|---|---|---|---|
| 23166 | 132.81 | 58.53 | 371.64 | 112.54 | 97.29 |
| 4412 | 377.59 | 61.12 | 558.75 | 77.91 | 96.99 |
| 18151 | 1133.81 | 261.37 | 563.27 | 117.10 | 96.47 |
| 15964 | 1187.13 | 325.69 | 508.38 | 159.50 | 96.12 |
| 11618 | 419.37 | 129.59 | 119.80 | 80.64 | 96.12 |
| 16882 | 177.88 | 54.70 | 82.96 | 14.87 | 95.78 |
| 24321 | 722.16 | 202.93 | 318.04 | 123.60 | 95.43 |
| 9097 | 258.85 | 82.10 | 115.52 | 31.47 | 95.05 |
| 20001 | 1683.96 | 373.32 | 1059.37 | 114.06 | 94.92 |
| 16913 | 1386.59 | 297.09 | 894.57 | 81.02 | 94.75 |
| 17887 | 14614.63 | 317.71 | 838.24 | 208.19 | 94.70 |
| 16924 | 445.74 | 155.90 | 188.36 | 46.16 | 94.57 |
| 20988 | 1221.44 | 211.78 | 853.97 | 84.52 | 94.49 |
| 22271 | 275.62 | 66.08 | 156.87 | 37.40 | 94.32 |
| 2222 | 802.84 | 200.86 | 537.76 | 35.92 | 94.06 |
| 6806 | 1236.90 | 342.77 | 566.10 | 189.93 | 94.01 |
| 13855 | 22.06 | 28.83 | 139.05 | 42.55 | 93.95 |
| 20513 | 57.97 | 25.96 | 166.84 | 71.44 | 93.82 |
| 9296 | 1306.96 | 257.77 | 840.48 | 105.26 | 93.80 |
| 643 | 62.16 | 32.97 | 14.32 | 5.63 | 93.71 |
| 16982 | 128.17 | 257.40 | 1462.72 | 552.54 | 93.60 |
| 20312 | 405.72 | 95.10 | 209.02 | 92.75 | 93.58 |
| 4073 | 562.17 | 184.40 | 230.54 | 83.32 | 93.58 |
| 3925 | 477.10 | 119.06 | 265.65 | 66.28 | 93.45 |
| 2913 | 736.68 | 160.48 | 481.77 | 40.00 | 93.24 |
| 10984 | 2020.41 | 564.71 | 1032.75 | 348.86 | 92.98 |
| 22321 | 100.73 | 64.58 | 321.87 | 131.71 | 92.96 |
| 2767 | 44.79 | 40.13 | 182.37 | 66.23 | 92.91 |
| 4151 | 563.27 | 167.25 | 920.16 | 111.75 | 92.89 |
| 7615 | 90.46 | 40.50 | 169.26 | 27.71 | 92.81 |
| 17399 | 1980.57 | 449.65 | 1255.63 | 187.29 | 92.64 |
| 6552 | 1594.49 | 296.14 | 1077.60 | 126.50 | 92.64 |
| 13111 | 228.20 | 73.35 | 132.80 | 17.16 | 92.59 |
| 13727 | 124.04 | 53.37 | 38.71 | 19.99 | 92.55 |
| 18642 | 974.76 | 203.55 | 664.60 | 62.35 | 92.55 |
| 3050 | 91.21 | 49.08 | 313.78 | 134.78 | 92.53 |
| 6438 | 114.03 | 57.15 | 38.70 | 14.25 | 92.51 |
| 20405 | 33.56 | 28.74 | 132.47 | 64.39 | 92.48 |
| 14185 | 202.17 | 89.20 | 491.51 | 237.69 | 92.48 |
| 16849 | 114.55 | 44.14 | 48.23 | 13.11 | 92.46 |
| 12901 | 1626.70 | 415.03 | 1002.61 | 177.27 | 92.42 |
| 20697 | 1421.26 | 277.19 | 931.95 | 163.03 | 92.25 |
| 8837 | 359.37 | 91.36 | 235.96 | 24.61 | 92.25 |
| 17361 | 145.97 | 59.92 | 56.10 | 14.57 | 92.20 |
| 17329 | 213.41 | 103.82 | 524.01 | 86.38 | 92.18 |
| 15600 | 774.27 | 210.27 | 435.87 | 107.62 | 92.08 |
| 16879 | 1207.58 | 276.77 | 796.63 | 98.39 | 92.03 |
| 4330 | 500.26 | 160.51 | 241.64 | 84.25 | 92.03 |
| 22152 | 7.72 | 33.71 | 81.27 | 38.69 | 91.79 |
| 21053 | 105.50 | 59.69 | 39.98 | 16.30 | 91.69 |
| 17324 | 360.96 | 79.01 | 153.55 | 65.98 | 91.58 |
| 7540 | 155.81 | 94.07 | 328.58 | 92.44 | 91.58 |
| 16128 | 286.68 | 62.49 | 192.02 | 31.18 | 91.56 |
| 14790 | 165.31 | 84.94 | 49.50 | 20.48 | 91.52 |
| 23115 | 570.61 | 171.16 | 295.42 | 91.28 | 91.47 |
| 11057 | 32.46 | 28.53 | 120.72 | 43.20 | 91.41 |
| 7537 | 230.23 | 69.42 | 125.41 | 29.85 | 91.34 |
| 19822 | 1596.44 | 410.54 | 942.00 | 210.50 | 91.26 |
| 17386 | 303.88 | 93.74 | 128.16 | 41.06 | 91.02 |
| 17248 | 2568.34 | 534.75 | 1704.94 | 295.46 | 91.00 |
| 15191 | 2013.99 | 1219.17 | 2599.48 | 219.23 | 90.96 |
| 1141 | 240.56 | 63.32 | 390.27 | 85.33 | 90.93 |
| 3099 | 966.22 | 189.19 | 660.01 | 95.36 | 90.70 |
| 21024 | 577.99 | 113.27 | 331.56 | 66.79 | 90.59 |
| 8709 | 148.12 | 48.57 | 78.15 | 19.09 | 90.57 |
| 19731 | 226.36 | 215.21 | 98.99 | 29.40 | 90.57 |
| 6250 | 492.94 | 104.90 | 372.14 | 23.59 | 90.53 |
| 117 | 21.16 | 17.56 | −5.10 | 9.54 | 90.44 |
| 17401 | 907.31 | 422.79 | 1550.66 | 328.51 | 90.42 |
| 15377 | 25.87 | 15.51 | 55.07 | 8.41 | 90.42 |
| 17326 | 22.55 | 24.06 | 93.51 | 28.61 | 90.42 |

TABLE 5O-continued

Atty. Docket No. 44921-5089US  
Doc. No. 1803440.1

COLCHICINE  
Timepoint(s): 6, 24, 48 hrs

| Identifier | NonToxMean | NonToxSD | ToxMean | ToxSD | LDAScore |
|---|---|---|---|---|---|
| 22697 | 59.78 | 40.38 | 12.83 | 13.23 | 90.35 |
| 14595 | 87.77 | 36.04 | 175.49 | 38.60 | 90.29 |
| 9223 | 150.65 | 64.81 | 54.19 | 23.82 | 90.27 |
| 8785 | 209.90 | 55.55 | 288.76 | 24.92 | 90.22 |
| 9339 | 360.32 | 89.43 | 226.70 | 47.31 | 90.22 |
| 23253 | 624.10 | 163.49 | 380.42 | 78.17 | 90.09 |
| 25907 | 19.74 | 25.13 | 47.86 | 14.93 | 90.09 |
| 15893 | 1733.99 | 343.83 | 1225.85 | 165.26 | 90.05 |
| 23514 | 407.55 | 167.53 | 162.38 | 70.14 | 89.97 |
| 3875 | 510.89 | 136.65 | 232.91 | 81.51 | 89.90 |
| 406 | 362.17 | 77.76 | 250.18 | 48.87 | 89.88 |
| 18343 | 437.98 | 107.72 | 280.49 | 46.68 | 89.79 |
| 25461 | 49.71 | 22.92 | 20.96 | 5.68 | 89.75 |
| 10789 | 326.18 | 107.75 | 117.23 | 67.68 | 89.73 |
| 23145 | 44.09 | 20.22 | 87.09 | 15.12 | 89.73 |
| 4048 | −7.14 | 26.09 | 121.21 | 153.77 | 89.66 |
| 11174 | 53.20 | 50.67 | 171.90 | 46.40 | 89.64 |
| 23709 | 2491.22 | 1205.88 | 2706.26 | 145.13 | 89.45 |
| 23224 | 194.78 | 48.70 | 129.40 | 19.04 | 89.41 |
| 11215 | 143.29 | 71.54 | 28.34 | 56.76 | 89.23 |
| 19479 | 276.88 | 106.02 | 134.33 | 36.73 | 89.23 |
| 15872 | 152.44 | 63.81 | 467.24 | 163.94 | 89.23 |
| 10985 | 1146.00 | 265.29 | 633.75 | 164.98 | 89.17 |
| 18451 | 1444.75 | 418.00 | 943.24 | 132.82 | 89.10 |
| 812 | 157.19 | 35.17 | 88.26 | 32.94 | 89.04 |

TABLE 5P

Atty. Docket No. 44921-5089US  
Doc. No. 1803440.1

CYCLOPHOSPHAMIDE  
Timepoint(s): 6 hrs

| Identifier | NonToxMean | NonToxSD | ToxMean | ToxSD | LDAScore |
|---|---|---|---|---|---|
| 17089 | 1545.78 | 604.39 | 6128.97 | 335.19 | 99.53 |
| 16081 | 113.02 | 372.21 | 1532.22 | 184.12 | 99.40 |
| 23619 | 327.35 | 96.06 | 660.24 | 21.96 | 99.32 |
| 5393 | −31.45 | 22.77 | 27.35 | 5.29 | 99.32 |
| 24049 | 1517.02 | 432.93 | 3280.45 | 348.50 | 99.10 |
| 22698 | 261.92 | 112.70 | −415.61 | 188.19 | 99.06 |
| 26222 | 371.68 | 149.80 | 1265.79 | 372.61 | 98.76 |
| 18118 | 895.16 | 271.71 | 2268.31 | 465.94 | 98.67 |
| 16469 | 1143.78 | 291.23 | 1083.34 | 3.98 | 98.67 |
| 17066 | 37.10 | 19.62 | −6.41 | 5.49 | 98.67 |
| 7084 | 123.08 | 117.29 | 622.25 | 118.49 | 98.59 |
| 24213 | 1604.12 | 349.78 | 3341.49 | 503.25 | 98.54 |
| 3470 | 143.86 | 59.86 | 458.18 | 196.11 | 98.54 |
| 23711 | 4518.75 | 2192.54 | 16927.73 | 3240.54 | 98.50 |
| 18831 | 4165.13 | 1320.79 | 10676.69 | 1466.84 | 98.50 |
| 108 | 289.68 | 144.40 | 164.86 | 3.48 | 98.46 |
| 1409 | 425.27 | 87.17 | 260.86 | 8.34 | 98.46 |
| 8815 | 664.61 | 111.50 | 420.20 | 41.92 | 98.46 |
| 12130 | 90.83 | 34.97 | 39.25 | 3.30 | 98.42 |
| 8213 | 3583.64 | 1528.59 | 10080.02 | 1528.73 | 98.42 |
| 109 | 556.91 | 312.14 | 239.04 | 32.06 | 98.42 |
| 21637 | 28.01 | 19.25 | −16.57 | 5.06 | 98.29 |
| 15819 | 42.77 | 22.12 | −47.81 | 46.21 | 98.16 |
| 44 | 34.58 | 17.78 | −3.41 | 3.04 | 98.16 |
| 6154 | 256.83 | 383.44 | −1506.42 | 1100.74 | 98.12 |
| 13412 | 28.40 | 24.99 | 148.78 | 61.50 | 98.12 |
| 6720 | 68.84 | 60.28 | 240.34 | 21.68 | 98.12 |
| 5117 | 162.84 | 78.90 | 364.60 | 35.27 | 98.07 |
| 5329 | 47.29 | 21.30 | 10.39 | 2.22 | 98.07 |
| 21866 | 109.05 | 73.32 | 379.42 | 172.12 | 98.03 |
| 14953 | 482.64 | 76.56 | 311.16 | 19.07 | 97.99 |
| 18350 | 90.05 | 49.29 | 301.03 | 46.70 | 97.99 |

TABLE 5P-continued

Atty. Docket No. 44921-5089US  
Doc. No. 1803440.1

CYCLOPHOSPHAMIDE  
Timepoint(s): 6 hrs

| Identifier | NonToxMean | NonToxSD | ToxMean | ToxSD | LDAScore |
|---|---|---|---|---|---|
| 2029 | 305.29 | 103.47 | 350.85 | 2.68 | 97.99 |
| 8837 | 358.84 | 91.24 | 173.81 | 19.49 | 97.95 |
| 25721 | 83.34 | 54.43 | 240.21 | 44.54 | 97.95 |
| 16272 | 191.69 | 64.06 | 131.07 | 3.08 | 97.95 |
| 5969 | 1516.76 | 347.22 | 2916.15 | 354.10 | 97.90 |
| 1689 | 4338.65 | 2126.09 | 15982.97 | 5400.06 | 97.90 |
| 4232 | 137.19 | 62.23 | 27.42 | 11.32 | 97.90 |
| 3049 | 202.76 | 101.21 | 529.19 | 69.46 | 97.86 |
| 18800 | 2711.70 | 1148.84 | 6417.82 | 556.95 | 97.86 |
| 14424 | 67.07 | 130.91 | 324.02 | 83.71 | 97.86 |
| 8849 | 222.06 | 71.45 | 477.43 | 62.77 | 97.77 |
| 25777 | 404.46 | 182.63 | 824.09 | 102.83 | 97.77 |
| 16902 | 66.96 | 91.89 | −172.67 | 27.28 | 97.77 |
| 23078 | 147.27 | 46.50 | 55.48 | 8.60 | 97.77 |
| 5461 | 193.94 | 117.20 | 396.91 | 37.67 | 97.73 |
| 24814 | 171.74 | 33.51 | 92.18 | 13.93 | 97.73 |
| 10860 | 46.07 | 29.90 | −6.09 | 2.93 | 97.69 |
| 1698 | 74.37 | 76.29 | 197.25 | 24.89 | 97.69 |
| 15408 | 193.87 | 58.16 | 69.92 | 11.05 | 97.69 |
| 17832 | 1948.88 | 851.66 | 5675.58 | 2032.21 | 97.65 |
| 7127 | 280.56 | 95.94 | 21.98 | 52.78 | 97.65 |
| 744 | 334.35 | 68.28 | 208.28 | 11.29 | 97.60 |
| 3081 | 387.30 | 84.71 | 227.05 | 31.49 | 97.56 |
| 18918 | 31.10 | 27.35 | −32.80 | 10.09 | 97.56 |
| 15154 | 267.93 | 62.29 | 131.15 | 21.56 | 97.52 |
| 17771 | 768.98 | 305.15 | 1490.79 | 130.43 | 97.52 |
| 20493 | 460.39 | 110.11 | 297.05 | 12.72 | 97.47 |
| 24437 | 68.49 | 25.43 | 175.35 | 41.14 | 97.47 |
| 8999 | 47.02 | 23.49 | 1.97 | 4.96 | 97.47 |
| 15382 | 122.71 | 202.12 | 570.78 | 188.00 | 97.47 |
| 8599 | 378.10 | 107.09 | 181.07 | 19.58 | 97.47 |
| 17682 | 672.30 | 178.35 | 399.02 | 29.34 | 97.43 |
| 22862 | 103.01 | 36.20 | 42.20 | 6.28 | 97.39 |
| 20920 | 626.34 | 183.56 | 421.78 | 11.19 | 97.39 |
| 17334 | 173.83 | 58.72 | 358.42 | 40.10 | 97.39 |
| 4067 | 123.98 | 59.95 | 245.14 | 32.72 | 97.39 |
| 17357 | 269.19 | 82.48 | 105.14 | 28.10 | 97.39 |
| 23314 | 72.17 | 276.94 | 318.28 | 105.05 | 97.35 |
| 19190 | 534.12 | 144.15 | 283.73 | 32.84 | 97.35 |
| 16943 | 2759.04 | 872.63 | 5041.36 | 392.40 | 97.35 |
| 16947 | 319.84 | 80.34 | 186.33 | 13.16 | 97.35 |
| 6405 | 380.95 | 93.60 | 241.49 | 11.37 | 97.35 |
| 9053 | 239.61 | 50.65 | 135.66 | 11.51 | 97.35 |
| 25253 | 293.63 | 65.17 | 155.93 | 16.09 | 97.30 |
| 1688 | 5256.94 | 3710.90 | 21624.32 | 7449.14 | 97.30 |
| 19993 | 2319.53 | 566.29 | 3763.82 | 221.97 | 97.30 |
| 20846 | 2377.64 | 663.94 | 3619.10 | 135.20 | 97.30 |
| 22142 | 32.37 | 17.29 | 0.24 | 3.37 | 97.26 |
| 17602 | 131.67 | 36.83 | 52.59 | 13.48 | 97.26 |
| 18274 | 300.34 | 63.28 | 159.26 | 25.71 | 97.26 |
| 15410 | 504.68 | 101.83 | 257.23 | 33.63 | 97.22 |
| 7299 | 181.01 | 153.33 | 372.36 | 39.71 | 97.22 |
| 6585 | 649.58 | 366.37 | 1390.92 | 91.78 | 97.17 |
| 17426 | 537.84 | 84.20 | 386.94 | 14.48 | 97.13 |
| 15190 | 1818.28 | 1175.28 | 4173.32 | 371.68 | 97.13 |
| 13598 | 349.78 | 108.22 | 755.01 | 165.06 | 97.09 |

TABLE 5Q

Atty. Docket No. 44921-5089US  
Doc. No. 1803440.1

DIFLUNISAL  
Timepoint(s): 24 hrs

| Identifier | NonToxMean | NonToxSD | ToxMean | ToxSD | LDAScore |
|---|---|---|---|---|---|
| 15582 | 98.54 | 389.02 | 523.22 | 20.51 | 99.87 |
| 23699 | 325.81 | 88.09 | 984.09 | 67.68 | 99.79 |

TABLE 5Q-continued

Atty. Docket No. 44921-5089US  
Doc. No. 1803440.1  
DIFLUNISAL  
Timepoint(s): 24 hrs

| Identifier | NonToxMean | NonToxSD | ToxMean | ToxSD | LDAScore |
|---|---|---|---|---|---|
| 1858 | 165.70 | 50.67 | 468.35 | 55.34 | 99.66 |
| 18687 | 415.65 | 168.60 | 1876.04 | 173.83 | 99.66 |
| 20810 | 1260.74 | 402.11 | 2154.96 | 30.08 | 99.44 |
| 23698 | 272.98 | 101.50 | 824.56 | 62.23 | 99.44 |
| 15906 | 73.43 | 105.60 | 328.56 | 63.09 | 99.40 |
| 21354 | 414.86 | 118.96 | 1273.64 | 189.63 | 99.36 |
| 16918 | 1181.89 | 410.28 | 2103.00 | 56.71 | 99.36 |
| 15048 | 861.35 | 213.04 | 1349.81 | 15.30 | 99.32 |
| 17758 | 126.22 | 53.45 | 567.25 | 114.93 | 99.14 |
| 23504 | 176.69 | 49.53 | 287.50 | 5.80 | 99.14 |
| 18686 | 468.60 | 214.77 | 2050.51 | 247.31 | 99.14 |
| 5351 | 711.19 | 145.06 | 979.89 | 15.97 | 99.06 |
| 18083 | 48.75 | 24.85 | 148.28 | 10.77 | 99.06 |
| 1977 | 142.19 | 40.33 | 293.78 | 26.17 | 98.97 |
| 20833 | 1254.24 | 350.22 | 1826.03 | 17.16 | 98.84 |
| 4012 | 650.38 | 267.26 | 1484.68 | 174.94 | 98.84 |
| 18250 | 1093.45 | 315.54 | 1684.15 | 30.30 | 98.80 |
| 26109 | 69.08 | 76.43 | 458.33 | 59.25 | 98.76 |
| 4049 | 23.28 | 65.36 | 63.64 | 6.15 | 98.76 |
| 23837 | 101.76 | 41.27 | 57.70 | 0.48 | 98.76 |
| 25679 | 901.31 | 261.02 | 1610.91 | 63.61 | 98.76 |
| 5887 | 79.37 | 88.10 | 285.80 | 15.29 | 98.63 |
| 23409 | 535.77 | 161.09 | 346.74 | 3.30 | 98.54 |
| 6380 | 135.92 | 123.74 | 459.26 | 82.61 | 98.54 |
| 2457 | 289.86 | 77.14 | 519.55 | 38.45 | 98.42 |
| 5667 | 744.60 | 177.74 | 1191.89 | 49.47 | 98.42 |
| 18293 | 770.57 | 235.09 | 1635.35 | 158.85 | 98.37 |
| 15579 | 32.24 | 115.84 | 189.18 | 29.09 | 98.33 |
| 18647 | 251.55 | 67.39 | 138.00 | 4.76 | 98.29 |
| 16849 | 114.09 | 44.40 | 66.30 | 1.36 | 98.20 |
| 15580 | 95.99 | 152.88 | 276.60 | 38.55 | 98.20 |
| 11205 | 594.93 | 193.66 | 371.24 | 5.25 | 98.20 |
| 17211 | 1440.25 | 553.34 | 2327.85 | 45.31 | 98.16 |
| 19244 | 1224.59 | 378.82 | 2305.53 | 135.95 | 98.16 |
| 1728 | 351.65 | 81.13 | 555.88 | 47.36 | 98.16 |
| 4010 | 965.06 | 407.94 | 2268.41 | 360.66 | 98.12 |
| 17563 | 1201.51 | 347.34 | 2039.09 | 80.83 | 98.07 |
| 19067 | 174.78 | 51.26 | 80.87 | 6.55 | 98.03 |
| 14763 | 38.55 | 133.68 | 500.64 | 63.55 | 98.03 |
| 17158 | 240.63 | 83.07 | 105.20 | 10.26 | 97.99 |
| 19727 | 1326.99 | 416.44 | 2052.69 | 41.43 | 97.90 |
| 2708 | 383.06 | 86.76 | 506.29 | 10.15 | 97.90 |
| 16204 | 755.43 | 187.45 | 1101.24 | 54.31 | 97.90 |
| 24748 | -22.65 | 38.12 | 33.61 | 1.39 | 97.86 |
| 15239 | 567.21 | 132.24 | 803.19 | 32.26 | 97.82 |
| 22052 | 256.34 | 73.77 | 451.80 | 35.28 | 97.77 |
| 20715 | 135.54 | 60.66 | 373.16 | 45.27 | 97.73 |
| 19268 | 940.57 | 273.83 | 1595.25 | 83.86 | 97.73 |
| 17686 | 1016.62 | 266.11 | 1780.84 | 121.15 | 97.69 |
| 20986 | 36.18 | 25.28 | 113.63 | 23.08 | 97.65 |
| 3027 | 1127.48 | 331.63 | 1758.65 | 53.48 | 97.65 |
| 23849 | 287.19 | 137.85 | 391.28 | 6.74 | 97.60 |
| 4952 | 108.82 | 48.80 | 171.37 | 6.32 | 97.60 |
| 1814 | 171.85 | 47.69 | 123.88 | 1.67 | 97.56 |
| 20839 | 1043.73 | 290.47 | 1565.67 | 42.99 | 97.52 |
| 16190 | 288.78 | 81.68 | 502.75 | 35.87 | 97.52 |
| 15875 | 1183.10 | 392.02 | 1973.54 | 86.87 | 97.35 |
| 16701 | 830.81 | 197.66 | 1528.91 | 267.69 | 97.35 |
| 15106 | 1887.41 | 709.31 | 3311.08 | 123.87 | 97.26 |
| 3434 | 326.00 | 140.86 | 131.21 | 15.66 | 97.26 |
| 21729 | 582.55 | 246.48 | 1512.04 | 499.79 | 97.26 |
| 19952 | 67.28 | 24.42 | 23.96 | 3.74 | 97.26 |
| 20818 | 681.56 | 422.22 | 1663.94 | 317.99 | 97.17 |
| 20149 | 1324.01 | 582.48 | 2795.60 | 215.42 | 97.17 |
| 14959 | 619.74 | 147.94 | 1010.98 | 113.74 | 97.13 |
| 16148 | 762.99 | 195.12 | 1313.23 | 188.91 | 97.13 |
| 24886 | 1263.69 | 371.87 | 2046.76 | 132.13 | 97.13 |
| 10878 | 952.87 | 253.83 | 1373.59 | 38.24 | 97.09 |
| 8946 | 207.89 | 87.83 | 74.88 | 7.06 | 97.09 |
| 19477 | 112.98 | 54.74 | 250.89 | 20.66 | 97.00 |
| 15468 | 734.22 | 179.64 | 1032.19 | 49.88 | 97.00 |
| 10109 | 1045.52 | 288.55 | 1597.93 | 74.73 | 96.96 |
| 3924 | 182.19 | 68.67 | 273.97 | 5.41 | 96.92 |
| 18918 | 31.02 | 27.50 | -11.16 | 3.27 | 96.88 |
| 17729 | 878.67 | 224.12 | 1508.83 | 163.08 | 96.83 |
| 14695 | 1736.29 | 632.39 | 2885.22 | 95.16 | 96.79 |
| 9799 | 145.87 | 50.77 | 85.38 | 3.80 | 96.79 |
| 20925 | 337.86 | 103.37 | 649.53 | 101.58 | 96.79 |
| 25501 | 102.21 | 56.92 | 20.07 | 8.06 | 96.79 |
| 7062 | 686.14 | 173.76 | 1144.72 | 115.88 | 96.79 |
| 5398 | 0.40 | 12.35 | 33.62 | 24.14 | 96.75 |
| 20711 | 43.78 | 42.18 | 150.73 | 22.20 | 96.75 |
| 373 | 34.25 | 61.71 | 167.08 | 44.08 | 96.70 |
| 16929 | 956.64 | 234.98 | 1405.43 | 58.88 | 96.70 |
| 20817 | 1073.65 | 677.30 | 2215.68 | 400.07 | 96.70 |
| 4291 | 295.13 | 101.25 | 151.24 | 8.90 | 96.70 |
| 23336 | 141.91 | 43.60 | 268.14 | 38.59 | 96.66 |
| 23270 | 209.26 | 61.36 | 302.15 | 9.89 | 96.66 |
| 4259 | 700.25 | 158.48 | 1007.49 | 53.89 | 96.66 |
| 18509 | 418.06 | 82.28 | 584.02 | 27.38 | 96.62 |
| 1694 | 1145.19 | 337.82 | 1796.01 | 81.50 | 96.58 |
| 4011 | 459.62 | 198.95 | 896.31 | 148.45 | 96.53 |
| 6949 | 1.61 | 27.50 | 36.30 | 10.98 | 96.49 |
| 4713 | 107.84 | 37.11 | 71.04 | 3.04 | 96.40 |

TABLE 5R

Atty. Docket No. 44921-5089US  
Doc. No. 1803440.1  
HYDRALAZINE  
Timepoint(s): 6 hrs

| Identifier | NonToxMean | NonToxSD | ToxMean | ToxSD | LDAScore |
|---|---|---|---|---|---|
| 23230 | 381.93 | 101.69 | 164.86 | 3.08 | 99.83 |
| 7299 | 180.37 | 151.55 | 684.70 | 26.37 | 99.66 |
| 11005 | 71.62 | 20.88 | 31.26 | 0.53 | 99.66 |
| 18715 | 190.60 | 53.82 | 312.84 | 2.17 | 99.66 |
| 18713 | 300.35 | 70.22 | 564.29 | 26.19 | 99.62 |
| 9306 | 45.76 | 18.52 | 121.89 | 7.27 | 99.62 |
| 19004 | 788.98 | 306.09 | 794.75 | 1.65 | 99.57 |
| 9525 | 5.08 | 44.31 | 64.20 | 2.12 | 99.57 |
| 19712 | 98.45 | 32.90 | 58.61 | 0.21 | 99.53 |
| 16203 | 66.52 | 16.97 | 45.27 | 0.17 | 99.53 |
| 20513 | 58.53 | 27.11 | 242.01 | 35.67 | 99.49 |
| 5918 | 26.70 | 40.82 | 72.84 | 4.20 | 99.44 |
| 14479 | 473.36 | 112.67 | 261.32 | 4.86 | 99.44 |
| 4194 | 34.33 | 17.04 | 74.46 | 0.76 | 99.40 |
| 8948 | 217.22 | 104.91 | 343.57 | 1.20 | 99.40 |
| 15015 | 503.71 | 91.72 | 339.92 | 3.82 | 99.36 |
| 22746 | 534.33 | 197.34 | 312.42 | 2.15 | 99.36 |
| 13235 | 16.43 | 13.42 | 75.50 | 8.64 | 99.32 |
| 90 | 93.87 | 50.03 | 147.79 | 0.44 | 99.32 |
| 16069 | 59.01 | 26.48 | 31.64 | 0.25 | 99.32 |
| 20523 | 549.70 | 152.39 | 1021.93 | 29.01 | 99.23 |
| 15872 | 155.66 | 71.91 | 53.38 | 1.82 | 99.23 |
| 3513 | 171.87 | 35.63 | 273.79 | 6.58 | 99.19 |
| 7452 | 8.04 | 13.04 | 37.85 | 2.68 | 99.19 |
| 15059 | 92.43 | 24.57 | 82.57 | 0.16 | 99.14 |
| 8597 | 241.04 | 57.82 | 387.68 | 12.70 | 99.14 |
| 20849 | 277.59 | 87.41 | 309.60 | 0.68 | 99.06 |
| 13298 | 101.48 | 29.62 | 51.68 | 1.68 | 99.06 |
| 11406 | 242.13 | 50.08 | 177.73 | 0.85 | 99.02 |
| 7071 | 133.86 | 64.50 | 98.99 | 0.88 | 99.02 |
| 23189 | 330.92 | 72.72 | 460.60 | 3.57 | 98.97 |
| 15411 | 303.87 | 90.07 | 657.96 | 59.65 | 98.97 |
| 8692 | 1045.40 | 309.78 | 638.87 | 9.02 | 98.97 |
| 22614 | 17.91 | 87.18 | 86.87 | 14.83 | 98.93 |
| 4969 | -18.84 | 34.82 | 77.79 | 30.12 | 98.89 |
| 3081 | 387.16 | 84.82 | 227.51 | 15.13 | 98.89 |

TABLE 5R-continued

HYDRALAZINE  
Timepoint(s): 6 hrs

| Identifier | NonToxMean | NonToxSD | ToxMean | ToxSD | LDAScore |
|---|---|---|---|---|---|
| 15231 | 100.29 | 44.00 | 233.89 | 22.19 | 98.85 |
| 15942 | 230.65 | 65.79 | 294.11 | 1.11 | 98.85 |
| 18406 | 33.60 | 18.22 | 70.49 | 1.79 | 98.85 |
| 16024 | 239.14 | 63.32 | 487.33 | 52.09 | 98.85 |
| 2539 | 46.96 | 51.90 | 304.80 | 46.42 | 98.85 |
| 26119 | 124.62 | 46.64 | 176.21 | 1.26 | 98.80 |
| 6723 | 200.38 | 72.05 | 91.78 | 10.99 | 98.76 |
| 21878 | 144.05 | 35.94 | 106.39 | 0.58 | 98.76 |
| 8664 | 106.71 | 250.43 | 160.02 | 4.54 | 98.72 |
| 21014 | 155.47 | 80.73 | 369.94 | 37.53 | 98.72 |
| 14842 | 122.80 | 45.94 | 280.85 | 20.55 | 98.72 |
| 13093 | 700.37 | 165.48 | 367.14 | 36.76 | 98.72 |
| 20404 | 53.45 | 44.01 | 336.92 | 98.70 | 98.72 |
| 15126 | 792.34 | 224.59 | 1256.68 | 25.48 | 98.67 |
| 4948 | 153.55 | 61.38 | 307.30 | 11.57 | 98.63 |
| 6844 | 123.76 | 58.60 | 32.99 | 3.47 | 98.63 |
| 16025 | 150.51 | 42.20 | 268.08 | 8.85 | 98.59 |
| 7615 | 90.87 | 40.61 | 221.25 | 17.10 | 98.55 |
| 22575 | 20.61 | 15.66 | 10.19 | 0.32 | 98.50 |
| 23141 | 239.29 | 55.53 | 490.92 | 129.05 | 98.50 |
| 15636 | 39.88 | 26.09 | 4.00 | 1.07 | 98.50 |
| 15885 | 93.27 | 28.63 | 182.42 | 15.91 | 98.46 |
| 5355 | 1164.75 | 345.23 | 1050.46 | 4.54 | 98.46 |
| 13151 | 711.00 | 343.67 | 1290.08 | 71.04 | 98.46 |
| 19195 | 1555.05 | 374.36 | 1121.86 | 8.23 | 98.42 |
| 6606 | 249.66 | 121.42 | 743.36 | 159.90 | 98.42 |
| 2888 | 2015.72 | 588.67 | 1201.76 | 29.67 | 98.42 |
| 20405 | 34.08 | 29.57 | 195.15 | 62.34 | 98.42 |
| 7197 | 197.58 | 84.65 | 309.34 | 7.55 | 98.42 |
| 1215 | 67.05 | 49.57 | 246.66 | 40.98 | 98.42 |
| 17479 | 157.69 | 34.71 | 89.24 | 4.57 | 98.37 |
| 22733 | 21.90 | 14.11 | 64.22 | 8.36 | 98.37 |
| 1920 | 426.50 | 112.57 | 740.10 | 44.20 | 98.37 |
| 8745 | 57.56 | 19.95 | 100.05 | 2.83 | 98.33 |
| 22915 | 171.30 | 47.15 | 114.08 | 2.66 | 98.33 |
| 25587 | 24.39 | 16.37 | 17.05 | 0.15 | 98.33 |
| 13259 | 68.80 | 25.82 | 161.38 | 28.29 | 98.33 |
| 17468 | 396.41 | 77.87 | 278.70 | 4.37 | 98.29 |
| 14405 | 465.44 | 308.54 | 1276.71 | 188.93 | 98.25 |
| 14861 | 48.74 | 17.37 | 75.52 | 1.15 | 98.25 |
| 3027 | 1129.44 | 333.52 | 1205.87 | 5.52 | 98.25 |
| 1214 | 165.46 | 52.58 | 424.14 | 92.45 | 98.20 |
| 11158 | 1023.54 | 302.35 | 1115.38 | 6.37 | 98.20 |
| 20202 | 624.37 | 196.92 | 959.56 | 18.31 | 98.20 |
| 18290 | 275.55 | 78.31 | 420.92 | 7.75 | 98.16 |
| 21527 | 239.85 | 60.68 | 369.29 | 12.50 | 98.16 |
| 24885 | 1107.60 | 334.53 | 1092.86 | 5.80 | 98.16 |
| 23689 | 0.64 | 11.77 | 22.99 | 3.94 | 98.16 |
| 8869 | 8.35 | 21.59 | 31.83 | 0.60 | 98.16 |
| 17502 | 147.76 | 53.99 | 264.34 | 13.12 | 98.16 |
| 13203 | −15.66 | 28.87 | 51.81 | 11.94 | 98.12 |
| 25971 | 106.47 | 34.61 | 50.27 | 2.15 | 98.12 |
| 13095 | 60.49 | 15.80 | 32.26 | 1.41 | 98.12 |
| 26036 | 34.25 | 17.22 | 19.79 | 0.49 | 98.12 |
| 17570 | 230.73 | 71.54 | 273.93 | 2.11 | 98.08 |
| 22543 | 689.99 | 222.20 | 447.42 | 9.98 | 98.08 |
| 17312 | 26.98 | 34.41 | 42.60 | 0.40 | 98.08 |
| 16026 | 221.52 | 75.94 | 411.54 | 26.17 | 98.08 |
| 5684 | 333.75 | 76.46 | 482.85 | 10.21 | 98.03 |
| 15879 | 374.14 | 93.39 | 276.43 | 3.61 | 98.03 |

TABLE 5S

IFOSFAMIDE  
Timepoint(s): 6, 24, 48, 144 hrs

| Identifier | NonToxMean | NonToxSD | ToxMean | ToxSD | LDAScore |
|---|---|---|---|---|---|
| 19252 | 647.94 | 142.98 | 520.93 | 34.13 | 89.74 |
| 1622 | 2071.83 | 907.04 | 1625.21 | 143.87 | 88.88 |
| 16148 | 767.65 | 197.63 | 575.47 | 57.95 | 86.32 |
| 17779 | 1952.57 | 790.85 | 1617.53 | 137.53 | 85.80 |
| 12932 | 153.85 | 49.70 | 108.04 | 13.75 | 85.63 |
| 11158 | 1027.66 | 302.42 | 759.65 | 56.80 | 85.37 |
| 10947 | 1800.32 | 754.28 | 1416.69 | 180.51 | 85.28 |
| 19408 | 2011.57 | 680.23 | 1580.63 | 160.66 | 85.24 |
| 16013 | 58.91 | 18.74 | 71.23 | 5.22 | 85.11 |
| 19254 | 241.32 | 76.35 | 239.54 | 14.43 | 85.06 |
| 17886 | 1504.90 | 495.37 | 1122.51 | 90.54 | 84.72 |
| 16895 | 2027.29 | 906.56 | 1603.00 | 189.71 | 84.63 |
| 18300 | 450.17 | 150.80 | 316.95 | 39.08 | 84.33 |
| 8211 | 2862.98 | 1618.85 | 2138.69 | 273.26 | 84.29 |
| 23710 | 1141.57 | 367.03 | 897.82 | 79.04 | 84.20 |
| 11954 | 3141.99 | 1699.73 | 2471.68 | 314.40 | 83.90 |
| 1853 | 2014.76 | 833.49 | 1614.19 | 220.80 | 83.90 |
| 14695 | 1746.72 | 637.07 | 1297.75 | 126.83 | 83.77 |
| 8212 | 2267.04 | 1143.40 | 1689.07 | 186.62 | 83.42 |
| 13976 | 453.36 | 377.22 | 783.29 | 266.52 | 83.38 |
| 14997 | 2596.32 | 1029.67 | 2216.17 | 249.47 | 83.20 |
| 23709 | 2500.59 | 1207.33 | 1994.07 | 261.44 | 83.16 |
| 22592 | 234.68 | 168.43 | 397.15 | 108.13 | 83.08 |
| 18142 | 2001.91 | 840.95 | 1479.52 | 180.12 | 82.99 |
| 9135 | 719.00 | 131.99 | 601.54 | 43.95 | 82.90 |
| 14694 | 2326.49 | 1072.49 | 1849.47 | 243.07 | 82.69 |
| 18810 | 1189.60 | 320.47 | 979.08 | 72.74 | 82.60 |
| 18077 | 2627.05 | 1191.54 | 1778.68 | 232.31 | 82.56 |
| 15125 | 1303.70 | 426.26 | 1007.41 | 95.34 | 82.55 |
| 20751 | 706.77 | 161.80 | 835.79 | 96.53 | 82.51 |
| 44 | 34.24 | 17.91 | 48.60 | 8.82 | 82.47 |
| 23544 | 1515.02 | 495.50 | 1325.70 | 110.75 | 82.17 |
| 19993 | 2320.17 | 574.10 | 2616.44 | 234.66 | 82.03 |
| 9942 | 443.45 | 98.80 | 518.47 | 38.50 | 81.95 |
| 17682 | 673.25 | 179.30 | 543.60 | 51.66 | 81.95 |
| 23574 | 2282.20 | 973.76 | 1808.58 | 200.84 | 81.82 |
| 6815 | 1138.28 | 344.89 | 837.60 | 73.20 | 81.65 |
| 11050 | 671.41 | 139.50 | 791.75 | 84.37 | 81.60 |
| 1247 | 1310.50 | 504.69 | 915.02 | 93.84 | 81.60 |
| 18078 | 1152.53 | 545.02 | 1014.06 | 139.87 | 81.56 |
| 1801 | 97.60 | 29.90 | 123.54 | 20.25 | 81.43 |
| 12901 | 1613.41 | 414.49 | 2126.00 | 326.75 | 81.39 |
| 20035 | 182.08 | 110.21 | 229.47 | 33.04 | 81.39 |
| 17118 | 53.61 | 19.28 | 66.07 | 6.68 | 81.30 |
| 17204 | 1733.32 | 660.21 | 1299.09 | 155.20 | 81.26 |
| 23847 | 47.46 | 36.72 | 90.72 | 17.29 | 81.21 |
| 10500 | 24.88 | 31.73 | 53.21 | 18.49 | 81.17 |
| 8347 | 76.96 | 46.62 | 110.08 | 23.49 | 81.13 |
| 3015 | 2318.93 | 997.42 | 1869.25 | 225.78 | 81.04 |
| 20832 | 722.84 | 197.13 | 591.89 | 72.43 | 81.00 |
| 18615 | 521.90 | 148.77 | 363.34 | 55.31 | 80.95 |
| 5989 | 269.37 | 71.43 | 354.20 | 68.39 | 80.91 |
| 19894 | 40.81 | 20.31 | 62.51 | 16.62 | 80.83 |
| 18076 | 2548.69 | 1193.37 | 1768.87 | 244.55 | 80.83 |
| 21423 | 1355.89 | 429.81 | 1080.04 | 115.43 | 80.78 |
| 1523 | 89.47 | 23.47 | 100.14 | 7.66 | 80.70 |
| 11991 | 57.24 | 22.13 | 76.61 | 11.20 | 80.65 |
| 23109 | 2089.70 | 930.42 | 1566.07 | 197.88 | 80.44 |
| 19727 | 1331.92 | 420.23 | 1162.29 | 117.79 | 80.44 |
| 18451 | 1434.72 | 418.40 | 1801.12 | 288.28 | 80.39 |
| 23884 | 41.09 | 33.35 | 54.46 | 12.98 | 80.39 |
| 472 | 662.53 | 178.22 | 500.21 | 63.31 | 80.35 |
| 11153 | 1474.65 | 500.35 | 1320.86 | 134.33 | 80.35 |
| 23125 | 4577.67 | 2547.90 | 5632.15 | 1198.40 | 80.31 |
| 12598 | 545.25 | 95.85 | 644.01 | 73.00 | 80.31 |
| 915 | 30.40 | 17.20 | 53.68 | 14.78 | 80.26 |
| 6808 | 698.18 | 193.62 | 893.93 | 94.12 | 80.26 |
| 10260 | 85.57 | 33.38 | 94.71 | 10.64 | 80.18 |
| 25545 | 94.20 | 49.43 | 150.75 | 32.71 | 80.09 |
| 23660 | 1281.20 | 383.06 | 1072.18 | 89.30 | 80.09 |
| 15410 | 504.96 | 102.87 | 427.16 | 47.59 | 80.05 |

TABLE 5S-continued

Atty. Docket No. 44921-5089US
Doc. No. 1803440.1

IFOSFAMIDE
Timepoint(s): 6, 24, 48, 144 hrs

| Identifier | NonToxMean | NonToxSD | ToxMean | ToxSD | LDAScore |
|---|---|---|---|---|---|
| 977 | 16.73 | 10.91 | 41.99 | 18.19 | 80.01 |
| 15137 | 1520.02 | 496.49 | 1254.30 | 128.20 | 80.00 |
| 26109 | 69.41 | 79.57 | 138.16 | 53.60 | 79.96 |
| 11136 | 1003.50 | 311.85 | 725.42 | 110.05 | 79.92 |
| 4217 | 519.77 | 126.27 | 592.35 | 45.95 | 79.92 |
| 13480 | 650.24 | 137.90 | 533.92 | 69.48 | 79.83 |
| 15535 | 448.65 | 83.59 | 358.13 | 46.40 | 79.79 |
| 15426 | 411.88 | 86.42 | 342.56 | 30.90 | 79.66 |
| 16012 | 73.15 | 32.18 | 78.40 | 10.56 | 79.65 |
| 4849 | 773.73 | 168.65 | 929.55 | 91.93 | 79.61 |
| 17765 | 1296.75 | 460.31 | 914.95 | 107.23 | 79.61 |
| 23967 | 383.11 | 92.35 | 484.27 | 65.27 | 79.53 |
| 9905 | 673.59 | 140.94 | 588.24 | 39.94 | 79.53 |
| 1583 | 30.08 | 18.99 | 43.08 | 7.71 | 79.53 |
| 1743 | 29.18 | 16.19 | 50.78 | 15.93 | 79.40 |
| 15446 | 370.71 | 93.07 | 266.06 | 61.63 | 79.40 |
| 18905 | 1363.50 | 302.26 | 1680.54 | 182.30 | 79.36 |
| 24049 | 1519.32 | 446.29 | 1776.05 | 182.78 | 79.31 |
| 24626 | 1504.58 | 431.27 | 1251.16 | 114.87 | 79.31 |
| 820 | 2467.06 | 1167.88 | 1920.44 | 339.35 | 79.22 |
| 1684 | 2833.17 | 1621.88 | 1212.60 | 870.83 | 79.22 |
| 21373 | 373.62 | 85.16 | 332.82 | 32.95 | 79.22 |
| 16211 | 2261.75 | 1141.46 | 1652.93 | 320.55 | 79.18 |
| 16521 | 285.41 | 90.61 | 359.56 | 55.31 | 79.14 |
| 22661 | 1309.12 | 421.45 | 1003.73 | 117.38 | 79.01 |

TABLE 5T

Atty. Docket No. 44921-5089US
Doc. No. 1803440.1

INDOMETHACIN
Timepoint(s): 48, 72 hrs

| Identifier | NonToxMean | NonToxSD | ToxMean | ToxSD | LDAScore |
|---|---|---|---|---|---|
| 155 | 21.42 | 16.98 | 101.88 | 13.61 | 99.53 |
| 154 | 112.29 | 36.99 | 249.23 | 25.25 | 99.27 |
| 16173 | 14.63 | 13.08 | 179.81 | 66.16 | 99.18 |
| 13614 | 340.21 | 88.42 | 786.72 | 118.82 | 99.01 |
| 1850 | 46.85 | 347.25 | 309.01 | 159.03 | 98.93 |
| 22499 | 8.20 | 11.83 | 58.62 | 9.91 | 98.88 |
| 1893 | 29.44 | 20.17 | 163.67 | 70.52 | 98.84 |
| 1221 | 0.23 | 15.64 | 193.08 | 98.35 | 98.80 |
| 21445 | 0.99 | 14.21 | 203.14 | 86.78 | 98.75 |
| 1854 | 43.31 | 289.94 | 282.61 | 143.16 | 98.67 |
| 25517 | 38.27 | 31.10 | 173.50 | 50.20 | 98.58 |
| 19710 | 43.43 | 20.81 | 132.45 | 42.06 | 98.54 |
| 6431 | 51.07 | 32.99 | 209.15 | 53.95 | 98.50 |
| 2457 | 288.90 | 75.46 | 543.74 | 54.46 | 98.45 |
| 7299 | 177.44 | 143.66 | 797.13 | 276.35 | 98.41 |
| 23964 | 12.50 | 18.01 | 63.92 | 17.10 | 98.37 |
| 1943 | 31.78 | 14.21 | 86.66 | 15.03 | 98.15 |
| 13615 | 253.23 | 68.59 | 560.03 | 77.71 | 98.15 |
| 20713 | 215.61 | 108.00 | 606.67 | 98.17 | 98.11 |
| 24237 | 56.39 | 37.15 | 281.98 | 103.56 | 98.07 |
| 8565 | 31.85 | 16.10 | 105.94 | 38.19 | 98.02 |
| 7540 | 154.84 | 89.44 | 535.02 | 179.10 | 98.02 |
| 1845 | −7.69 | 24.61 | 109.59 | 48.06 | 98.02 |
| 18684 | 137.77 | 49.02 | 305.11 | 48.29 | 97.98 |
| 7858 | −4.71 | 7.47 | 47.48 | 40.75 | 97.98 |
| 15408 | 192.19 | 56.59 | 376.55 | 44.39 | 97.98 |
| 10281 | 172.58 | 185.66 | 567.51 | 296.37 | 97.94 |
| 18867 | 103.82 | 49.82 | 263.24 | 51.22 | 97.94 |
| 18353 | 112.33 | 68.84 | 349.21 | 48.50 | 97.94 |
| 20715 | 134.85 | 59.63 | 354.19 | 34.91 | 97.90 |
| 6551 | 576.57 | 201.46 | 1150.85 | 135.93 | 97.90 |
| 7665 | 282.66 | 95.03 | 609.80 | 128.48 | 97.90 |

TABLE 5T-continued

Atty. Docket No. 44921-5089US
Doc. No. 1803440.1

INDOMETHACIN
Timepoint(s): 48, 72 hrs

| Identifier | NonToxMean | NonToxSD | ToxMean | ToxSD | LDAScore |
|---|---|---|---|---|---|
| 20868 | 22.06 | 17.54 | 98.66 | 30.62 | 97.85 |
| 343 | 28.72 | 32.40 | 151.55 | 21.38 | 97.85 |
| 20869 | 21.84 | 21.14 | 111.52 | 32.81 | 97.85 |
| 20711 | 43.08 | 40.65 | 197.85 | 41.42 | 97.77 |
| 16521 | 283.95 | 85.02 | 655.14 | 127.79 | 97.59 |
| 21444 | 19.93 | 43.02 | 180.28 | 49.29 | 97.51 |
| 21683 | 33.96 | 22.93 | 127.35 | 39.46 | 97.47 |
| 3180 | 309.65 | 80.63 | 524.23 | 45.30 | 97.47 |
| 1942 | 17.90 | 24.48 | 99.74 | 38.19 | 97.47 |
| 14184 | 113.17 | 49.05 | 251.46 | 48.41 | 97.42 |
| 1894 | 202.61 | 73.39 | 421.42 | 64.64 | 97.42 |
| 15851 | 200.88 | 151.27 | 525.10 | 94.05 | 97.38 |
| 20700 | 85.68 | 416.32 | 391.89 | 193.02 | 97.38 |
| 4749 | 234.65 | 200.18 | 431.09 | 62.04 | 97.38 |
| 6094 | 138.21 | 54.26 | 356.45 | 88.21 | 97.38 |
| 2555 | 96.41 | 46.12 | 235.98 | 52.95 | 97.34 |
| 3260 | 193.81 | 71.46 | 443.67 | 108.75 | 97.34 |
| 19012 | 483.92 | 149.86 | 930.52 | 98.29 | 97.21 |
| 5887 | 77.25 | 81.17 | 491.60 | 169.72 | 97.16 |
| 20041 | 192.79 | 82.66 | 490.91 | 119.03 | 97.16 |
| 16007 | 26.63 | 17.31 | 92.50 | 26.48 | 97.04 |
| 21653 | 236.04 | 61.07 | 399.34 | 79.22 | 97.04 |
| 13004 | 142.59 | 42.21 | 275.32 | 36.65 | 96.99 |
| 19387 | 667.36 | 146.95 | 1017.20 | 82.56 | 96.99 |
| 2554 | 53.34 | 18.18 | 111.59 | 20.52 | 96.99 |
| 4661 | 307.32 | 90.25 | 543.97 | 56.72 | 96.91 |
| 21467 | 13.64 | 131.26 | 140.69 | 60.68 | 96.86 |
| 18352 | 162.12 | 85.33 | 437.38 | 90.35 | 96.86 |
| 15191 | 2030.38 | 1211.92 | 434.31 | 67.70 | 96.86 |
| 24183 | 68.30 | 35.60 | 194.82 | 48.12 | 96.82 |
| 4748 | 110.39 | 127.49 | 266.50 | 52.38 | 96.82 |
| 19711 | 83.58 | 22.63 | 149.45 | 21.04 | 96.82 |
| 848 | 18.09 | 11.05 | 45.15 | 4.76 | 96.65 |
| 10015 | 231.63 | 76.39 | 422.68 | 89.46 | 96.65 |
| 11708 | 319.08 | 90.36 | 587.03 | 103.59 | 96.65 |
| 22321 | 101.90 | 68.06 | 234.02 | 51.42 | 96.61 |
| 1597 | 50.19 | 41.89 | 187.05 | 63.28 | 96.61 |
| 6120 | 511.17 | 159.69 | 914.06 | 106.73 | 96.52 |
| 20714 | 178.33 | 78.97 | 430.20 | 87.05 | 96.52 |
| 24200 | 421.16 | 141.29 | 847.55 | 177.88 | 96.52 |
| 3316 | 8.48 | 11.20 | 32.02 | 7.24 | 96.48 |
| 14595 | 87.99 | 36.42 | 175.31 | 16.47 | 96.39 |
| 21654 | 362.19 | 114.34 | 536.63 | 59.58 | 96.22 |
| 22479 | 433.07 | 146.06 | 846.76 | 137.55 | 96.18 |
| 18687 | 418.98 | 188.38 | 661.54 | 59.97 | 96.13 |
| 5572 | 330.93 | 144.21 | 692.30 | 98.63 | 96.09 |
| 3020 | 292.14 | 93.53 | 549.45 | 92.30 | 96.09 |
| 25366 | 52.69 | 46.59 | 140.27 | 34.35 | 96.01 |
| 11183 | 98.16 | 39.08 | 183.02 | 34.74 | 96.01 |
| 19145 | 363.77 | 71.33 | 513.30 | 38.33 | 95.96 |
| 15409 | 399.23 | 98.94 | 637.09 | 62.27 | 95.88 |
| 17950 | 64.06 | 23.04 | 112.35 | 10.61 | 95.79 |
| 16945 | 934.12 | 162.35 | 1222.61 | 66.01 | 95.79 |
| 16917 | 755.96 | 258.94 | 1351.72 | 135.35 | 95.75 |
| 9286 | 205.05 | 59.59 | 354.73 | 51.76 | 95.66 |
| 18217 | 15.31 | 19.01 | 63.19 | 16.35 | 95.62 |
| 14185 | 203.46 | 94.18 | 411.57 | 81.62 | 95.62 |
| 16646 | 28.33 | 20.91 | 71.67 | 15.31 | 95.58 |
| 23837 | 100.89 | 40.39 | 206.26 | 37.38 | 95.53 |
| 21066 | 43.85 | 16.28 | 90.93 | 15.15 | 95.53 |
| 18068 | 82.30 | 21.15 | 125.33 | 8.28 | 95.49 |
| 21410 | 183.82 | 61.54 | 326.34 | 61.71 | 95.45 |
| 18355 | 56.83 | 27.50 | 129.21 | 39.86 | 95.36 |
| 6044 | 327.15 | 91.24 | 520.74 | 70.39 | 95.36 |
| 23145 | 44.14 | 20.10 | 96.23 | 26.84 | 95.32 |
| 16859 | 122.48 | 51.26 | 241.14 | 54.89 | 95.27 |
| 15246 | 63.40 | 20.73 | 113.00 | 17.39 | 95.19 |
| 24019 | 27.09 | 25.66 | 86.45 | 18.38 | 95.19 |

TABLE 5U

Atty. Docket No. 44921-5089US  
Doc. No. 1803440.1

LITHIUM CHLORIDE  
Timepoint(s): 120 hrs

| Identifier | NonToxMean | NonToxSD | ToxMean | ToxSD | LDAScore |
|---|---|---|---|---|---|
| 24019 | 27.07 | 25.30 | 127.00 | 8.27 | 99.61 |
| 14421 | 418.40 | 87.55 | 639.64 | 12.93 | 99.57 |
| 13641 | 47.49 | 30.07 | 145.93 | 13.26 | 99.53 |
| 1463 | 619.17 | 296.16 | 1455.45 | 46.93 | 99.53 |
| 16300 | 61.51 | 20.88 | 147.76 | 15.29 | 99.49 |
| 13974 | 296.90 | 139.79 | 1260.41 | 77.75 | 99.49 |
| 3244 | 127.45 | 30.43 | 40.35 | 2.64 | 99.36 |
| 10464 | 131.43 | 35.68 | 41.70 | 2.59 | 99.36 |
| 1462 | 407.93 | 201.27 | 1216.38 | 60.80 | 99.36 |
| 18525 | 246.32 | 66.03 | 97.58 | 6.10 | 99.27 |
| 14227 | 72.35 | 65.02 | 265.04 | 34.60 | 99.23 |
| 25741 | 185.55 | 57.43 | 490.81 | 62.92 | 99.23 |
| 1224 | 3.70 | 11.53 | 50.50 | 8.69 | 99.23 |
| 13880 | 679.69 | 204.44 | 295.39 | 24.01 | 99.14 |
| 14261 | 39.73 | 17.42 | 113.90 | 16.40 | 99.14 |
| 18472 | 1551.82 | 378.09 | 827.52 | 66.71 | 99.10 |
| 15363 | 446.56 | 133.55 | 187.16 | 15.68 | 99.06 |
| 8598 | 139.25 | 41.61 | 362.49 | 73.57 | 99.01 |
| 5176 | 217.77 | 121.65 | 603.36 | 60.94 | 98.93 |
| 14754 | 99.93 | 24.11 | 228.47 | 44.23 | 98.93 |
| 20849 | 276.44 | 85.41 | 565.38 | 36.71 | 98.93 |
| 15955 | 750.17 | 198.73 | 371.84 | 30.56 | 98.89 |
| 14633 | 97.72 | 88.30 | -1.97 | 5.36 | 98.84 |
| 15371 | 378.04 | 55.30 | 593.66 | 40.88 | 98.80 |
| 17342 | 202.36 | 532.80 | 480.79 | 60.48 | 98.80 |
| 20809 | 317.42 | 60.81 | 558.00 | 56.79 | 98.80 |
| 16650 | 256.32 | 82.88 | 614.21 | 64.30 | 98.80 |
| 18109 | 19.25 | 21.24 | 92.33 | 9.99 | 98.76 |
| 18286 | 10.51 | 10.22 | 41.67 | 5.33 | 98.76 |
| 24049 | 1526.25 | 442.84 | 773.94 | 52.98 | 98.76 |
| 16245 | 386.32 | 115.78 | 64.71 | 31.63 | 98.76 |
| 23651 | 656.57 | 627.85 | 1600.29 | 142.54 | 98.76 |
| 574 | 335.41 | 164.90 | 679.82 | 42.41 | 98.71 |
| 20099 | 81.48 | 29.97 | 171.81 | 18.17 | 98.71 |
| 1976 | 24.82 | 21.34 | 269.98 | 118.48 | 98.71 |
| 23294 | 244.42 | 55.35 | 115.25 | 8.35 | 98.71 |
| 3733 | 340.43 | 153.36 | 790.69 | 47.48 | 98.67 |
| 23957 | 68.22 | 41.24 | 264.04 | 43.03 | 98.67 |
| 3348 | 496.09 | 130.59 | 245.12 | 25.78 | 98.67 |
| 20697 | 1418.84 | 278.90 | 908.67 | 36.86 | 98.67 |
| 260 | 415.71 | 110.53 | 903.01 | 137.68 | 98.63 |
| 19321 | 313.57 | 55.98 | 464.14 | 23.58 | 98.63 |
| 8597 | 240.21 | 54.94 | 523.47 | 111.57 | 98.63 |
| 17159 | 699.06 | 218.26 | 1124.72 | 53.18 | 98.63 |
| 18103 | 58.33 | 28.29 | 149.64 | 17.07 | 98.59 |
| 5698 | 1169.95 | 220.06 | 1885.00 | 141.61 | 98.59 |
| 24648 | 40.24 | 20.33 | 6.76 | 1.40 | 98.59 |
| 14020 | 277.14 | 68.14 | 152.09 | 12.77 | 98.54 |
| 15246 | 63.64 | 21.09 | 87.26 | 0.84 | 98.54 |
| 24115 | 68.51 | 36.48 | 345.37 | 126.46 | 98.54 |
| 21997 | 28.94 | 25.26 | 95.22 | 19.06 | 98.54 |
| 960 | 191.35 | 46.71 | 93.10 | 7.12 | 98.50 |
| 22321 | 100.55 | 58.87 | 629.47 | 166.32 | 98.50 |
| 20886 | 711.00 | 279.64 | 2114.98 | 382.05 | 98.50 |
| 16354 | 280.15 | 119.74 | -118.26 | 64.76 | 98.50 |
| 12376 | 19.26 | 124.98 | 83.39 | 19.10 | 98.50 |
| 17106 | 81.66 | 24.82 | 36.82 | 2.74 | 98.50 |
| 18473 | 2589.69 | 916.99 | 1318.66 | 52.24 | 98.50 |
| 9254 | 246.49 | 48.78 | 393.24 | 20.14 | 98.46 |
| 1340 | 191.26 | 49.84 | 289.47 | 26.83 | 98.46 |
| 17162 | 6.69 | 16.97 | 58.11 | 15.91 | 98.46 |
| 6806 | 1233.36 | 345.85 | 586.60 | 42.84 | 98.41 |
| 25840 | -2.65 | 12.34 | 54.97 | 27.90 | 98.41 |
| 20887 | 784.36 | 296.51 | 2396.08 | 485.51 | 98.37 |
| 1372 | 199.45 | 51.98 | 391.46 | 35.86 | 98.33 |
| 18349 | 140.08 | 38.43 | 262.92 | 23.80 | 98.33 |
| 14989 | 500.36 | 106.29 | 910.22 | 99.63 | 98.33 |
| 4049 | 23.03 | 65.14 | 113.93 | 24.17 | 98.29 |
| 11483 | 65.04 | 45.49 | 132.25 | 10.90 | 98.29 |
| 9867 | 29.07 | 22.58 | -38.05 | 11.94 | 98.29 |
| 13411 | 789.51 | 324.70 | 239.08 | 27.46 | 98.29 |
| 25709 | 267.20 | 83.61 | 591.14 | 81.21 | 98.29 |
| 17160 | 1038.70 | 287.67 | 1872.62 | 168.15 | 98.24 |
| 12673 | 37.66 | 22.70 | 116.03 | 13.02 | 98.24 |
| 25306 | 27.76 | 21.91 | -55.70 | 19.66 | 98.24 |
| 16349 | 47.04 | 14.11 | 94.68 | 13.74 | 98.24 |
| 13392 | 190.93 | 48.80 | 355.59 | 34.39 | 98.24 |
| 4048 | -6.11 | 32.04 | 34.41 | 10.44 | 98.20 |
| 2915 | 87.49 | 36.50 | 176.88 | 18.22 | 98.20 |
| 15761 | 90.06 | 42.30 | 20.08 | 3.24 | 98.20 |
| 111 | 590.89 | 237.37 | 1115.91 | 164.07 | 98.20 |
| 24695 | 63.72 | 21.72 | 13.53 | 4.47 | 98.16 |
| 19152 | 164.93 | 52.20 | 401.36 | 74.04 | 98.16 |
| 24597 | 585.04 | 105.40 | 935.83 | 83.53 | 98.16 |
| 21527 | 239.33 | 59.62 | 438.09 | 50.65 | 98.16 |
| 3776 | 377.17 | 93.88 | 689.18 | 68.23 | 98.16 |
| 5626 | 26.84 | 18.16 | 84.22 | 9.81 | 98.11 |
| 3075 | 524.14 | 179.66 | 209.94 | 19.92 | 98.11 |
| 15511 | 214.84 | 128.36 | 897.69 | 308.94 | 98.11 |
| 6386 | 20.45 | 18.01 | -5.75 | 1.87 | 98.07 |
| 134 | 69.64 | 33.24 | 7.05 | 4.13 | 98.07 |
| 19665 | 91.84 | 47.87 | 296.74 | 33.57 | 98.07 |
| 10984 | 2015.62 | 568.01 | 964.72 | 141.17 | 98.03 |
| 15247 | 637.80 | 190.94 | 1369.01 | 148.83 | 98.03 |
| 2905 | 246.54 | 108.85 | 410.67 | 11.79 | 98.03 |
| 13343 | 210.51 | 55.05 | 72.01 | 21.01 | 98.03 |

TABLE 5V

Atty. Docket No. 44921-5089US  
Doc. No. 1803440.1

MERCURIC CHLORIDE  
Timepoint(s): 3, 6, 24 hrs

| Identifier | NonToxMean | NonToxSD | ToxMean | ToxSD | LDAScore |
|---|---|---|---|---|---|
| 8665 | 332.39 | 171.86 | 5197.14 | 2943.02 | 99.44 |
| 1475 | 136.94 | 103.32 | 3940.87 | 1974.36 | 99.18 |
| 20035 | 178.08 | 98.83 | 635.50 | 155.87 | 98.10 |
| 19723 | 74.87 | 55.61 | 273.03 | 109.44 | 98.02 |
| 15191 | 1988.23 | 1177.92 | 5041.11 | 935.19 | 96.55 |
| 14139 | 80.54 | 27.01 | 25.59 | 13.59 | 65.47 |
| 8664 | 86.42 | 70.91 | 2082.06 | 1352.81 | 95.23 |
| 12331 | 594.25 | 155.97 | 254.07 | 138.26 | 94.96 |
| 17734 | 119.63 | 75.92 | 566.88 | 280.56 | 94.84 |
| 23579 | 734.95 | 158.66 | 430.76 | 80.03 | 94.78 |
| 23983 | 544.27 | 150.95 | 220.82 | 131.74 | 94.48 |
| 14138 | 84.72 | 29.10 | 33.29 | 12.42 | 94.31 |
| 16518 | 826.45 | 273.09 | 2395.53 | 930.51 | 94.24 |
| 17635 | 651.30 | 148.78 | 358.62 | 92.32 | 93.79 |
| 7196 | 178.22 | 77.07 | 494.09 | 205.98 | 93.68 |
| 15850 | 1203.52 | 323.32 | 2507.97 | 545.30 | 93.68 |
| 24235 | 433.60 | 163.10 | 1038.60 | 349.80 | 93.55 |
| 21445 | 2.08 | 22.76 | 30.67 | 12.91 | 93.51 |
| 24649 | 122.93 | 28.55 | 76.77 | 12.19 | 93.49 |
| 5867 | 166.42 | 48.13 | 259.79 | 50.17 | 93.49 |
| 3348 | 497.46 | 129.58 | 259.25 | 78.88 | 93.45 |
| 15848 | 1313.68 | 402.72 | 2886.50 | 676.70 | 93.42 |
| 19768 | 706.30 | 166.91 | 1328.43 | 290.35 | 93.42 |
| 17161 | 1144.51 | 381.55 | 2737.15 | 723.56 | 93.33 |
| 1004 | 108.90 | 32.28 | 56.68 | 10.23 | 92.84 |
| 15190 | 1789.26 | 1124.32 | 5409.42 | 1117.57 | 92.73 |
| 14595 | 89.23 | 36.64 | 26.57 | 16.82 | 92.67 |
| 15189 | 1722.10 | 1120.12 | 5391.29 | 1462.09 | 92.60 |
| 15300 | 135.69 | 130.01 | 397.39 | 125.33 | 92.60 |
| 23314 | 67.33 | 271.41 | 622.50 | 259.52 | 92.43 |
| 15301 | 37.59 | 67.32 | 147.90 | 49.32 | 92.39 |
| 18944 | 202.65 | 68.48 | 458.00 | 181.57 | 92.30 |

TABLE 5V-continued

Atty. Docket No. 44921-5089US
Doc. No. 1803440.1

MERCURIC CHLORIDE
Timepoint(s): 3, 6, 24 hrs

| Identifier | NonToxMean | NonToxSD | ToxMean | ToxSD | LDAScore |
|---|---|---|---|---|---|
| 6054 | 27.38 | 53.50 | 71.68 | 29.34 | 92.26 |
| 13642 | 209.02 | 74.04 | 85.92 | 29.90 | 92.24 |
| 23230 | 378.13 | 96.00 | 695.07 | 177.40 | 92.17 |
| 17211 | 1433.79 | 549.05 | 2360.95 | 279.33 | 91.85 |
| 3493 | 58.50 | 20.07 | 107.74 | 26.19 | 91.82 |
| 23825 | 283.86 | 49.04 | 166.00 | 50.35 | 91.78 |
| 18564 | 219.22 | 49.05 | 95.46 | 32.77 | 91.74 |
| 11680 | 360.19 | 81.92 | 233.52 | 34.79 | 91.68 |
| 17765 | 1277.82 | 438.77 | 2585.84 | 579.12 | 91.65 |
| 16982 | 138.22 | 290.89 | 380.00 | 223.17 | 91.57 |
| 13610 | 357.65 | 69.18 | 196.18 | 80.11 | 91.26 |
| 21993 | 76.47 | 25.96 | 129.83 | 18.36 | 91.26 |
| 8927 | 745.07 | 166.28 | 377.77 | 106.17 | 91.01 |
| 11871 | 55.24 | 129.01 | 197.33 | 57.60 | 90.90 |
| 11050 | 670.06 | 136.16 | 972.43 | 147.61 | 90.88 |
| 13507 | 422.59 | 99.12 | 659.30 | 138.95 | 90.83 |
| 9271 | 102.44 | 54.22 | 21.68 | 25.82 | 90.82 |
| 19031 | 59.98 | 47.58 | 145.41 | 39.97 | 90.79 |
| 24577 | 1168.59 | 364.98 | 2135.75 | 393.09 | 90.79 |
| 10182 | 2.45 | 99.29 | 78.59 | 59.67 | 90.75 |
| 18300 | 451.47 | 147.74 | 136.58 | 90.13 | 90.75 |
| 18259 | 207.76 | 78.23 | 1353.31 | 770.76 | 90.72 |
| 1928 | 485.55 | 106.87 | 208.21 | 110.11 | 90.66 |
| 6632 | 171.87 | 58.89 | 288.22 | 64.66 | 90.53 |
| 13611 | 273.95 | 107.44 | 57.12 | 66.20 | 90.45 |
| 25098 | 43.26 | 30.01 | 276.68 | 179.66 | 90.37 |
| 22539 | 71.67 | 46.78 | −27.28 | 37.71 | 90.36 |
| 20945 | 897.15 | 248.57 | 1469.22 | 277.42 | 90.32 |
| 19678 | 110.11 | 57.05 | −19.38 | 53.40 | 90.32 |
| 23567 | 52.11 | 60.74 | 235.62 | 105.54 | 90.29 |
| 23868 | 159.82 | 189.43 | 1997.17 | 1212.75 | 90.24 |
| 812 | 157.29 | 34.98 | 83.70 | 36.70 | 90.19 |
| 23872 | 44.34 | 60.45 | 587.85 | 460.34 | 90.16 |
| 21372 | 276.72 | 65.43 | 134.32 | 44.54 | 90.10 |
| 18611 | 1409.94 | 446.15 | 2438.75 | 459.58 | 90.10 |
| 21306 | 126.88 | 54.43 | 52.78 | 18.76 | 90.09 |
| 3808 | 166.04 | 48.80 | 407.80 | 212.39 | 90.07 |
| 12031 | 145.86 | 38.78 | 225.16 | 30.38 | 90.06 |
| 23869 | 36.50 | 52.75 | 579.45 | 394.24 | 90.03 |
| 3015 | 2289.41 | 964.34 | 4534.92 | 1150.81 | 89.97 |
| 17908 | 60.79 | 49.95 | 325.35 | 238.47 | 89.90 |
| 25539 | 125.13 | 35.09 | 45.76 | 23.16 | 89.89 |
| 3473 | 120.74 | 34.02 | 69.52 | 20.97 | 89.83 |
| 2536 | 397.05 | 123.98 | 201.50 | 73.82 | 89.83 |
| 23826 | 344.12 | 55.78 | 225.14 | 47.99 | 89.80 |
| 9114 | 870.77 | 222.15 | 416.13 | 221.53 | 89.80 |
| 1639 | 97.37 | 22.99 | 62.34 | 12.37 | 89.70 |
| 20920 | 617.66 | 155.43 | 1397.16 | 623.36 | 89.60 |
| 20350 | 156.72 | 49.50 | 53.00 | 45.87 | 89.58 |
| 6615 | 279.24 | 84.15 | 96.62 | 96.14 | 89.50 |
| 19952 | 67.58 | 24.21 | 24.03 | 11.92 | 89.41 |
| 8237 | 102.59 | 36.73 | 179.81 | 51.98 | 89.37 |
| 11841 | 886.79 | 192.06 | 1632.36 | 479.53 | 89.34 |
| 2310 | −47.82 | 40.85 | 36.34 | 37.62 | 89.32 |
| 15796 | 337.30 | 87.85 | 156.28 | 76.95 | 89.24 |
| 22681 | 216.80 | 177.12 | 918.02 | 459.53 | 89.21 |
| 22543 | 694.25 | 216.61 | 217.39 | 263.73 | 89.20 |
| 19433 | 110.25 | 59.85 | 445.41 | 230.04 | 89.17 |
| 22540 | 1828.95 | 538.43 | 794.41 | 586.09 | 89.07 |
| 17473 | 421.95 | 90.69 | 764.49 | 230.12 | 89.04 |
| 15875 | 1177.56 | 384.90 | 1982.41 | 472.79 | 88.98 |
| 18396 | 74.08 | 26.23 | 124.23 | 18.90 | 88.94 |
| 19 | 336.88 | 73.75 | 628.54 | 175.62 | 88.82 |
| 25567 | 456.18 | 167.99 | 922.98 | 373.29 | 88.65 |
| 20728 | 538.10 | 99.95 | 327.92 | 109.45 | 88.59 |
| 24351 | −2.24 | 8.36 | 22.30 | 16.23 | 88.56 |
| 9053 | 240.22 | 50.14 | 146.06 | 39.78 | 88.55 |
| 18305 | 1364.98 | 457.67 | 2297.19 | 462.10 | 88.51 |

TABLE 5W

Atty. Docket No. 44921-5089US
Doc. No. 1803440.1

PAMIDRONATE
Timepoints(s): 24 hrs

| Identifier | NonToxMean | NonToxSD | ToxMean | ToxSD | LDAScore |
|---|---|---|---|---|---|
| 439 | 55.65 | 23.09 | 35.13 | 0.15 | 99.49 |
| 381 | 23.05 | 20.96 | 4.85 | 0.20 | 98.80 |
| 1439 | 233.12 | 46.90 | 167.13 | 1.64 | 98.63 |
| 24501 | 526.65 | 117.76 | 477.38 | 1.09 | 98.50 |
| 815 | 1161.46 | 344.32 | 1840.91 | 46.72 | 98.50 |
| 21723 | 24.61 | 15.80 | 18.81 | 0.26 | 98.37 |
| 25907 | 19.98 | 25.22 | 27.99 | 0.55 | 98.33 |
| 4440 | 320.37 | 110.50 | 249.77 | 1.69 | 98.33 |
| 8950 | 91.09 | 33.83 | 64.54 | 0.45 | 98.29 |
| 1145 | 59.20 | 26.43 | 36.98 | 0.67 | 98.25 |
| 20257 | 130.93 | 45.11 | 78.91 | 1.23 | 98.20 |
| 12781 | 189.97 | 49.11 | 273.46 | 3.66 | 98.12 |
| 20427 | 796.69 | 192.75 | 1119.78 | 17.38 | 97.90 |
| 16938 | 1322.80 | 411.98 | 1887.43 | 31.46 | 97.90 |
| 1324 | 63.66 | 31.18 | 28.89 | 2.88 | 97.82 |
| 16584 | 115.91 | 45.04 | 161.39 | 2.19 | 97.73 |
| 17102 | 47.91 | 18.57 | 30.16 | 0.64 | 97.73 |
| 10227 | 447.34 | 108.01 | 244.96 | 13.58 | 97.69 |
| 1310 | 152.06 | 33.32 | 86.35 | 7.14 | 97.69 |
| 8476 | 3812.40 | 1012.46 | 4862.16 | 57.22 | 97.65 |
| 22051 | 151.18 | 44.26 | 223.47 | 4.06 | 97.65 |
| 5049 | 297.65 | 66.21 | 180.38 | 7.11 | 97.60 |
| 16323 | 68.35 | 35.92 | 36.63 | 1.47 | 97.56 |
| 6654 | 166.71 | 45.74 | 158.83 | 0.92 | 97.43 |
| 1651 | 878.67 | 240.75 | 692.24 | 5.18 | 97.39 |
| 16192 | 41.41 | 14.72 | 34.35 | 0.38 | 97.31 |
| 12343 | 50.68 | 18.55 | 31.84 | 0.83 | 97.31 |
| 691 | 133.51 | 42.32 | 62.52 | 3.81 | 97.26 |
| 17635 | 648.73 | 151.15 | 484.36 | 6.12 | 97.22 |
| 9286 | 205.78 | 60.59 | 319.19 | 10.41 | 97.22 |
| 14800 | 36.39 | 23.63 | 34.69 | 0.41 | 97.22 |
| 23888 | 105.90 | 50.58 | 91.90 | 1.08 | 97.13 |
| 5969 | 1521.63 | 357.02 | 1485.82 | 9.84 | 97.13 |
| 3475 | 384.13 | 98.77 | 465.98 | 4.26 | 97.05 |
| 11174 | 54.15 | 51.85 | 121.54 | 7.12 | 97.01 |
| 26119 | 124.47 | 45.67 | 234.96 | 195.06 | 97.01 |
| 18250 | 1094.73 | 316.96 | 1382.93 | 14.86 | 96.96 |
| 25069 | 133.97 | 60.97 | 77.32 | 2.29 | 96.88 |
| 18135 | 133.61 | 28.59 | 96.51 | 1.97 | 96.88 |
| 21742 | 33.31 | 18.06 | 25.78 | 0.33 | 96.83 |
| 25702 | 579.55 | 128.85 | 805.98 | 44.29 | 96.79 |
| 10936 | 207.62 | 43.60 | 191.02 | 1.12 | 96.79 |
| 12342 | 96.27 | 49.48 | 87.13 | 1.04 | 96.75 |
| 19976 | 47.03 | 15.83 | 30.77 | 0.70 | 96.75 |
| 9620 | 530.95 | 116.93 | 770.14 | 47.74 | 96.71 |
| 20810 | 1262.30 | 404.25 | 1842.66 | 50.26 | 96.71 |
| 24721 | 203.81 | 53.70 | 187.98 | 1.38 | 96.71 |
| 14967 | 49.34 | 21.65 | 19.69 | 1.41 | 96.58 |
| 1309 | 43.01 | 16.54 | 30.28 | 0.59 | 96.54 |
| 730 | 112.34 | 33.32 | 65.78 | 2.57 | 96.49 |
| 15876 | 1174.15 | 310.95 | 1565.93 | 37.98 | 96.49 |
| 16482 | 195.58 | 40.06 | 132.17 | 5.76 | 96.45 |
| 5654 | 41.42 | 24.77 | 86.94 | 5.20 | 96.45 |
| 15850 | 1216.75 | 351.89 | 1264.63 | 16.42 | 96.45 |
| 4259 | 700.70 | 159.00 | 935.48 | 29.71 | 96.36 |
| 7010 | 309.13 | 55.63 | 255.94 | 3.25 | 96.36 |
| 18880 | 36.99 | 12.90 | 31.14 | 0.58 | 96.32 |
| 3007 | 126.64 | 42.37 | 192.91 | 7.32 | 96.28 |
| 1375 | 84.74 | 20.63 | 55.45 | 2.98 | 96.28 |
| 19244 | 1227.03 | 383.14 | 1715.96 | 64.01 | 96.28 |
| 6595 | 76.76 | 35.41 | 102.22 | 2.83 | 96.19 |
| 18126 | 701.66 | 166.62 | 548.76 | 14.64 | 96.19 |
| 10869 | 11.30 | 60.29 | 123.29 | 15.83 | 96.15 |
| 15239 | 567.46 | 132.45 | 783.53 | 43.73 | 96.11 |
| 4241 | 114.51 | 43.66 | 203.36 | 162.90 | 96.11 |
| 12360 | 55.02 | 27.32 | 35.03 | 1.44 | 96.11 |
| 11687 | 25.88 | 23.50 | 35.95 | 1.69 | 96.11 |
| 5492 | 97.03 | 47.49 | 24.35 | 5.81 | 96.11 |
| 9671 | 124.41 | 52.83 | 135.25 | 1.91 | 96.11 |
| 9410 | 62.57 | 24.27 | 60.98 | 0.84 | 95.98 |
| 13105 | 64.62 | 26.94 | 43.02 | 1.19 | 95.98 |

TABLE 5W-continued

Atty. Docket No. 44921-5089US
Doc. No. 1803440.1

PAMIDRONATE
Timepoints(s): 24 hrs

| Identifier | NonToxMean | NonToxSD | ToxMean | ToxSD | LDAScore |
|---|---|---|---|---|---|
| 10659 | 132.22 | 90.74 | 258.54 | 43.13 | 95.94 |
| 106 | 59.79 | 20.18 | 35.91 | 1.62 | 95.89 |
| 2697 | 1226.39 | 358.41 | 1822.86 | 80.35 | 95.85 |
| 10217 | 310.63 | 90.28 | 201.72 | 7.38 | 95.85 |
| 22658 | 275.00 | 67.48 | 237.14 | 2.73 | 95.85 |
| 3417 | 445.05 | 113.12 | 533.98 | 7.67 | 95.81 |
| 15446 | 369.04 | 93.58 | 428.95 | 2.94 | 95.81 |
| 2847 | 62.77 | 31.28 | 81.96 | 1.81 | 95.81 |
| 2469 | 1383.42 | 482.22 | 963.09 | 26.57 | 95.81 |
| 17175 | 619.05 | 156.40 | 867.90 | 59.01 | 95.77 |
| 4386 | 56.38 | 26.60 | 45.57 | 0.72 | 95.77 |
| 21491 | 110.61 | 27.92 | 90.43 | 1.09 | 95.77 |
| 20844 | 843.25 | 294.01 | 1309.53 | 64.24 | 95.72 |
| 9370 | 773.72 | 201.87 | 676.25 | 8.78 | 95.72 |
| 15130 | 274.69 | 83.28 | 262.79 | 4.56 | 95.64 |

TABLE 5X

Atty. Docket No. 44921-5089US
Doc. No. 1803440.1

PAN
Timepoint(s): 168 hrs

| Identifier | NonToxMean | NonToxSD | ToxMean | ToxSD | LDAScore |
|---|---|---|---|---|---|
| 6100 | −24.28 | 62.27 | 70.39 | 19.04 | 99.79 |
| 2048 | 31.63 | 20.68 | 119.91 | 5.57 | 99.79 |
| 24024 | 32.82 | 21.87 | 144.74 | 15.76 | 99.79 |
| 14722 | 658.73 | 219.20 | 1717.84 | 115.16 | 99.74 |
| 21651 | 31.52 | 24.04 | 198.29 | 19.08 | 99.74 |
| 15401 | 75.65 | 26.38 | 220.16 | 14.55 | 99.70 |
| 15503 | 124.16 | 37.19 | 305.20 | 27.55 | 99.70 |
| 7090 | 16.70 | 14.04 | 114.99 | 16.69 | 99.70 |
| 10893 | −30.66 | 62.67 | 46.11 | 19.29 | 99.70 |
| 23780 | 24.98 | 35.81 | 102.35 | 16.07 | 99.66 |
| 16726 | 944.95 | 205.53 | 460.40 | 16.03 | 99.61 |
| 14430 | 33.41 | 27.29 | 289.53 | 65.58 | 99.61 |
| 15434 | 132.29 | 53.11 | 374.76 | 31.01 | 99.53 |
| 17198 | 812.71 | 267.14 | 249.19 | 36.68 | 99.53 |
| 15437 | 38.33 | 22.07 | 168.45 | 19.74 | 99.53 |
| 225 | 123.21 | 34.21 | 276.57 | 21.70 | 99.49 |
| 3584 | 64.34 | 31.89 | 290.58 | 28.71 | 99.49 |
| 9084 | 46.92 | 17.70 | 134.77 | 13.50 | 99.49 |
| 20736 | 331.77 | 100.84 | 748.89 | 43.21 | 99.49 |
| 19374 | −8.73 | 12.21 | 63.84 | 14.49 | 99.44 |
| 20699 | 94.34 | 231.80 | 255.20 | 18.42 | 99.44 |
| 22816 | 23.08 | 15.16 | 83.31 | 4.90 | 99.44 |
| 23297 | 384.07 | 96.58 | 840.46 | 53.16 | 99.44 |
| 15002 | 140.16 | 98.17 | 338.90 | 19.21 | 99.44 |
| 3269 | 75.61 | 36.41 | 365.17 | 72.48 | 99.44 |
| 23773 | 212.24 | 81.04 | 629.63 | 48.29 | 99.40 |
| 23992 | 5.27 | 6.59 | 56.95 | 14.22 | 99.36 |
| 17682 | 673.28 | 176.72 | 223.65 | 27.55 | 99.36 |
| 3079 | 34.49 | 46.53 | 164.24 | 20.61 | 99.36 |
| 23778 | 68.50 | 31.99 | 270.34 | 37.08 | 99.36 |
| 19006 | 642.56 | 208.65 | 1445.68 | 75.63 | 99.31 |
| 20887 | 793.69 | 313.68 | 218.40 | 48.36 | 99.31 |
| 6039 | 310.04 | 86.04 | 693.54 | 28.37 | 99.27 |
| 15003 | 35.50 | 95.84 | 254.52 | 23.59 | 99.27 |
| 17227 | 873.36 | 191.79 | 476.74 | 33.25 | 99.27 |
| 1801 | 97.51 | 29.11 | 207.98 | 12.46 | 99.27 |
| 10015 | 231.53 | 75.18 | 560.75 | 25.13 | 99.27 |
| 12683 | 60.85 | 40.62 | 505.60 | 124.63 | 99.23 |
| 16675 | 33.50 | 33.48 | 151.49 | 16.04 | 99.23 |
| 1809 | 36.19 | 128.09 | 267.84 | 32.82 | 99.23 |
| 15981 | 75.09 | 25.95 | 290.62 | 83.27 | 99.23 |
| 2637 | 124.84 | 42.73 | 270.38 | 22.27 | 99.23 |

TABLE 5X-continued

Atty. Docket No. 44921-5089US
Doc. No. 1803440.1

PAN
Timepoint(s): 168 hrs

| Identifier | NonToxMean | NonToxSD | ToxMean | ToxSD | LDAScore |
|---|---|---|---|---|---|
| 2284 | 99.14 | 37.28 | 252.45 | 25.44 | 99.23 |
| 11338 | 39.20 | 31.91 | 342.99 | 92.86 | 99.19 |
| 16425 | 19.78 | 26.43 | 256.34 | 69.36 | 99.19 |
| 9212 | 1017.57 | 301.78 | 2309.86 | 189.18 | 99.19 |
| 13977 | 281.63 | 142.69 | 1144.78 | 134.21 | 99.19 |
| 3572 | 33.77 | 17.83 | 169.37 | 47.47 | 99.19 |
| 22079 | 78.37 | 356.23 | 216.47 | 49.64 | 99.19 |
| 13974 | 298.69 | 149.15 | 842.98 | 65.09 | 99.19 |
| 24564 | 568.47 | 175.61 | 176.63 | 24.26 | 99.14 |
| 18603 | −45.88 | 67.13 | 192.24 | 18.99 | 99.14 |
| 2010 | 33.66 | 315.34 | 180.93 | 36.19 | 99.14 |
| 17501 | 31.72 | 17.98 | 94.02 | 6.17 | 99.14 |
| 23376 | 14.35 | 15.90 | 95.17 | 30.08 | 99.14 |
| 6517 | 231.39 | 155.95 | 730.29 | 101.68 | 99.14 |
| 20599 | 22.90 | 12.70 | 74.26 | 5.67 | 99.14 |
| 23377 | 61.42 | 52.07 | 359.41 | 62.64 | 99.14 |
| 14405 | 459.81 | 287.63 | 2264.76 | 369.05 | 99.14 |
| 1564 | 38.78 | 169.92 | 459.31 | 64.11 | 99.10 |
| 16676 | 38.17 | 26.57 | 134.01 | 11.56 | 99.10 |
| 21695 | 59.83 | 35.43 | 188.55 | 18.05 | 99.10 |
| 20886 | 719.56 | 292.49 | 116.56 | 44.10 | 99.10 |
| 17151 | 16.05 | 62.27 | 445.34 | 138.38 | 99.06 |
| 770 | 798.22 | 219.65 | 310.69 | 35.90 | 99.06 |
| 7262 | 1116.47 | 390.83 | 2517.22 | 160.89 | 99.06 |
| 23981 | 809.28 | 155.43 | 1417.26 | 153.29 | 99.06 |
| 22552 | 314.65 | 94.11 | 570.75 | 29.08 | 99.06 |
| 20709 | 162.15 | 69.62 | 483.04 | 60.17 | 99.06 |
| 7585 | −91.46 | 37.80 | 142.97 | 84.57 | 99.01 |
| 15853 | 5.82 | 59.90 | 258.64 | 131.89 | 99.01 |
| 22592 | 233.64 | 160.86 | 1028.66 | 111.76 | 98.97 |
| 4445 | 514.32 | 117.31 | 988.03 | 63.78 | 98.97 |
| 4086 | 14.01 | 16.98 | 152.91 | 75.32 | 98.97 |
| 21509 | 88.80 | 92.91 | 448.20 | 56.16 | 98.97 |
| 24651 | 100.64 | 23.29 | 204.63 | 19.93 | 98.97 |
| 7101 | 389.56 | 671.41 | 1218.47 | 165.33 | 98.93 |
| 15851 | 200.60 | 148.70 | 784.83 | 83.88 | 98.93 |
| 23769 | −6.25 | 8.68 | 29.51 | 10.78 | 98.93 |
| 15504 | 128.87 | 50.45 | 417.46 | 77.64 | 98.93 |
| 1613 | −7.12 | 28.04 | 117.88 | 29.33 | 98.93 |
| 15438 | 65.66 | 32.54 | 171.12 | 14.45 | 98.93 |
| 1460 | 198.26 | 83.19 | 563.02 | 70.47 | 98.93 |
| 13976 | 449.17 | 351.62 | 2551.95 | 498.75 | 98.93 |
| 20903 | 69.41 | 42.80 | 397.90 | 116.45 | 98.89 |
| 23123 | 310.66 | 118.21 | 861.54 | 70.50 | 98.89 |
| 15790 | 45.93 | 25.16 | 134.46 | 10.51 | 98.89 |
| 21391 | 213.21 | 127.55 | 742.74 | 58.03 | 98.89 |
| 455 | 137.60 | 153.63 | 269.32 | 29.16 | 98.89 |
| 20772 | 149.52 | 40.53 | 313.83 | 28.96 | 98.89 |
| 19275 | 726.18 | 191.87 | 1580.61 | 140.07 | 98.84 |
| 17149 | 81.87 | 40.60 | 328.14 | 60.26 | 98.84 |
| 19243 | 76.71 | 48.71 | 359.48 | 105.52 | 98.84 |
| 17197 | 1903.25 | 828.79 | 668.38 | 83.11 | 98.84 |
| 11891 | −15.63 | 11.78 | 25.77 | 9.49 | 98.84 |
| 4640 | 80.30 | 30.25 | 184.62 | 15.77 | 98.80 |
| 4569 | 0.89 | 6.39 | 34.18 | 10.37 | 98.80 |
| 2629 | 25.55 | 23.81 | 70.08 | 4.98 | 98.80 |
| 18529 | 202.36 | 80.95 | 572.14 | 48.95 | 98.80 |

TABLE 5Y

PAN  
Timepoint(s): 6, 24 hrs

| Identifier | NonToxMean | NonToxSD | ToxMean | ToxSD | LDAScore |
|---|---|---|---|---|---|
| 410 | 1099.85 | 252.82 | 487.89 | 71.66 | 99.01 |
| 1137 | 58.38 | 18.64 | 128.72 | 40.53 | 97.55 |
| 18322 | 2669.23 | 812.57 | 1422.54 | 109.34 | 97.47 |
| 15433 | 67.21 | 32.38 | 147.81 | 13.69 | 97.04 |
| 8990 | 278.32 | 77.85 | 504.55 | 67.10 | 96.35 |
| 23115 | 565.35 | 169.43 | 1013.53 | 113.02 | 96.22 |
| 1460 | 199.21 | 86.34 | 300.32 | 24.45 | 95.97 |
| 335 | 96.10 | 45.37 | 194.53 | 15.33 | 95.92 |
| 2866 | 637.05 | 212.44 | 1020.97 | 43.03 | 95.75 |
| 15701 | 37.69 | 16.68 | 82.72 | 11.76 | 95.75 |
| 16853 | 67.54 | 23.29 | 107.06 | 8.27 | 95.58 |
| 17693 | 1257.20 | 377.49 | 705.99 | 42.86 | 95.41 |
| 6250 | 490.36 | 103.66 | 731.52 | 54.23 | 95.36 |
| 19327 | 89.22 | 29.33 | 144.42 | 10.71 | 95.28 |
| 21977 | 88.79 | 52.26 | 163.28 | 17.00 | 95.11 |
| 1962 | 33.32 | 26.88 | 74.11 | 7.81 | 95.06 |
| 19080 | 75.82 | 57.08 | 219.58 | 56.51 | 95.06 |
| 13598 | 349.80 | 109.75 | 578.05 | 60.94 | 95.02 |
| 11524 | −14.25 | 24.65 | 43.36 | 19.72 | 95.02 |
| 729 | 90.40 | 35.70 | 171.30 | 19.74 | 94.98 |
| 15552 | 175.81 | 40.06 | 237.25 | 9.67 | 94.98 |
| 4312 | 77.28 | 38.83 | 150.22 | 19.98 | 94.94 |
| 18996 | 137.86 | 44.69 | 250.58 | 35.37 | 94.85 |
| 17411 | 79.24 | 54.48 | 184.11 | 25.15 | 94.76 |
| 20752 | 13.07 | 11.34 | 26.51 | 2.40 | 94.76 |
| 11445 | 436.52 | 103.96 | 686.40 | 101.03 | 94.42 |
| 17755 | 393.23 | 102.51 | 214.27 | 40.93 | 94.42 |
| 19077 | 208.94 | 51.22 | 306.89 | 24.65 | 94.25 |
| 21355 | 375.05 | 118.77 | 619.86 | 88.05 | 94.21 |
| 6454 | 239.78 | 78.25 | 421.17 | 60.75 | 94.16 |
| 21092 | 392.44 | 225.02 | 575.95 | 55.98 | 94.12 |
| 11618 | 414.89 | 130.79 | 694.32 | 108.18 | 94.03 |
| 18338 | 72.29 | 20.32 | 112.46 | 9.87 | 94.03 |
| 15050 | 637.68 | 181.55 | 464.30 | 24.18 | 94.03 |
| 1608 | 12.70 | 29.99 | 54.74 | 9.39 | 93.99 |
| 24539 | 613.90 | 163.40 | 344.65 | 53.69 | 93.99 |
| 5900 | 265.48 | 65.87 | 137.54 | 40.46 | 93.99 |
| 13239 | 109.63 | 48.60 | 209.05 | 26.39 | 93.99 |
| 5163 | 20.12 | 13.08 | 44.33 | 7.38 | 93.82 |
| 21130 | 78.12 | 26.32 | 110.79 | 5.99 | 93.73 |
| 2236 | 140.10 | 38.70 | 215.23 | 16.78 | 93.69 |
| 5967 | 1225.74 | 339.49 | 1876.92 | 202.57 | 93.65 |
| 9799 | 145.09 | 50.35 | 241.50 | 35.40 | 93.56 |
| 16205 | 940.52 | 264.48 | 668.73 | 24.99 | 93.56 |
| 456 | 869.99 | 317.52 | 515.38 | 44.20 | 93.56 |
| 25097 | 4.68 | 10.99 | 25.79 | 8.52 | 93.52 |
| 12020 | 167.47 | 60.50 | 285.05 | 31.13 | 93.52 |
| 5924 | 162.21 | 46.91 | 256.59 | 29.67 | 93.52 |
| 4716 | 156.93 | 40.11 | 238.10 | 25.26 | 93.48 |
| 8339 | 432.55 | 130.90 | 704.91 | 90.15 | 93.43 |
| 5561 | 167.91 | 55.87 | 283.83 | 41.10 | 93.39 |
| 15112 | 1549.68 | 531.98 | 736.99 | 111.89 | 93.39 |
| 7278 | 1467.27 | 341.78 | 1077.40 | 67.94 | 93.35 |
| 7108 | 53.62 | 29.56 | 116.16 | 20.84 | 93.30 |
| 4956 | 79.01 | 38.21 | 153.60 | 24.20 | 93.30 |
| 20404 | 53.75 | 46.18 | 126.25 | 22.59 | 93.26 |
| 6049 | 621.00 | 123.14 | 541.13 | 9.05 | 93.22 |
| 9109 | 1021.28 | 337.87 | 723.36 | 26.27 | 93.22 |
| 4393 | 1268.21 | 369.74 | 824.30 | 42.57 | 93.18 |
| 18541 | 1081.46 | 298.74 | 758.66 | 24.93 | 93.13 |
| 15556 | 208.38 | 83.99 | 333.56 | 45.17 | 93.09 |
| 4589 | 1213.38 | 369.83 | 790.80 | 42.48 | 93.09 |
| 22271 | 273.68 | 65.98 | 411.42 | 75.15 | 93.05 |
| 21423 | 1355.28 | 427.17 | 786.98 | 56.19 | 93.05 |
| 6506 | 234.14 | 60.71 | 335.18 | 21.90 | 93.05 |
| 4290 | 94.34 | 28.53 | 147.53 | 19.36 | 93.05 |
| 20350 | 155.10 | 50.13 | 248.15 | 31.72 | 93.05 |
| 714 | 46.67 | 31.34 | 115.67 | 27.05 | 93.05 |
| 1485 | 93.58 | 57.35 | 198.96 | 32.55 | 93.00 |
| 18433 | 19.39 | 46.95 | 105.10 | 24.21 | 93.00 |
| 17567 | 1185.38 | 364.09 | 750.70 | 33.02 | 93.00 |

TABLE 5Y-continued

PAN  
Timepoint(s): 6, 24 hrs

| Identifier | NonToxMean | NonToxSD | ToxMean | ToxSD | LDAScore |
|---|---|---|---|---|---|
| 24615 | 817.72 | 230.83 | 583.06 | 24.71 | 92.96 |
| 15742 | 33.17 | 14.60 | 56.07 | 3.60 | 92.96 |
| 20766 | 56.29 | 20.07 | 93.49 | 10.52 | 92.92 |
| 15209 | 164.94 | 33.20 | 220.88 | 12.45 | 92.92 |
| 20879 | 87.79 | 50.58 | 180.08 | 38.06 | 92.88 |
| 19408 | 2011.27 | 675.11 | 1014.96 | 97.93 | 92.88 |
| 1247 | 1309.18 | 501.52 | 569.36 | 138.91 | 92.83 |
| 15299 | 88.50 | 61.88 | 119.48 | 12.69 | 92.83 |
| 11377 | 116.76 | 30.96 | 177.28 | 17.37 | 92.79 |
| 9037 | 22.39 | 16.20 | 56.28 | 11.77 | 92.79 |
| 24390 | 162.85 | 113.82 | 331.70 | 49.97 | 92.79 |
| 1550 | 30.09 | 69.61 | 60.64 | 8.26 | 92.79 |
| 1300 | 156.68 | 44.76 | 234.60 | 19.19 | 92.75 |
| 1585 | 67.71 | 33.38 | 128.60 | 16.01 | 92.70 |
| 25599 | 56.14 | 20.41 | 91.99 | 8.79 | 92.66 |
| 17524 | 1173.79 | 285.74 | 801.36 | 115.86 | 92.62 |
| 15122 | 420.86 | 89.65 | 588.05 | 45.81 | 92.58 |
| 25369 | 18.36 | 10.68 | 38.74 | 6.19 | 92.58 |
| 3886 | 58.10 | 28.84 | 117.74 | 22.59 | 92.53 |
| 643 | 61.37 | 32.91 | 119.52 | 18.91 | 92.53 |
| 14003 | 815.86 | 212.90 | 497.74 | 73.28 | 92.49 |
| 16164 | 1083.28 | 283.92 | 680.99 | 54.84 | 92.49 |
| 20864 | 1587.98 | 660.11 | 798.40 | 87.84 | 92.45 |
| 17742 | 1066.26 | 308.06 | 723.12 | 37.02 | 92.45 |
| 23248 | 37.67 | 17.23 | 53.27 | 3.03 | 92.45 |
| 17204 | 1732.06 | 656.42 | 888.59 | 86.53 | 92.45 |
| 24501 | 525.70 | 117.48 | 664.66 | 34.25 | 92.40 |
| 14125 | 128.41 | 50.32 | 217.38 | 25.88 | 92.36 |
| 5968 | 962.02 | 263.60 | 1474.27 | 231.26 | 92.36 |

TABLE 5Z

PAN  
Timepoint(s): 6, 24, 168 hrs

| Identifier | NonToxMean | NonToxSD | ToxMean | ToxSD | LDAScore |
|---|---|---|---|---|---|
| 15433 | 66.69 | 31.46 | 164.15 | 24.65 | 97.20 |
| 1962 | 33.08 | 26.68 | 80.19 | 11.69 | 95.26 |
| 16122 | 116.83 | 40.09 | 224.79 | 57.88 | 94.96 |
| 1247 | 1312.82 | 499.50 | 526.34 | 127.30 | 94.87 |
| 16853 | 67.23 | 22.82 | 120.51 | 22.86 | 94.83 |
| 17693 | 1260.09 | 375.71 | 656.50 | 74.07 | 94.78 |
| 13239 | 108.92 | 47.30 | 236.00 | 58.32 | 94.57 |
| 15112 | 1553.39 | 530.07 | 717.14 | 110.65 | 94.35 |
| 18433 | 18.80 | 46.13 | 126.18 | 39.27 | 94.35 |
| 16121 | 109.21 | 58.36 | 264.16 | 84.47 | 94.18 |
| 15701 | 37.56 | 16.60 | 76.48 | 12.40 | 94.05 |
| 19077 | 208.57 | 51.01 | 301.25 | 21.97 | 94.01 |
| 4723 | 1721.81 | 624.78 | 922.60 | 68.61 | 93.58 |
| 25097 | 4.60 | 10.95 | 24.13 | 7.34 | 93.23 |
| 7278 | 1469.82 | 340.27 | 993.59 | 122.75 | 93.23 |
| 1159 | 888.08 | 229.69 | 532.18 | 82.33 | 93.19 |
| 15184 | −80.88 | 50.16 | 76.70 | 82.34 | 93.07 |
| 456 | 871.69 | 317.12 | 499.51 | 56.17 | 92.97 |
| 1608 | 12.56 | 29.97 | 50.60 | 9.98 | 92.93 |
| 15437 | 38.06 | 21.84 | 118.82 | 46.29 | 92.69 |
| 225 | 122.71 | 33.55 | 235.76 | 49.22 | 92.51 |
| 14997 | 2605.00 | 1019.08 | 1218.22 | 195.95 | 92.46 |
| 15401 | 75.23 | 25.84 | 175.78 | 44.88 | 92.39 |
| 19408 | 2015.21 | 673.87 | 1049.53 | 100.77 | 92.20 |
| 18076 | 2552.08 | 1185.85 | 1116.73 | 165.36 | 91.90 |
| 18077 | 2630.74 | 1183.04 | 1067.76 | 130.98 | 91.72 |
| 15434 | 131.68 | 52.58 | 292.95 | 80.76 | 91.61 |

TABLE 5Z-continued

Atty. Docket No. 44921-5089US
Doc. No. 1803440.1

PAN
Timepoint(s): 6, 24, 168 hrs

| Identifier | NonToxMean | NonToxSD | ToxMean | ToxSD | LDAScore |
|---|---|---|---|---|---|
| 16211 | 2268.34 | 1131.65 | 761.93 | 145.25 | 91.51 |
| 11208 | 322.94 | 110.75 | 642.67 | 141.37 | 91.48 |
| 24651 | 100.37 | 23.09 | 169.86 | 33.73 | 91.48 |
| 16012 | 72.52 | 31.21 | 141.73 | 32.89 | 91.35 |
| 1542 | 928.57 | 263.76 | 548.27 | 84.14 | 91.34 |
| 14722 | 656.51 | 217.90 | 1314.74 | 367.97 | 91.31 |
| 4589 | 1215.64 | 368.99 | 748.52 | 72.66 | 91.21 |
| 17886 | 1506.14 | 491.91 | 843.64 | 96.88 | 91.16 |
| 17829 | 2232.91 | 1111.68 | 900.83 | 138.88 | 91.16 |
| 15673 | 804.12 | 164.51 | 1076.89 | 78.92 | 91.16 |
| 4312 | 76.92 | 38.49 | 154.79 | 22.22 | 91.09 |
| 2079 | 303.47 | 81.98 | 400.13 | 28.12 | 90.99 |
| 18694 | 53.10 | 48.50 | 177.05 | 53.91 | 90.96 |
| 18322 | 2673.81 | 811.21 | 1499.15 | 181.85 | 90.79 |
| 16168 | 350.70 | 206.64 | 479.34 | 84.79 | 90.78 |
| 17779 | 1958.43 | 783.05 | 911.49 | 158.95 | 90.73 |
| 8990 | 277.74 | 77.38 | 465.89 | 83.79 | 90.57 |
| 3434 | 322.35 | 138.05 | 614.67 | 136.42 | 90.57 |
| 18729 | 19.67 | 29.33 | 96.11 | 37.87 | 90.57 |
| 14003 | 817.64 | 211.58 | 458.34 | 85.08 | 90.53 |
| 22816 | 22.96 | 15.10 | 59.89 | 23.04 | 90.49 |
| 9799 | 144.50 | 49.47 | 258.44 | 54.08 | 90.49 |
| 1521 | 20.40 | 50.29 | 136.10 | 71.19 | 90.49 |
| 15886 | 302.74 | 61.73 | 436.98 | 44.28 | 90.45 |
| 16155 | 1084.95 | 423.63 | 632.04 | 54.95 | 90.43 |
| 1485 | 92.98 | 56.73 | 213.05 | 31.14 | 90.36 |
| 17204 | 1735.18 | 656.07 | 938.01 | 109.72 | 90.30 |
| 1203 | 4.95 | 18.70 | 44.90 | 22.64 | 90.27 |
| 19080 | 75.38 | 56.65 | 202.18 | 64.18 | 90.27 |
| 1622 | 2078.05 | 898.00 | 838.34 | 144.28 | 90.26 |
| 17712 | 858.75 | 187.72 | 604.46 | 57.40 | 90.26 |
| 19407 | 1533.63 | 471.44 | 919.83 | 109.37 | 90.26 |
| 4280 | 1275.34 | 435.07 | 698.85 | 97.31 | 90.22 |
| 635 | 1254.34 | 431.22 | 723.36 | 97.99 | 90.17 |
| 22554 | 544.56 | 150.27 | 343.47 | 69.26 | 90.17 |
| 11524 | −14.44 | 24.49 | 37.71 | 21.53 | 90.14 |
| 21703 | 16.32 | 12.14 | 42.83 | 13.13 | 90.10 |
| 14125 | 127.72 | 48.99 | 246.62 | 72.21 | 90.06 |
| 17480 | 119.30 | 33.27 | 190.90 | 31.79 | 90.01 |
| 23322 | 1169.31 | 283.61 | 760.72 | 114.86 | 89.96 |
| 8234 | 49.37 | 21.69 | 92.92 | 31.52 | 89.93 |
| 13682 | 176.92 | 61.79 | 309.18 | 50.37 | 89.89 |
| 11321 | 175.44 | 50.38 | 286.20 | 55.16 | 89.89 |
| 25253 | 291.91 | 64.62 | 414.09 | 38.27 | 89.71 |
| 23852 | 262.19 | 102.61 | 480.31 | 78.92 | 89.71 |
| 20781 | 57.13 | 21.07 | 88.06 | 13.32 | 89.70 |
| 1582 | 16.67 | 13.15 | 45.26 | 13.10 | 89.67 |
| 24696 | 68.64 | 47.19 | 170.78 | 42.12 | 89.67 |
| 818 | 4144.91 | 2804.50 | 980.91 | 271.23 | 89.66 |
| 9109 | 1022.78 | 337.79 | 702.34 | 58.34 | 89.66 |
| 21708 | 36.51 | 16.01 | 73.22 | 15.22 | 89.63 |
| 17549 | 1309.92 | 366.25 | 854.17 | 88.86 | 89.61 |
| 16591 | 151.86 | 47.16 | 253.45 | 36.23 | 89.54 |
| 17154 | 198.88 | 57.70 | 280.48 | 33.03 | 89.53 |
| 14694 | 2332.83 | 1063.34 | 1038.43 | 256.02 | 89.48 |
| 23109 | 2093.27 | 924.06 | 1002.79 | 195.59 | 89.48 |
| 2236 | 139.93 | 38.69 | 200.68 | 21.94 | 89.48 |
| 22661 | 1310.36 | 418.55 | 756.78 | 88.01 | 89.48 |
| 7857 | 51.98 | 45.43 | 149.29 | 46.95 | 89.45 |
| 20876 | 1681.76 | 611.63 | 958.77 | 99.56 | 89.44 |
| 25468 | 2183.54 | 1132.38 | 823.42 | 189.02 | 89.44 |
| 23215 | 106.03 | 29.48 | 169.54 | 21.53 | 89.41 |
| 5900 | 265.96 | 65.56 | 144.68 | 40.70 | 89.41 |
| 1811 | 10.93 | 26.49 | 65.20 | 23.39 | 89.37 |
| 23709 | 2507.78 | 1197.86 | 1088.40 | 231.11 | 89.35 |
| 495 | 135.24 | 83.30 | 303.90 | 57.27 | 89.32 |
| 20998 | 161.29 | 73.65 | 276.37 | 48.32 | 89.32 |
| 17194 | 46.75 | 27.72 | 107.07 | 19.66 | 89.32 |
| 19327 | 88.98 | 29.10 | 144.83 | 20.18 | 89.28 |
| 18101 | 81.85 | 27.96 | 121.65 | 14.02 | 89.27 |
| 819 | 3112.24 | 1661.98 | 1015.34 | 283.90 | 89.27 |
| 3015 | 2325.38 | 988.40 | 1058.04 | 289.77 | 89.22 |
| 21355 | 374.22 | 118.21 | 598.37 | 91.02 | 89.20 |

TABLE 5AA

Atty. Docket No. 44921-5089US
Doc. No. 1803440.1

SEMUSTINE
Timepoint(s): 168 hrs

| Identifier | NonToxMean | NonToxSD | ToxMean | ToxSD | LDAScore |
|---|---|---|---|---|---|
| 23830 | −3.74 | 14.74 | 24.13 | 2.44 | 98.46 |
| 2655 | 43.68 | 49.43 | 103.83 | 13.87 | 98.07 |
| 22547 | 15.31 | 164.20 | 55.98 | 7.70 | 97.99 |
| 21893 | 51.15 | 34.39 | 119.77 | 15.62 | 97.86 |
| 7806 | 52.07 | 19.62 | 68.71 | 1.17 | 97.73 |
| 7785 | 1830.12 | 494.30 | 1054.17 | 67.70 | 97.69 |
| 25705 | 455.94 | 115.83 | 667.36 | 30.91 | 97.64 |
| 22050 | 3163.82 | 930.45 | 2122.73 | 41.59 | 97.47 |
| 21443 | 103.90 | 53.37 | 35.53 | 5.08 | 97.26 |
| 23981 | 812.67 | 160.21 | 626.66 | 12.41 | 97.13 |
| 5733 | 12.64 | 47.16 | 51.31 | 11.73 | 97.13 |
| 8494 | 276.36 | 53.17 | 213.99 | 3.26 | 97.13 |
| 8901 | 25.65 | 33.31 | 2.82 | 0.93 | 97.13 |
| 7023 | 364.88 | 77.19 | 291.07 | 3.81 | 97.09 |
| 18353 | 113.25 | 70.77 | 275.16 | 28.92 | 97.04 |
| 3027 | 1129.65 | 333.83 | 1127.48 | 12.54 | 97.04 |
| 8177 | 3894.73 | 1495.61 | 2320.07 | 89.57 | 96.92 |
| 19398 | 4332.61 | 2167.49 | 2566.57 | 72.18 | 96.83 |
| 23626 | 71.43 | 37.20 | 159.26 | 19.40 | 96.83 |
| 18650 | 804.69 | 246.36 | 518.86 | 13.70 | 96.74 |
| 15627 | 5054.50 | 1946.06 | 3041.20 | 96.69 | 96.62 |
| 20757 | 413.88 | 222.48 | 607.95 | 51.66 | 96.53 |
| 2410 | 11.25 | 10.57 | 25.63 | 2.99 | 96.49 |
| 7274 | 576.90 | 150.70 | 364.54 | 16.30 | 96.44 |
| 26147 | 1030.83 | 225.21 | 645.26 | 49.87 | 96.32 |
| 3359 | 119.66 | 57.61 | 290.85 | 65.10 | 96.27 |
| 11994 | 104.13 | 23.52 | 63.18 | 4.39 | 96.06 |
| 7867 | 64.06 | 34.54 | 163.76 | 30.00 | 96.02 |
| 3701 | 90.19 | 44.20 | 111.89 | 2.06 | 95.93 |
| 23800 | 32.07 | 18.29 | 77.92 | 15.10 | 95.84 |
| 1684 | 2810.78 | 1628.26 | 2548.66 | 84.69 | 95.84 |
| 19162 | 2230.57 | 613.60 | 1498.90 | 56.20 | 95.84 |
| 14958 | 138.49 | 48.09 | 181.53 | 4.13 | 95.80 |
| 11454 | 238.93 | 79.65 | 379.87 | 38.25 | 95.76 |
| 7764 | 6.68 | 15.73 | 27.19 | 3.33 | 95.76 |
| 19993 | 2327.93 | 570.40 | 1514.68 | 94.53 | 95.76 |
| 9407 | 350.93 | 216.90 | 167.34 | 16.19 | 95.76 |
| 15600 | 772.34 | 211.63 | 480.10 | 25.98 | 95.76 |
| 22662 | 137.98 | 35.08 | 116.24 | 1.67 | 95.72 |
| 18142 | 1994.46 | 839.22 | 1965.70 | 25.18 | 95.63 |
| 7278 | 1466.77 | 341.68 | 1037.78 | 55.91 | 95.59 |
| 1685 | 9177.09 | 7104.79 | 4192.02 | 442.45 | 95.59 |
| 15136 | 720.68 | 229.89 | 618.26 | 7.44 | 95.50 |
| 17248 | 2563.75 | 537.86 | 1741.86 | 94.90 | 95.46 |
| 15301 | 38.66 | 68.20 | 52.95 | 4.33 | 95.46 |
| 24627 | 5024.80 | 1714.05 | 3187.73 | 133.28 | 95.46 |
| 16678 | 192.60 | 90.16 | 295.43 | 9.43 | 95.37 |
| 21798 | 2088.65 | 441.72 | 1574.36 | 40.27 | 95.37 |
| 3582 | 396.47 | 105.41 | 299.17 | 10.26 | 95.29 |
| 22618 | 28.62 | 11.98 | 54.72 | 9.80 | 95.24 |
| 20295 | 23.12 | 13.39 | −1.42 | 5.25 | 95.20 |
| 10269 | 1868.08 | 422.77 | 1408.13 | 42.28 | 95.16 |

TABLE 5AA-continued

Atty. Docket No. 44921-5089US  
Doc. No. 1803440.1  
SEMUSTINE  
Timepoint(s): 168 hrs

| Identifier | NonToxMean | NonToxSD | ToxMean | ToxSD | LDAScore |
|---|---|---|---|---|---|
| 7975 | 744.31 | 175.27 | 709.93 | 7.00 | 95.12 |
| 3090 | 308.90 | 80.19 | 389.68 | 9.44 | 95.07 |
| 8163 | 105.92 | 55.18 | 246.10 | 47.62 | 95.03 |
| 7337 | 130.17 | 35.83 | 72.98 | 11.19 | 95.03 |
| 5689 | 12.93 | 20.23 | 44.79 | 8.55 | 94.99 |
| 22737 | 204.61 | 104.35 | 375.42 | 54.48 | 94.94 |
| 4640 | 80.47 | 30.73 | 144.33 | 17.03 | 94.82 |
| 10819 | 1187.21 | 363.05 | 1125.76 | 18.01 | 94.82 |
| 3269 | 76.54 | 40.97 | 147.76 | 18.49 | 94.77 |
| 18468 | 90.58 | 33.19 | 99.23 | 1.85 | 94.77 |
| 6204 | 39.16 | 12.29 | 53.01 | 1.67 | 94.77 |
| 19372 | 61.97 | 54.00 | 9.74 | 2.20 | 94.73 |
| 21628 | 116.51 | 45.00 | 204.96 | 26.35 | 94.69 |
| 3075 | 523.79 | 180.19 | 291.98 | 21.30 | 94.69 |
| 8015 | 52.45 | 36.45 | 80.79 | 2.30 | 94.64 |
| 20105 | 80.00 | 53.71 | 27.37 | 3.94 | 94.64 |
| 18830 | 5928.33 | 2277.75 | 3404.34 | 229.07 | 94.60 |
| 12639 | 1231.40 | 359.71 | 1328.85 | 25.82 | 94.60 |
| 2697 | 1227.29 | 359.86 | 1375.72 | 25.94 | 94.56 |
| 2326 | 1442.32 | 399.30 | 866.19 | 98.10 | 94.56 |
| 9180 | 82.53 | 35.16 | 153.13 | 21.13 | 94.47 |
| 22838 | 1383.85 | 399.86 | 912.16 | 54.21 | 94.47 |
| 23509 | 2234.19 | 462.51 | 1771.07 | 42.02 | 94.47 |
| 23709 | 2494.50 | 1202.87 | 2200.91 | 59.43 | 94.34 |
| 2912 | 2618.16 | 709.02 | 1838.26 | 100.99 | 94.34 |
| 20944 | 1191.93 | 395.05 | 1322.96 | 34.77 | 94.30 |
| 25589 | 154.92 | 38.08 | 184.54 | 2.96 | 94.30 |
| 18800 | 2730.47 | 1166.13 | 1296.14 | 149.09 | 94.26 |
| 2311 | 22.96 | 16.01 | 54.56 | 12.04 | 94.17 |
| 410 | 1097.48 | 256.27 | 795.24 | 44.26 | 94.17 |
| 17885 | 246.73 | 58.07 | 148.75 | 13.01 | 94.13 |
| 21458 | 229.64 | 104.63 | 360.82 | 32.46 | 94.13 |
| 22069 | 689.12 | 145.63 | 514.75 | 17.18 | 94.13 |
| 3584 | 65.13 | 35.08 | 106.58 | 9.75 | 94.13 |
| 5968 | 966.61 | 265.81 | 609.81 | 49.16 | 94.04 |
| 19525 | 27.97 | 21.00 | 56.08 | 10.20 | 94.04 |
| 18757 | 250.38 | 72.47 | 327.68 | 9.19 | 94.00 |
| 19768 | 711.98 | 179.77 | 874.96 | 22.13 | 94.00 |
| 7392 | 29.06 | 15.76 | 62.61 | 15.61 | 94.00 |
| 10267 | 2119.14 | 891.88 | 2056.03 | 48.77 | 94.00 |
| 23190 | 70.87 | 28.52 | 103.79 | 5.80 | 93.96 |
| 25676 | 218.79 | 80.22 | 97.09 | 19.62 | 93.96 |

TABLE 5BB

Atty. Docket No. 44921-5089US  
Doc. No. 1803440.1  
SUFLADIAZINE  
Timepoint(s): 24 hrs

| Identifier | NonToxMean | NonToxSD | ToxMean | ToxSD | LDAScore |
|---|---|---|---|---|---|
| 13158 | 464.71 | 105.53 | 185.18 | 11.81 | 99.83 |
| 2010 | 31.95 | 313.46 | 578.42 | 46.88 | 99.79 |
| 15535 | 445.86 | 80.88 | 792.83 | 41.28 | 99.74 |
| 1564 | 34.77 | 147.30 | 1395.56 | 106.27 | 99.70 |
| 4452 | 989.99 | 248.64 | 328.14 | 43.97 | 99.70 |
| 4450 | 282.32 | 50.39 | 113.73 | 16.34 | 99.61 |
| 20700 | 81.27 | 404.51 | 1604.45 | 209.39 | 99.61 |
| 20481 | 208.68 | 44.26 | 81.56 | 7.25 | 99.57 |
| 25686 | 666.44 | 155.98 | 1348.56 | 47.39 | 99.53 |
| 5695 | 1559.28 | 402.43 | 636.16 | 43.80 | 99.53 |
| 6477 | 13.20 | 160.91 | 187.40 | 49.13 | 99.53 |
| 17101 | 352.23 | 77.89 | 621.28 | 16.27 | 99.49 |

TABLE 5BB-continued

Atty. Docket No. 44921-5089US  
Doc. No. 1803440.1  
SUFLADIAZINE  
Timepoint(s): 24 hrs

| Identifier | NonToxMean | NonToxSD | ToxMean | ToxSD | LDAScore |
|---|---|---|---|---|---|
| 15175 | 318.83 | 49.56 | 153.62 | 12.70 | 99.49 |
| 20699 | 90.33 | 220.48 | 1192.64 | 109.71 | 99.49 |
| 6478 | 22.55 | 383.52 | 251.88 | 88.78 | 99.44 |
| 725 | 117.71 | 45.62 | 14.15 | 2.76 | 99.44 |
| 645 | 151.16 | 54.99 | 17.82 | 6.85 | 99.44 |
| 3987 | 192.50 | 47.15 | 465.13 | 55.22 | 99.44 |
| 21947 | 752.67 | 136.25 | 319.39 | 29.30 | 99.40 |
| 17291 | 1389.57 | 412.30 | 482.86 | 101.58 | 99.40 |
| 238 | 227.68 | 51.22 | 496.72 | 69.45 | 99.36 |
| 20887 | 794.18 | 312.69 | 103.79 | 42.68 | 99.36 |
| 1558 | 203.57 | 58.77 | 553.28 | 64.74 | 99.36 |
| 17661 | 255.29 | 58.73 | 540.05 | 70.79 | 99.36 |
| 16947 | 320.42 | 79.17 | 77.47 | 19.86 | 99.36 |
| 16204 | 752.56 | 177.92 | 1702.82 | 145.45 | 99.36 |
| 18906 | 255.45 | 83.89 | 55.16 | 8.36 | 99.36 |
| 17357 | 269.77 | 81.23 | 2.53 | 12.73 | 99.31 |
| 17514 | 859.90 | 174.50 | 359.55 | 37.03 | 99.31 |
| 16416 | 22.83 | 18.51 | 84.23 | 3.30 | 99.27 |
| 2085 | 688.34 | 191.75 | 339.59 | 20.82 | 99.27 |
| 7101 | 380.51 | 644.25 | 3330.36 | 683.13 | 99.27 |
| 18278 | 1896.72 | 507.81 | 639.93 | 108.91 | 99.27 |
| 25718 | 392.38 | 80.21 | 851.19 | 103.08 | 99.23 |
| 1478 | 352.13 | 79.44 | 88.92 | 22.22 | 99.23 |
| 9621 | 292.01 | 59.49 | 563.88 | 51.66 | 99.23 |
| 23596 | 1491.59 | 375.55 | 487.23 | 90.69 | 99.23 |
| 20884 | 637.92 | 258.49 | 19.93 | 9.59 | 99.23 |
| 10016 | 207.78 | 73.01 | 590.63 | 39.54 | 99.23 |
| 7665 | 282.42 | 91.44 | 861.31 | 113.78 | 99.19 |
| 472 | 661.53 | 177.31 | 345.51 | 23.33 | 99.19 |
| 18597 | 521.43 | 162.83 | 914.02 | 31.92 | 99.19 |
| 4222 | 545.41 | 102.20 | 1014.25 | 79.67 | 99.19 |
| 20886 | 719.84 | 291.88 | 50.84 | 41.81 | 99.19 |
| 1884 | 178.24 | 37.12 | 331.54 | 22.95 | 99.19 |
| 1422 | 297.77 | 88.40 | 75.68 | 10.49 | 99.19 |
| 17104 | 449.21 | 107.90 | 1060.31 | 149.95 | 99.14 |
| 17907 | 1319.66 | 300.38 | 623.40 | 49.85 | 99.14 |
| 17284 | 229.07 | 60.08 | 77.02 | 16.01 | 99.14 |
| 8981 | 142.60 | 87.32 | 716.17 | 136.32 | 99.14 |
| 4451 | 290.54 | 64.21 | 76.77 | 27.51 | 99.14 |
| 15955 | 751.14 | 196.31 | 146.28 | 35.67 | 99.10 |
| 16419 | 306.72 | 58.43 | 562.97 | 56.12 | 99.10 |
| 16627 | 97.46 | 34.41 | 213.43 | 14.92 | 99.10 |
| 22592 | 234.18 | 163.38 | 903.10 | 59.07 | 99.10 |
| 19824 | 224.78 | 67.21 | 32.81 | 20.42 | 99.10 |
| 9905 | 674.04 | 138.26 | 279.49 | 36.23 | 99.10 |
| 15002 | 139.13 | 94.64 | 580.42 | 72.97 | 99.10 |
| 812 | 157.04 | 34.99 | 39.35 | 14.07 | 99.10 |
| 15193 | 172.71 | 60.15 | 463.80 | 40.10 | 99.10 |
| 11205 | 596.04 | 192.04 | 155.98 | 25.86 | 99.10 |
| 17535 | 246.41 | 64.45 | 529.14 | 76.63 | 99.06 |
| 4360 | 330.80 | 65.83 | 138.60 | 23.78 | 99.06 |
| 5667 | 742.84 | 172.36 | 1513.63 | 136.63 | 99.06 |
| 20056 | 309.09 | 59.92 | 81.20 | 26.34 | 99.06 |
| 11081 | 352.98 | 113.10 | 740.48 | 49.43 | 99.06 |
| 3916 | 738.87 | 186.54 | 212.10 | 43.88 | 99.06 |
| 1801 | 97.49 | 29.02 | 212.29 | 21.51 | 99.06 |
| 25317 | 15.28 | 68.43 | 72.14 | 39.26 | 99.06 |
| 24501 | 524.69 | 114.42 | 955.66 | 63.01 | 99.06 |
| 19508 | 100.97 | 41.09 | 11.48 | 5.01 | 99.06 |
| 19769 | 63.82 | 80.07 | 487.54 | 129.83 | 99.01 |
| 25546 | 473.54 | 139.58 | 193.05 | 34.65 | 99.01 |
| 10878 | 951.05 | 250.12 | 1714.95 | 105.09 | 99.01 |
| 10819 | 1183.30 | 358.76 | 2036.62 | 53.76 | 99.01 |
| 18507 | 701.19 | 159.97 | 1396.26 | 108.52 | 98.97 |
| 2915 | 87.36 | 36.13 | 206.79 | 19.36 | 98.97 |
| 15003 | 34.41 | 91.73 | 507.05 | 83.25 | 98.97 |
| 2583 | 369.08 | 148.55 | 848.08 | 90.80 | 98.97 |
| 9620 | 529.25 | 111.98 | 1071.29 | 125.35 | 98.97 |
| 19298 | 364.57 | 96.71 | 819.01 | 116.31 | 98.97 |

TABLE 5BB-continued

Atty. Docket No. 44921-5089US  
Doc. No. 1803440.1

SUFLADIAZINE  
Timepoint(s): 24 hrs

| Identifier | NonToxMean | NonToxSD | ToxMean | ToxSD | LDAScore |
|---|---|---|---|---|---|
| 6614 | 478.70 | 150.19 | 97.33 | 35.20 | 98.97 |
| 15986 | 320.13 | 83.84 | 46.97 | 24.78 | 98.97 |
| 13646 | 727.39 | 191.95 | 1634.83 | 174.87 | 98.93 |
| 240 | 184.44 | 53.70 | 394.90 | 58.94 | 98.93 |
| 16675 | 33.18 | 31.66 | 226.87 | 74.32 | 98.93 |
| 11968 | 297.46 | 82.47 | 94.28 | 17.16 | 98.93 |
| 17540 | 561.49 | 199.04 | 1593.99 | 230.39 | 98.93 |
| 19161 | 1068.85 | 309.26 | 2020.78 | 120.96 | 98.93 |
| 23924 | 208.78 | 62.50 | 465.78 | 53.25 | 98.93 |
| 4482 | 227.17 | 73.35 | 67.19 | 17.67 | 98.93 |
| 5199 | 611.50 | 182.04 | 158.54 | 39.19 | 98.93 |
| 117 | 21.06 | 17.59 | −12.77 | 2.61 | 98.89 |
| 22536 | 1715.17 | 473.49 | 3319.42 | 278.50 | 98.89 |
| 17100 | 819.32 | 235.74 | 1519.10 | 85.28 | 98.89 |
| 14332 | 537.23 | 133.39 | 1143.62 | 152.21 | 98.89 |
| 5232 | 365.72 | 93.58 | 160.50 | 9.58 | 98.89 |
| 10561 | 78.49 | 36.71 | 188.47 | 14.45 | 98.89 |
| 15098 | 185.41 | 66.49 | 32.78 | 6.96 | 98.89 |
| 3401 | 14.24 | 21.17 | 144.41 | 52.94 | 98.89 |

TABLE 5CC

Atty. Docket No. 44921-5089US  
Doc. No. 1803440.1

SULFADIAZINE  
Timepoint(s): 3, 6 hrs

| Identifier | NonToxMean | NonToxSD | ToxMean | ToxSD | LDAScore |
|---|---|---|---|---|---|
| 2459 | 327.82 | 133.31 | 1186.99 | 180.16 | 99.44 |
| 985 | 18.91 | 23.49 | 435.93 | 226.01 | 99.36 |
| 6054 | 24.46 | 35.46 | 463.67 | 144.11 | 99.18 |
| 21546 | −60.81 | 78.07 | 461.08 | 143.78 | 99.14 |
| 11259 | 101.27 | 105.67 | 1117.26 | 304.40 | 99.05 |
| 223 | 10.81 | 16.39 | 121.57 | 31.76 | 99.05 |
| 13745 | 27.17 | 26.30 | 236.39 | 104.08 | 99.05 |
| 8304 | 263.66 | 68.46 | 104.04 | 18.52 | 99.05 |
| 2154 | 54.19 | 102.13 | 766.15 | 271.93 | 98.93 |
| 6585 | 635.65 | 314.22 | 2778.88 | 622.70 | 98.80 |
| 17506 | 33.02 | 28.55 | 170.00 | 54.28 | 98.80 |
| 2153 | 179.20 | 124.41 | 1217.91 | 474.19 | 98.75 |
| 23872 | 47.29 | 87.73 | 387.10 | 112.60 | 98.71 |
| 15301 | 35.41 | 55.60 | 466.69 | 146.16 | 98.67 |
| 15192 | 164.68 | 117.96 | 858.98 | 208.00 | 98.67 |
| 17327 | 209.40 | 86.17 | 531.34 | 65.50 | 98.62 |
| 15300 | 131.96 | 108.91 | 967.46 | 264.07 | 98.62 |
| 7700 | 80.97 | 38.43 | 377.20 | 103.65 | 98.58 |
| 13930 | 128.33 | 69.33 | 520.74 | 123.87 | 98.54 |
| 10659 | 128.90 | 79.62 | 602.71 | 192.55 | 98.54 |
| 7197 | 195.08 | 78.35 | 557.25 | 113.13 | 98.37 |
| 19060 | 150.81 | 79.81 | 399.19 | 134.24 | 98.32 |
| 15299 | 86.11 | 52.88 | 422.06 | 161.10 | 98.28 |
| 355 | 10.95 | 13.39 | 102.92 | 40.18 | 98.28 |
| 7196 | 178.85 | 80.11 | 517.52 | 81.96 | 98.28 |
| 25730 | 196.00 | 64.30 | 513.70 | 106.95 | 98.24 |
| 5356 | −12.88 | 18.58 | 46.77 | 19.05 | 98.19 |
| 19657 | 3.19 | 17.88 | 84.23 | 34.61 | 98.15 |
| 25084 | −12.38 | 22.65 | 46.65 | 25.44 | 98.11 |
| 1501 | 58.67 | 53.51 | 250.18 | 120.56 | 98.02 |
| 17908 | 62.13 | 58.89 | 240.27 | 66.39 | 97.98 |
| 16314 | 43.27 | 38.63 | 240.75 | 61.16 | 97.94 |
| 2555 | 95.85 | 44.10 | 292.92 | 71.25 | 97.94 |
| 21682 | −35.82 | 31.41 | 50.22 | 26.54 | 97.89 |
| 5384 | 40.19 | 41.73 | 218.67 | 41.90 | 97.89 |

TABLE 5CC-continued

Atty. Docket No. 44921-5089US  
Doc. No. 1803440.1

SULFADIAZINE  
Timepoint(s): 3, 6 hrs

| Identifier | NonToxMean | NonToxSD | ToxMean | ToxSD | LDAScore |
|---|---|---|---|---|---|
| 22626 | 83.22 | 71.71 | 465.98 | 192.17 | 97.85 |
| 11483 | 64.30 | 44.10 | 197.71 | 47.03 | 97.85 |
| 16053 | 229.00 | 93.51 | 658.28 | 200.15 | 97.81 |
| 4045 | 93.63 | 47.19 | 244.15 | 46.42 | 97.81 |
| 804 | 454.28 | 182.83 | 934.61 | 83.33 | 97.76 |
| 8874 | 118.37 | 60.25 | 305.67 | 73.98 | 97.76 |
| 23314 | 62.72 | 247.80 | 1403.77 | 543.62 | 97.76 |
| 21 | 69.73 | 31.90 | 161.45 | 47.41 | 97.76 |
| 22681 | 218.11 | 182.12 | 981.97 | 310.38 | 97.72 |
| 7471 | 219.05 | 63.97 | 421.52 | 40.74 | 97.72 |
| 13240 | 475.09 | 362.91 | 2390.71 | 790.75 | 97.68 |
| 1340 | 192.32 | 49.81 | 108.32 | 15.13 | 97.64 |
| 16312 | 54.74 | 33.76 | 197.76 | 42.24 | 97.59 |
| 11876 | 107.52 | 40.42 | 242.85 | 40.07 | 97.46 |
| 20161 | 38.17 | 33.28 | 150.28 | 32.80 | 97.46 |
| 15996 | 49.41 | 38.61 | 170.53 | 42.38 | 97.42 |
| 12978 | 105.07 | 45.80 | 334.16 | 95.16 | 97.42 |
| 14179 | 49.88 | 26.28 | 132.84 | 24.19 | 97.38 |
| 12534 | 87.91 | 36.00 | 223.28 | 65.14 | 97.38 |
| 21779 | 147.51 | 35.16 | 262.54 | 35.74 | 97.29 |
| 11979 | 210.67 | 69.55 | 85.98 | 17.52 | 97.25 |
| 17161 | 1152.09 | 406.69 | 2288.34 | 334.10 | 97.25 |
| 11434 | 326.14 | 103.27 | 663.21 | 132.01 | 97.12 |
| 6844 | 124.34 | 58.18 | 17.91 | 11.06 | 97.12 |
| 22 | 53.08 | 46.64 | 206.89 | 59.81 | 97.12 |
| 3464 | 165.60 | 53.31 | 329.80 | 63.59 | 97.08 |
| 3434 | 322.01 | 136.13 | 755.72 | 108.22 | 97.08 |
| 22248 | 243.91 | 118.15 | 625.27 | 179.46 | 97.03 |
| 9423 | 937.34 | 251.31 | 1765.27 | 274.26 | 97.03 |
| 21683 | 34.05 | 23.48 | 105.62 | 26.60 | 96.95 |
| 16527 | 51.16 | 16.84 | 24.15 | 3.25 | 96.90 |
| 4512 | 1.04 | 32.53 | 73.93 | 19.11 | 96.86 |
| 4725 | 81.40 | 55.94 | 245.03 | 66.25 | 96.78 |
| 21239 | 114.57 | 59.35 | 256.57 | 37.93 | 96.78 |
| 17329 | 213.88 | 104.30 | 531.44 | 105.41 | 96.65 |
| 13467 | 37.67 | 24.44 | 111.98 | 36.67 | 96.56 |
| 15089 | 179.58 | 77.35 | 389.68 | 58.33 | 96.56 |
| 3454 | 86.52 | 35.67 | 198.35 | 31.79 | 96.47 |
| 20523 | 547.69 | 149.96 | 965.84 | 112.80 | 96.43 |
| 15058 | 197.84 | 70.39 | 377.22 | 46.94 | 96.35 |
| 14492 | 613.89 | 164.78 | 1076.44 | 162.75 | 96.35 |
| 12999 | 128.09 | 33.18 | 203.14 | 71.45 | 96.30 |
| 22967 | 163.84 | 54.49 | 255.51 | 13.19 | 96.26 |
| 18008 | 1.51 | 16.75 | 42.22 | 12.38 | 96.26 |
| 24640 | 177.45 | 57.95 | 357.46 | 73.86 | 96.26 |
| 7913 | 55.20 | 20.69 | 108.16 | 18.70 | 96.17 |
| 2625 | 141.92 | 31.66 | 87.09 | 9.03 | 96.17 |
| 3049 | 201.89 | 100.36 | 461.30 | 105.24 | 96.17 |
| 18011 | 31.95 | 28.60 | 105.17 | 25.57 | 96.13 |
| 23834 | 71.40 | 23.40 | 137.38 | 25.69 | 96.09 |
| 19818 | 32.37 | 21.21 | 85.97 | 15.20 | 96.04 |
| 12673 | 37.51 | 22.58 | 99.74 | 25.41 | 96.04 |
| 15377 | 25.91 | 15.53 | 56.38 | 6.78 | 96.00 |
| 12745 | 330.67 | 112.37 | 623.69 | 81.74 | 96.00 |
| 14111 | 150.33 | 66.27 | 327.97 | 47.79 | 96.00 |
| 11157 | 681.75 | 178.91 | 356.49 | 80.44 | 96.00 |
| 23166 | 134.04 | 62.51 | 266.66 | 54.48 | 95.96 |
| 3519 | 375.57 | 125.21 | 690.15 | 176.36 | 95.87 |
| 16124 | 420.65 | 131.40 | 193.12 | 32.21 | 95.83 |
| 17800 | 204.49 | 42.25 | 108.97 | 22.01 | 95.79 |
| 8639 | 368.08 | 97.97 | 620.44 | 125.57 | 95.79 |
| 25090 | 83.00 | 43.32 | 203.07 | 48.58 | 95.79 |
| 15191 | 2005.55 | 1208.87 | 3819.43 | 343.39 | 95.74 |
| 7469 | 286.95 | 67.51 | 149.39 | 36.61 | 95.70 |
| 21238 | −17.22 | 39.01 | 55.57 | 20.45 | 95.70 |

SEQUENCE LISTING (2221 sequences)

SEQ ID NO: 1 - DNA, 203 bp, Rattus norvegicus
  Genbank Accession No. AA012785
gatccagtaccatcaccttgcaagaacacttgtatttccaaagggaatgcacctttattttctaatcatttacttttataataaatggatttactactrtgcaaaaaaaaaaaaaaaaaatctagaatgaagaaaagtatactgggctggtaaaaatatctggataagaatatttttatcattgagtggggcaaaaaaaaaaa

SEQ ID NO: 2 - DNA, 158 bp, Rattus norvegicus
  Genbank Accession No. AA108277
accctttgaactagaagctttctattctgaccctcaagcagttccatatccagaagcaaaaatcggccgttttgtcgttcagaatgtttctgcacagaagatggagaaaatctaaagtgaaagtgcgcgtgacacacatgcatttcacatatccgctc

SEQ ID NO: 3 - DNA, 186 bp, Rattus norvegicus
  Genbank Accession No. AA108308
ggcctccgaagccggggtagcctaggagcggccgcgttactacgtcaggagccgctgtcgcttcgctcgacctcccgagcgaaatggtctctcaagtcccggccaccgggcctccgcgctccccatgaagggtcggaggccgcgcggggagtagcacggtctgcaggcgagcggagaccgacacac

SEQ ID NO: 4 - DNA, 221 bp, Rattus norvegicus
  Genbank Accession No. AA684537
  misc_feature (1)..(221): n = a or c or g or t
cttggctgtagtagccatggcggctataagcctnctgcagcgggcttcgntcgccgctctnacagctctntttggccgccgcgctggcactaggctcggagtcggaagttttntcacacggagctttccgaagactgtngctcctgtccggcacagtggggaccatggcaagaaactgtttgtaatcaagccttccttatactataacgcccgcttcctga

SEQ ID NO: 5 - DNA, 318 bp, Rattus norvegicus
  Genbank Accession No. AA685178
  misc_feature (1)..(318): n = a or c or g or t
catccaacaagaagctacactttattagtgatagaaacagtacaaattttaaaccaagctgtagttccacttttcaaacaccaaaaggggggggangggggaggagggtgtccttgctgtcagataattacattgttaattccataatagcatttacaatatcgttactgtngtttttnagggctcggacagcctttgctcttgacacatttgcttgtgacatgaccaactctatgtccttaacttccacacccgtttcatcaacctcctcttcttcgntctcctcttggacagtcggcgtctgcggtgttctcctga

SEQ ID NO: 6 - DNA, 371 bp, Rattus norvegicus
  Genbank Accession No. AA685974
  misc_feature (1)..(371): n = a or c or g or t
gcctcgccacagcctttattgcgcgggcactccaccgggctctgcaggatgcacgggggctaggatgtcagagcggggaccctctggtttgttgagggtgacctatggcgcantgggagacccccagacccggaactctattaatccctggtcaggccaggctgaagagggatgagctgacttggacaagctggattcagcccggttctgtcacttgggtgcattgaagggcagcgcacgctggtttcatcgggttgtcaggagagcgcaaccactccttcttcagcagctgcttcagctgtnagagccgcatgttggggttttcctgcttcaaccgtggcagcttcanctcctcaaatgcggtgaaggcc

SEQ ID NO: 7 - DNA, 437 bp, Rattus norvegicus
  Genbank Accession No. AA686423
  misc_feature (1)..(437): n = a or c or g or t
cgccgtgagagctgcctcaggaatattacgtcccctcaatgtctcggtttcgtcaacctatcggaactgtgccaggaatgcctntnttagttctgcgctgcgcaccattccttttagacatattcagacatcagttgtttcctctgctccaaggcttgtcaagtctgtcggacacctggcatatgggcacacggcatcagtccttaatagagtggccacattggttcccagtgtcttgaagcctccggtcagagctctgacgtactgcagtgcacggaaaggaaagagaaagacagtgaagtcggttgtgcatcgcttcctccganttcattctggccttttggttaaggaggaaaggctgggtataaggaaaaattttgggaaaagttcaactncaaggaaagagccctttnnggggattcggtgtcctgcaatag

SEQ ID NO: 8 - DNA, 362 bp, Rattus norvegicus
  Genbank Accession No. AA686470
  misc_feature (1)..(362): n = a or c or g or t
gtcgatcataccatgttgaagatgagcgggtggcagcgacagagccaaaataacagccggaacctgaggagagagtnttccagaaggaagtgcatcttcatacaccaccacacctgaaagcagaaaccggtccaattacagtcatggcagctgagtctctgcctttcgcctttgagacagtntccagctgggagctggaagcctggtatgaggntctgcaggaggtcctgtcctcagatgaaattgggggcanctatatctcatccccaggaaacgaagaggaagaatcaaaaacctttcactacttttgaccctgcatccctagtttggtgactnaggagccagggccagcagaggtcaca

SEQ ID NO: 9 - DNA, 685 bp, Rattus norvegicus
  Genbank Accession No. AA799325
gctgaagttagaatttaatcctggggaattaaaattattcatgtctgctgagtagatggcaagacaaatgtcacatgaccatgctttttaaatcttacttgggagttttgtttgcacaaactttctttgggctccttttaaagatttcttttccgtaagaaatcacgtcacatattgttcctttttgttctttggggtaacttagtcctgtcctttatcatacaatttaaggaaagataacataaaggtaaaaagacatcaaattctcatatacacaagtaacattctcctttggtcacattagcatcacgtgacttgaggtcgcagacagactcttctgtatctttgtccacgtgtcacacagacagcaagcacagggttcaggatgatagactagaaggcaccttttactttctgtgtaaacacgtgtgtgctggtttccttaccttgcgtattggtggttttcctgtctttgtttttaagtgttgtaatgtggtgcttagcttttctccttattaaataccatctccagaaactcgtcttggagtttagaaaacacttttgactgttcatttcctttttctttctcttaaaaatcttctagtccttattaccggaatttctgttaacagaattatgccagtgtcattgaagacttaaataatggaagatgtaactttcacat

SEQ ID NO: 10 - DNA, 617 bp, Rattus norvegicus
  Genbank Accession No. AA799330
tatttaattggaatacatgtcctgccaaccaaaccataaaacacttcatgggaacccatcacacatgaaaccccagcaggaccaacaagtgcggccttgcacttgtcaaggatgctgtagaagaagaaactattgagtttccgtcttaatcctcttcagaacttgaatcatcctcttggtcagaaagttccggcacagggaagcggagaatggcagctactccagtcagctgaccaagctgttccccagacacgtggagactggagaatatccttacggtgcccgcattctctttcacactgtccaccagcctgacataccggctccgggtggccacatcctgatgccggaagagctcatcactgatgagcaaggtgtcaatcgccaaggcttcattggccctctccacctgcttgagtccatagaatgctcggtcaggttcgtgctgtaacattttgtagaagtcatccaaggcttttacttccccggcagctttcgtgtctgaaaggcggctcgctacagtaggatcacataggacctctttcagggagtacctgtgtccagaggaggcgtgtacctgaaggaatttggagccgttttccaggagcaccttgttt

SEQ ID NO: 11 - DNA, 495 bp, Rattus norvegicus
  Genbank Accession No. AA799412
catgaaaggttcaaaaccaaaagcggtttctctttgcagcaaatatacattaaaatagagtctctgtacagccaagggctctgggccctggcttgccccatggccctgcgcctccctggccaaacccaaaaataaatatagtgttattgctctgcagggcgtagaggcagtgctgtcccccatcccttgaggtgggagctgatagggggccctggccaccccagggcctcaagcatttccaaaaacagcttgtgcatggagtcagagttggcaagggccagagctttcagcaggacgtactcctcccgctccagccgtagggcttgcagccgccgaaccagctgcagcaaggctgcccccagatcccccagaccagcagcccgtgccccctcttcatccaggaccaggtcctcagcaaaggccaactcatcctgcaatggcagtgagcgctgggccacacccagcaccagcacctccatccacatactctgcagt

SEQ ID NO: 12 - DNA, 553 bp, Rattus norvegicus
  Genbank Accession No. AA799449
cacaactttaatagaatattctaactattctgtacaaattgaaaacaccgtattcagttacaaatgtgttattgggtaaggctgagcacgctctacatggctggtcactgtggacatggctgtcctggctaccagagacacaaccacacactcggaaacaccccccccccccacactaaccaccaactggtcaccaatcccaggtgtggccctggtgtgcacagtacaagctgaagctgtgctctacaggccagagatcctactgagggagaacttcctcgtagaacttagcttctatgtgcgcacacctcacctggagctgcttcagagcattaattcttcttttgacagctttaggtaaagtttctatgtaactagatggagtgtgagagacgttgtcaagacgttcctgcaaagctgccagcacttgtgggttctgcatcacctggtctgtgagtttttctgtattactggcatttttagcagcttccacagaatctgctgggcctccatctgaaagactgtttttctgcatctgaacacctttgcctcg

SEQ ID NO: 13 - DNA, 548 bp, Rattus norvegicus
  Genbank Accession No. AA799472
acaggaaggctggggtaggtatgtaccatagcatgtggtgatttctctcaccgacagctagagtttacgctcgttcctagaacataaatccacccttccacgttctgtgattctcatagcttagtcactgaaggaagactcactcgctgaactttcttctatggctttttcactttcgccacttggcaccggagcatctggcttctccagtagctctgggtctagtccttctgagatcatcttgtctctgattgccatcatcgggacacccacttgaaccatcttgaggtatctggcatatcgtgggtccttggctacagttacgacattttctgatggcgcttcaccttgttgtactccggagtcttgcgtgctgttctgcagttgctcagcagtgggttcagaatgtgattcatttgtgacagcagtgacacttagatgagacatgtcaactgtgacatcctctaggtctgcgatacatgacagcttcacatctaaacatatgacagctgtttcaacttgttgcatccgaagagaaaggtctgcca

SEQ ID NO: 14 - DNA, 513 bp, Rattus norvegicus
  Genbank Accession No. AA799497
aaagccatacatggatggtgagagtaagcagctgtacagaggggacagcatcagtgtacatacattcatgtccagaacacttagcatacatcagggtttatacaaggtggcagaggctataggcacaatgatacaaaatataaagtatatttccatctataaatacacagccggggacttccctaggcaccaatcctggctccatcagtgcccttctctgccatctcacctccaacctcagatcttccgagtggccggaggctgtttgtacctgggctgttcctaaggggtcttgttaagggcatcactggccgccatgttctcctgtcacccctccccctctttcattcctgtctaagaatggacaacactctccctgttgatatagagattcaacaataaacaacaacatgacagatcattcacaaaagagcagtgggtaaaagtgctctcgtttaaaggaagtctttggcaagaatacagagttgcatacggagtgctctgcctcgtgcc

SEQ ID NO: 15 - DNA, 483 bp, Rattus norvegicus
  Genbank Accession No. AA799523
  misc_feature (1)..(483): n = a or c or g or t
aaatcataaatgtacaacagcttcttaactctacacacgcacttaaatttttaaaggaaaaacgttatgtcttattacaccatgatcctggctaatagcttttcaaaactttttgagaaaaatcttaaaaaaggtttcacatgtcacctgaaacttacaaatttaacattatcaaagaaggaatgcttctacactcttacaaagaccactagaaagaaccaacatttaaaaggctagaaactgtctcaaagcatttttttttacatccttcctcaacagtaagtattaattatcaatccatcacaaatgctctcgcatcgctctgtgtctccgcatacaatgctattagcatactganataaagttctaaaatgtaattcgaaactgagccgtcggtactcgggctcacactcccaataacaattaccccaggaattagaaaatcaatacggtcttcaaatacccaattccaatcccaaacac

SEQ ID NO: 16 - DNA, 633 bp, Rattus norvegicus
  Genbank Accession No. AA799545
  misc_feature (1)..(633): n = a or c or g or t
caaatgacttagatttaatcactggaagcaaactgaatggaagcttacaacagaagagatacacgtcagtgctttttgcaaaccgagatgggacagactgggggctgcccctcaacctgatcctttgcaaacaaagatgtccacagtgttcctggaactctggctcaggaaaggggagactgctggttctgtggttcagtcaccttgcttagcactcactcctggccagcatctggagcaccggtttgccggttctggtcatcacccttcttcttgtggccagagacaatgtcatcaatccgcagaagcagaactgcagtctccactgctgttttgtatgtttgtagcttcacagccaatggctcccaaatacccagctctttcatgtccactaaggtaccagtctcaccattcacaccccaggtctcacaattctcctgtgtgtgcttggcccgaagggaggtaagcagacgaatggtactggccccacagttctggatcaaggtccganggatgacctctaaagcctgngccacagccctatatggccattgttccacaccagtcatgggcttagatttgtctgtcnaagcatgggccacagccatctcagaggctcccacacaagcacan

SEQ ID NO: 17 - DNA, 604 bp, Rattus norvegicus
  Genbank Accession No. AA799560
cacagcagaagttgtgtgagacaggaggtcacaccctacacacaagagtatggtcagagtctgaggtagcccttcccaccctgatgccaaaccccaagcagtcggacctaagttctttcccccagtcccactttaggtgcacactgacagctattaaagttagtgcggccaaaggacccgggcccctccctaatgcccctgcttcaatgtgtttaccattgttcttcactggccaccatctcccgttctgactttctttttacatgctggatatgtctatcacgttaaggatcagtaacacaccagcaaatattcccctgagagacatccatttaggagcattgccttcagaggccttaaacgtcaaggcactgtgtcagctttgggggaatggagctcctcatatcccaccaccaaccctacacatacacacactctcctacccttgcaaatatgggctaaagagggggagtgatggcatccccgtgacagctaaaacaacttattgttcctcacctatagaaacaagtcagagagggaacataaaagccttcccaggacaaaacgggagaggagatacttagggggctggatcctaagaata

SEQ ID NO: 18 - DNA, 533 bp, Rattus norvegicus
  Genbank Accession No. AA799570
acggggtcacaggcaaatggctttattggcttatcatttaaaatgggcttgtcatcacaaggcttgggaagttcagacacttccaagagagatgttcaaacaaacccctttctaaccagtcaaggggaaagaacagtaggcccgagattgactgcagcgtgagttcagcctactcagtataaccaggcatgccaggcctactgcaagccacatgtgcttttactacctaagagttctagagtctggattcagaactgttactagcagacctgagctcataccctcggtgactctgccaagggaggagggggaggggaacacagattagagaaggtggcccgacacccaccttctaggcctttgttaggggccaagtgtggctctctgggcctactgtgggaacaaaccatggcaaagccactaagaagcacaaaaagttagtgtggtactggcatctccaaaatatgtcctgaaagtacaaatgagcagattccatattcagacacgaaggcatccaactaaaacatttaaat

SEQ ID NO: 19 - DNA, 597 bp, Rattus norvegicus
  Genbank Accession No. AA799591
cagacactatgaattgctttaatggtggtatctgtacaagtgatgtcaggacacaggacagcaaatgcacagtggacatggctagcagacaagctgtgaatgaataaagagttcacactgctcccatgctgtagtgactaagacagctctaagccacctcctcctcagcctcctcctcaaactctccttcctcctcagctgtagcatcctggtactgctggtactcggacaccaggtcattcatgttgctctcaccctcagtgaactccatctcatccatgccctcgcccgtgtaccagtgttggaaggccttgcgtcgggacatggctgtgaactgctctgagatgcgtttgaaaagctccggaaaggccgtgctagttgccaatgaaggtgccgggcatttttaaggcaccgggtggaatgtcacagacagctgttttcacgttgttggggatcaactcgggcaagtaactgctgtccctgttttgggcatttaccatcggtgcggcaccgccttcaataacatgcggcccctgaaaaggtagccactgtcaagtaacgcccatggggggatgagaggagccatcaggtcctaac

SEQ ID NO: 20 - DNA, 506 bp, Rattus norvegicus
  Genbank Accession No. AA799598
acattactatacaataaaacaaaattggaatctttataggtggaacagagaacccaccaccccatgacggactgggaaccaacagagagcttatagactggttgcagctacaaggagtggatgcaaatacaatagaaaaggtaaatttctaaatcaaaggattcctatgatactgttgaaaagctgcttatgttgttgaatgtatgttgaatctttcagattgttgaagaagattacacactttctggatattctcaatgatatcactaaggaagacctaaggtgcctcagactacggtaagagagcctgcaaacaatttaaataataaaatggggcttttttatgtgaatacttttatttttaatgctggtagtttccccgatctttgaaatttatctttcctaggttgtaacaagcacagctcattttctcaggttggcaaggcatgaagtgccagacctttctttacattgtttaaatgccaaacctctacccagatcaccaa

SEQ ID NO: 21 - DNA, 478 bp, Rattus norvegicus
  Genbank Accession No. AA799663
ccagcctcaaagttttattatcaactgtgcacattcgagttcacatcccatggtgtacagcttataacacggacagtgagagacggcaggggctgcgtgagccatttggtgaaatggtcttgctcagaacccacagtcctgggcaagcaggggcctaagagatcccaggttccacacctcagcattgagcaaatgcacacagagtccttgtgcatacggaactactgaacgcaaacaaatacagggtctccagtttctggtgccataggtggcagagcggacacacacagctgcatacttgctcagtattggctgaatatactcctggccctggtcctcaatggctgggtctggcagctgtgcctcctcattgttgaggacttctaggagctgggtgacaagaatgtccttagggagtgactcgctccgctccactgcttccgtgaagagttgcttgccaaagcacagcttcttccag

SEQ ID NO: 22 - DNA, 571 bp, Rattus norvegicus
  Genbank Accession No. AA799718
caaaaagagcaaacatgtaaaaatccagggtgctagaaatacaaactcaattcagattcaagcttgtctagaccctggtcataattcccagtgaggtgcctatgagcaccaagtcagggaacgggacaggagtgaatcggaggccaagagaaagggtggggaggggatctcctaggtctcccggtgttcacccctacagtggtatctccatcttcccaatgacttgaagatctgccaggcccagtcctcttggccccaacctcaccctaaccagagcatgaaggccgatggcaatcggttctcccttcccttgctcagtactcacttgctctggcttctagccttattcttgtcctccacattcttctccgtgattagtagcaggttgggttctgtagaaagccacagtgaggctgggggccagaagaggtggggtggagacgggatgaagacgagggaagagctgtcccaggacccctttcttcatgggatcccaaactgtacaaccagctcttctttcgcatccacgcggatctgagaaagtgcactataggcataagcagctatcctg

SEQ ID NO: 23 - DNA, 503 bp, Rattus norvegicus
  Genbank Accession No. AA799726
gacatttcacagtcaatttctacatgacttcacactttcttagaagaactcacatttggtagtctctaccctaaggagtcgcttcagtatatgggcagaagcaatgtgtctgctgaaggagtcataccagaaaagataggtcagacagtaccataatcaataaaaacagtgtagtacattacaaatgacagtgcattctataaccaatttcagtcgggaacctttctaactgtgtccgatattgccaatacaactgacaagggttctcctgtgggctggtctgagttaaaattgactcctcaccttgagaaaacaacggccctacataatgcttcagaagagctcatagcatgcactaaggccattgctactcacagccttgggcaaccaatgaagattcttctggtccactccagactttctctaagtgctggtctgctctcgggcctcaaaggattctctactggagtctgtctgcctccagctgctccaggaacagagca

SEQ ID NO: 24 - DNA, 579 bp, Rattus norvegicus
  Genbank Accession No. AA799732
aggccatactgggcttgggttttgtagcttcttccaccgagggtgggggctgtcaagggaggtgctacacaggaacaaggcaaagcccaagcctggagggatatgcccagagggacccacattcccactcagcattcagtcatggggccttctcatgacaccattcctattgcttggaccttcccctccaaatctgatcagtgggtggcagcgggcatagccagggtctagtcagctcctcagagagatcaggcctgttggcagccggacagtcagtagcccccacacagacaaggctgtggtgccagccatcctaggcaacagaggacagcgaggaccgcccacttggtcacagagccggctttcccatttggcagcccctctgttgcagcttcctgatgagttccagtaagttcatctgcagcgtcagctcctgaggattagtggtcacatagaaaccagctacccctgccttctccagtgtgctctgctggtcagcaaccttccggtccagctccaggacaatctttcggtccattgcctgctgctcctcccggatccggtgttccaaggcctcta

SEQ ID NO: 25 - DNA, 616 bp, Rattus norvegicus
  Genbank Accession No. AA799744
caaacaggaaattctttattgcaaagatacaaaagcagtcacggcgacatgtacagcaataaattaggtggtggccatgaggcagggtgcagacggggccaacagtctgtgatcttgatctcttctcaataatttataacatgggggaaaaaaagcacaaaaaaaaaataaatattgaaatgaaattgccaagtggcaggcggctgaggatgccaggcctcggcatgatcggcatgtgtccctgacaccttttgaaatagttaaagcttgctttaagaagtcagaggaacaagacagaaaactcacttttatctttaaataaaaacatccatatattattaagttgtgacaatgaaatttcagtgacacgaagccatggggcatgctcacacccttcccagccccctcctggcaggtgtcctctgcaggtgctccagtggtactgacagccctgtctcccctggccgccaagagtatggggcctccacccaggaggaccaccagaggccaggagcgggcagcaagccagtcagtggtcacctgcctaccctggagaccactcatccagttacccggcctgccagcaccaccacagaaagactgatggaggctgttg

SEQ ID NO: 26 - DNA, 671 bp, Rattus norvegicus
  Genbank Accession No. AA799751
  misc_feature (1)..(671): n = a or c or g or t
acacctaatacatgaaaagaactctgaattgaaatccagccatctagaaataattctggtcataaaatgcacaattatcccatgtgtccaaagtctgctgagtttgctctgaagtttgtatttactccaatatctagaatgtctcaggaccacatgctgatactacacagaacagaagggagctgagcagaaccacacgtaaatgcaaacttaagaactttatggtattgctctggtgccttatgtcttaagcactgaccagagagttaagtgtgagctagaaaagttttcagagaaatgagctgcagaacttcctaccccacccctaggttattcagagcaaggagggctgatgtgggggatgagaacctacagactgaacatcctgctttcttcctacctcagtccgacgctggacatcctggagtgtaaggcactagaactggcctgagaagtgctccaagcttcagttcttggtgtgcaaaagaaattgtggcatagatcttttgaaacataataaaataactcccccctcctcttatattctgttattcacagacaaaaagacaaggaggtanatgtttgcaaagattaaaaaacaggtgaatcaaaatatgaagaaagtgtgtatacntattcagatatggagaaccacttagagggcaanagtc

SEQ ID NO: 27 - DNA, 631 bp, Rattus norvegicus
  Genbank Accession No. AA799771
actagacacctttgataatgatagaatgagtatcttgtcttaaacattctcagcactatgcccttattacatatgacatctaaaaacaagatactcattctatcattatcaaaggtgtctagtaaaaaaggaaagattgacattgaagatgggactagaaacccctacttaggggccttcaaacggtttctcacacacatctgtgaggtaggttattatccacattttgtacaagagaaaactacacaaggttacataccttgtgctgccataatagcaaacagggaattagatccaattagatccggtccttagctttgcatttcttttctttataaactttaaaatataaagactgctagtaattgcattcattttaaaagcataagaaggcagccaaatagtttcccgggtggctttacaaagtgaaacaaatgaacagaaaatgcattcagtgaagacattccaatggtgacgctgtaaggtctggtcaagtggaaccaaaaggcagaagcaaaccacgtgaccgcctgtgggacaggtctcaggaaaacgggggagctgggggcagcagactttgaacacacgtttacggctactctgcaagtatttgagaatgcaccaggtactc

SEQ ID NO: 28 - DNA, 596 bp, Rattus norvegicus
  Genbank Accession No. AA799801
ccggcgctcgctacagcgctctgctcggctcgggagggaagtattggagcgcgccaagagaagggctgtggactggcattctccagagcgatccagaggctgcgtgggggtcctttacggccaggacccctaccaggaacgatggtcggtcccgggtccccagagcctcctaggagaggcagagagaagaaaggcgcccaacccttagtacttccttcaggacaatggcagaattcatggactatacttcaagtcagtgtgggaaatactacttgtctacaccggaggaaggaggggcaacccacgtctaccgttatcacagaaggaagcctgcagaagtgcacgtgtgctcagactcggggcacagggaagcgcaaagaaactgcagaggagagacatctgttggtccaggaagcatctatcaaacatcagagcattctcaagagtcatcttggcctattgagaacatctctaaggacctctacatagaagtctatccagggacctattctgtcactgtgggctcaggtgccttaagcaagaagacccatgtggttgcagttgactcggggcaaagtgtggacttggtgttcccc

SEQ ID NO: 29 - DNA, 556 bp, Rattus norvegicus
  Genbank Accession No. AA799803
gagattatagtaaaagagaatttattctatacactgtctgcctccgtgattttaatatgagaaacgtagtgcttatcaaaaattggttagatacttttttttttttaatatactacacactggattctaacccaatgaatgctggcttcagttttcatctccaatctctttcttgatccagtcaacataattcagtaacttggtgtaaaagccgtatccctcaccacacccaatgccccaggatacgatgcctgtagccacccagatatcacgactgcggtccctgactgcaaaaacacccccactgtccccctggcaggcgtcatgcttgagagttgggtccccagaacagaacatattttgagaaaatacatcattactgtttttcgtccggagccacctctggcatgcctctcgatcggctatgggcagacggacaaacctgagattaaaagctattttatcttctgttatcccgaagccgctgacataacccataaggtctttgtcataaaaggtctcattgtctgggagacagatggggaggaggttggga

SEQ ID NO: 30 - DNA, 499 bp, Rattus norvegicus
  Genbank Accession No. AA799861
ggtaacccaaccaattctttattgtaaagatgagtgctacaaaggaggcctagtgtgtagggagtggggggtcaccttctttcaagggactccacaaggtccactagagatgacatatagccaaggaataagcctgagccagggcagcagtggttctgaactctattggaagttggggttctgaatcaagcccactgacccaggtccatgaggaagtgttcaatgtcatcgtagagactattggtgctagacaagcacaggccaagactgctgctgtccagagaggacacaccctcacgctgcacgccttccagatgtgtcttgcacagccatggctccagcttcaccaggatcaggctcttctccttgggcctccctgctgacaagtcttgcccaaaacccaggtagatggtgtaatgtggtgatccttgtcgcctccgggcccggaactcctccagttctcggaagaaatgctgaagtcaaagatgggagtatggca

SEQ ID NO: 31 - DNA, 523 bp, Rattus norvegicus
  Genbank Accession No. AA799893
aaaaagtttattgtaaaaaaagtaagccattcacaaaattgaatgatttttagcagtacagctaaaacccaactgcatggcagtgagaagtagtagagtggcccagaataaaggctcttctcttaaggatgttccttttagccaataacttctgtagcatgttttttaaacaaattttatgacagcagttaagcctcatagcagattccttcctaaaaaagcaaacaacatttagaactagccttttgtggggccaattcccatcattaaactagtcccaccccctcccattaacaatccacccaccctcccaccattttggggaaatgtatctaatattactttgagccattgctttaagaaaatgggtcaaaggaaggttaaataaaattaaagggccaaaacatattgtcacaatagaaatgtattcattcccttcaagtaggacttaataggcattaattaaataaaaacaattcatctccagaaaaaccaagtgcagcttaactggactagttttggc

SEQ ID NO: 32 - DNA, 505 bp, Rattus norvegicus
  Genbank Accession No. AA799899
gacagtctgaagcttttattcagtgggtctctgtgtctagaagaaggtgtttggcctcttggtggtgaagcgtggtttgtgctggcgccgcaacacacggtggggcaatgggaacttgatcttggagtcgtggaactgcttgacagctggccggcggcacttgccagctgcaatctcttccaccttcatgatctggatggagtgcgcacgggcacggtgtcgggcacccatgtctcggtagcactgtgtgaccgcgccggcagtggtcaggtcccggtactctcggtacatgttgtgagtgccacttcgggaatcatagcgcagccagatgccgaagttcttcacacgcaggggtgacttctcaaacacctgcccacagtacacaatttccccggatgacttcttcatcttcttcagctgcgacacaaagtaccagaagcgggacttggccaccacatggttgggtgcagattcgcattcggtacagtggcggtgtgtggcattt

SEQ ID NO: 33 - DNA, 483 bp, Rattus norvegicus
  Genbank Accession No. AA799971
acataagaaggaattccaaaggtatacccaaggggcattgatcataagctgaacacgcagagggccccaacgaatggcacagagtctgaacggattggcacgttcaacttccattcatgatggctgaatactccttctggtgctcaaccattctcagaaacacttgatatttcttgtcataatattttttatcagcacgctctgggaacacaaccttccccactttgctcattcttgccattgcctcctgcacagaagcaaagtcccctgaggcacaggcacccagaatagcagctcccacgaggacagactccacctcttgtgacagaaccacaggcatgccagtaatgtcagcatgcatttgcacaaaaaggggattcttgcttaggcctccacataagaagagggtactaagagaatgtcctgctgcttccatggtctcaatgatgaagcgagtcccgaaagcaatggcttgaatagtgg

SEQ ID NO: 34 - DNA, 693 bp, Rattus norvegicus
  Genbank Accession No. AA800190
atgggtatagaagtttaatccatttctcttacaaggaggtaacagtaaatagtagaggggtgatcatgtattatggcttcaagggacctcatgcacagggcagcagatgaccagccccagaacctgcccacccacccccaaagctaccacagtggttccggtgaattgagtgctgaaaacagacacctcccagtaaacactgccagggttgaggaaagtgaggcgttttcctgcccatcccgaaccagatacagcaatgcaaggtggtgaatctctggaaggagttttatgtagttctctgacaaccctactctgccctcagggaggagcatggctcctgtagtgggtgggcttaaccgctctttctcactatgctgctgtagcagagtgggaaccaggccctactgcaggactagcagctgagtcagccagggcagaaatatccagactgaccaagtacaaggtttacttgcaaaaaaaggaaggctttagctagtttcaattcctcatgaagtgttatttcctgttgaaaaagcaaaggactaagccaaccgtctataaaattgccagtccttaaccaaggcctcaaatatgggataaaggtctctctttagtctcctcttcagggttctggggttccacatgacacccacagggttctacaggtggctacagaggcatggccccatatgg

SEQ ID NO: 35 - DNA, 543 bp, Rattus norvegicus
  Genbank Accession No. AA800202
gagtgacagtttattggtccttagcattacatcttaatctccaagtgaaattcacagacacaactgcagataaaaacatgtaaaataatataaaaataaattgaaggctacttttatatatttactgaattaagtagtgtaataaatactataagcaaaaagcttcaatcacacaattcagtttcactgaagttatagtagtgtttgtaaatatgaattttagagtttaagttacaaatattaaagcattgaaaaactagtataaaagtgaattttggcacgtaagtgagctcttcattagtatttgacggtgtgggacaatgagaaagccacttcccacctgttttttgaggtacagctatccaactagtcagcagcatggctggaatacttaacagtttacagtctttgaactgaacttttcccttttgagaagccagagcttattactgtgcaaaaattctccaagatcctaacaggattcagagggacgtttttattgatcacagcctgaagggctagtatctaggcctcaggtcagag

SEQ ID NO: 36 - DNA, 596 bp, Rattus norvegicus
  Genbank Accession No. AA800218
aaagcctcttccttccacactctgccctggtgaagccagccgcccgcacgagcccgtcctccagagtgggccaggacaaggtcatggggaagggcataaggccaaggcctcaaagggccagtgggaaggtgaggacttaggcatagtgggtgcccggtgttagagaatggccccctctgtggtccagctggtcctgcaagcgggcaaactcggccagctcgttgagctcctggaactgtcggtccgtcttatggctgaccagtgagcggtagaagtgaacggcaaagacgataaacaccaggccacaggggaccatgatggcagtggaggcgatggcagccgcctcacccggggtgatgccaccgttgttgctgctgttggcgacgacgacggccggttcggtgggtggcttggtggggcttggctgtcccgcctgcctcttgagcggtaagaacttcacccagcagagcagcacgacttcggccaggaaaagcagcgtcccgatgacggtggagaagcccaagccagctcgatgtggcggtgcatgcgctcgtgcggcgactccttgacggagttgaggttgtggacgttgctca

SEQ ID NO: 37 - DNA, 569 bp, Rattus norvegicus
  Genbank Accession No. AA800235
caaatctatataaaatgttcacaagtaggaaaataaatgtccaatttacatttcatccagattcatcagtggtatgctctctgtatatagctatagaaatgcgcgcgtgcgcgcgcacacacacacacacacacgcgcgcgcgcgcgcgcgcgcattccattcgtgtatacatatacatatactgactttttcttcagttgaaccatttaaaagttggccatagacatcaccacattttactttggtctgtgtcccacgggacaggaacattctgtacaaacatcatgattgttacagccttacaacactgctgtctaatatacatccagagcctagttcctccaacagcaattatgtcttttacagtgcagtggcttctttttaaaattattccatgtattggtgtgagggtgtctgatcccctggaactggagttacagacaattgtaagctgccatgtgggtgctggaaattgaacctgggtcctctgcaagagtagccagggctcttaactattgagccatcaatccagctccaaggtctgcctctgtctctctgtctccctctc

SEQ ID NO: 38 - DNA, 609 bp, Rattus norvegicus
  Genbank Accession No. AA800258
acagcaatgcactaaggctgcttttaatggcggcgcagtagagaagacagggttcactagcttgagctcatagaaagatacccattgactcgtgcaaacacctcaaaatagaaatctacccagagccagaccccaggctgtgaaaaccgcacagcacacgatagagatggcttcttgcattttgtggggtgaaagaatgactgtgccccaacactgtgttcagagcgtgggaagaccctttgtcttcagacggtctcacctgtgcctttacttgggtgggagatgggaagaaacatgcttcctcacacactgttttattaatacatgttttgtttcagtaggacgccatccattaggcctgccggagccctcctgggtatttctgggttgtgttgtgtacatgtgtgcttgacagcgacagcttcgcttctcatagcactgtttgccttactgttagaattccagtaaagtatcctttcccacattccttgccaacaaacccagtaagatcctgagtcctcagcaaacatctggttttaaaatctggaaaacagtcctgaaagaaaaaaaaaaaactactttctgaactctgggcttcatgacagtagt

SEQ ID NO: 39 - DNA, 609 bp, Rattus norvegicus
  Genbank Accession No. AA800380
  misc_feature (1)..(609): n = a or c or g or t
gcactaaccagaagatgatcttcgtcccgggctctatagcgcttttgacagtattggaaagggtgtttcctgagagattcctggacgttctaaagcacaggatcaacgttaagttcgatgctgttgttggctacaaagataaatgacgcagaccgcctggttttcctgaaagctgaatcactcgattcaagttgatctcaccaaatattaatccaaattctgatgtttttaatgttttctctttatcttgtctcttcactgcctccccttgaagctgtgaccatttccatgaaagccagtttcctgtcatggacccaaacagccctaaggaagttgctcctatgaagaaggggcagggacgattggcctcgtgatagcgatttccccagatactgtagctcaccaccgggttgtcagaacttgaactgtcactttttacttatggtatctgtaactgtactttactttgttcgattcacactctccgctccgtcccgtataacgttagaaaccttaacctccccgggtagaatgaaggactgagtctagtgtcatttcacagcggtgtcatgtgctctgaaacattccgtcncatgtatcagcgctgtt

SEQ ID NO: 40 - DNA, 627 bp, Rattus norvegicus
  Genbank Accession No. AA800587
cattcctaccctttattggactctaaaccgagctggctctgggcccttcacaacgtctcagacatcccccagaagggtttaggaagatgccatcattctgtgaagaaggcctagcacctaccccagacttagagcccccagtggactccctaagagcctttagggagctaaaggaaatgggtggcaggaaggcaaggggacaatattgaggaaatgcttcggtttcccagtgtctcctgagggtacactgagctctgaagaggactacttggagaaacagtcggagattcctaggctgagcagccctcatttagatggcaactttgaggagacgtttgatgtcaggctcgatgttgatggtctggaaggtgcggctgtagcgacggaaaggctcgccttctggccctatgaggaacttctcagagttccaggacacatctgagcggcgcaccggactccatatgatgagcttgggatcggtcatgagggagaatgggtcgtcataagggtacggcagcttgtctttcaggtacgcaaagacaggatgctgattctgcccattgacatcacacttttgggtaagactgaaggtgggctggaacccacccccagggcggacatacttga

SEQ ID NO: 41 - DNA, 506 bp, Rattus norvegicus
  Genbank Accession No. AA800613
cacactcaagattttatttaaaaattccaaaaaaacccacaaaaatagacttgtacggtaacaatatattacttaatatattatagtatatacttaatacagtatcagttttaacattacaaaaagaaaaacggagtagacgacccaatatatataaatactataaaatcttattacaataaataaagtcgtcataaataaagggtccattggttggggcaggggcgtgggggaaaagggatttggcaatggctttggctatttgctttgggagggaaatttgagcaccaggattctcaggagaggctacaaccaccggacactgaacttcggggtctagtaaaaattaggatactattgtgggagccgggtcttcacagcacttaacattccaggagaccagagtttccgaggggctggtgcatacctgtaaccccagaacttggaaaaggctaaggcaggattatattgagttcaaagccagcctggggtaccctagtaatccc

SEQ ID NO: 42 - DNA, 533 bp, Rattus norvegicus
  Genbank Accession No. AA800693
tatttgtgggtagtcatagaagtcaacagaccagcacagaacagacacagctacacagtgctcatgtccacaaacacactgacaggggacagcacacagggctgggagacttgggctaagaccacctaagtccagagcacgcccctcctgcacagcagggattgtggggccaactgtgctttgctctaaagaccaggggcctctggggaggtgaggtctctgggaaggactagcagggtcgggccagccccacagtgcagcccatttgacaattggtccaggtttgcaacacatgggtgagattctgacatgctcagtgccaggaatgggcagctataaaccagagcattcacgagtaacaggtttcattcttcgagggctttgttcatgaagagttcacctccatgcacaatacactgacatcatacccccatcatccaaaaaaaaggtgttgggtgttttgtgggaatcactcaggcctgagctttgagaggacattgcttctgccttcctgctctgtgagttatgaggga

SEQ ID NO: 43 - DNA, 636 bp, Rattus norvegicus
  Genbank Accession No. AA800701
  misc_feature (1)..(636): n = a or c or g or t
agcattttcaaactttatttacaactgtcacagtgacaaaaagtagtttggaaaaaaaaaatgctagtttctccctgagcctcgatacagaacagacagaagtcacaggaggttcatctcacaacaggcatgtcactgaaatactaggattttttttttcaatacgatcagttagaaatacacacaaattacttaaagaaagaagaggaggaagaggggaagagaaagagaaagagaaagagaaagagaagaagaggccagacaggagctcagccacttgtccaagagcagctgggtccccccaacaggctcaaccgctgaggggcctgacgttagctatcagcccctgacctgctcagacaacacacggttgtacaacatggtctagtgaccggcaaaaggaagaagccaccccacagacacacatatacacaaagctgattgatactggatttacaagcacatcccgtcacacggcaagaccaagacagatcggggtaggggtgagaagacaccaanacacaggaatttcaaaggccaaacacctgtccataaagggaggcgagggacgagaaatgccgtgggagaaggggagaaggatgaacagatctctgtagccaaaacagaacagagtgg

SEQ ID NO: 44 - DNA, 475 bp, Rattus norvegicus
  Genbank Accession No. AA800753
agacaacagtatgtagtagttttgaatccactgagatgttgctttcaatttgaaatattgtgtatacatgtatataaaaaataatccaatgtatgactcatctgacagatgtttaagatcaataaagtttttgaacatgcatttaggaagagaggggagaagcccaccccgctaccctgttgttgctggcttatttctgcagtggtctcaatagtggtttttagagggaaccatgtgccttcagtcttcagagttacgataagataccataatcaagacgggaggggaaatggggaatgggcaggtattaatcttaaatacattttgcactctatctggtacaagataaaaacaggttaatggggataggtattaattaggaataaattgcagtcagatcaagacataattgccgaattgagtttttaatagactgcatatatagatgtttagccatactctagatcaactcttt

SEQ ID NO: 45 - DNA, 460 bp, Rattus norvegicus
  Genbank Accession No. AA800928
aaaaaaaaatgttaaaataaattacacctgccttcaccaccagtacatgcatacagtgtggttactatggctccgggacattcagcttaggacatctcacaggagccaggctctttctcccaccccgaggccggtgtggcctctgcaaccgctttgaggatggcggacgtatggacacacacctctcactgtcataacgtgggggctctggccctattacgccccttggcaaacgaacagggcaaggggaggggctgaggcaggtaatcagctgagctgggaactccatatctcctgccccacacctgagacctgcgggtgtctctctctccctcgctagacaaaggacaagctgagttgggaggacaacagagtgcccgacagacagacctccatcccaacggcagggaccctgttctttactggctctgggtataaaagaaaagacagttcgttaaaa

SEQ ID NO: 46 - DNA, 533 bp, Rattus norvegicus
  Genbank Accession No. AA801165
ccgtctgtttgcgctctcgtgatgtccggccgtggcaagcaaggaggcaaggcccgcgccaaggccaagtcgcggtcgtcccgcgccgggctgcagttcccagtgggtcgcgtgcaccggctgctgcgcaagggcaactacgcggagcgcgtgggcgccggcgcgccggtatacatggcggcggtgctggagtacctgaccgccgagatcctggagctggcgggcaacgcggcccgcgacaacaagaagacccgcatcatcccgcgccacctgcagctggccatccgcaacgacgaagaactcaacaagctgctgggcaaagtgacgatcgcgcagggcggcgtcctgcccaacatccaggccgtgctgctgcccaagaagacggagagccaccataaggcgaagggcaagtgaggcggctgctggcaccggcccgcgtctctacgaacccttccccccccccagagaactctcaaaaaacggctcttttcagagccacccacagaatcagataaagagttgtgtcacggtaa

SEQ ID NO: 47 - DNA, 543 bp, Rattus norvegicus
  Genbank Accession No. AA801307
aaaaagcaatttaccagggctggggatgtagttcagttggtgacacacttgctcagcacaagtccctgaatgtcattccccagtgctgggggaaaatcagaaaaaaagaaatatttactactaagtccttcctgatatggagagaaaagggagacgcgtgtagaaccaggtcttctccataggcgtttctagaacagttcaggcgagcacttggcccctcggagagcgaagctcgcacttctagtccttcccacccagatgcagcgccccctgtctgtgcctctcagcatgcagttagatttggacaaataagattcccgaggaatgactttctccatgacaccacggtttcagctttatgtaaacacacacacatccccttatagttctagtctggagatgctgctgccatgctggcctcaggtagactgtgtgatgtttttaccactcagaggaggccaagcgtggggctgaggtgtggcctgaaccttccctgtatggagtcttcaataccaactctcaagatgccacgctaccccctgc

SEQ ID NO: 48 - DNA, 285 bp, Rattus norvegicus
  Genbank Accession No. AA801395
aaataaaaaatggcgtcttttattcatcaatccccattcacactgaaattcatgcatctttcttacattacttcgcaacatccttgctatcctttcccccctaagtcaacctgatgagttcatctttaagctcaagaagtttttctttttatttctgaaatgctacttacatgttgttgtctcaatatcaaggccaatctatgaatttattcttcctacgggtgaaatgggtgttaatacgggaacatgtgagcacctgttcaagatgacagcaaagttaggccc

SEQ ID NO: 49 - DNA, 522 bp, Rattus norvegicus
  Genbank Accession No. AA817726
ttttttttcttttttttgaaacacaaagtcccatttagtgtttttttctgatgcacaaaggagttcactcaatacattaacaataagcaaatcatacagatactgaggggaaggatgtccccttgactacatacacatatatgtatctattcttaagaacagcaatcaagaggttaacaataatggaaggaagaagtagacaggtaagtcactgccaaataacacaagttcataatgatcggttactcaagtaacctggcaaatgcctgctcagaatttacatttactttcctcattgactttcttgcctttgtgtttcagtgaatttggactaggtccaaaaactagaccttcaaaactccatctctcacattcagtgctgaagatgggcatgaaggtggagtatacttgagaacatgcatggtaacgaatgtcaaagagttttctcacagtgacctttcccctgtctgcttcttcccacacctttagaaatattttcatgcttcctctggagacattaga

SEQ ID NO: 50 - DNA, 493 bp, Rattus norvegicus
  Genbank Accession No. AA817921
tttttttttttttttttaaagcagcagcaaaattttattcatgtgaactgttaaaaatgaccatctataccagtgtcaaatgagggagggaggggaaggcagggcagagcagggagacgaggggaggagggaggagtcccctctactggtaataaagctccaggttcatcccgtcgtggatctcatagtctcccagagacacgtggtctttaaaaatcgtgtaccactttttaagaacgatcttattccagcgggtgccagtttgagccgctatcagtttcttcaggtcgccgatggtgtcatcggtgttgcacttaacgcggactttctttcctagacggtcgttgcaaaccacctcaatcattgtggctggagccggctttgcctcccgcaacccctaggctcccaagtcttggcagcttcccgcgatctccggcctctccgtttagccttctcacctccaatgtcctcgaacctagcgaccctcgtgccg

SEQ ID NO: 51 - DNA, 337 bp, Rattus norvegicus
  Genbank Accession No. AA818005
tttttttttttttttttaaagtggacaatacaatgtttaattctttgcaaacacaaaagtaggactaatgatacagtaatttaagaatgccaggattatgaaaaataggaacacattcattttccttcacaaagcattaattcttttttttttaagtgtcttgggtttgactgtgagaaaattaataatagtattgagaccacaaggtaatcagatataatgagaagttttcaataaaaacaaccaaatttaatcctagccccctgacctttcaagctttgtatttccttgtaaaactgatgatataaactcaaaggctggggttcctccctaatta

SEQ ID NO: 52 - DNA, 394 bp, Rattus norvegicus
  Genbank Accession No. AA818016
  misc_feature (1)..(394): n = a or c or g or t
tttttttttttttttttgtttaaaagcataaacaatgtctttattccatataatatttgtgcattaagaacaagattgcataggtgaatataatacagtcattctgaatacagtctgagtacatgctcaagcctaagagaccgacctagcagctgagcaaccgcagggcaacaaccatgcatcttcatccccacaactttagtattttttgccaaagggagatttgagtaaaggagaatgccgtgagcgcaagatccgtgcgtaagggctgctgtctgtcgagctttggcaggtaggtgtccggggaagtaagtgtcgtaggaatggtttcttccctgngggttgatgattcggttgctggttttcctggtttgctcncagtcgctttttggca

SEQ ID NO: 53 - DNA, 532 bp, Rattus norvegicus
  Genbank Accession No. AA818026
tttttttttttttttttacaaaaggttaagctctgtttatttggagtcacaaggagctgattgagtcactgtgactcaagaccacaaagaaaccctttgcctccacttcagtctcaagcctgtggtgaaaacctcgaccagcacaagtgctcttggggcccattcacaggtttacaagtttctcgttgagggcaatctgtgactgggtgagattggccaggtaggtcaccatcagcaggtcgttgatgttgctgttgagcatggtttcaaagtcatcaggaactatcttgggtacttggttgacaaggctcatcaagaagcggcctactgtgttgtcagcagacactttcccagacagcacatcctcagcatactgcaatacagtgcttagagcatcctggatccgggctgaggcccctcccacttgctgtaagtcactcgagagtccaatcacccggttggggctaaaacatgtcttcatgatgaggtcaactccaatgcgctcagtgtcataatacgcatacttcactgt

SEQ ID NO: 54 - DNA, 525 bp, Rattus norvegicus
  Genbank Accession No. AA818089
ttttttttttttttttgattgtaaatttgttcagaattccttcaactttaattgtgggggtaaaatcaagcagccactgaggaaaaatagtccctggaagcagtcgaaacgtttgtgtagtggacacgatgagttatttattagcacaggttgtcacaagtcgccagctgttctcattcttccactgtctccttcttgccagtctcttgcccttcaaagagggggtacctggcctccacatcagcccaagtgatgttgccattggccagatcacggaccacactgggcagttcagagacctctgcccttatctgtctcatggagtctcggtccctcagagttgcagtgtggggggtcttgttcactgtatcaaagtcaatggtgatgccaaacgccacgccaatctcatcagttcttgcatatcgccttccaatagacccagaggaatcgtcaactttatgagacacgccatttcgagtcagagcttccgataattccttgacaaatggcataaactcttggttt

SEQ ID NO: 55 - DNA, 461 bp, Rattus norvegicus
  Genbank Accession No. AA818224
ttttttttttttttcttatacacatgcttttttattcatatagatttctgagacaatactgtaatcttgaaaggaggttcacactattacatcaacagtgaatttcagacagaggcaaactgagcaccataatttacaaatagaaagaccatgctggaggacaacagaagttcactaagggtgcacaatgtatccgagaagttcttaagcctcatcctcgccctcctcctcctcgaactcgccctgctcatcagccgtggcatcctggtactgctggtactcagacaccaggtcattcatgttgctctctgcctcggtgaactccatctcgtccatgccctcgcccgtgtaccagtgcaggaaagccttgcgcctgaacatggcagtgaactgctccgagatgcgcttgaacagctcctggatggcggtgctgttgccaatgaaggtggctgacatcttga

SEQ ID NO: 56 - DNA, 425 bp, Rattus norvegicus
  Genbank Accession No. AA818261
tttttttttttttttttggatccaatctctttattgtcagccctccctaccccccgtgccgcccttcacaaccccctttactttcaaacctatagaaaaaccccaagcctgggaatgtcctgggaaaaaaagagcagagtgcttctgcccctttactttcaaacctatagaaaaaccccaagcctgggaatgtcctgggaaaaaaagagcagagtgcttctgccccttggcccaggcagtgcagacaggaagagtgcgtgggataagggtaggccagtaactccacttgcaaaggatgtagcactcactggctgggatgcaatggggagagaagttactgctgccagccttcctctggtactctctctagactggcatccagagatgggtgcctggcttgaggcctgagcctcgtgccgaattct

SEQ ID NO: 57 - DNA, 495 bp, Rattus norvegicus
  Genbank Accession No. AA818359
tttttttttttttttttgacatgattttggtgaagatactttattttccataaaaatataattgtacaatgctcttctaaggaaaaaaatccttcatttgcccccaaataccatgtggtttaatcatctcttatctcttaaaaaacaaaatatgtattttaatatttgtaaaaacatgcagctgatttctgtgaaatatagtatttgtttttgttgattttacccgcctttaactaaaagtgaagcccagcttaaatctgttctctaccaccagccaaagcggacccatgcggcccaagatgatgacgtcacagctggagacgctgggctgtgcacagggcaggcagtggcaggggctgctgcactcagggctgatttgggcgtcacaggactatgttagatgaggacagaaagcacactcagaacttcacatagcctaaaggttgacctgaccagatcagctccatgttgcaccagttgctccagtgtgtggga

SEQ ID NO: 58 - DNA, 564 bp, Rattus norvegicus
  Genbank Accession No. AA818421
tttttttttttttttttgaaaaaaatgtatcattttatttgcacacttagaaaagttgtacacagaaacttattgtttgtaaaacagaactgttaggatgacatttttatttttaaatcattaagactggttgagaaatagaacaaaaacatagtaaaatgtttaaaaaattaaagaacattttccaagtataaattttataaatacaaaacaaattcacaaatgactttgaatgctaaataaatatctagttaataaattcagttggtactggctacagcacatcagagctagcgaactggactcactcatgtgtagtgttgaaaccctatgacatggagctcagacacactctctatggtgtgttctagcaggctcaccgtggagacaagacctccttactactggaactcctaaggctcaatgacaaaatagagcatagatgaaaaatattttccaagacacctgaacacatgaatgatctcaaaatatacacaagcctctgtaacccagtactgtacccagtacgtctatgcaacttagtagacactgaacaaaagctgt

SEQ ID NO: 59 - DNA, 555 bp, Rattus norvegicus
  Genbank Accession No. AA818512
tttttttttttttttttacagttaagcaaagaacttccagttttttatttttaaaaattatttaacaagaaaaacagtcaatcaagtcttaaaaaattagaatggattaatttacaataaaacagtcaacttaaaatatgagccccttcaggaggaccatggaggccaatagttctcctttaaacagcaggattgcacagttgacgttctgacctagatttaacagcacagaaatacaaaagccaaacaacttccaaccaccttcccttctcttcagagtttaaacacttgcttagagaaatactcatatttttagaaaaccagttgtatttttaagaatatctacaactaatctcatcgagaacactcttaaaacaattcttataaaacacaaataccttaaaataactttgtggcacatgagatagcttaaagaaatagcacaataaaactaatgttcaagaatgatcatcgctttctcttctaaatagaagccacccaggcaaaacgtttcccattctacctctgtgtcccacaatcagcagagctaattct

SEQ ID NO: 60 - DNA, 419 bp, Rattus norvegicus
  Genbank Accession No. AA818574
tttttttttttttttttgatttttaaaaattatttaatttagtagtttttttttttgaaaaaaagcaataaggcaaaaaaactgaaaatatatatagatatatatatagtcttattttgctttcatgtgactttattccatcttcaggacttctaagcttcttccgttagcagggatctgggaaatcaagctagaaatgtagtgcagatagaggggaaggggctaaagcaaggaggttccttgggaaatttccactctatccaaagcctctggaatggtattttccccaaggacccacactggctgaggctcaacagttaaggaacaaaaacaaaaacactaacaaaaagtacacaaggaaggcacctcaatttatgaccctcaaccaagagtgggttgcacaagggttatatttctga

SEQ ID NO: 61 - DNA, 470 bp, Rattus norvegicus
  Genbank Accession No. AA818615
tttttttttttttttttaaagataaaaacatttcttttaattggtcttggctttgatttgtaccgccaagccctggagacaccgatacaatttgatggtaaacaaacagaactgcggcagttagagagaacacagacccacttcccaggcaggcaactgtttcccaatccccctcatgctacttctgtgcttctgttcagaaaggtgatactgtgtcccagccctagcaaggctgaggcaggaggaccaccagtgtgggaccagtatgggataggatacataaggaaaccttggttcttgttgtttttaaagggaaagaaaaaggtaagtttgaaaccgaattgtgcagaaccgatcacaactcatactaaggatggagatagtcttttaccaaaaaccaacccggtcaccagcactaagatttgtttctctggatttgaagaaggaattgagaaaatgatctgcaccaa

SEQ ID NO: 62 - DNA, 448 bp, Rattus norvegicus
  Genbank Accession No. AA818658
tttttttttttttttttggagtaagagttatatttatttggatcacgaagtataaatatgaaccaggttttggaaatataggttgtaacagttcagaaatggcactagaaacttccatggggtctgtgacagcacacatcacagttttggtgagaccgtggtctccttacccaaaaccttccctcccgccaaccttctctgtactaagtgataggtatcagttaccaagaatagtcaactccaaaattccctgttcttcctcagcctttttctttactaatgccttctccaaactgttctgtgctctaccaacccctgcatggagtagcaccagaagaatggcaggataagggaaatgtcttgatacaaagggagtgacacggggtgatggaggaccgggaagctgcaggaatgggcgcccaatctttctgcctcgtgccgaattctt

SEQ ID NO: 63 - DNA, 537 bp, Rattus norvegicus
  Genbank Accession No. AA818721
tttttttttttttttttggagggtgggtctcagcatttaatgacagctttaccagggtctgctctccgctgcccaagaggagagcacaagtttctcagggaaccactgctcacaagcagatgtagtccttggatgttactttctgtgggtggcaccactgccttcaaggaagggaggcctggaagaggctcgcagtctcggtacccctcagagcggggagcctacttccgctttctgtacctgctcactcttgtgggtaccatcacagtaagggggccgccgagtggccttgcaggtacagagggccactgtgcgtgtctcttcggccttgaacttgagtggggaaaggccagtgcgctggaagaagtgggagccatcgcagaagggctgattcttacttcggccacatacacaccacctgtaggttttcccggcaaccagctccaacctgatgggtgttttctgtgccaccactggcttggctggatctttggggaaccatcgggccaaccaagaggagatttccccctcgtgccg

SEQ ID NO: 64 - DNA, 596 bp, Rattus norvegicus
  Genbank Accession No. AA818741
tttttttttttttttttgttgcctttattttatccctatttgaccatcaaatatgtttacagaagatggtttacaggtgcttgagcatcccactggattctctaccatttcaaggtgcaaaagaggcttacagtgtgtttcattaaacaaagcaaagctgcgacaaaacaggatcacatcaatagtagtatgcatcagaagagtgtagtaatccatcaaacacaattgggcatctgtgcctttcctcaaaaagaacaagagctctacactgaagaatatgtagtgcacaagaagcattgtttgtaggctgtgaaggaacataaactggcataatgtcacttattaattcaagtctcgatgacctatgacctctctgtgaatacaaaggggtccaatgtcttaggcacctgctcatgggactgtatgtttatttccagggtgcacagctccatacaaagacactaaagatgggtttggaacatggcagcatttacatatttgaaaaagttcaggcacattcggatacaaaagaaagggggggaaatgcaaatagaaatttctcttaagtctctgaaacacagtgcaaaattgagaca

SEQ ID NO: 65 - DNA, 544 bp, Rattus norvegicus
  Genbank Accession No. AA818747
tttttttttttttttttgggttttacattcgaatacagaactttattaggaaaaattgtaggtgaagatacatcatttttcattgatatgacttcaaagtagaaatggcctctcaaataactgtcatatattaaaaacgagaataagaaagcacacactgcgtataggaagctgccttctcctggaccattttcacattatctgggagacagaactgaaacaaaatacagtattcaccacatgcaacactgaaaccatcgctgcgtagacactgcaagctctgcggaggaatgacttctgtgaggaagcccctggtgacgccgccgagataatcacccatgagaagataaacagaactcgatggagaggcctaaaggcctcatgccaagtcccacagaggaatgcagccttttgctctccaaaccctccctcaaagccgaccaagcaatgaatcagaggggtctgccacctcggctgcacttccttcccactgtccccgaatagcaagcagcacagtgtaaacacaaggtacaaatctgggttt

SEQ ID NO: 66 - DNA, 368 bp, Rattus norvegicus
  Genbank Accession No. AA818761
tttttttttttttttttacaccgatggacgttccctttcctagctgacattgtaaaactccaggtagttgggagttaaacacaacccaccgtgggaaaagtaaacagactttcttaaattcgctggtaaaaaattctatcttgcccgaagaggtcgtgtctaagacagcaaatgagaccacccacccaccctttccgcggtagtccacgccaggcgatcagtctaggctgaccagtcccggggtctccagccacttcaatcaactctgatcgcagcaagatttgatttgttcagttctggatctcagccgaaggccggctcgcccacagcagcctgtgggggcgaggtgactcaagtcacttcccagt

SEQ ID NO: 67 - DNA, 488 bp, Rattus norvegicus
  Genbank Accession No. AA818770
ttttttttttttgttttccctcagaaagctattttatttggatttcacacacaccaaaagcagagaggagactgtggggctggccctctttgggctggagtctctggctcccctgggcagtcggttcccagcctcccaggcttgtcatcctctgaaggctgagtggggtgtctgccctgcaccacagctcttctccaaagccgaggaaaacccatggggaatacagggtaagaggacctaaggatcatgggatgggagcccacattgaacctcggtgaggtagtctgtcgcctgaggcccacacgggtcctgctgaggtaaaatttgtaagtttatttcagggacgtgggtcaggactcctcggtgccagagtcatcctcttcatccccaaagcagctgtcggcctcctccacttcaccgtcctcatagtagtcgtcgtagaagaggtctgagccctcgtcgggcgccggcgccttggcctcgtgccg

SEQ ID NO: 68 - DNA, 407 bp, Rattus norvegicus
  Genbank Accession No. AA818801
tttttttttttttttttaagtaaacactgttttatttataattacagaaggaaggaacgttttactcagtctcgcccgctgaaaatatacttaagtttgaacagccgttcaattatatcaagagtaattgcccattgctggtttgtggaattgatccaattccttgaaaaataagcatgtgtgttatcaaagcagaatttcattggacatcaagtcgtgccccagtggatttctccccaacaacaagaggcgtgaaatttccagagccagcaggagtgacttgccctttcatttctaagggctgttcctgcagctccagtgtgacatttgcttaaagatgaagccagccccattctaaataaaggtatctggacagcccttcagcgatgaatgttttcctcgtgccg

SEQ ID NO: 69 - DNA, 479 bp, Rattus norvegicus
  Genbank Accession No. AA818875
  misc_feature (1)..(479): n = a or c or g or t
tttttttttttttgcttaattcttttattggaaaaaaatgtatcttaaaagtccatcatcaactttttaatataaattatgactcaaactcattccaatcaccttgttaagtggtggcagcagacatactagagaaggtagctcgaggcagaagagcatcagcaggaaggactgctcaaaaaactaacgcacaactggagctcagggtcacccacactatgtccaaccttttgccaatggccttcctgggagcatgctgccaggggacacaggtcctccagcaagtattcacgtagcctccaattaataagctcctctagggctatgaggtgaactcccttagggaggcangcctgactgaaaccgcacggaggcaaactccgagtggacatccgtgaccagtcttagagcctgagacaccagagtgcagagctttggacaaatgaaagtctcagtcactagaccgggggtaactggac

SEQ ID NO: 70 - DNA, 582 bp, Rattus norvegicus
  Genbank Accession No. AA818907
  misc_feature (1)..(582): n = a or c or g or t
tttttttttttttttttgaaatttgaagtctttattgaaccaattgcatgttaggttacaaagctatttcacttttccaaaatgctgtttctctttgtagaccaatctggccacaaaaggctacctggctaagtattagccagaaacttctaaatcccagtgtgatcttcttgtggcatttttccaacaaataatgcagaccaaatcacaagatggccacctcactggtcacatggtccttaggttaatgagcagaggctgacaggctgtctcctcactcttccaagaaccgcccccaagtgcacacaggccctgcttcgtctcctcatcggcccatcttctggtctccttcctcaccacaatcttcacctgaacagcagtcaaaaggcgcggtcggtaggccgcggaattatcactgcgcatgcgaccattagggtccgtgcttctactgccgaaatggagaatcccggttccttagcagcaggctccgtatcccgcggccactgaggaaccatccggggatgcagaccgagtacggtgggctggagaactgggagaatggggggcggngggcaagactgg

SEQ ID NO: 71 - DNA, 613 bp, Rattus norvegicus
  Genbank Accession No. AA818911
tttttttttttttttttcagtataagtttttattaaaaagtgcattttgattaatttatgatttaggtaagttgtaagattatcagtatactctctggaataataactttacaaagatttaaaacaaacaaaaatttaaaagcctttttatttccttcaccattattgttttacaatacaaatatcaccttgtgagtagacactacacacacacatacacacgcacacatacacgcacacacacacacgcacacatacatgcacgcgcatacacacactcttgcacgcgcgtgcacacacacgaaacctacagaaggtaatcctgctgcacataaaatacagaaaggatattatatttatatttatatttatatatatatatacttcttcactcttagaaaactattttgttctccacgttggcaagtatagagtagaatacttccccaaacatacgtatgtcaggagtaaaactcagagttacatgcgctttctgcacaaatatattgtaaagaaatagctctctttttgctgttgttgcccaccagcaaacctgtcatgagagtgtggataactaatttatagctttcaagtttcaggtaagtgatcattt

SEQ ID NO: 72 - DNA, 582 bp, Rattus norvegicus
  Genbank Accession No. AA818998
  misc_feature (1)..(582): n = a or c or g or t
tttttttttttttttttgatgttttatatatattgtgtttaatctgataaagtatatgatccatgtataatgatgtatttaacatatctatgaagcacccaacagaggggcagctacttccttaagacattataaggagaattcacttgctgatcactgaaggaaaggcaatagacagaggggaataggcacagtagtcagaaaacatactctccctattgctagtaagggtagcagaagtttccaaattttgtactatggtttctaggaggagccatttggagcagatgataaaggaatgttacataaatcctagaaatatgaaggggctaaattacatgagtccagtaccgaagggtataggcctgcttcaaactcaggaacttaagggaagtctangagcaatctgacaaaaaggagttatggagatctgttggccattcacactgcttccccagagcacagacagcagctctcttttgcagctggctgccatttattctctcttttcaatcaccttcactctttgctcaacatccaattacatcccccggcccaaccgacatcatcttgtgtttgagt

SEQ ID NO: 73 - DNA, 518 bp, Rattus norvegicus
  Genbank Accession No. AA819008
  misc_feature (1)..(518): n = a or c or g or t
tttttttttttttttttccacaaaaataagagtccttttatttttgatggttcgattcaagtctgtgggcaactttagaggcgatacaattttaggaagaacacacacaattacatcttgtctgtaagttttactacaataaataaggaacaaatggagaacatgttgtatatcccaaactttggacaaaatgcagtttactcgtggaagaccagcactgggaagtctatacgattttgtgttcagagatacataatcatatagatttataattaaccatgtgtcctaatatcctttatgtttaaaaaccgcttccaaatgaatggtagtaaaggcgggaaggcttctcaagaggagcagaggacgtgggtggggatttttaaaaagtcgcaggatatcaatagttaccaccttctgactgctcagtccttcactgcacggngaggctttgggctactctgggtttccaggcaactatgccccagaagtacaatggagggcaagacaagcgcaagaac

SEQ ID NO: 74 - DNA, 624 bp, Rattus norvegicus
  Genbank Accession No. AA819081
tttttttttttttttttaactcttctaagattttattgaaacattttaaaatcaccacatatgaataagttgtcccctaaccagggcattagtccaaaagaactaagttaggatatttgtgctttacccaaatggtaattatgacagacagtaataggagaactgacttagcgatgagatagagcgatgtgtatctgttacgtagatattttggataatcagcagagtgacgtgagacctgatctcgttgtgggttagtgcagagattgttcaggcacttgtcatcctttgggcaagcactgcaagtggctccctgcttatatggccacgttgggtaattccctgctggtccatagttgcaaataaaatttgctcctctggggcagagttgcactgcacagccaatcttgtaactatctgcccaaacaatctgagtgtaatgcccacagacttttttacatttcccagtgctgaagtcatagtactggctttcttcaaaccaggcgaggatggccgcacgtactgagaagagggatagagagccaagccaaatgttttcgcccaggccagtaaagtttgggtgtattcgcgaatgcagctgtgggttgtgttgaaatacacaag

SEQ ID NO: 75 - DNA, 531 bp, Rattus norvegicus
  Genbank Accession No. AA819234
  misc_feature (1)..(531): n = a or c or g or t
ttttttgttttttttttaacaaaacaaaccaaactttacttgcatttagccattaataaataatttacagtatgtacacgcagtggtgctccacacaggccgcagacatgtggactcagtgaggggtccccacttccaagcagaacgtgatcaaacacaaccaaaataaagtgcttcgactcttttacttccaacatagggatagctaaaaaaccagcagggaggagaggggcggagctgacccctcccagctacccatgtggttttggcaggggttgggacctctgggagggagaggcaggttctgcagcctcctggccagtgtatggagaggtccctggggagcagcacagggctgctataaacattgagtggggctagggtaggctctgcanggccgctggctgggtggcccatggggctggctgttctgttgtgctggtcgcttggggggcctctggaacagcagcagagttgggaatggctctgggctctgtgggtggactctcgccttgagctgaaggagaccta

SEQ ID NO: 76 - DNA, 630 bp, Rattus norvegicus
  Genbank Accession No. AA819269
tttttttttttttttttcagttatgtaagtatttaatcagttctttagaaaacttcctgattagtaaagttggcttctttgaatagccttaaacattggtcaccgtttaaacaagacatcctaaaacaaacaaacagaagcaatcacataatgttcatagtaatttacaagaggatggtacacacgcagatacagaggtagaaattcactttacaatgtttcactaatacacatataccaaattcaaggcacaaaatagtttgctttacaaaaaaatactgtaaaaatgtcatttgctgttctacaatgtgaatatacctttcaaggaatctttacacccttcacaatactccatacaagatccgtcccccacactaatcaaagctggcacgaatgtggggactttttaatgcagaaattcccattatctttgtagagctgctgtgttcggtagacaaggtcctctctcctcccttaaacatgagtttgcagctccgtgaggaaagggcactttctatatgcagcaaaattcacaggtagaaaatgtataaccatttggattaaccaggtctctaaacatgtaatctagtatttcagagatttgatttaaaaatcaccaactatttagtc

SEQ ID NO: 77 - DNA, 621 bp, Rattus norvegicus
  Genbank Accession No. AA819306
tttttttttttttttttgaagttcaatcgtatttattttttatatagaattgcgaagtaaaacctgtaccaaactccagataaaatggtttgatctgatggatttggccgcacatttcctgtatgtagaacatactggattataaatcaacaacacaggtcccacttggtaaaacgtagaaataaaaaaaagaaaagaaaaaattaagttaaagtattagcacatatacagtgtcagaaggggtctccgtcaatcaccattttgaattaaccgttttcctttctgaatggcttgttttgttccacgaaagttggactttcagaagttgcttctaatcacatcataagaacacagtactccgtgacatgcctatcaattcacgtcaccttctgcagattcctttctgctgaacagtgcccaggaggctgaggcttattctgttttatgtgcttctcacacaccgagaaatcaatcacaggaatacattttacatcctggatactacagtgaaactcggcctaaatatcacctactgctaacacatgacagaatgtttagctattcaaatgcttcagtaaagtgtatcttaccaagagaaatgtgttttgaatcaaactttta

SEQ ID NO: 78 - DNA, 566 bp, Rattus norvegicus
  Genbank Accession No. AA819376
tttttttttttttttttcagtttctagaggctttattttgacgtatatgaccggacacaagcgggcggatagcgctgggtgtacagaatagggccagcttgggccaagtactcctccaccacacagaagacccggggaaacgcaagcgcgcctaagcgccaatggagccacgtatgtatccaggcgcaggtcttagggtgtgtagcttccaggaaagaggagcagataacaatttccagaattcgaagtcttacatttcctccacagaagcaaaggaacgttcctcaggtcctccttttttttctcattaaaacgtagtttttaaaatgagcacacacacaaccaacttatacagctgtaaagttcaaagcagtttgcatttagggaacgtgcacttggccagatgtgagcgaatgagcagcggatactgaacgagcccaggtcccttgcctctaggagagaatccccacagcactgcacaggcccacagctgggacgagtgggattccaggcaaggaaattgctctaactggtcccttcctctttaagcagcacccatcccattt

SEQ ID NO: 79 - DNA, 612 bp, Rattus norvegicus
  Genbank Accession No. AA819391
tttttttttttttttttcatttttaaaaaataaagtttattagatcataatgttgtctgaatttaccacctttttcaaaagtcaactcagcttccaatgtagtctacaattggttaaccaaagccagcaacctatggatagcttcactgtttacagtcggcctttcactagccagacaaacttcccgaaatagttgtaatgcctgattcatcctctcaaattctcttgcttttctgtgtcccttctgaataacttcctctggaagattagcaagccttgctgcattaaagccatagctcttaggacaagctcccttaatgaatttatagaggaaagtaatggtctcctggctgggatcctcacattcattttccaccatgcatgccatatgtcctaggcgcacacaaacatttttagaataatcctctactaatgaatgatagtgtgtagaaaacagtgttcgacactttatggtttcagcgagttctttaacaaccgcactggctattgctgtcccatcaaaagttgcagtccctcttcctaattcatccacaagtaccagagagtgtgctgtcgcatgcctgagtatgctagcagtttcgctcaactcaa

SEQ ID NO: 80 - DNA, 462 bp, Rattus norvegicus
  Genbank Accession No. AA819517
  misc_feature (1)..(462): n = a or c or g or t
tttttttttttttttgtggcatctgggactcgctttattggacacatagctgtccaaaccttgctctgagggctggggcctgaggcccaggcaccaagtctctgaggaagcctagtagtcagggctgcttggatcgaggccacaggcggctggtgagtgagccaaagaagaggccctgcttgttggacttggagagctccgccaggcgctgctgctcctcctgttcaagccggctctgccgctgtttgaatgcctccaatgggtcatcctctagagcatagtgctccagcacagtccggacgtcctctacttggttcagcgcgatggtcttgaggaaggcagacaggtccagcaagacccggtcatctgagttgccatcccaaggccgcaaggcgacaccattgaagggctgtangcggaaagcttccttcttgcagtccacgactactactcgggctgggt

SEQ ID NO: 81 - DNA, 480 bp, Rattus norvegicus
  Genbank Accession No. AA819526
tttttttttttttttttccgaagcatggcaccaacatttattaaccctcacaacatccctgtgaggtaggtcaacatgtcctttatagcagagaatggagctacaaggctagaggatctcgcccataccggattgaggaggcttcaagagcagctggtgagggccggaccgactccagaagggcgggcccttggtcctgcgctcacccacgcaggtgtatttctatacataccgcgtgggtgtatttctaccaatgaaggtcacatacaggaaggaatgaaggaccaacacggtgtccaggctgacaataggaaaacggaggttcggatggctcggggaaacatgtcaatcacgagagcaagcacgctagccagcacagggaggccgagagaagatgtgcactgagagagactgggtctgggtcttggcctgcaaggtggaccctgaccccggaatcttcaggacggtttagagaaatgt

SEQ ID NO: 82 - DNA, 506 bp, Rattus norvegicus
  Genbank Accession No. AA819558
tttttttttttttttttaaatctcactttttttttaatgtgattaataatgttgttttcaaagaagcaaatcatgacaggcagggaagaaaaacacagcagagatggtgtcaggctccacttttcaggccactgctattctacacagaaaggaagtcttatgtgaatggcgtcctcatcctggaatgaggaccaggctcatccacagggagcgataactaacgtctaggactaaggtctttagaatgcacctttccatgctggagtctatctgagggaagaagcgaatgaaaaccttggtccttggagaggaaacgtaactagaaatgcccacaatgcaatctgctgctggaaatgcatctacattatttgggaattgccagaacattcttcactctgtacatagaatgctagtattgggtgacaagatgcattgttagttgtcattttcaaccaagctactagatgtgtttctaaagtgcacgtcagaggaaaaaggacctacta

SEQ ID NO: 83 - DNA, 573 bp, Rattus norvegicus
  Genbank Accession No. AA819653
tttttttttttttttttacttctggttttgatcatttatttcagaaaattgaaatatactatactcgacattgttgggcgtcttcaggtcatcccgatgttctcagtttcccagatgctttgtgtgtctgccttgtgctattaattttcctgtggccttgttggtcagatccactgaggcaaatgccagcgttcttccttgcttcagaatatgtgctgtgatcactatttcttctccgatcttagcaggtgacatgtacgttatgttcatgtcaatactgactccgggtgcccctctttctgtgcacattagagccatggtggatatgctgtccacaagggttgccgtcaagccgccgtggagagtaccaaacttattagtgtgctgctcctccactttcatttcacagattagcttttcaggagcagcagagacaagtgtcaccttttccaaaactctatcaaaaccgggaactttgaacataaccttcattatttcccgtagattctgggtcatgttgctcatcgtggacgcaaagcaagagtctgggctctgcgagaatgaactttggaa

SEQ ID NO: 84 - DNA, 478 bp, Rattus norvegicus
  Genbank Accession No. AA819744
tttttttttttttttttactaatatagagattttatttgaactgtattgagttcttacagcacattgcatgtgtatcacaacgcaactgcacagtttggatatttggccgcatcatgtcacttacacccacatcagctctgaaagggtgaacgcatctgagccagaagcccagtctctccaggccatgcaatctgttcactgatgggacagtccctcaaaacagccacacaaagtagacagatacagtctccccgaatgttcccgatccccctgaaaacagagtgaagtgcaatgaaaactggtaattaaaaagccacttgggactggcagtaacatttaatgattgagaaaatgcttaaaataattttatgtatcagagacaaactgcttgtcactctttcattgatcttaggaatttcccagacacaaaaatctccattatccagctccattaaaatgagaagaaaaaatgtgcta

SEQ ID NO: 85 - DNA, 145 bp, Rattus norvegicus
  Genbank Accession No. AA819776
tttttttttttttttttctcttccttttcttcagcctgatcaacattgacttccttgtcacgttccttctccacacatagagtcatggggtagccaataaactgggaatgtttcttcacaatttcttttattctcggttcctcca

SEQ ID NO: 86 - DNA, 579 bp, Rattus norvegicus
  Genbank Accession No. AA819889
tttttttttttttttttaagagaacacatttaataagcaatctcagtcttattaccacagcacagccagtttctccttagagttgacgctgaagacaagcattaccttagccctacttaacatgtagaaggtaaagggagattaaatattatcaaaatcatagtcggaagtaggctcttagtcaccagaagcagtacaagtatttttacttttatcacacaggactatttttaagacattcttgtagtgttttgcccaagtgttacaagccaattgtgcttatcttaaaaaagagagcatcattctctctttttccctccaaagactgggtttctctgtataacacctctggctatcccagaactcaatctgtagaccaggctggtcttgaactcaaagagatccacccgcctctgcttcccaagtgctgggattaaaggcatgtgccgacaacacccagccattctttcattttttagttccccaaggatgtgtgactttttgtgtttttcaacagccactccaggattcaaagtaacaagatggaaatatgataaatacttttaaaagaatataact

SEQ ID NO: 87 - DNA, 675 bp, Rattus norvegicus
  Genbank Accession No. AA848315
  misc_feature (1)..(675): n = a or c or g or t
tgaaaaattcaaggcatatactggatctgttttcagaagagccgtttctcatacgaatggaggccgtgaacgccaccttccacctgagctgaggacgttctcttctcaaatttaagttcccccgagtacatcatggctctgacttgggttaagctcttggcaccaatgtcctgacaggaatgctggatgccagcaatcaaataagggacaaacttgtggatagaccctttgtcctgcactgcccctgaaactccttgggccactttgatcttgtcagcttcactgaaatatcggttctggctgctgaggtgtttgtccatggcatcaagagagcccataccacgatacttcttcagccggatcccatcggagaagaagtactcaccaggggcctcagtggtggcagccaagagggagcccatcatgactgtagaggccccaagagccaaagctttggcaatatgacccacattctggattcctccatcagcaataacagggacaccgaagcgacgggcatactcagagaccttgtatactgctgttgcttggggtcgcccacaggccaacacttcctgngtgatgcagatggaaccacttcccatgccgactcgcagagcgtccacacctgcgtcgatgaggttcttggcttgagcagcagtgactacattgcct

SEQ ID NO: 88 - DNA, 574 bp, Rattus norvegicus
  Genbank Accession No. AA848389
  misc_feature (1)..(574): n = a or c or g or t
tctcgctgcccttggttattctaaggatgacattccttcactggtgaaaggaacactgccccaggaaagggtcacgaagcttgcgccgcgtgcccagtcagaggaagatttgtctgctttgttcgaagcatcaatgaaactgtactaattaacagattaatgaaaagaatcgccatcggcccttacaacggaagctatgagagcagaagttggtcagggctggcctttgccgtcttatctccacacttaattccactgttactggcttgaatgtgacgtgattttatccttcgggggattcctttgtgctcattatgtaagaccccaggagtcagtgtccctgcaccaaaccccatcaaatacagaaatatgcctctgtccagacactgcttgtctagaaattcaccctgaagaaatactagcattagtatgcaaaaaacatgacaagggtgtatctgacagtatgggtagcaaaaattaaaacaatctgaatcttccttcctaaatgaatcctaatatagtcagtaatagaatactgtggtgttgttaataaagatgaagccaaactcttgan

SEQ ID NO: 89 - DNA, 564 bp, Rattus norvegicus
  Genbank Accession No. AA848437
caaacaatagacatttatttttcacttctcaggaggttgaaagcccaaactgctatcaggtttggtttcccagtgcctctccttggctggttggcagctgccttccggctgccatcctctctcggggtgtgaacaaaccctcggggcatcttccgtgtcctttaagtcagatagaagtatgagcctgccctaagaacctcattcgacctcaatcacacccttaaagtactatctccaaaaacacttacttagcatttggggcttccacacctgaactttagaatccagcccatagcaaggaccccacattgtctttctgccatccctctacttgctacgcaccatgattctcagacaggaatgctgtaaacccgatcccatagtttgtaaatatctgttaaatgactagatccatttaagtcgagctttgggcttcagagtagtaagagcctttggcctacacagaatgcaaagtctggaagagaaacaccattttccagctctgaggtctcccatcttctcattgatagttacttggatacggagaatctcccagagtctgag

SEQ ID NO: 90 - DNA, 501 bp, Rattus norvegicus
  Genbank Accession No. AA848496
ggatagaggtttgatttgctcttgaatgttccagggtggagacaaggagaaagcacaggtgtggaggtctactcagtgcagtcgtctccctcatcctcatcctcaccgtccacagacagagcagcgtacttgcttgcagaactgaacttagaggctcggttctcctcagatttctttggctcaggtgcagatctggagtcttgatcttttttgccgtccttcctatccaactccttccagtggtctctgctccctccatccccaggaccacggctggagtgtccagtctggcctttggtggtgctcaccccatccactttagtttcatctttccttgatggtccttcctcagagggctgagctggagcaactttccctccaccacttgtaggggacggctgctctgtgtctgagctctgagatcgagcaggagggttagagcttcgcttcacccacgcattctcctttggtggaggggctggcattacctttagaggctgg

SEQ ID NO: 91 - DNA, 492 bp, Rattus norvegicus
  Genbank Accession No. AA848675
gcttcatctctctccttttcaaagaccctaaactggctgtgaaactctacttcggaccctgcaattcctaccagtaccgcctagttggacctgggcagtgggaaggagccaggaattccatcctcacccagaagcagcggatcctgaagccgttaaagactcgcactctccagacctcagctagtgccccagtgtctttcctgattaaggtcctggggctgcttgctattgttctggccttctttttcaagcttcatgggttctaatctgtcccatgacacttttctccatcaccgcctctttgaaagggagactaaagaaattacatcctcattataattttacttcaggggaacaagtagggggactgattgtagggagatcagaagaattaggtctagatataaagctaaattaaggtcacaggatgctgttatcattctactatctcctccaattcatcagtcttcacgtggtattctgtaataacac

SEQ ID NO: 92 - DNA, 340 bp, Rattus norvegicus
  Genbank Accession No. AA848738
caggtgtgcaagctggtggtggggttttattaggggttgtggccagacagcaccaacattacatctggggacggccctagaccctcatcgtaggtaggtcagggaggaccaactgggttctggggtcacttagatgaggttgctttctttccgtgtcactgtgtgccctcctctgctttagtctcctcttcatttaaaagccatttagagctctgccagaagctgtttgcctggtgacaatctcaggccccgggagatgccttttgctttcccagtttctgagcttgggtggacggaagcctgatgggtatctgcgtccacctagagctgtaagccagag

SEQ ID NO: 93 - DNA, 616 bp, Rattus norvegicus
  Genbank Accession No. AA848807
attttaaaaataagtttattcatgtatatatttacaagaatatatttaaacattcatcaaaaactaaagagtttttaagaatttctcaaaatcgtttactgaagctttggcaatctctttacaaaatacttcatcaggaaaagatacgaacttgtccaaagacacatagttaggttttgctggatcatactgtgctttgcccaagtaggcaagaaacaagtgtctttctttaattttaaatactcttgtattaaatacctgtgggaacttgacaatgatatggtggggaatattcatcacattgtgtacataatcaaaagtctccgtaagttttcttttgtttgcagttagcatcttagggatcttggtgaccatatgctgaatttcattatgtttaaaaccaagttcaaggcggtaaaccttcatgttttccttcacaggctccagacttcctgttagtagccttggaagacgaacaaccagatctctagtcttcttcacactcagttccagttctttctgaaaaaatcccagtctgttatctagtctttccacggagaagctcaacagaaatggtgcatttttgaccatacaggcaatatctgtcttactgaaa

SEQ ID NO: 94 - DNA, 316 bp, Rattus norvegicus
  Genbank Accession No. AA848929
cagcgcccttgaactataacaaagtgccctccctgcccacagggtgtagccccagctttgataaccgggtgtagggtccaggccactctgaaaagcaggacctcacgcccacaaaatattcataggccaagactctcacaaagtcggaaagcctggcgcccagagtcctgtccagcgcaccgtcagccctcggtgacaacagctctgaggtgagagggctgtctcctcaggtcttcctggttggatggctgaggttggaggcagccatgacagtcacctgcactgaacagacagtcctcgaagtcgacctcgtgcc

SEQ ID NO: 95 - DNA, 535 bp, Rattus norvegicus
  Genbank Accession No. AA849497
  misc_feature (1)..(535): n = a or c or g or t
gagttcataaactttattcctacaacagtgggtctttagcacaaaaagtacaagaaaagagagtttcgcctacaagtgcctctcatgggcagggttctgttcctggtgcagactaggaatgttaactcccttggttctaggaccagcatatcttaatctttcaacgaagcagatgatatggaagtcctctggagactgaagccacttgcctagtctcttgagcaaatgaacagacactgctatcatttgacaaggaattcagactcagaacagagacaacaaagtattttaaaaaataattattcatagacttgctaactgtcacttataaaggctagtgcaggcccanagtaagaactggtgctttctgagaaagctgaaaaaggattagaggtgccgcctgcttctaggtacgccctcacttacactctgcatagctaactctggttaaggacatggtgttcaagtctctgttctgggcttggagatctctgtagcctaagagagtatcagtgcatggttgacctgagccctg

SEQ ID NO: 96 - DNA, 507 bp, Rattus norvegicus
  Genbank Accession No. AA849518
ggatttcacatttgctttcacttttattgttaggtacagctacgaaaccaagccacacgggctcggggctgtctgcccagttaggggagccacccagacagcaaggtccaggacggctcgctctcagatgtcttgctcgatcccagtctcgggtacgccttcccttctgcctcttcctggcccccacccttttcacttcgaggttttaccatcaagacacagtctggtaaggtctcaaagtgacccatcacaaaaccaaggcagctttaggctgtgaaagcatcggacctttggcaagggttgtcctccactctcgcctgctcactcgctgtcaggggcttctttacagatctgtcttttcttcgtaacgacaccaacacgcagcccgctggctgtccaggtatggcttgcagcctaaatggatgacgctgtcaaagaggagctccacggttgtctcgcatgcctggacgttctgagagagtccgagtgtcttctgcacgtctctgc

SEQ ID NO: 97 - DNA, 582 bp, Rattus norvegicus
  Genbank Accession No. AA849796
gaaacaattcaataaaccatttatttgcaaataaataatgtatgtctaccacacctaaataaacatttaagaactagtaatactaggatataacctcagtattacattgtaaatggggaatcaaagtccagagttaggatgcccaggctgaggcgctgcctccgacttaactgctaaatcatgtggggagtgatctttgatactttaagtcaacttcaatacagaactatcctttggttactccatacagttagggaacttgttttctacacttaggcatgacccttcaattaaaatggaagattcttattatgaatcaagagactcatctacacggttggaggatccacttcatccatgctctgatttagtctttctgaatggactggtttctaacctagactaagtacaggcctgaaacttcaacagccatcaggaaccatggagcgggccatgaaggtgcttcgaagggccacagactttttcaacctgggacagactgcaacactcgtgccacaccccatatgacaaaaagctggaaaacaaggtgtgtgttttcacttatgtatcaccagatgcaac

SEQ ID NO: 98 - DNA, 446 bp, Rattus norvegicus
  Genbank Accession No. AA849827
gacttgtcctaaggaaactataaaacctgctggctaaggacagtagctaggagggaggccagacgaactctgtagagaacaaggatgctccaaaaatgcagtgagaacgggagacagttgtgacgcctttcttttcctaaaggtaacggacagcggagcccaatggactgctgtccaccctttccctgctcagttccctatgagcgtaagagtaagggctgtgcacacgtaactgtggtgcacacgtaactgtggtggacacgtaactgtgatgcacacgtaactgtggtacacaccttgcacttgggttgtaaggtggattgatcttcaccaaagtaaaacacaggattatgggacaacactctagctgtaccttcgtggacggcagcctgtgaaagctgcccagaagacaacctgagatcagaacaccaggctgtgtttcgtac

SEQ ID NO: 99 - DNA, 504 bp, Rattus norvegicus
  Genbank Accession No. AA849917
aaagatagtaaaacttgggatttatttattcagtcataacttaaagcttaactacttcttctccgagcatagacagtcttctgtaccatggtcctatgtaggtatttagtcaggagagtgaagagttaacagatggaaaaggtctctggggcagtccatttgctgagacctcaagtgggacagggcagtgagcagagacatctgaccagggcactgtgggtaaggtaggggtgcctcagacttggccctgctactctcgctcctaaagaactatacccttcaagcctcagcatctcacaccccaatccctcaggctctgcttcctggatgcccaactctcaacagggctgccaaccactaagacagacacagctgctatgtcccacctctcctcagcagttaaaaaggaagagactaacggggagcctcggagtttcacttactggtcacagttcgctatgatgccatcatcagtgtaaacaatgttgctttagctgtgtaaga

SEQ ID NO: 100 - DNA, 459 bp, Rattus norvegicus
  Genbank Accession No. AA849939
acatcaatatcaacaacactactgatgaggactgaatgtataaggttggggctctcttgcaggaacctcagaattcaaaaagcagtttctaaggaagcaatgtggggaaaaatctacatctgaagtatttctgaaataaaaactgaaggccaagaaatcaaatttctggttgcgagatgacaaaacatctttctctttctgtttctctctctcaggatgcacaggtaggtatgcacaaacacacacacacacacacacacctatacacttcagaaaacaaggaaggtatcttaataaattatctggattcatatatgttattttagtctgtttcacttggaaaaacagaacaaaaacaaatgaatacaaaaccccaaaacacagaagctaccagttgagagtcacagactgatttccaactggcagtgtaatcttccaacaggaaaataacacctgtgt

SEQ ID NO: 101 - DNA, 465 bp, Rattus norvegicus
  Genbank Accession No. AA850037
gaaaggaatcaattttcaagattcatcaaatcaataaggtaaaaaggaaaagcaagatcaaagaaacaataacaaacatttcattataactttggtgacttggactcaggaatttctgcgctggcgagaggctggagacagtggggagggctgggccccacccgccccaggctcagaggccatgtgtatattcactccacggggcccctgggggcctggggccccacctgatcttgacccaggagctcaagcagctgccctctcttttgcctgtgtcaggaagcttgtcctttgagctggactccatcactggtgcccataagctccatgggcaggaggctgagcctgagctttgattgacaggaaagcccagaggtatggaggtggcagagctaaaggcagctccttcgactcaggtttgggggtcgtcgtataaattagagttgctggtgttcccgagccctg

SEQ ID NO: 102 - DNA, 519 bp, Rattus norvegicus
  Genbank Accession No. AA850040
aagtacataaaggtttatttccacaggcctcaggtaatgggcagaagtcacaggacaatctctcttcctcttttcccacaaaaaaaaaaaaaaggttgcatattttggtcagtgtgtcctagagagaattctgggtttgcgataccaatgctgtgcaagactctggtgtaaaccaagccccaaacagctgcagtggaggtcttagccctatccaggtccctacgaggaggcctcagctgctgagcgtgacaagcaggaggagtggacacggtgacagtcatctggcaggaaggaggaccgccagactccttggaatgctgtgtttttcttccccccttttttctaagttgttcccccatgggaatcggggcgggggagggggttaagactttttgggaactgctactgtcctgcagctgcaagaggaatgcctgctgtgtgtggtacatgccgacccaggatggaatgcagaatgaaggatgcttctaggaaacaagtctgcttggaatgctgggtggc

SEQ ID NO: 103 - DNA, 428 bp, Rattus norvegicus
  Genbank Accession No. AA850364
gccagtgctgtgcatgacagccgctgccactgcaggagagcgagtggaggatagctcagcctgtgcttccgagggtccccagcccaagctacatcttcaagagtctgctggctctttgtccattcatgttctctgtcgaagatggcttgtgggtgagctctggaggctaccagaagttgctttcctttgtaataaccgcttgccaaagctgctgggaactgtcaggggaagagaagggacatcaatgcaaggaaaaatgtagagatgagccaagagaaaaatgagcccaaggtactaagtctcagtgaggtggcgctggagacagagtctggaagggtggctgggatggatggtcctttccatctgtggctgggcagagccaggtttctctctcgtgattcgaggactctgaaacccctgtcctgaga

SEQ ID NO: 104 - DNA, 556 bp, Rattus norvegicus
  Genbank Accession No. AA850608
ttttttttttatgcttaaaatttatttacagttaataagttaaaaagcaacacacaaccaaattgtaaatctcattcatatgcacattaaactgtccagggaaacacttcagttccattacaaacaattgtgttctaatgcacttaagacataacagcttatcaaaaaatatctgaacacaccaataaaggaaatgttatgtatgtatgttcatcaaaaatcaccgatttaaagaacaccataacaacccttaagacaacaaaaaccttttaagttcaaaattgtgatttttttgtattcaaatatcttaaaagttttttataaagttttttgaaaaatagtagtattatgtacacatggcaaatcaataggtatgagctaccagcttaagtcacacttgtccatagaatactgcaacagacaaaataaataggcaccacgtcagcaacactgcactatcaacacggaagcttgccctcagccgtcgccaggccattggcttagcaaagtaaaagtaagttgctgggtgatggggaggaggatataaatgacattg

SEQ ID NO: 105 - DNA, 552 bp, Rattus norvegicus
  Genbank Accession No. AA850893
  misc_feature (1)..(552): n = a or c or g or t
aaaaaccatgcaccacgcctatcacacccctcttgcagtgacaaaggtgggagaggcaggatggccacatactgtttcctctggctcctcccttagaatagagactcttcaagaccagattgacaggccagataaattagggtctgctgcctctgtgacgactcttggtggtctcggtcctgagggtgtgaagaaagacgtgtctgtgcaggcagatccagaagtctctccacagtgcacagcatagtccttggtatccgagtggtgctaaaggctcagaatggaggaatgttctctgcagcagtgtggatggaggctgtacctgcttgatgcccgggagcccagtgtcctggcaaagcagggaaggcacaggccttgtcacctgaagtccaaagccatgccctgggtcctcctggggcgggcaggtctacatcctgcagatccttcggaggggacggagaggctatggtctcatcaggcggatatgtctgatgactgggttatgcaggtgatcttgtaggacagccacaagctcgcgaggcagangaagct

SEQ ID NO: 106 - DNA, 641 bp, Rattus norvegicus
  Genbank Accession No. AA850909
caaagtataaactcatattatgtaggaaatgcttacaaaataatattcccaacccagattgccagattctccatcacacacacacacacacacaccatcccctaaagagggatgtgtagttctcatctcactgggtaggggttataagaattcagtagtcttccgataagagcagattctcccaaacttggggtggcaaggcacacttgcattaggctctcccctccagcactggacctggaattcatgctctggagacaggaactggggtgctgggtgatgaggagagggtgtgaaccctgagattcctgcctgcaggagtgggtggaaatggggaggtcctacctgacactggggaatcctctcccttttcacctttggggagcagggtgggagcctctgctgcctggagggctcaggtctgagcagcagggagccctggatcctgttcttgcataactgtggggactctaaggcctgaggataagtgcaaggtccggattctttgagactttaagggtagttgagatagaagtattcggtgaatgccgtggtcaaagggtcgcagccttaggagtccttgtgggggacaggtggtacagaagaatattctgagctccctgccttgggaggtaaaatcc

SEQ ID NO: 107 - DNA, 496 bp, Rattus norvegicus
  Genbank Accession No. AA850916
caggatacaggcaagctgtcgtgggttttagagaagactatttaagtgagaaggtggtcgctatgacaactgcagaaacaactgtagtttctcaaagctgactcctgctggttctctgaggaaatgcaggtagaagctgatctgtgtatgccacagcattgactagatatctaatagggtctcttctcctggaggcatcgtagcctgggactccttagctacaagggacgctgccccaggtaggacctaagtactctctcatttcccagggcctggttaacccacgggcaatagggacctaccaagatcacttgtctattccaaccctgactttattccatcctgaccctagcttcccctagccttcctaaggggctctagatcaccctgatatgtgggtaaatctattaattatccccaaatcgcatcatcccttacctttaacaacatcctggtacttttttccccacctacatatatgcgtgcctcatcaaac

SEQ ID NO: 108 - DNA, 655 bp, Rattus norvegicus
  Genbank Accession No. AA850919
accttgtgctatagagagaacttttattcaggcatgttattttcacccccaaggaagggggggggggattcattaacactctccttttgtttttaagaagtattaagttcattctaaggcacggagaattcacttctctcctttgacctttgtcattgttctgttgggtcacagcttactgctgacagggtgtggtaattcaacaacaagtttcccaatatttttccccgagtacatatagtcaacagcctgaaatatggactccaggccaatgaacctcccctctggggccaggtgtcccaggtccacctcacacaccaggtccccacgagtgtacagctgtagcaagtgttccatggcagcctggtacttgtcgaagtagtggttcaggaagaaacccctgaggctggctgacttcttcaggagtttggccggcaaagctcccgctttgactggtgaaagtcctgtagggctttggtaaccagagataaacccaattactatcaagcgccctttggtggctaaggcatccacggccaggtcaaacatggctcccccaacagactcatagactacatcaactccttcagggtactcctgcttcagaactgtctccacgggctctgttctgtagttgattggccgatcacaccca

SEQ ID NO: 109 - DNA, 534 bp, Rattus norvegicus
  Genbank Accession No. AA850975
acaaatacaaataaaacatgaaaaactctacctcaaaaaaatctaacagttcaacaaaagtctttagctgtgttctagacattgacaggctacatcacaatttaaaaatccaatggtaaaaatggaggtttagaattgtttggtaatcacatgtcaaaagaacaccttttattcagttagccacacctgcagggacccagtggcagttgccaaaaggcaatttttccacaccagaaaggagttgtgacttgatttttcccgcttccaaaatgtttatcaaatcctgtgtctcccaacaaatgaaacatccgtggtcagtgaaaccgagacacttctggggaatggccgtgagactccagtctgtgtatgcagcgtgcattccaggatacacagagacactgtctctggagaaattgtttgttctgtaaagtgaggacctgaattcagtctgtagaacacacatggtgtcaccatgtaagtagacgggtgggtcgctggagttcactgacttaatcacagcttaatcaaggtaac

SEQ ID NO: 110 - DNA, 494 bp, Rattus norvegicus
  Genbank Accession No. AA850978
acaactaacattcactttattcaattctgttctcttaactcagaaggcaacaaatgaccacataaaaaagggagcatttttgaatatatacacataaaattgatctgggtacaggtgtttactgtaatagaaaactgacatcccacatcactaagtgttctagttcattcctacaacagacacccctaggccttagtcattcgtttccatctaaggttctataggactgtcatgattacaaaatgaggcactcatacagacaggaatggagacatacatatacatgtatactgtcttatttttatattaacgccaaagctattattggagagtatctgaaagaagcccttgctcacggcagctgtttaaatgttgacacaacagcagtaagctgaaacaaaacatctgattgacagggtaagttaagtgtgtggagactgggcagttagcaaagactgtaaagcccccacaggtgattttggcatggagaactc

SEQ ID NO: 111 - DNA, 423 bp, Rattus norvegicus
  Genbank Accession No. AA851017
tttaggttcacttctaagttatgtaaaatatgtaatgtcacaactgagaatgactttctgattccgtcaattttttgtaacacatgccttatcacgatgcgtcaataccctgtgggacagtaggtcttcctgggacagctgatggtgaaaggaaggctgcagctcgttgtgagctggctacgactaggagttagtcacagaaggttcaagttaagccatgtcttcccagctttaggtcctacgcagctcctcactgagagcttcttggcagtgaactgtattatgtccttaggtttctccagcacatcatccacatctttccccgatggctcagacgcactatcctccactgattggtgggatgatggcaacttcgtctccaggctgaagcaggagttgttgatctccaagctcgacatactc

SEQ ID NO: 112 - DNA, 412 bp, Rattus norvegicus
  Genbank Accession No. AA851184
ggtgacgccagatactttactcatctcaggcagtctggactagttcccctcccgtggactccagggtaacaccagaactgtcctagaccatagctgtcctctctggcggctggaggtaggcctgcagggcacggtggaggaggaagcaggtctgtgggtggagggaagcaggtctgaaggtggagggttccagtgtagttgtggctcatcctttcctatcacctctcatcatggttcacagtgttgcttccagggacatctacctagacaatggggtccccaaatgtgcaggcctcctcaatggcgaggttgtagctggaacctgtccctcccttataggtgctggtcacaattctcatccagcctcgctcaccccaaggctcgccccatgaattgcggacaatccaatact

SEQ ID NO: 113 - DNA, 527 bp, Rattus norvegicus
  Genbank Accession No. AA851230
aagtcactacccaccaggggtttaattctttttatgtcagttcagaaaggggccatgctttgtccccatccaaaggaaaagatctgcagggcaccctgggaatgtccaaacccagaaaagccaaggggtagtccctgagcaagtagagaagtgggtcctggggctcaggccgcctcctcctcttcttcttcactctcctcctcactctcatgatactgtctgtgattggtgttgacaaagaggtcagaatcatcttcagaacctgacccttctcctgacagctgtggctcagcggggagttccggctgactctctctgttcacattgttttgtttctcagctacctcagaaaaggcctcaggccagtgaccctccttctgtagagagcggacatggttcttgcagagcacaaaagagatctcagccttcactttttctccttcttcaatagggtcaacaatgaggaagtcccctctcttgatccagatgttcttgcggtatttggagggcatgctcaccaggaagcg

SEQ ID NO: 114 - DNA, 494 bp, Rattus norvegicus
  Genbank Accession No. AA851237
  misc_feature (1)..(494): n = a or c or g or t
ctgtttgcatcaccacggagaaacagaaaaggaactattagtgcacagaagagagatcccatgaactgattacctcccactgggccctgtcccttaaaagttctgtcacccaaacgcctccatactaaagaccaagccttctgtgtgtgagctgttgggagacaaactacagccaagccacagcaataataataatccttgcttataaatagggcttaattatggtttttaaattacgattctcgttgaaatgcagcagatgtgggtacaggagaggagaaaagagtctgtcactctctgaaggtgtgagtatatctgtcaggatccagtcttcatgtaaaccaagagataggcagtttccctccaacgatatatgtgatccccataggtacactggacatccttccaggtcacccaacaaacatgtgaatcattgaagcagaaccattctccatccacgggattccggatgtangcacagtaatgaccgaagt

SEQ ID NO: 115 - DNA, 608 bp, Rattus norvegicus
  Genbank Accession No. AA851241
atccaggtccaattttattccagtccttgggatctgagaggcagacaccaggaatggccctgagaaagcctgggaagccaactccccagtggcagttaggatgggcaagacccaacatgtctctggcaggagtccctcctgcagcggggcctggctcatgactcagtggccaaggaccagggtttagtcaggagggttgctgctttgactctggatgaggcctgtcttcttgtgggggacactgagaagttactctttggggaggggtgggctgctcagggatggagacaacggtcttgcttggccaggtcagcgtcagggccggttggttatacagatcccaaggagagcagaggagtccagcagtaagtaaccccctgcctttgcagagaaacgttaatcctgtgtgcggtgccagctgccccaaggaccctccgagtgtaaatgcagggtcagggtccatctgcttttctcttctgaggggacactgctgccctggcctttttgatggccgtccagtcttccaggatgtcgatctcctgcagcatgtacacaatgtatgggccagaaacgagtggtgccttcttcctcttgctgggtggcactga

SEQ ID NO: 116 - DNA, 541 bp, Rattus norvegicus
  Genbank Accession No. AA851261
cgctggccatcaggtttattagaaaaaggttatcgtgtggttatttgtcctttgaacttctgggctcagcctttgctccaagctccctcccatggtggagccctggctctgcatattcacagacggggcagccatatcagactgcaaagccacacaacagagtctcaggcagttgggagagccaggcccactgcttctgtctagatggtttgcagagcagacactggggatgacactacagcctcctcagcagctagccagtctgctttgcctgcagggcttacgatgtcaccttttctttacaaacttctttctggaagcattgggatttaagcgtctcctcccaacacccaacatgctgtcccggacttgcaggatggctgagcggctggagatgtcattctctgcgaagggagaaaccccagctatgtactcgggggcaaacacgttggtcttctgcctggccttgtgggagagtcgcagctgagggaagcgctgatcctcggtcaggtgggggttgacggcatatttgccccctttt

SEQ ID NO: 117 - DNA, 574 bp, Rattus norvegicus
  Genbank Accession No. AA851343
ggggtaaaacatttattgctcctctaggtaatgtcaggtatgacatatgacatggttaagtctctcagtgggaatggacaccaaggtgacacatgcagcaagtccatagacagggctcttagcacatgatggcctcctctatgacctgctctttgaccctagctccaacaagggcttgacaggccactggaagcatggacctaacctgctgcatgccatctccacaggatgccgcctaacctcaggtgacagcacatcaggagctcacgggcgcgctcacacgggcacgctcacacagggcctgtgcagcacaagattatggagtcacctcctttgatcctaagctggcctggtccctccatcagcctcagggaggtataggaagatgaatataggcccagctttctgagcttagctcaaccacagcttctggctaagctctggaccaccaggggctggagccttggaccagggatgggatagtccgttgctcctgtaggtcagctgcacacgcactgccaccatcgagccatggcccaatgacaggatggctgtgtcgccttccttgatcagc

SEQ ID NO: 118 - DNA, 421 bp, Rattus norvegicus
  Genbank Accession No. AA851379
gggatcagagtttctttatgggctataggggccacaaggctggccaggtggcaaggtcaccggtggcccggtcaccgatacaggtagtcagcctggatgttggccgcgatctcggcctcccacttgtcaccattgttgagtagcttctccttgttgtacagcaactcctcatgcgtctcggtggagaactcaaagttggggccctccacgatagcgtcaacagggcaggcttcctggcagaaaccacagtagatacacttggtcatgtcaatgtcatagcgtgtagtccggcggctgccatctgctcagttccccatccccaggaaaagcctccagtcctacctgtgcgcatggcctgggccaaggcccggggcagcactgacgagctcaggcggtacatcactttctctcagaccttccc

SEQ ID NO: 119 - DNA, 461 bp, Rattus norvegicus
  Genbank Accession No. AA851392
cacggaataaaagctgtatttacacaacatcactatacaagaatttttaaaagaaaaaggtagtgtcaagagctggtagtcaagagggaccactgtgctggctggcagccaagctcaagagattcgccttcaggaaagactctacctgcttcccagagatgccttccacctgttccaggtcctccacctcattaaaggggccatgcagctccctccagcccacaatgagctgggccttcttctggccaattcgctgcaggcttcgcagatcccgagctgagccttcattcagcagatgcaataattttttgcgcccccgtgccagtaactctgggctaatttgtatctcccagtagtcctcatccttttccacagcttctgactcatgtgatgactccagcttccttttgtggcctttcttcaagaggtggatcttgtttgaggactctgactgcttctga

SEQ ID NO: 120 - DNA, 534 bp, Rattus norvegicus
  Genbank Accession No. AA851417
  misc_feature (1)..(534): n = a or c or g or t
ggagacaatgaaactttatttaaaaaccaaaccacttgngaaaatatattgcaggcttaacacagcaaacagacaaatgtatcactgtttcaagtaattaaattggtataaatacaatatagtactcatccaatagataaggtgccacattgggccagcaacactgcactgcaaaacccccagtaaaaatggcatttggtaagaaggtgtgtgcttctcctgctgtagtggccctagctttccttggcccaagttgcttacttttaggcctccttgtggctacaaggctctgtaaattcagagctgattaatactgggtttgcacttttattttgtgaacccaaggccaatacttctcaacagctcctgtttattctagcgactggcgtgtgagtgacaaccaaccccacttgcttttcgtgaggatgtgtcacttcggtgtacaagtcagtgaagaaagctgtttcccatgtacactgtgacactgtctggcttttctggggtttctagaataatagaatttgaagaaatgga

SEQ ID NO: 121 - DNA, 487 bp, Rattus norvegicus
  Genbank Accession No. AA851733
cagtcaactggtaaagtttatttcgtcagtataaggaatttaaagccatttactaaactataaattccagtgcattagaaatgactgttggagcatttctgaggtgttgctgtcaatttaatgggaaatgttactgtctggatgttggtatgaaatgcagctgtcatgccttttattaaacagaactgtcatcagtggtgattatgatggtgggtttttatagctttcaggagttagactgtgcatgtgctttacatcattttccaaacattagtggtgatttggttgactggttatttctaactaagcttgtggaagtgaggggcagccatgatatgtgtcacaggagctgaggaatttcaggcacacaacactacctgtcagtcacccttcatcagaaactcagtgacatttacaagacaactagtgcaaaaagcatcaaaaaattatgcatggcagcagattaattttcttgaaattttaaaac

SEQ ID NO: 122 - DNA, 294 bp, Rattus norvegicus
  Genbank Accession No. AA851814
aatgagtatcttatgtacacacacacaccatacaacaagcttggttccattataattccatcaggcgctcaggtatgttcaatgacctgagatagagttgatgaagcatggcctttaggtcacaatgaagtccatcagtgagttgtcaggctgcagtgtggggattgggacatctgctacctggatgatgttgacttctaggattccatctacaattgtgatggtggctctgaagtaaccatatctgtttattcggcagttttcattggaaatgtcactcagctccatggattt

SEQ ID NO: 123 - DNA, 366 bp, Rattus norvegicus
  Genbank Accession No. AA851871
cacacccatacagtttaatggttttaaaaaaaacccaaatttgttactttagaaaacaaatgcagtgcattttcagcaatcttatggccacagattccgactgctcagtccacacataagcagaagctgccttctgtggtgacacgttctctgcactaattcccacgaggcggagaacatgagggcaggggagcacagactggactgttgcacaaacaacatttactcatcagatcccaccgatctcttctgtgcccgcttcctgggcagccttctcggagaagctttattgatctgattcaaagtttcctgaggaatccaactcatgtcaacatcattttgacttgaggtacccatttctacctt

SEQ ID NO: 124 - DNA, 549 bp, Rattus norvegicus
  Genbank Accession No. AA858621
cggccgcttgctctgcccggcgccgaagaagttgttggtgtcctgcaggcggcacgagaagatctggcccacgtcgccgccgtcgccgtaggggctcagcttctcgtcgccgtagggcagcacctccgacatggtcgcgtccgggggctccgaggcggcacctcctccgcccgcgtccccgcccgcggaggacagggtcagcggcgctggggccggggatggccggccggggacggccctcggggctgccgcggtgctggggccggcgagtggccggggagagacaccgcttggggcaggagcgcgcagcccgcgcgagcgacccaacgagcgcccgcagctgagctgcgctgcgctcgggctccgcgcgcgagtggctgctgctccggcaggcgggcaggactcacatcctcggcgctctcgggcgcggggcgggggccgaaccgggcggggccgcgacgcgcggggaggagggtgtccctgcgagcccggagggcgcgggaccgatgtgggcgcaccccggggagcgcgcgggccggtcctgccgcg

SEQ ID NO: 125 - DNA, 522 bp, Rattus norvegicus
  Genbank Accession No. AA858636
tttttttttttttttttggcagtcaaaacactttattggcagaataaaaaagtgcagcatgggaagtattgacctgccagacatttagctcctcatattcatccagagctgcctggaactgggctggtgtgaagccacgtgatatgcagcgctgttcagcctcagaaaagcggacactccgtccccctgataccaactcacggacggtagcaaatatcacatctgctggcctctgggtcctagccgtttgtcccttttcacccagaagggagtcctttgacatctccatcaaccttatggcttcattcacatcttccttctccacaatgtctaccatccgaaggcgagccagagcagtagaaagtcggagaatggccagcagggtccgggcagaagtgtaggtggcatccttactggcccgggcctctcgcctcatctccacatacgctgcagtgatgtagtcagccagagagtcaggcactgtgggctgcctctcgcggcacatggcaatgtaccgtctca

SEQ ID NO: 126 - DNA, 275 bp, Rattus norvegicus
  Genbank Accession No. AA858674
tttttttttttttttttcaaacaggaaattctttattgcaaagatacaaaagcagtcacggggacatgtacagcaataaattaggtgggggccatgaggcagggtgcaaacggggccaaaagtctgtgatcttgatcccttcccaataatttataacatgggggaaaaaaagcacaaaaaaaaaataaatattgaaatgaaattgccaagtggaaggcggctgaggatgccaggcctcggaatgatcggcatgtgtccctgaaaccctcgtgccg

SEQ ID NO: 127 - DNA, 520 bp, Rattus norvegicus
  Genbank Accession No. AA858693
tttttttttttttttttacttgtgtaacactagttgtttattccagcagcgggaacagcagcggctgtgagagaactgggtcttggttactcagtccaagctgtccaggaggcagcagcagcagagcgcggcccagcatgcagccaggactgcctgacacccagcatccgtgttcgtcttcctttcccgttccaaaatgtacacctcttttctctgggttcttctacggagctgaaagctcagctggtctgggtcttggaggaagagggcacaggaagcagtgaacatctgggaggattctaggtcctggattccctttatcggctcaccacactatagccctatctatgttcttttcacatcctaagcagagtccctacatctcaactccagttacagcttctctccactgctgctggcctggttcttcaggggtacacgatcaggaagagcctgctcgctccatccaccaacactaaggacatgcatatcttctgcaaacatttccttttgccatttc

SEQ ID NO: 128 - DNA, 520 bp, Rattus norvegicus
  Genbank Accession No. AA858696
tttttttttttttttttcaagtttttatataattttatttattataaaataattcccaagagtgtttaacaatacaaattttattaaaaaaataagaaatatcgaaacttcagaaaaatctatattcgatgtaaccaaaataaacaaacagcaaaataaaaaaatatacatctctctatatatttgtgggcaagaaacaagtgcatttttggtcccaatagttttgaatatattatatttatctaaggaattacattaatggctaagaagataatttctaagttaatagcgatgtaacttaaaacttcttttaagatctgtaagcggagtctttgttctttgtcttgaattcctgaccactaagatgttatgatagtcccaagatagagagaaatatattaatgtttaatgaactgaacagataccactcctgcctttaaatccagcatttgggaggaagaggcaggcagaaatctatgagttcaaggtcagcctgatctacctggtgagtatcaggata

SEQ ID NO: 129 - DNA, 354 bp, Rattus norvegicus
  Genbank Accession No. AA858704
tttttttttttttttttgattaaagaaagaactctggtttttaatagttttgatcattaaaaaagtttaaacctgcatagcaatcatttcagaaataattatttaatgttccataattaaactgtacacaacctagtcgtgggacacataagccagtgaggtgaatggagcagtctggcgcggccccaggagccaggattccagccgagttttgtcactgtgttcatctaagctgtttttttccttttcttttttaaaatcttttttgttttttttagatttagttttttttcattttttgatacttggcacagtctggctccaccgatgggcatgagcagatccctcgtgccg

SEQ ID NO: 130 - DNA, 539 bp, Rattus norvegicus
  Genbank Accession No. AA858758
  misc_feature (1)..(539): n = a or c or g or t
tttttttttttttttttcaagctcccttcatgctctttattaaaactatgcaacattctccatcctttttatctccccaagcaattccaccctagtccaaaaagaaataagaagaaggagaataatagaaattggaccagttcttaagtttcttcttccatgtttcttggaaaacagtgtgtagtcaattcttcttcatccgtggcttcactgtggcaccccatttccagtgattgatcttctctccaaacaggtagaggctggcactcaggatgtaactggctgagaagaagagaataatacccagcgggctgagggaggcaaacacggggtacacccagtttccggtctgaacgtagcgccaaaggatcctgataatgtaagcaaaattacaggcacccagcangctgagtcctagcttcttcgatggatagttgtgtggtctgagaacggtttcagccagggaaaagggaaatatggaggtatgcattgcgtgattaaaccatgctggaaagaaatcatccaagcccttggggtaa

SEQ ID NO: 131 - DNA, 490 bp, Rattus norvegicus
  Genbank Accession No. AA858759
tttttttttttttttttccaaacttcaaacttttaggatttttatttacaaaatggattgactcttattttgtacaaattaaaaaacccgaagtcttaaaaatagaaacaactccctaactcttgggataactttgaagcaactaagggagttagaacttggtgtcttccttcttccccagccctggtctggcagcgcttgtcccagctgagctgctggtggccaggagggaggtcgatcaggtcagagtctgcaggagcaggatcttctcattaatgcagaagcgatgcaggaccaccatcaggttctcaccacagcgggagacctggcgctccatggccaggcggaagtcctccttcacacctttggtgatgcctcgagtgactgtgtggtgcttgatcagcattccttgatttgggagtaattccagatgaatcttccctccttcctgggttcttaaataagcaaattcccctcgtgccgaattctt

SEQ ID NO: 132 - DNA, 359 bp, Rattus norvegicus
  Genbank Accession No. AA858788
tttttttttttttttctgttcagattcctttattgtactgcaaagtccaatgctccccagtcttggctcctcttcaggtactacccagaaacttgctggagagggcagatgtgtcttgaggcgcctctctaggtgtttggcaactattttccaatggtctgtcctgtccagcgtccctctcttcccttaaactgcctgaggccaattctgccatccgcatagcaagagggcagatgctgagaaagtgctaggaggcagcgaggagacagagcgggaacaggcaaggtgtgttccagagagagatggagatgagagggtgggaggaggctgtcaccagaggcagtggaaccctcgtgccg

SEQ ID NO: 133 - DNA, 479 bp, Rattus norvegicus
  Genbank Accession No. AA858815
tttttttttttttttatgctacccaatttttgtatttttattacacgtttgtgtgtgtgtgtgtccaacagcatttttagaccttgaaaatcaactttaaaatatataactctttaagggcaagaaacttgaaactattcttagaataaagaacaaaaagatatactgccatccctggtgaatgtttctagagctcaagaaaagtgatgctttgggtgttggtttgaatgagagtgctccctctccccaatagattcatagaattaaatattgcctccaccttggtagaattgtttgggaaggattagaaagtgtgtgctgttggaggaggtatgtccttagagaggggctttgaggcttcagaggctacaggattcccacttagctctctctacctagtacttgtagttgacgatgtgagctctaagcgacctttcactcctccatcatggactttaaccctctgagactgtaagcca

SEQ ID NO: 134 - DNA, 513 bp, Rattus norvegicus
  Genbank Accession No. AA858830
cggccgctgtctcgcgcacctgccgagcggctgccagccgggggccgcttggagggaaggggctgtcaaagcgcctgcagtcgcgtcccagccccgagccccgacccctcttgagatctctctttcccctgttctgcaggttcgcttgcggcgtcatggctcagagggcctttccgaatccttatgccgattataacaagtcgctggccgaaaactattttgattctactgggaggctgactcctgagttttcacatcgcttgaccaataagatccgggagctccttcagcaaatggagagaggcctaaagtctgcagaccctcaggacggcactggatacaccggctgggcaggcattgctgtgctttaccttcatctccacaatgtgtttggggacccggcctatctgcagatggcgcacagctatgtaaagcacagcctcaactgtttgagcaggcggtccatcaccttcctgtgtggggacgcgggccccctggctgtcctcgtgccga

SEQ ID NO: 135 - DNA, 515 bp, Rattus norvegicus
  Genbank Accession No. AA858892
  misc_feature (1)..(515): n = a or c or g or t
tttttttttttttatttgtaattcaatacttttttttcctttaattcatactgaacttccatggctctagctactttacattaagatttggctggacagccttgtatgtgtctaggtactagcaataagtttttggaccttgcgcacagcgccaggcaaagtacagttatagatccaaatatagacggtcagacaacccaactgcaaccaaactgtgttctttcccactgtggcccagtgcaggtgttgggtgctgctccctctgcctcacccgactccaccccatgtcaggattatccagggggccactatggcctctgatccatccctccccacctcagaatgtaggttgagtggggtcgggggaagcaccatgggtttgggaaaatggtctggtccatgcagagagtggtctggccctagagtgcaaggtanggagatgtggggtgccacacattcttgttggcaaaagtgactgttttactgtgcagtctctgcacacaacacagaagccc

SEQ ID NO: 136 - DNA, 513 bp, Rattus norvegicus
  Genbank Accession No. AA858930
ttttttttttttttattcatgcttccgtttattcagctcatataaaagtctcttaagaatgcatttgagcacaatatataatagtaataatattataacatacattgtgagaaacttttgaaaacaatataacgtccacctggaacaacgcagtgttacagacgtaggaacccattggtcatgcacattttgtgccattttctttaactagttgtcacaatgctgaactgaagcatgacacatattttacaaactgaaactgacaccaggaagaggcctaacaagtgttatcagaagcttcacatttgcataatttatgacatcagttcacattctacgataaaaattcacattgtcttcttgttgcctttgatgaatttgaacagggctcccctgcttgtgggcagcatggagactagctctgccaaatcagtagtctggggctactcagtatcatctgtgagcaaatgtagtgttgttttattagaaccaaagccacaattagagcagagc

SEQ ID NO: 137 - DNA, 511 bp, Rattus norvegicus
  Genbank Accession No. AA858953
tttttttttttttttttggtttttagcgactgttcgtttattggttagtgggagtacagcccatcggaacacacgacatgcatttgggggagagcaactgtgcactgcagccgctgtaaacctgctgagtgtgcgagcagcgcagacggcacccacggaaaaggcagggatgacttagctgtctacggtggctaagtgcaaagtctttgggaacagatttactttttgttactcaggaattacatcaaagaggaaagccctaactgccccccgttcttaaactaaaggctaagggggttggaatcatttgataacccaccatccaaatcacgttcattgcaaactgtaatccaattccccttcattaagttttccctgtcaacccatacccctcaggattatacacactgtatgagttcagaaaagattaatgtgaatgtaaggggtatgtattcgactccagcatctttgtcacatagccaatttcttttaaatgtctgctataacagat

SEQ ID NO: 138 - DNA, 540 bp, Rattus norvegicus
  Genbank Accession No. AA858969
  misc_feature (1)..(540): n = a or c or g or t
tttttttttttttttttccaagaaacgtgaatatttattagcaagtcggtaatactttggaatggctggaaacgttggggtggatgagcctgtcttgcaaagataccttcaaatatatttacaaaaacggacgagatatcgcaggtgctggtggtcggtgagcagaggaacggggattcgtctaaaaacctacgaaaggacaggtccccactttcaacttgccccaacttctcgccctcgggcaactcgaccagcgtctgagtctatttacagcggcatggcgctcctcagtggctcagggacttgcggcccttcagcatgcggcggaggatgacctgcacgccagcaggcgtgctcagccggcggacccagccgtgcttgtgcttgcgcttgatgttgctcggctgatactcgtttccgcgtgtgcggcctcggacctgctgcagggagaggggccaggcatccgggagtcncatccagaccctggactggagatacctgccactcaacaggatcaccgacctgcacgcctggccccca

SEQ ID NO: 139 - DNA, 353 bp, Rattus norvegicus
  Genbank Accession No. AA859085
tttttttttttttttatcaaatactctttaattttattaactcttggaaaatattccaaggaaataattgaaaatacagaaatattttgttagtacaaagacattacctcaactgtcctcttagtgaaaactgaatatggtctgcgtgatctattagggcaatagtaaaaataaatgtctgtgttacataagagctttgcataaaaatccctgtattgtgtgtaatgtatgatatcgtgtacgcgatgtgtgatataaaagttagcaaaatgaaaaataaaacagcctttgtggattaggcagaaaaatatcaaacccgatgccttttccttatttcagtgacacgtgggaag

SEQ ID NO: 140 - DNA, 147 bp, Rattus norvegicus
  Genbank Accession No. AA859114
tttttttttttttttttgggttttaatttaattttatttttgtcacatgggcagtataggatggtgttagcccatccttactccgcttgcattgactgtgcctcgggtcttaagacgctaaagtgtcatttagaactcactcccaga

SEQ ID NO: 141 - DNA, 550 bp, Rattus norvegicus
  Genbank Accession No. AA859241
cggcagcaaaggttttttggccttttttttcaagttcaacaggtctttattgaatgtcatagttcaagaggcaaatctggacacactggtatcagtgagcttgaaacaggatcactgatgcattggtgatgataattcctagcaaatgtgattgatttttacttgatttccaagtagctctcaggcatctaacctgtgaaacagtgactgtttacatacagggatgcaaggggacataagaatcagagcagaaaggaaacaacataaggtacttcacgaaaataatgttccaagaactgaaaagcctcgaaggtgtacaagaatccagtaataacaaactcatgttcaagcaggattagaaacacagcgttaaaactggactcagtgccgtgtcttcacgtgcaaacctgccaacactgaagaggatcatcccattttcctgtgactagtcaatacattacgaagttcttttgcaaatcactctgctgacaagtaacaaaactgcactgaaagcctttactagtcctcttcccctccctttctcccgtgt

SEQ ID NO: 142 - DNA, 585 bp, Rattus norvegicus
  Genbank Accession No. AA859271
tttttttttttttttttacatgaaagagtatttattgaaaacactgtgactgacaggaagcccctggctgctctctggttacactcagctcatgactgagagcacagcagctttgctctcaactttatttctcttaaacatcctatcctaggataggaagatcttatataaatatatatacatgtctgcataagtatggcctatagtaaagaaaatatatagtacactcttcattgggcagtacccgccacgctaggctgccagtgctgaataccaccatttaacatgcgtccaaggaaggaggctgtgcgcgtgcttcaagtgctgcagcaccaatgaaggcccatggcacagctgtggccccggtacttcttgaaatcatggctaatggcagaaaccacagtgccaggaaggagagagggaaggcaacgcccctcgtctgcggcaagaggggcacaaatagaagggcctgtaactaagggggatgggagcattcttcctcagcaaggacaagacagaactgaaggggtgagctagaggtctcacctcgcctttccttgcagcattcctagagcccgagagagc

SEQ ID NO: 143 - DNA, 538 bp, Rattus norvegicus
  Genbank Accession No. AA859333
tttttttttttttttttctgtttaaacatttttaaaacagggttgatcacaacagtcaacagcacaacagagggggagcatagctattgccaaccctgtcagctgaggctctagcaagagttttagctttgtgatgcaagggacccccaggtggcagtgagggagcttggaaccctgaggagggcatgctgactccttgctggagaaaaggcacctaaatagggaagctgggcttgtgggcctcccagggagccatggggtgaggtgagatgggctaaaggaagcagtatggtgaaaactccaattctggttcccaaggccaacctcctatggggaaagttaaggaatcctggagcagagccttatgcctgaaacctgtctgagggagcctcatcctttcccaccccgctcccccaagcccaggttaacctccttcccactgcccagctgtaggccatgtgctgggagggaatggatgttaaaggggtctcaggctgttttggtgcctgagtccacctccttgtggctcacaaccagg

SEQ ID NO: 144 - DNA, 558 bp, Rattus norvegicus
  Genbank Accession No. AA859348
tttttttttttttttttaaggatcatcctactgctaagtcagtgtctcctcttgattctagtgttttggccacgcctcaccaaatgtctgcaatgatccagtactcacaacatgttcaggaggagctgggtcagattttgacagagggtatgggaagggaaaggggagaagaaatcgacatttattttattatttattttaaatgtttacatttctttgtgttgttccaagcctgaatagaaacagatagcattaaaggactctgttcccaccccttctctgtctctctctcccccacttgtgctaacttaggataacactctctatttcgttttgtttctaaagtgatttgtggacttgtgccgtgtgaactgcattaaaaaggttctgttttcaaagatcgattgtcgttcctgtggggacagtggctcctaagaaatctgcattgtaggagaagacaatgaaagaccctggccctgtctctcaaaacttaactctctgtatgatttaaaaaaaaattccatttactttactttgtggttacttgattttgaggaa

SEQ ID NO: 145 - DNA, 470 bp, Rattus norvegicus
  Genbank Accession No. AA859520
tttttttttttttttttctaaatggaaaaaaatatccctagtcagaaataaactgacaaatttacattctcctctcttaaaaaagtaaataaaataacattattcaaaatgtgaattagctataagacatacaatacaattacatagatacatatcaatacagcacattcaatctgccaaaacattaatgattaaaagccagtatggatgttgcaatatcaagagagatgtatgtacaacgatcagagcatttgtaattgcactgtacctacaggcagtctgttaattaaattacaggggctttctagagcaagggatagaaaagccggggagtaacacatgagaacacttgactacagtcagcagtttcagtgctcatacagtgagctgttccctctcccagctttgctattcaagaaaggtgatttacacggaagttgagattagtgccaagctctaatgagaccaga

SEQ ID NO: 146 - DNA, 529 bp, Rattus norvegicus
  Genbank Accession No. AA859545
  misc_feature (1)..(529): n = a or c or g or t
tttttttttttttttttccctcccaaacagcttttaatagttttacttcagctggaagatgtagtcagagaataagttacaggaacagacaaaaacagaaaataagaaaacagaacttaaagtgcttcaggctgccaacgtaaacataaggggcacaaagaggcccacttagctatgtccccaacccctgagacaggagagtcattgtcattgtcgtgggtccctttaccactaccaccctctaatcttggccctgtaggtgggtgcaaaggaattttagcggcagagaggattggacacgaatgagagagaatactctgtaaactcgggacgacgtgaaggatcggggcgaaggagctcctgcagcctttgccctgctggggtggggccaggactttacactcacgcttggcaatcttgtctagagaaagcacagccttgtccgggggcaggtanaggggacgaccgacaggggaggccacagggggggtgatggccctgcgttccatcacactgcctgacctcatga

SEQ ID NO: 147 - DNA, 557 bp, Rattus norvegicus
  Genbank Accession No. AA859581
tttttttttttttttttaggaaccatttgtacttttgctcatgtggatgcgtgtggcgtctgtggagatcatggatctcctagagttagtcataggtgggttatagttatagtctgtgagtcgtgggaactgagctcaggtcctctggtagagctgttaatcaccaagtcacctccccagcctttcaactgggggacagcattctgttttattttctactcccaccccctttcttttgtctaagaaatgtttggctggatcatgaaaccctgtttgaggccaacattcacaggcaactgtgcccaggactggggtgggattccaccttctctagagaaagctgtttacaaaagcaggtttcattttacagcgggtttggaccaggctcctaagtgatggaagccaggactcaccacactcttggagcccgggactctggcaagcgctgaggggttcttcctgtgtgtccctgcccctctctctctggtggctggtgtgtcatgggtggttttacaaccacaggtcactccattaacccccaggaggaatgcgccagc

SEQ ID NO: 148 - DNA, 533 bp, Rattus norvegicus
  Genbank Accession No. AA859585
  misc_feature (1)..(533): n = a or c or g or t
tttttttttttttttttggtggtttggaattcttttctcttttgttaaaagaggggtaggaaatggggaccaggtacccctgggctctgggaaacaggcatgcagggaacccttgcaggcaggggctgggtagaagagtcctggagtttcccataatccttcgcaggaaacagcaatgctggcagataaggaggtggagtgaggcagggcccttcaaacaacagggtggcgggccaaggggcttggggctcactctaacatgcaaagtccagctgccccataaactaggttgcttttgaagagcgacatacgtataaatacataagacacagctacacgcacacatgcggagaaggctctgcattcccaagggtanggatctaggcctactggccccaagacaggagtcatcatgtgtctgccaccaagtgattctctgaaacactccaggtggtggggccaggcaggtaagtcttcgttgggatggctgcttggtctccaaggtgctgcccactaggcacccaagccacttt

SEQ ID NO: 149 - DNA, 283 bp, Rattus norvegicus
  Genbank Accession No. AA859648
tttttttttttttttttgcgactttgaaagattgtaatatattctgtggaaaacattcggcagagcaaaagccctccctgggccctcccgcagtatgcaaccagtggaacggtctggaaatctgcagctctggaaaggtccctggctcagtccttgaggaatgcaggcagctatatgggaagaacctgctccaggatggttctggatgagatggggatcctatcagggaagatgacttcaaattcgataacaaggtctccacgtttctcaggtgttttgggga

SEQ ID NO: 150 - DNA, 546 bp, Rattus norvegicus
  Genbank Accession No. AA859652
  misc_feature (1)..(546): n = a or c or g or t
tttttttttttttttttaaataaaaagccacaaatttattgtaaatctagaagtaccagaacgtcactcatacagatcagcgatcctgtggtggttttcgtttttgttttccccacccttcccaacattggcacccctgattgttgacagactgaaaaggacacacgttttcctgtctcatgcagtagacgagagcagacccctcagaaaccagttataaatattaaaccatctcgaacattcgtagtacaaaatcgcttgtaaagtgctaaagtcagataacacctgcaaaccgaccctcgagcctagagcatttatttctcgggggcagccccacagagcttgccacatccatctcatttcactcgagtctgctctttcggacagacacgttgtcttccagtcactcgccctcccccaagttttacagattgtcctactagttctatggctgataagatgctgtattaaacgtggcgggtggtgacgcacctcaccacttccgtctcagtgcanagaagagattcaagcttgtgtgtacctgta

SEQ ID NO: 151 - DNA, 371 bp, Rattus norvegicus
  Genbank Accession No. AA859663
tttttttttttttttttaagagcttagaaaatttatttttttcttgaaatgacacacatgggcagggaggtaggacttggtgtaggttggtggaaaccgtgtcccccagcatcccagttttcctctcagttctttgatgagaggtctcctaaagactgggaggcggagcggagagctcccagttctaagcttggaatctaacttgaagtgcggagggtatggggatgtggtgggagccatgggactttgttctctggtaaaaccaaaaaatcaaaacaacaaaactccgagtcagctcggggatacttaatttgcatattggatgctgggtttcaggaaggatgttgtgtgttggtccttgcctcgtgccg

SEQ ID NO: 152 - DNA, 454 bp, Rattus norvegicus
  Genbank Accession No. AA859680
tttttttttttttttttaagttttatttaaaaaaccttcggtgcaatattaaaaagcaatacagccaggtggaacagtcgacagacagaaagggaaggagctagaggacccaaggtcctttacctcacctgttccccagaagctgggggtcaagggggagggtctgggggtggtgggacgaggaaaaaccaccaccaggatgaataggtagaacaaaacacatataagatacatctggctgaactgaagaggggtttggggccacaggaagctcccctggtttttgttgttcaaaaatgtcctggtttggggagaaagggtgacccctggcaaatgagccagccaagtcgtccgaccccacactccactgctgtggagaggggtgaactaaggtcacgggtgtgagaaaagggggaaaatggagaagggaatcccctcactggagtctgttagg

SEQ ID NO: 153 - DNA, 436 bp, Rattus norvegicus
  Genbank Accession No. AA859690
tttttttttttttttttacaaccattcatagaaattttattggacaaagcaaaatgctcttcaataagcaaacaaccataaaaacatggtgcgtccgcaccactcagcagggaagtcatgcaatttctggaacagagcacaaggtattacactgagtgagagcatctccaatgcttctgtcaacacgcttccatctcagcgctgcagagctggaggagagttggtatggtagcgaggtatgaagagttaggtggtagtgaggcagctgggtgactataagacagaatcaacgggccctctggagtactgagctcgttctatacattggtcatacataattgcatgaatcggcacacatgataaaatagcacgaagccacatacatactgttccaattaacaagtccttgcttttgatatgttacaccatatgttct

SEQ ID NO: 154 - DNA, 522 bp, Rattus norvegicus
  Genbank Accession No. AA859693
tttttttttttttttttctgtgtcagagccagcccaatccaggtgggctgctgggagggtttactctcattttctcctcagacttttctgagaagcccagaaaaccacggagaccagattagtgtccttaacatctcaactctacagtagtcggacagccacgtcctaaatcctgtcagctacttcaggctaaaatccatcaagtgctgctgagcccaaggctaggcgatggagaggtggcttataactcatccctcatggcctgcatcctacttcctgtctccagtcactgccttcccgagtaatgagataatgaagaaaataagagtggatggaaatcaccaagcagaaattacacggtgccattagcaagcactataaaaacaaaattacaggttaccctcatttcccatgctcacacctgtctaaccagaaacactagattaatctaaccagtatatgcaagaggaaaacctcaaacagtaatttcaaattttaaacctgtcagccattcaaattgtt

SEQ ID NO: 155 - DNA, 483 bp, Rattus norvegicus
  Genbank Accession No. AA859700
  misc_feature (1)..(483): n = a or c or g or t
tttttttttttttttttcaagctccatcaacttttactttcatgagtaggagagtgggggtcagctgttcgattctgtgcccaggacagcaattgctgcctggcgcccactctctatacagtcattgacagctaccccctcataggaggccccagccaaagtcaggggcaacctctgggccgtcaggaattgcagagctgagtctagtttttgccagtggcctagtgtatactgagggatacagtttttgtgtagatggaccaagcaatggcttggttgctctttcagtcctaactgtgtggcagccgcttcctgtgctgctcgttggaatagctctggagacaattcatggccattggctttcagcttctgtaaccagtaacctcccaacatcacagtcagtctgaggcctgnggggttcccatcctgctcaggaaaagcaaccgagtcatacacgattcccaggacggtcgggtcttctga

SEQ ID NO: 156 - DNA, 337 bp, Rattus norvegicus
  Genbank Accession No. AA859777
tttttttttttttttttgaaaattcacaattatttatttaggtaggggccaaaaaaaacttttaaaaaatacaaaagaaaacccacatttaaatgagtaagaaatataagggcaagtgaaaaaatttagggttaaaaaatgaaaccatcaaaaactgacagtcagaggacaaccacagactatttaaaaacggcagccatgcattgtaaaatttttaaattgcaaaaaggcattgggctttaaagggaatgcatagctttaaaaattttccagtgatcccaaaacagatttgtaaagtggtctaaattaacatgaaaggaaaacgagacaagaaccc

SEQ ID NO: 157 - DNA, 472 bp, Rattus norvegicus
  Genbank Accession No. AA859804
  misc_feature (1)..(472): n = a or c or g or t
tttttttttttttttttggtttagcaccatttatttgtgatctcagctgttgtagtagttgctgctgtcagcctgttctcaaaggtaacatgctcttccgttcctcttgtccaggacagaagggtcttccaggtggcacgccaacagaacaagagactccgatgacgccagcttcaatgatggtgccatccagagagggagagtgtcatggcacattcaatcgcggcttccagaggttttgaaaaaggagcctttgggggcccagcctgcctggcattttgatgctgtcggtgtgagttttgtattccataatggtgttgggaggtangttaagcacgcgccgaagagtgtcccggattcgggctgtggttgcttggtcgctggcagtcttattccatatagaaataatgtcctcctggaagcggacagagaccacagccccgcagatttcctccccaaccatgaactgttc

SEQ ID NO: 158 - DNA, 450 bp, Rattus norvegicus
  Genbank Accession No. AA859805
tttttttttttttttttgactagaaaacccttgttttattaagcacccgggcaatcttgctgtgtgggatggccaaaacatcaaaattaaaaccaacaacagacaaaatggtgttgtagaggagacttaggtacaaaacggggtctggcatccagaatccctgtgggtttggtccatgttcactccctgaggccggcagggagggatgccccagcggccagctgccctcgccctccggctaggcggctatgcttcttgggggaggctgcctggaagcaggtcctgcttttcaaggggagacaaggggggctccgtccactgagatcaggactggacgattttgcagtttgttgtagagacgaagcgacctgtgtagtggatgttgcatctcaccacgttgttggtgaagtcagactccagaacaatgtacttggggttcacgtgcacctt

SEQ ID NO: 159 - DNA, 554 bp, Rattus norvegicus
  Genbank Accession No. AA859885
tttttttttttttttttgttttacctttatttattaatagtaacaaaaatcagaaataacaaaaaccagttaaatgaaatatggaagcacagtaaatacaaacgcatcttcataaccacacgggcagcagaaatctgttgaaactgttttctgaagtttaactgtttaggtcattggcgtcaccaaggcattcagagtgctcacatggacttcgctgccggtggacgagcctgcttcccaagactgacagtagcatccagagccctggcatatgcaaagacctccctgggtcctagatcttgagagatactgatgttaacaaaaccaaaccaaaccacagagcaagcccagggagcctgcagtcttggcctaaaggtttctagaggacactaggaactgaagtagatgttatcctgcttgttggccccatgcaaacctcaacccaagtcttcccaaaccaggttacttagcttttcatgaatggttcaagggtcacaggaatctgtggtggttcagacaacagctgccctagttacacagaagcagcagaactt

SEQ ID NO: 160 - DNA, 520 bp, Rattus norvegicus
  Genbank Accession No. AA859898
tttttttttttttttttaacaagtctttttttatttgtggattttttacatgtatcctacagtcttgttttatataagatcatacactgcagctgacaatgtggtgattggacaaccaagacaaacagcacttcccagattggctgtaacaatcaccccacaccatgctgctggtgtgttctccctcggcaggcttcaccaccacagcacagcaccgcacagcacagtctcaggatggatggttagacagcacagcattgctgtctcagggtggatggttagacagcacagcaccgccgtctcagggtggatggttagacagcacatcactgccgtctcaaggtggatggttagacagcacagcactgctgtctcagggtggatggttagacagcacagcattgccgtctcagggtggatggttagacagcacagcattgctgtctcaaggtggatggttagacagcacagcattgctgtctcagggtggatggttagacagcacagcattgctgtctca

SEQ ID NO: 161 - DNA, 408 bp, Rattus norvegicus
  Genbank Accession No. AA859926
tttttttttttttttttcccagaaaaaggaggtatgtgtatttgtggggaaactgaaatggatgctttaagacttcccaggggctgaagaaaacatgttggaattttacttcttcctctagcatagaaggatctccttcaaatagtagatgagctaaggtttatttattttaacatttttaaaatgtttcattcacttcagtaacatgggtgacggacagttgaagggtttgtaaagtccggagttggaatggagcagggaagctccctgcccaattcctgaggtgtggtgacggagtcgagccaggtcaccatcccactcgtccattaagctgatgtgatcataagagaagaacatgttgacctcgactccatgaagatacaactcaactgctcacagagagcgagc

SEQ ID NO: 162 - DNA, 521 bp, Rattus norvegicus
  Genbank Accession No. AA859942
tttttttttttttttttatatataatatatatacttttattattcacccgttaactccataatatgccaatcacgagcgaggtttcagcagttccattcccttgatcatggctgcatgagcatggtaattcactgaaaacagggagaccagaaacatggctaaaggtgacgtcacgcagcccacgccatggcaatataattgtcaagttcgctggcggtttggtaaagccggttcagttctgttctgtttgccagcgatctcacatctgtgagagctggaccacaagtggagggttccgtttcctggtttggattctcagtggctttatccagaatctcactggcagctggttactgtaacaccaacccaaccttctcggcccccatgctcgggcacttccaattgtacaggtaatactgcaggttgccgtcccctatgccgaacttgagcttctccaggaatgttttgttctccatgagatccagtgcattgaatacgtcgaaccctttcattttggcta

SEQ ID NO: 163 - DNA, 482 bp, Rattus norvegicus
  Genbank Accession No. AA859948
tttttttttttttttttccacagtcaggatgacatatttattgggaaaaaaaaaatgaaaccacagatgcaatgcattatacaaagaaaggtcttcattccataataaaagtcctgtgggggaggaaacaagagccagtggctacctgccctgggaaggtaggcactcggtgaaaagtgagatttgcttacagggactactctaatggaaaacagtggaaagggttaaaaacagaaggggcgggcataagcaaacaaaaaccaaccccacccctgcgcggtttgagtttgttataagcttgagacatttaggttatcaccaagatttaaccacatccctcggtttgtccctagtgtggcaatcgaattttaacttagggtcttcaaacctgaggtagttgagggtcacctgaaacacatttctggaaggttctatcctcacagctggatccagtcatgtctaaccaaccattcctggcttcg

SEQ ID NO: 164 - DNA, 536 bp, Rattus norvegicus
  Genbank Accession No. AA859954
tttttttttttttttttggaatgatcaaagatgtctttataaagtttttcacgacttcattctaaatatacagaataaaaaatggcgtactcatttgtgagacaccaaccagattttccttatactgtctcaaaatttaaagatcaatttccccagagggtgtgcaatgcatcataaaatggcctttttgagggtgggaaaggaaggcatattacattgttccatgataggcatgcaagactgctatccaacatatataacttatatacatttggtgacttagaaaaaccaatcatttgtgacaagcctgaaaagcctggcatatttaacatacgtcagaaggttctgtgtggccgaggttctccagttggaccatgtggccctgtgaaagtgtcagaaggccaattttgttaagtttgcagcagaacatcatatccaccctaaagaatacaatgtggattgaatcgaaggtggagaccttaccttaacaaagaaagcaaaagtatgtcagtgtaaaatgtggactaaactgcttt

SEQ ID NO: 165 - DNA, 409 bp, Rattus norvegicus
  Genbank Accession No. AA859966
tttttttttttttttttcaactttattccagtaatttaagagaagattaaaataatagataatatgaaacagatgaagataaccgagctggtacaggtccaggccagcctagtataaagttaaggaggcatggagaatggtgaggcaggggagtggagatctctgttgcaatggcggaaagcagcttggagtatggttgatggtactgtctccttctacacgtgtgttcaatgtgttaacaaatgggaaacggaatcctgcctcattctaaaccagatggtaagagaaatatggcagaacgaggttgtggtatccaggcggctcgggcctgctttgaacactctaattttttcaaagtaaacgcttcgggccccgcgggacactcagctaagagcatcgagggggcgcc

SEQ ID NO: 166 - DNA, 487 bp, Rattus norvegicus
  Genbank Accession No. AA859981
tttttttttttttttttaaagttctgatttattgcattctgtatcaccacgggcaggggagggcctgagagctcgttctaaagctttattacctgagatttgcattccgaacaaccaggatgggtgactaacacacctcacaagatttgggtttggctctgatgaaagaccatgtaccgacctggaaaggggctacccgagattagagaggatcagctaagcaccgaggtccggggacagctatggtagactatcccggaactcaagcccccggacagctctttcccagggagctgctcatgtcagccttagagctctgtacggctcacttctcatcgtcccggccgtagttaatggtttgtagggcctgagctatgagcactgccatctctctggtgccagcagccaccactctgcacgacatgaggtcaaggggtccacctgaggtgtcaatcacaatgccacctgcttctctgatgatgactgt

SEQ ID NO: 167 - DNA, 550 bp, Rattus norvegicus
  Genbank Accession No. AA860024
tttttttttttttttttcaatgttcagtttcctttaatgacccccatctcccttgaaggataggtgcaggcagctaggtgactggcaagacatgttcacttgaagatcttgccttgattgacggctttgccaacgtgctggaaggccccctcccaggaaaagtactctcgaacgagggtctgggtctcctcgctaccaggatccagtttccgccatgtatatgactcatagtccacctgccaatctggactcagcggaaaggcaagatcttggcctcggaagacccaaaccccagaaatggagctgctgttgttggttccaaacaggataacactagcaaaggcattctttctcagtttgtccaatcgctgaaacatcccagtgatgaggttacagctcatgaaggtctgggtgagctcttcagggaagcggtactcagcataccacagggaccagccatccttatcaaaatgctcccaaaaatatggcagcgccacagagagggtgtcctcattggagtactttcgcttaaactcatccaacacaaagg

SEQ ID NO: 168 - DNA, 442 bp, Rattus norvegicus
  Genbank Accession No. AA860030
tttttttttttttttttgacattccacaaagaaatatttattgagcgcctgccacgtgccaggcaccgtttaccccccaatgagaaaacaaaacggaacaaaaacaggacagaggcagcagaaagaaacaaagggcagttggaaaaaagctaagggaactaagcgcttgaagagctcctggatggccgtgctgtttccgatgaaggtgactgccatcttgaggcctcgcggtgggatgtcacagacagccgtcttgacgttgttggggatccattccacgaagtagctgctattcttattctgcacgttgagcatttgctcatctacctccttcatggacatccgtccacggaagacagccgcaaccgtgaggtaccggccgtggcgtgggtcacaggcggccatcatgttcttggcgtcgaagacctgctgggtgagttca

SEQ ID NO: 169 - DNA, 358 bp, Rattus norvegicus
  Genbank Accession No. AA860039
tttttttttttttttttgggtgagtgagtttctgtacgagtttattttatattacacatacattcagaggatatgcatctgacgaattctctatcaatcttacatggtatgtgtttcacatttgcctgagagcctgggcatgtgatgcttcctttaatcctagcttgttgggaagacataagtaagtagatctgagttcacggacagtctagtcactcgcgggagttctaagacagccacggctacacgattaaaactaatctctgactataggggataaatccagatttccagtgtgtctgaaaattcctaggctaatctttaagtcaatgtgggtttataggccaaactatgtgtc

SEQ ID NO: 170 - DNA, 358 bp, Rattus norvegicus
  Genbank Accession No. AA860055
tttttttttttttttttgcttttattcttaagccaaccaaaacttttaatataaaactttgtaatatacacaatgcaatcacaatagcatacatgtagcagcaaggggatgaagggcttagggtaggggtggatggaatgggagtttttcaggtcagcctgccaaatacctcctttatcctaaagcatttgggtatctcatgagaatgcacatgtggtcaaagcaaaccctgaccaccccatggactccaagcaggacctctaatatacctcctacccagtgcagtcctctcagaaagccaggctcaggagatgagaagatggctatgaccaaaagtacctgccatcccctcattggc

SEQ ID NO: 171 - DNA, 308 bp, Rattus norvegicus
  Genbank Accession No. AA866240
tttttttttttaaatttaaagggaacctttattttaacccaggaatgggtacacaatgacacaagggatcaaaaattgttatatgaaaaaaataatacaagtggatttgtgcaaaaaccccaaaaactgcaagtgctttcgggatcttaaaacaaaattcaggatgggtgataaagggaagggactgggtaaaaacctgaaggggatttcaaaagggaacacatttaaacccaaaatgcccgatttattcaggaaggaatgaaccaaacctggaaaatgggtggcaaaaaggcaaaaccattcaaaac

SEQ ID NO: 172 - DNA, 430 bp, Rattus norvegicus
  Genbank Accession No. AA866264
tttttttttttttttttagaggaaaaaatgttatttttatttcaataagtggttcaaaacttaatggcatttctgtaggttagtaaatgtggctctaattgcctgtcatttgttagatgaagtatggatcaaccagaagggccgtgtcgcattagcatcacctccagcagtagcagcaaggtcattgtcctcatttaggagcttcaggtagacgccgcgacaaagactctcatactaatagtcatcagaatatggataattagggtgttcagcagctatgttcacaggaaaatacctgaagtttctgttcaggccatctaggacttccatatcctcggaaggcaactgaaattcaaatacctgaatgttctctttcatctccttctgttcataagtttgggccagggcaacaaccccacgctgtacctgg

SEQ ID NO: 173 - DNA, 493 bp, Rattus norvegicus
  Genbank Accession No. AA866276
tttttttttttttttttcatctttatattgagattttttctcttaaaaaaaagaacattatagatgtgaggggtgggaaaggatgactgacagcaggtgctatagaaacccaaagctccagaaaattaaaaaaaaataaaatatatatttatacatttatatatatatatataccaagtaatgcatgtgagtcccagagaagcagaaagcagcagcaagaagcaactagcacacaaggacctgggttcatgtacagcacacacaagccattccaatcctgataacccaccccaagcccagcccccacccccaagaaaagatgtttaagaaacttccctcttaaatggggctgcacaactggggtactgtggcacatctgtaatctcagcacctggacggtggagacgttaagataagggttcaatggaagccttagcgacacaattaagtttgagaccagcttgggctacattaagaacatctccaaagctat

SEQ ID NO: 174 - DNA, 405 bp, Rattus norvegicus
  Genbank Accession No. AA866302
tttttttttttttttctgggaaggcatctttactcgaaacggatcaggagaagccttgccgtagagggggcgtggccatggtgtgggtggagccctgaggtccagcctttcagccagttggagctgattgacttgtccagcgccttgcgcggtctgggtgtgggtggagcttacattccagacctcacaccgttggtctccaggtcagtgaggttaccccgtagggcttgctcctcttcgaaagctttgaacagagagttgaagttacctgctccaaagccctgtggcgatagaaggcaagtatgagctggaaacttagcaagcagttggtgctacctgttgggtgcaggctgtacctggtggttgtggcgttggatgacttccaagaagagcgtgggccggtcc

SEQ ID NO: 175 - DNA, 543 bp, Rattus norvegicus
  Genbank Accession No. AA866414
  misc_feature (1)..(543): n = a or c or g or t
cggccgcaaaggttttttttatttttttttaaaaaatatattgctttgtcaaaaataaaaatagttgtttatccatattttgaacaagctactgtctcctactccaatgggtcaaaacttgggtttcgctcccccaagactcagtttagctggggttggacacagcaagtctctcatgagggctgagtgtgtgggcaaaaccaaggcacggaagaagcactcagaaaatacacagttaataaattacaaccctcccatcctcccgctatccccatccatgtccagagcagacttatgtattggcctcaccccgcaaaagaagcttgaaccagcccctctgtgtccactaggtctagggcctttagtagatggctatggaatgtatgaatgaatgaatgaatgaatgaatgaatgaacacctggtgagagagagcaagtacttaggaatacgagcctcagtcnctcacctgtatcttactctcatcagaatatctctctagatgcagagaagggagacttggggtgggggtgggacagaaaatg

SEQ ID NO: 176 - DNA, 293 bp, Rattus norvegicus
  Genbank Accession No. AA866444
tttttttttttttttttagtaacttacattttatttcatgtacaaaggggccttgtggcagtgaggtgacatacggcaaacagcactccggtgagcacctggaaaaggctgttgaagcacatgcagctgccagtgagcaggccctgggggccaggataggcacgcaggaaggcacaggcttggaagagcttctctctgcttccctccaagttgggaccaaacccccggcacccacaaagtcacatgtgctccggacatttgaaaatagcacagccccccctgaaaacccaaca

SEQ ID NO: 177 - DNA, 534 bp, Rattus norvegicus
  Genbank Accession No. AA866454
  misc_feature (1)..(534): n = a or c or g or t
tttttttttttttttttcccagtgtgtgtcctttattctccccagaagccatgttgactcccttctgcaggctgatggaaggaagggcgctgcccttcatgtggactgtgctgtggacggatctgactgagaggagccccagtaccaagcagaatggagttgagaagccagggcgctcactaacagagcaggggacaagtggcctccttagaaggtgtgcatgttctgggtgttctgaggtaacaggcctgtccacatggcctgcatgtccattgatggcctcccaggctgctagtagaagtgaggctgttgctggcacgacgttactgcaagcagcaacagagttcgcgtatccacaaagctgagcatgtctaccacttagacatgcagactccttgtgtcgcagagcccctgggtcaccagcggaggtatcacctgncgggcgcaggcatgcgatcgtgaccgttccctccaacttagtcgaaacctcccgctgccgtggtgctaaaaaaaaaaaaaaaaaccctcgtgccg

SEQ ID NO: 178 - DNA, 523 bp, Rattus norvegicus
  Genbank Accession No. AA866459
cggaagcccaggtttttttttaattttttttacttttctataaggatcatatcattaaagccctagaggctacttttggctttaccttaggaatgactcttgatttgttttcttttgatacagaagcaaactttgttttttaaaagtgcctgagggagaagctatactgtacccccaccaggtaatgcactaagtgaacagcatactctaatacccctcaactatcttctgggcaatttatatagtaaaacgtgtaataaaaaaaagtcatggttatcaaatacaggcaatattacctcccctcatttaatctcacttcaaagtgctaactgtaaactaaggactggtttctgatgagggtgataactgcttggttaccagtgcattgtgttaccactttaaccacattccctttaaaagttaaaaaccaaagacctgtagtgaattttcttgactctctgcttcgtcctttaccctgcctcagtcagctcccactgccagcaatgggttaaccatcacagcc

SEQ ID NO: 179 - DNA, 543 bp, Rattus norvegicus
  Genbank Accession No. AA866482
  misc_feature (1)..(543): n = a or c or g or t
ttttattttttttttttaaagaaaaatacagtttatttcaggcgtacagtaactttcagagcactgctatggtccgtccgtttgtccgaagtcccaggctactaagggagaggggagggtgcagaaactactctcttgatgaattttgaagctcagctctcagaaagctgattccaaggttaaatcatgaattaaacaagaaagtgttatgttattaagatcttaagcctcatccctggacttaaaacagcccaactttcccaagttcaccacttttagttaagtccttcaaactctcaagggtattcaagggggagaattcccaggaggatgaaaattctggtcggttggggaatgctctgtgggaggctanggtggggacattggggaatgtagacttctacatctctcttccagctgtatgcttttctcacaattgccaagccagccagcctcccactgtggaattccggtcctttccataaatgtacctgcctactttccacaagcctggcttctataaccacatccacacctatcacc

SEQ ID NO: 180 - DNA, 530 bp, Rattus norvegicus
  Genbank Accession No. AA874849
cggccgctcccggggagcccggcgggtcgccggcgcggggttttcctccggcctcgtcctcccccttccccctccgcggggtcgggggttcccggggttcggggttctcctccgcgtcggcggttcccccgccgggtgcgccccccgggccgcggtttcccgcgcggcgcctcgcctcggccggcgcctagcagccgacttagaactggtgcggaccaggggaatccgactgtttaattaaaacaaagcatcgcgaaggcccgcggcgggtgttgacgcgatgtgatttctgcccagcgctcacgcaccgtgctgtgcgggacatgtaggcagcctgctgacaaggctgccagtggctcaggagcccaggtgggcggatccatctcctctggctcttctgcctccagtgtcacagtcactcgaagcttccgcagtgtggggggcagtgggggtggcagcttcggggacaacctagtcacccgctcctacctcctgggcaactccagtccccggaccctcgtgccgaattc

SEQ ID NO: 181 - DNA, 471 bp, Rattus norvegicus
  Genbank Accession No. AA874857
tttttttttttttttttccttgaaaaccccaacttttattcttgaaagacagctggataaactggcaaatgccagtttgttgaaatttcaagatggtataaaaatgcttccaggatagagtcagcattcgtgttcacttcagttccattcacagatggattcagcttccaccgggtgcaatgcttgaatcattcatccaccatttgccaactttgattgtgaggtactgaatatgatggatcaagttcttaaaaatttattttaaaagaataaatgatgctggaattctggacctgaggatcgatcgtcagtattcagtaaatccagagatgaaactgaaggtgaactgagacttcagttctggttatttccaacttctctgcgaggatgtgtatctcattaaagctcagttgtggccacagttcctttttgcagatagtcaagttttaaggtttaaaatgcagccagcca

SEQ ID NO: 182 - DNA, 585 bp, Rattus norvegicus
  Genbank Accession No. AA874873
tttttttttttttttttcaattttgccaattttattgaaccaataaaattcctactaataacaatgaaataaattctgcaggtataaacgtgatacagtttaacaaaacccattgttctgtacctataaatagattttcaaaatgtcatagaaagtgcagttatgaattgttaacatgttaatacacagctcctttatttcaggtgtgtttgtcttgattcattaacagttccttctttatctgttcaaataatattacccatccctcgaaaaacaaaaggacagccgcagaacgaggaacaacgcttctttctggtttgcaggagctgagccaagcggcaaggccaggtttcccaggtgacctaacagggttctcatctcattcaccttgaccagactgtgcgtgtgcccgttcaattcatagaaagatgccgccaggtggcctgggatttgcttccaatgttcatcttgctttgggtaaaaagagtaaatgtgaagaggaaggaaaaatcctacttcctctctcgcagagacatccaaatgcaaaggaaatgtgtgcactagatgtagatcaccatccttggt

SEQ ID NO: 183 - DNA, 573 bp, Rattus norvegicus
  Genbank Accession No. AA874951
cggccgcccaggggctgcagcagagacgcgcagatccacggcagcgtctcggcgttgccgcagacgcagcccgtcgcgtcggtgcaggcctgggagcccactctcagcgcgcccgacccgtggaagcgcaggcggccctcgcgggacgccaggaaagcggccaggtcctcgtcgcgcgtgaacgtctgacccacggccgagacgctgcggacgtgcaccgggttggggcctgggccaagcgccacgcggaaagacccgttgcgcgggaagaggacgtcgtcgtaggtgcagggcacgcgctcggcgtccacgaagaagatgccagactcctgggttccggagctccataggtgagggtcaagccaggagaagcggtcgggattgcggaagagcaacggggcgccagggttacaagccgggtcggagtcgcctcctgcagcgctgaatgcagctcccgaggccaggacgaactccccgttcagcggcaggagcatatccgagatggcgtgactgtctcgcaccaggaccgacaccatcttgtccgccgggaactggaccgcatctcccgcgcac

SEQ ID NO: 184 - DNA, 542 bp, Rattus norvegicus
  Genbank Accession No. AA874995
  misc_feature (1)..(542): n = a or c or g or t
tttttttttttttttttcagagtgctatacccaatcatgtaggtgtaatttatttatgttggaaatacatagatcacaattcttaaggaaagagatgtgccccccaaagtttgcatttgcacacatcagctacgctgagggcattgtcctcgggtttaacattaagacccagtgggaaagcttatggtcttatacactgggtattagccatgctaggtatggccatctgtcagacaaaggggcctagtctcctcccacaagtcatgtcctaagtcatctgcgtattatggcaacaggagcagcagggctggctanagagaggtatggtttggccagttagtattgacatcttagaatcctgggggtacatgtgttgtaagaagccaccttcagaaggctgacggtactatactggagaagctgtggaacaggctgcactgaccagggcaggctttcttagagaagcctcagctattggtttcatacagtttccatttccaaggaggcaagggcctgtttggtatgcanagagactaacaagg

SEQ ID NO: 185 - DNA, 486 bp, Rattus norvegicus
  Genbank Accession No. AA875025
tttttttttttttttttgcatccaaacagtttaatgactggtacaatcatgcagatgccaaaccagggatgcgggaggcaacaagggcctgaggggagggtactacaacattgtcatagggaaaatggggttgcctaatattcatgggggagaggtgtgtggaggaaagacccactggcagtgcgggaccacgacgtgctcctcgtgggaacttgtatcctgccatgaaagcagaacaagctggccacctttactcccggacataaattcttgtgcacaccacatcatcggcgccaaatgtcaggattagctcatcgttggccagctctcgggtccagtaagttttggggccatccccctcaagaagcgtctgcgtgcagtgaatcttgttctcattctcccaagtgggtaaactcctgcacttgcgtccgtccaccgtctcctcctcgaagccctctccgaccttgaagttgatccctcgtgccg

SEQ ID NO: 186 - DNA, 580 bp, Rattus norvegicus
  Genbank Accession No. AA875032
tttttttttttttttttctgatcttaattcattttattctacaaaatgctactcagtggaaagtaggaaagccaacaagacaacaagaacataaaacgagaacaaaccccgagggaaaataagttttaatatgttcttccctccatagcagcaagctctaaacagctttccttagtgcaaatactgtaggcttgtgtcacacacagtacacagaacaacgcaacacacaccaccacagatgcttctgagcagagatactcctcaaaaatttaaaactatacaaagattttttgagcacgtggtcctgcctggagaattcgactagagagaccctcctaggaccatttcaccattactgtaaaaacgggacaaaaggtccccagaaaggaaattagaattccccatggagccataaaaccttgtacaactcgtttgcctccagggtctaatagcaaatttcactgcacgtcattgacatatcccaaatacggatgcataaagcttgagtttctacgatataccaaaatacgatatatatacaactcccactgcaaaagaaaccctgatacctagtctttat

SEQ ID NO: 187 - DNA, 335 bp, Rattus norvegicus
  Genbank Accession No. AA875097
tttttttttttttttttggggaaaaaatgtaaaactttatttttttttcaaagcagtaacgcatctcagctgtgttcagctacagtacaaagaacaatggaatagcaccagggaatttctaaaaagttcacaagatccgtgacaccttcctcttctgatcattcttctcggctaaccaagcaaagaaagcagagcccccactttccattccttcagctactgtcccaccagcggtctgattttcatccgaacggccctcagagaataatccgctcctctgaagggaacccagaccactccgttctctatctcatagggactgttgttcctggggt

SEQ ID NO: 188 - DNA, 511 bp, Rattus norvegicus
  Genbank Accession No. AA875098
tttttttttttttttttcgttagaaagcactatttatttcttcttactcttgtttcgtttctcttctttcagcttctttttggagactctgggtgtgctggcctttttgtataggtgatacccaatcaggcccaggagtgctggcaccatggccatgcctaccagaggcaaaatgcccttcagcagcttttgccagtagttggctcgaatcaaggcgatcagctccacatcatactgcaccactgcatcggctgggatagatggtgggtaccctctctttccataagccaagtgagaaggaatgactgctcttcgcttctcccctacacacatgtccagaaggctctgctccagacctgggatcacctgcttttggccaagttctatgaccagaggatctctggtcagagaagtgtcaataatgcgtccatctgccaagctgcccgtgtagtgtatgtggagcgtgtctccaaaggcagcggattccgtgcacgattcagggggctgcacc

SEQ ID NO: 189 - DNA, 469 bp, Rattus norvegicus
  Genbank Accession No. AA875102
  misc_feature (1)..(469): n = a or c or g or t
tttttttttttttttttaacaaaaacaagctcacatttatttttaccccaatgagaatgtacaagtgaaacaggatgagtaaatgtagtcaccagcagcccctgagccccttctcaacctctcccatgcttggccactgctagttggaaacgctttggagcagagtaatattatctcctttgagcatgatccgacccagttgttttcttgactttgttttagaatgaatttcttctgcatcatctaatacgaggttcatgtactcatcaaagccaataatacaaccctctatccgcatattcacttgttcatacagccacacctgaattcgagatctattttgcaagtatctgaagataaggttgatgggctgcaccatcaccttctgcaccttctggccctggccgcggtacgccatggtggaagtcacaaaanaaaaaaaaaaaaacctttcctcgtgccgaattct

SEQ ID NO: 190 - DNA, 569 bp, Rattus norvegicus
  Genbank Accession No. AA875126
tttttttttttttttttatatataaaatcacatttatttgagactgggactttcgaagcccagtctggcctgatctagtgtccagaagcactgattagcagatgtgttttcctctagctggctacaatggctgcggttcattctattcagatgtcagacaataggcacagctgggttccttattcaaaatctgaaggagtctgggaggaggacaaacacatagatagaatcaagcttaggccaggaaccagaaactacggattgctttgttaaaggccaaggaggcttcaaaagcgaacacagctggagtctcatttcagtctccattttcgcaccacttcagtggaagttccatgaaacagcccgatggttctgaagtgccatcaagtcacttcgagctccagcaacttaggtttccaggacatcttctagaagaactcgatcatcccttccacgttatggggccactcacctggcctcgatgcccacctggactcgaagtagccctgcaccgcgcctgtaccctgatgacgacggatgcagaaaaggtgagggccgccctcgtgccg

SEQ ID NO: 191 - DNA, 503 bp, Rattus norvegicus
  Genbank Accession No. AA875146
tttttttttttttttttgataggcattaacgttttatatttttaagtgaccaaatctaataaaatgaaaaacaaaacaaaacaaaacaaacaaaacaggtttactaaacaggttcaaaagacaacacaggagataagcagtaaaaccaaagcgtgagtggcactgtccatgtcaacctccaatctcctccagatcacattttggtttttgctttctgtttaaggtttttaaaaagtgaagcccaggagtccggcaggccaccctgtgctcagcagcatgtccgtctcgcctgcatcaagctctggcccctgtgtccctcagcagcaactgcaggttgtggcttgtgaacctcactcctgtgctatgcttctcagcacgtatttgaccgtgtaggcaaaggccgcaaacccaactataacaaacaagttcgccaaaacgccgcccaggagtccatgatgcctgttggcctgtgggagcccagcaaggtttgggccagcagcagg

SEQ ID NO: 192 - DNA, 420 bp, Rattus norvegicus
  Genbank Accession No. AA875186
tttttttttttttttttccttcaagtgttcaagtttcataaaaagggaggagggaggagaaaggggcaaattaaaaacaaaaacacgacggatttaaacagaaacaaacaaacaacccccccccaaaaaacattgaaaaacaaaacaaacgagagaaacaaacacaagtgtatcgctcagagacaacggggttgacagagtcacacacggtttgtggtatgtacagcgattacagaggtgacgacgcggaggggggttgggggtcacatttgtgtttctgtctgttccaggcgcttggctacacgcacccacgagggggagtgcctccgtgcacacacaccccacacacaggctccgcatccccacgcgcacgcacactctcgcacactctccatggctcatccacacacagacacgccc

SEQ ID NO: 193 - DNA, 559 bp, Rattus norvegicus
  Genbank Accession No. AA875205
tttttttttttttttttcacacagggttgcttttatttccacatccaacttgagcagaggccctgccacaacctgaacagctgtgaggtgctgggtgcctccagagtttctggcacagtaagtgttgggtgtgcagacttcctgatggccacatgacactggcccacacaggaacagcaagtccatgaatggaaatcccactgagctggaagtggaggctctggaaaccccatgggcagcagcaggagttaaaggagccaccaggaacactgcagtgaggctccaatgcagacagggctgataaaaacccaaacagggcattgtgagagcagaggctcgagtgtccccgctgaggacccggggctgaaggcacagagctgtgtcgggatggaagaaccctgggtgcactcgcagtccagagcacgaaagcacaggtgagaacccagcccgaggctctctgtgaagagtgtggccttggatcttgggcacggcacagtgacacacagtgctgaggtcaatcctgacttcccagaggaatgacctcttcagtgacaaaaaa

SEQ ID NO: 194 - DNA, 483 bp, Rattus norvegicus
  Genbank Accession No. AA875257
tttttttttttttttttaaaaaaaaaaaacaaaccaaaaacgatcctttaataaaattagcccattgaatctccccacttcttaaggttctaaacttgtaatagctgcaaaagttccagttcagaagccagaggctcagtccagacagggattcaccgacttgtgctggtatctgggtgtttgggttgtagtttgagttaagggagagggatagctaggcccggctcctctagtcttctgcggcaggtatacaattcttctgtccacaggccaataggcgttccctgaccctttccagtttatcttggaaaaattggcttcacgttataacatgccggcctacaaatgacgacagggtcaactggtttgagaggccagtaagggggacacagagtgaaacagtatgatccgcttctcaccaaagtccggcaatcaactcacttctgaaaggtccaagagagggctaagcaccaagctgaaaac

SEQ ID NO: 195 - DNA, 466 bp, Rattus norvegicus
  Genbank Accession No. AA875268
  misc_feature (1)..(466): n = a or c or g or t
tttttttttttttttttggatcagggcgggtttattcacagggattctgggatcctcacgttcggcttggcagctctacctgcggtaccagatcttcagcttctgttcgcgtttgatcttccgctgcagctgcaagatgccgtagagcagcgcctcggccgtgggcgggcagcctggcacatagatgtccactggcacaattcggtcacagccacgaacaaccgagtaggagtagtggtagtagccaccgccattggcacagctccccatggacaccacataccggggttcgggcatctggtcgtacaccttgcggagtgctggagccatcttgttagtgagcgtgccagctacgatcatcacgtcagcctggcgcgggctggcacggaacaccacaccaaagcggtccatgtcatancgcggggcggccatgtgcatcatctccacggcacagcacgccaagccg

SEQ ID NO: 196 - DNA, 514 bp, Rattus norvegicus
  Genbank Accession No. AA875286
tttttttttttttttttgtgggttaaaaggctttattagggaaacatacaggggcaaggaccatccttgggagacctcaggacgctgtcctccaggttgctgggcaggtacagtccccaggagcccctgctcagaagcatctgacctgggaggcagtaggaggggtggcttctactagtgaaactgccccctgcccccccagtacttaagctgtggccctggcacccattccttgccagggatattggtaacaggaggcagtgactcatgcagcaggtctaaggccagggtcaccctgctgcttcccacaaacacaagtgccgctcaccagtctccactggggcctcgtctgggactgtgacctgcccagcctaggagtccactagccacccatccctcgctgctgctgctcctgctccaggcttcgctgcaggacctgctgctggttggcaatgacacgacggataccattgacaaagttgctctggtcatgcgggatgaggccaatgaagat

SEQ ID NO: 197 - DNA, 394 bp, Rattus norvegicus
  Genbank Accession No. AA875327
tttttttttttttttttgttatgtaaggttctcttttatttaaaagatcattcacaaaataccatatccatagactcactttctgtcatagaactgaatgtgttaagtgtttggaattccattcttacagagtcagctgggcgcccagcagtgtggatggacgtgcctgttctgtcttttccgcattggagatggattagatcatctgaaagcatcagctttgattacaaccacgcaatgcatgtctccaattctgtgtgctcatcccagctggatacctaccaacaggccaccacagccgcctagctagtggccccagctctttcccagaagccaaggggtggctggcaggaagctgctggctaacgagcaagctgcgcacctcagcccttct

SEQ ID NO: 198 - DNA, 512 bp, Rattus norvegicus
  Genbank Accession No. AA875495
tttttttttttttttttgtataaaaaagatttattgaaatttatcaatgacaaacagacataaaactcaaagtttggctcttctcaggggcgggagaaaaatgagttacagctgatctgtacaaatgagacacagggtaggaaacagcacgtcacttctaaagcaatctggaaggggggcgctgaaggcacacgcactctctaggagaaatctgcggccacttcagagtcccaccaggtaagaaaatacgagcttgcattccttttccgtgctcctatgtatttgagaaggaaaacaaacagaacaaaaacccagaggacacacagggcgcttccagagcttagatttgttaaaaggttctaagctggagcgcccgaggagtcctcctgccatttctgtaaaacaaattgctctaatattttacagaacaagatagaacaggttggcttttctgaagaagctgaaacacgaaggttcacttctttcccattttacgtgtctcctaaacctgc

SEQ ID NO: 199 - DNA, 451 bp, Rattus norvegicus
  Genbank Accession No. AA875509
cggccgcgttctacgtcaggagccgctgtcgcttcgctcgacctcccgagcgaaatggtctctcaagtcccggccaccgggcctccgcgctccccatgaagggtcggaggccgcgcggggagtagcagcggtctgcaggcgagcggagacggacacaccggggacctctccgaccaccgtgcttctgctgcgcgcctccaggccaatgtgcaataccaacatgtctgtgtctaccgagggtgctgcaggcacctcacagattccagcgtcggaacaagagactctggttagaccaaaaccattgcttttgaagttgttaaagtctgttggagcacaaaaagatatttacactatgaaagagattatattttatattggacagtatattatgactaaaagattatatgatgagaagcagcagcacattgtgtattgctcaaatgatctccta

SEQ ID NO: 200 - DNA, 403 bp, Rattus norvegicus
  Genbank Accession No. AA875523
ttttcttttttttttttcaaagagcaagttttatttggtgaaggcaaacatcatccaaaagaaaccagacaggcaaggtgctgtgattagggagcctctggggccacacaggaatctcacactgggcaaggagcaggctcgagacacgtaaatgtcctcagccattcagcaccatccggacaagctccgccccatgggcccgtcaccccgacaggatatgcctcacaaatgcttcatagttaatgcaaccgttgctgtcctcatgccccgccactagcatctcgacttcttcctctgtcatcttctcccccagtgtgactaggacatgacggatttcagcacccatgacagtgccattcccttctttgtcaaacacacgaaggccttcaacataatcctcgta

SEQ ID NO: 201 - DNA, 492 bp, Rattus norvegicus
  Genbank Accession No. AA875577
  misc_feature (1)..(492): n = a or c or g or t
tttttttttttttttttatattaaggaaatgtggttcttttatttggagttctagcagcatggtgtaggtgtttattcagacaactgtaatatggagttaaatgcaaatctaaccccccctcccccaacaggatgccgtgattctaggaagtctctggggaggaatgttagagacctctccccacaaagcaggcagagtatggtggggaaccaaattgtggttgagatcatgcaatgaagagggctggagggaatgtcactccagatgacacaaccacagtaagaagggtatctgagaaacctaagcaaaatatcaggttggtacaatcctttgcctactcatcacatggcacgggataccacatctcatggcactttctanggtccagggcttgtcctgaaacgctggtatcacaccatggtcatgaccttcatggctgctggctggaaccttccgatcttcttcttcagggccttggaggcctttatgcg

SEQ ID NO: 202 - DNA, 404 bp, Rattus norvegicus
  Genbank Accession No. AA875620
tttttttttttttttttgcttttaaaagattttattacaagcaggaaaccatgcacttccattgcaagccattgtaagcagaaagacagatacacttcaggcaaggtaggcttttattacattggctaatgctcatgttcaagtgaggctctggttcagtctgggctgccacctgccatgcctgtgatgtgggacagccagcacccacggctttgcggcctttcacgctcggatagctggcaacaaggcagtagtaaaaaggagtccaacttgtcagttttgagtagcagctaaggccttcccagcacagaggacaaagggcttgttatacaatgagatgatcatgacattctagtcacttgtaggaactccaccttagtctgggtcctaagttagcccacatc

SEQ ID NO: 203 - DNA, 446 bp, Rattus norvegicus
  Genbank Accession No. AA891041
aaatagattcaataaaaagtcaaacacacacacaaacacatcttaaaatagactttagacacgaagtgcgtgtttcttctccacagtactgtgcagagggggagggcagggggcggaggttcctccctagtatccccacaggctgagtaccaggcggcggggccagctccgccgcgacaacccccttctcccctccctgttaaatacacaaatatattatattcaatatgaattcagtctctttccagaaaaaaaaaacatacaaaatacgctggaagggggccatgtaaacctcgaggtggaaggactgggcgcaggcgggcaggccagagtccagtgtgtgagctgcgccccagacctctgggcgagtgcccatcgcctgcccccctcaccccagtggggggcgggcgcccagccttcaaggctgggggtgtccgtatggagca

SEQ ID NO: 204 - DNA, 529 bp, Rattus norvegicus
  Genbank Accession No. AA891209
cccatccttctgagtggaggtgccctgtgtggggttaggaagtggtgctgggagggctcagaggagaaaccacaccacgtcttgccttaggaaagccaggatgtccttccatcctacccgcacatgtcctgcaccttccctggtgagatgggcgacggggctcagagagttctgaagagtgacacagtgtcacctgtacagggcaatgccagctcccaaaggaaccagtgccctagacaagcagtccaggccagtgtgcctcaggaaagaggacgtgaaggctcatgacaggtgagggtcacagctccgagtgtgccgccttggctactatcaccagcttggagagctcagctttgaaggccccaggcctgtgagacactgctgtcttggtcacttcaaactcctcgcttttcagggggacatcactctctctctcaaatgcagctttggagtaggccatggcgtactcgatctcagcaccctgcaactcagccttgaactgtgtgaagtagaggtaggatttcccctg

SEQ ID NO: 205 - DNA, 438 bp, Rattus norvegicus
  Genbank Accession No. AA891322
  misc_feature (1)..(438): n = a or c or g or t
aacaggaaattaattttattcttaaatccaagggatcagaacaaaaaacctctgccctcaaagggcaagccaaggtggaaaggctaggaaggcagacagcaaggcaggagcatgtccacaacagaggcctcttcattcaggcgctgcctccatcagaaagaatttctctggggccatgtacccatccccaccctcggcctccatgtacatgtctcgaccatcactacctagcccttccagcccattgtcctgaccgctcccacccccaccccgggccttccctgccccgctcactgccccgctccccacgcttgtgctctctatcccggtcacggtctcggtctcgacggcgttccctctcacttcggtgacttcgacgcctctcccggtctcgatcccgacccttctcctcagggncatcanggccttcaaggccaa

SEQ ID NO: 206 - DNA, 614 bp, Rattus norvegicus
  Genbank Accession No. AA891553
aattttatttcttctgctagagaacaggagctggacacacgctgcccaggcacagctaggtgctaacacacgcaggcaccaggccaactcacttaagtttcttcctcttcttcttcttcctcctcttcctcctcatcctcttcgtcctcctcagagctgaaggtgccatcaggcaagctgtagactcggatgacctgcttgttggggtccttgaggatgaggtatttgccctcctccagcttcatgcagatatcaatgacacagcgcaggatgccccaggcattctccacactcaggttgatttggctggcaaactcattgggcttaaactgctgggtgcccaggatgacgtggcgcgaggagtcctttacatggtaccgggacacatacccgagcttcaagtactcagagccagccagcaaagcacagcacgtccatcgcgccaacttgtagctgttgttcttcaactcagtggcgatgacagccccacgctgagagtccagcttctgacgccagtcaacgccattacaatgcctggagtcccattcattgagtgtcttgatgttgatgaaggacacttccccgttggccccagtcatgacgccatcatgttc

SEQ ID NO: 207 - DNA, 419 bp, Rattus norvegicus
  Genbank Accession No. AA891571
gaactcagtccatatttatttatttattgagttctaaaaaaatctgatggcatcagtaaaaatagcatgttcttaaaagtctactgatctcaatccaaaaaggtcagcatggtaactcttggatcaatcttcagcctcttttcctttgattctgactgcaaaagccccaaatttctctcctttccaagcaatagaacaggaacttaaagggttctcaggatacctgcttaacttgtgagttctagcaaccgatgcaagatcatcttctgaccatagcggacctgcaaggcttgctgctcccgccagctcagcttggcatagacctccttgttactgagtaaatcctgctcagtttttaagtctgtggcataggtctgtagggtcaacagaacactgtctcgaagaagccgtttccacga

SEQ ID NO: 208 - DNA, 410 bp, Rattus norvegicus
  Genbank Accession No. AA891578
aatacatgtcagaataataatgtgcaataaaatcattcatgtgtacatgccactaaaatagaaacaaaactgtccaggcgaatgaaagggaccagcaggagggtgaagggagagaaagaggaaagtaaatgtgtgtaaatagtgcacatggcatacatgtgtgtaaatagtgtaatgtgatgtacatgtgtgcaattatagtcacaggacatgatgtacttgtatgtaaatgccttcatgaaacccaccactatggatcatgcatatgtcatatgcaaataatgtgcagaaacggatgagagattgttattcaggcaggtgagtgtgctctagtctagtctgtcctccatgtctattactttcttatcgaagaaatccaggaagagcagtctctggatccgaaaagccat

SEQ ID NO: 209 - DNA, 381 bp, Rattus norvegicus
  Genbank Accession No. AA891666
aaacagaattgtccaggtttattcacaggcaggacgtcttcgggcctgctgctgtatatccctccacactcagtcaaggaaagacttctttggcctcctcagctgatatctcctgggagtagagatctgtgaagagagctggcagccagtagtgggcctcccctggtgcctgcagatccagccaggccagtccttccttcagcaggtgttccagcacttgccgtgctcgctccgtctcccatttaagactggctttgatttcactgacagtcacataaccgtttttctcggccagctgcagcacaacagtgtgatccatattgagctcagctggaacagactgaatgaggtaagttccctccacagggatgatgccaaatc

SEQ ID NO: 210 - DNA, 558 bp, Rattus norvegicus
  Genbank Accession No. AA891737
aaatggttcagaatcactgtgaggcttttagatgttcccattattcaaacaacccaaattaaaaacatacaactcacattttaagtaatataagcaaaataaaaattatctttaacaatgccttatattttgttttagtattctactatagacacataagaataattatttccattttctgcttccctcaaaactataaaatgctgttacatatttttgaaaaatcaaactccttcatatcctttcatcaattttatgttgaaaagagagttattttgaagcactggaattagtgttggaaaaataggtttagagtccaaagctggtgtgtttgcgaataagaacacaagctgacaagtgatttaaattccttagaaaccttcacagttctccatatgtacatgtggcagaaggatgaattgccagccaatatacatcagtgatcagttgcttacatttcaaagatcaaaacacttggtgggaagcctagaaggaaacacttaaagacatataattaagaactcttatctctgaaaagcaaagtccacattttagtta

SEQ ID NO: 211 - DNA, 599 bp, Rattus norvegicus
  Genbank Accession No. AA891739
gagcgtcccggaagttttattgggttctggttgggtcagggtccccccttcatcatctagcgagccgcgctcagcgcccgttactgggcgcgctcagctgccccatcatgtcggccagcatgcgattgcacagcgcggcgtacggattgagcagcaccaactggcgccgtgcgaacgagctgcccagtctcgccgcctgctcgaagtctctgcgggcatcgtcgtcccgaccctgaaatcgtgccagcagcccgcgctgcacgaagctctggcgggcggcgcgaccccggccgccgctcaacgtcaccgcgcgctccaagtcctctagggcgcctgctacatccccctggagccgcctcgcttgggcacggttgttgtacgcagaggctctctcaggtagcaggctaatggctttgccaaacctctccagggctgtgtggaggtccccagcttctgctgccctcactccctgcaactccagggccttggattgctccaactgtgcttgagggaaaactccatcttcatctccctcctctgtttcttccaggtccaatccaacaacatctccaaagggggtattagggttgaggatggcc

SEQ ID NO: 212 - DNA, 591 bp, Rattus norvegicus
  Genbank Accession No. AA891760
catgacagacaaggttgctctttattggttaaagtcccggctggcccgcagactcaacagtgcacacctgataggggttgagccagggaagctcgtccccactgggcagacaccaagggagatgacaggtgctgtggccaggtcaccacccaggagcagatgagccttttgtttgtttgttccctaaggacctaccaggccctacccacagtacttccaacaagcatccctcaggccctcactaaccccccaagtcatcatagcagagtaaagacacagaaaacagcactcagctaaaagaaaccaatgagccgtggggggtgggggatgtctcagcccatcacagacatctgtacctatctccctagagtcagacaccgcaggggtggaaggtgcatgcgacagggggtgggtagtggttcgcaaagcagatggtgaggccatgaacgtgcaggtggcccaaggtgatgctaggccaggtcctggcatcgagggccaaggctcccaaggatcctgactgggtaaggcacagagtttgggttttctcaggggcccagtcccagcctggccccgaagagcctctgcaagcgg

SEQ ID NO: 213 - DNA, 423 bp, Rattus norvegicus
  Genbank Accession No. AA891769
ctgtctctctgaacacgggggagacacatgggaccagaggggagacaagtgtgaccatggggagggctggactggacaacgggatggcacatgtgaggggaaagacaggcgtgatgacgtgtaaccatgaagacgagtgtgaatacagagaaggcaggtggaaaggggagtggatgggtgtgactgcggggaaggcaggtttgaccttggtcgggagagacggtggcttcccccttactttaagaagggaaagctgtgaggtatcaacaacccaggcacttgaagaaggaggaactcggaagagaagtcccttagctgctgtggactaagcagactcttccatctccaacaggtcatccacatactccacaacctctccctcatcgtcgtccatgaggtgttcctgagcgaagtcatacagtt

SEQ ID NO: 214 - DNA, 555 bp, Rattus norvegicus
  Genbank Accession No. AA891774
ccagggacctccgtagtcggtctccctatcccactcccaaacctcagagcaggaaatgggcttggctgagaagattcatgcttgatgaccaggggaggcgtgcagccccccaagaagaaggggaaaagaaaaacggggaggttgaaaagcagagaggtgcaccttcccttctgaggaagcaattctggtctgggaccagttgcaaggggttagtaagagaaacctaaggggtgcttacatttttattctggcaaatgaatctcttaaaaggctccctcctaggggtgcttacatttttattctggcaaatgaatctcttaaaaggctccctccttcgttcgggggaacagcacatgtacctgtgtcagcgtgagatgcaatgctacacaagaacgtggcattgggccaatcatgtggacccctgtgctgctcccaagggagaggttctgtttgggtgtgggataaatctaaacaagcatacactcgtgttatatgtggccttaagggtaggggagcaaaaggaatggacttctctgtagagcagctcaagaggga

SEQ ID NO: 215 - DNA, 620 bp, Rattus norvegicus
  Genbank Accession No. AA891812
  misc_feature (1)..(620): n = a or c or g or t
agacaaagaaactgcttaaagacttttatttgtgagtaagacctgttacgacgaggaaaggacacacaggacctgtcctccaagtctgtccatatatgcagcgatattccgtgtgtaatacaaagattagactacaaaagtgagaagtcattgcatatgtgggataaaggaagggccagaaggaagacgaggaggagtccagatgaggggactcaggaccaggtgagagctcaggccaccgtggtgactagtgggactagcagtacagcaggctgtggggtcctgcttggtgccccattgggagatcacagggttctgtccacatccgagcacccgctctatgaggcccaacccagcaggggcgtggagggccccagcaggctccctctcctagtcaggctggcagtggcagctcctggaacaaggccccttaggattccacctgacactcggcttccccactcactaaagcagtttcaagcccttttccagggataaaagttaggtaaaaattcataagggatgaccaagaaggtcatgggctccatgaatgatgcaagacattagatggcacctccaaagccagcttcaaccatgagttaccatccctatcaanacca

SEQ ID NO: 216 - DNA, 617 bp, Rattus norvegicus
  Genbank Accession No. AA891824
gctgggccacagagggcatggcacctaatccagagccactcggactgctacgggatgaaaagtttgtgcaacttcttgaagcagtgggaaacccgaaacatgcagtggaggctaagaagctcagggcgggcggctttccgcgcgggactcctcgccctatctgtgcagatgaatggttacatacatataatacagggggactgacttcccctcgccagaagagaacattgtacattcccttgctctttcttggttccaactgataatttcttaagagtgtaaattatagaatactcagctaaaatgtgtcttcataaatagttaacgaacctgccaaaacacaaaggggaaagtatttttcgttcaaaaaaaaaatgacatttgaatgtcacacaacacaagaaacaatgcttagagacatgttattgtttccagaagaaaatggcgagtaaactacttagctgaagacaaagaccacccttccccaggaccgtggtgcacaggaagcgaagtgtcaaacaacagtacctcaaagcaaaacaaaggtctgggtggagcccgctcacttgtaatcctgttaaagaatgagagccactgtttaggtccaatgtactggg

SEQ ID NO: 217 - DNA, 475 bp, Rattus norvegicus
  Genbank Accession No. AA891831
agaggaaaaaatgttatttttatttcaataagtggttcaaaacttaatggcatttctgtaggttagtaaatgtggctctaattgcctgtcatttgctagatgaagtatggatcaaccagaagggccgtgtcgctttagcatcacctccagcagtagcagcaaggtcattgtcctcatttaggagcttcaggtagacgccgcgacaaagactctcatactaatagtcatcagaatatggataattagggtgttcagcaactatgttcacaggaaaatacctgaagtttctgttcaggccatctaggacttccatatcctcggtaggcaactgaaattcaaatacctgaatgttctctttcaactccttctgttcataaggttgggtcagggcaacaatcccacgctgtacctggtagcgaagggcaaactgagctggacttcgattgcgttttttgggcatgccaccatgaactgg

SEQ ID NO: 218 - DNA, 537 bp, Rattus norvegicus
  Genbank Accession No. AA891838
aaagagtctctgctgtctacagggagcaccctgcagacaaaattttattctctatagaaacaaagtcactgcccagcacctcccttgtctttatccatagcagaaaaaccagccgctccctctagggggcgacagcagtcctgggggcgaccagtggagatgaagtacttgctggaaggccttggttctggttcccagagacagctgtcgtcctcctcctcctcagactccccctcagactcaggcacgctctcgggaagggcaacggccatctgctggaatctccctgactgggcatcccacatgtatttgatgggcactttgaattcggccatctcatacccaaacagcttcaggacaaggacctgctctggggtcagcacgtcaccctccttgcacacttcatagtcagacagcaggggcaccagacctttcttgagggcagtgggcagtcccagctgcctcagctgtggctccatggaatgagggaactgtttcagcggccctggatccaggctcacagttaaagttgctttg

SEQ ID NO: 219 - DNA, 591 bp, Rattus norvegicus
  Genbank Accession No. AA891842
aacaaacacctaatatttattaataaattagtatacttgaaggcatttttctgatatcagttcctcaccactaagcccacccacacaaaggcagtgggcgtctagctctgcattagagtctgacaactgagcatcagaggacaggttgataaatgagagagcgtagttgcaaatttatcggacaggagttcttacagctgcagccatttttaacgaaagtggttggatgacaaaggaaacccagcaaggccttgagggcagactggacctatagactatgtgtattgagagagagagagagagagagagagagagagagagagagagagagagaggaataaaaaaaataagagaaatatcttttaaagcaaagctgggcataaagtggctttccaaggtgcagcaaaggtgttcctaaaagatgaagatcgagttctttggcggcccaggtgtcaagccactgaaacagcaagtcctggggacttaaggatttcattctccagcccagagcttagcagcattaacgggagcacaagttacaagcagtgtacggtgtccagacgagaaccatacagcgagcgatagagagtg

SEQ ID NO: 220 - DNA, 576 bp, Rattus norvegicus
  Genbank Accession No. AA891914
aaagaacatcccattcaacactggctttattactgggcgggggcaacagatccttggcagtggttgggctgaaagctatgagggttggaaggcctggggctcagctttcaccaggcagagcgggcacactagcaagtgcagcaactaggcgtgtatatatgtcaactccacgtagaaacacagcctcgtgcagtcgttcgttatggtcatgtagtaacacgggtgtgcggttcatgggcgagaagcccagagctgggatccccaccgctcggatataacggctgtcagtggcagcaggaaagatctccggctccagagtgaggttcatttccttgcaggccccgctgaaagctgcccaccaggggtccgtatcatcagtgggtgtcattcgaggctctgtaaacttctgagcaaactcaaaggtgaccccctctcccgcttcctggcaccagctctgcagctgcttctcgaaggccttcatgtctacatctggcgccactcggaagtcaaaacaggcactcatggtaccaggtaccacattataggccacaccaccttcgggcttagtcagattca

SEQ ID NO: 221 - DNA, 550 bp, Rattus norvegicus
  Genbank Accession No. AA891943
gaaagaatgcactttttagtagatatgagtgtgagactcttgtctcgttattgctggtgtgcttctcggtctctggcagcagtgtaattatctgcgcatgcctgacctgcagtcaggcggtagaggggccaagcatctccgctccgggcagcagtactggttgtgcgtctttgactccacattagcgtgctccttcagtgttgccttcctcctgccttctgtttattccacgcatctcagcagaggaaacagcagcgctgctcctaaattcactctaagccactgacaggaagaatttgggctgtgctataaagtttccaatatgtctcgacattgttctccagctggtggtgatacttggggatacgatggcatctttactaatggggacaatgtatgcatgaattataaaccagagacgggagagatggccaagtggttaagagtgcttcttgcagcagatccaagttcaggtcccagggcccacatcaaaatcacctgtaattctagttgcaggggatcagataccctcttctggttccgtgtgtgc

SEQ ID NO: 222 - DNA, 605 bp, Rattus norvegicus
  Genbank Accession No. AA891944
cctataataactgtgatgatttattccatcatagagattaagatcacatgtatgttacatacaatacagaataatgtgtatgatgactatataatacccctgtacatatatttctgtatctgtacatacaaccagcaaagagaaaatctacatctgtgacctaagacacagaattcacaccctgcttctccagccaggctaacagtgagatcacagtcagtttcctgagtgctggggccaggttagagtccctgtaaccaacacatacaaccttagaagagctttaagaaaacacgcttgctttctcacagtcaacctactggagcgggatctgtgctataaacgtgacctcaagaattatttctgaatacccatgtacatcataaggatgggaaacaaagcctctgatttcattgcagacctttcctgtgagtccatggaaccacgttaacaaaagaacgagcaggcagaaggggagtcttagcagaacttggttcacccccaatcccactgccgtgagacttctcagttcaacctatccttacccacaccatataaagtaaacccaccttttacatttaagtgatgctttttcataaagtacc

SEQ ID NO: 223 - DNA, 569 bp, Rattus norvegicus
  Genbank Accession No. AA891949
aagcagaaaaacgtttatttctatcaaattccatacaaatcaatcttcaagcaagataacaaaacaatcaattaatacaatgaatagttaggacagcacatacagaacagactctggattaagcacatacgccaaaatcatcttgaacaccaactgtcactgaaggaaagctgatgtgtcagctcccgggggacttaagccaacattgcattaaagactgccttgaacttggggggatcacagtgaaacgccatcacagctcaacatagtcccccagacatccgttcagctcagaaaacaaaattggcaaattcagtagtacaagttctcataaaactagagaagccttgagccccaccatttcttgcagttcacacaaagcccgggtttcccatttttcttcccttttcccgaatcccagagagaaggtgcagtactcttttcaaaggttttaaacaagagtcttttattgaaagatgttgtgcttcctacaattgtctgtcactagagggagtccatgtggagccgtgggcaatggcttactcacttaacctgtctctcacacccaa

SEQ ID NO: 224 - DNA, 216 bp, Rattus norvegicus
  Genbank Accession No. AA891965
agagatccagtttgacgttttattaggtccagccctctgctacctgagcagtttcctcatcatccccagggatgggcttctatactcccgcccaaagtggttccaatggtttaggtagttaaagagctggtagagcagcaggcgtttgtcgaaccctggagcctttgggatcttctgatggtaggcagtgaagaatgatctggggaaccccccaag

SEQ ID NO: 225 - DNA, 482 bp, Rattus norvegicus
  Genbank Accession No. AA892053
  misc_feature (1)..(482): n = a or c or g or t
gaaaggcctgaacacaaaggcaagctgggacagcagaaagaaggcaggacattcctcagactgctctgattcctagagtaccaggggaggaggaaaaggaaatccagagtgattgccctggcttgccccagactcggggttccatcctaggccaagcaaggcctcagcgggctgcttgctccgcacgcttgggcctcaggcctccaggagcttccctaggaagcggaggtttagaatcttgatctgctggtcttccaggtccattcggatgatgccatcctcaccatcaatactcagaaggaccccggtagcctctcggtcctcacccagaatcactttcaccttgttgttcttggtgggggtgatgggctccagatgctcactggagatactgnacaacttctcactatctttcaggtacacggagcacatgcctcccgtgacactgcggatgacgcctgtctgccccactatttgtgtgt

SEQ ID NO: 226 - DNA, 495 bp, Rattus norvegicus
  Genbank Accession No. AA892066
tgtcaagttacaatagttaggaatgtgaaaatacatcacccattaatgctaccacaatgaaacacacaaacacggaacagacacagctacagaggtgagacgggtgccacacccacaggtgcctaggctaggtccctttgcctgttacctttgagacccatccaggcagaccatctttccttcctcccaccctcacagggattcccctcagcttttccttcaccacacctcctgggctggccccctgaaagggaaggcccccgacacctgctggggccctccagtccctctgtcccttaccagggacagagctatatgccacatcttcaatctgaaacagttggctgtgggcaagcagggttagtgtgcaggaagatgagtctccccagcactggtttgtgaagtgagggcagcatgcacctacttcataaacgttgatgagcttctacatggtgtggtctgtttcagagctgggaggggggggggtgccggttt

SEQ ID NO: 227 - DNA, 433 bp, Rattus norvegicus
  Genbank Accession No. AA892112
cagggctaaggacctttattgagcacacggcccctgatggtgctgacggagaaaccttaggctttccttcccagcagcctccgccacagttcttggctgagtagtgcctgctccctccgggcgccctgcagcacactcctgttctcctgggctcttcggatcaggtaggatatcacctcttccaggcagccataggggatagacttatataccatgtatccagcttgccctaatgccagggagacgtggtcacacatgcccagaagttgtccgaagcagacaggcccatccagaggaatgcccagctcccacatgctgcagaaagggtcacattgtcaatccagagagtggctacagcgcctcgttgcctggcgaatggattcttcattgtgggaagccacatgaggtggcaccggggaccgtggttggacac

SEQ ID NO: 228 - DNA, 443 bp, Rattus norvegicus
  Genbank Accession No. AA892128
  misc_feature (1)..(443): n = a or c or g or t
agacataattaatgttacagtaaaaataggcatttactcatatttgtcttgttttagccactttaatttctttcatctcccctccccctaaggttttctcaaagcacattatcattttacaaatacagtgccaaggtcctgagtccactttgcaagaatcttcttcacattcacggaaagcagttacttagtgcagagttctcatttccacttaactgtacacggctttatcggtgctgagacactggcccacctgctggccagtgtctcccacttcacacacctaaaccaagctcaagacaggaaggctgagccgtgaagagcatcnccacancctctccactggcccgatagctctttcccgcccctcccagttgtcctgagaaaaatcagatttgtcacagaaaactgacattcctacattcataggcagaagaatttta

SEQ ID NO: 229 - DNA, 386 bp, Rattus norvegicus
  Genbank Accession No. AA892154
gaggtataaaaatctgtatttatattacaatgacataatgacacagcacagccccatctgttagacaggtgggatggggtcccattccagtctgcagctcaggtctcataactcacccactgcactggcaccaggccccttgtgtagccccagactctggcacggaacctgccctagaacagcaagctcaaccacctgcaggttagaaatacagaggcagacctagggcccatatggagacaaaacctccgtgtcctctcctgctagacaagctgggtctgcagcaggatggtgggtctggtacatctggaccacctcctacgaaagaggcccaagcctgagcctggagttgcagactctgttatggagcacacgtggctcacatg

SEQ ID NO: 230 - DNA, 368 bp, Rattus norvegicus
  Genbank Accession No. AA892173
gacagtcaaaaaggattttatttaaaccccgactctcccaaagtgactgtgtgtgcagggctgtttccagaagtaggtacattgaggctttaagagaggggaaagacattgctaaaatcacccatgtgaggcaccaacatataagcaacaaaacaaagtcccagagagagggtttgggtaggtgagagttgctagcacacatactgaaaataagcagttttcagaagaaaaagtgtgagatgaactaagaagtaggcaactgtaaccctcaaactagaaacaaacaaacctgggcaacaagccaactgagaagtctggacaccagacttacaaagtagtccttatacatgtgttcccagagctaaagc

SEQ ID NO: 231 - DNA, 662 bp, Rattus norvegicus
  Genbank Accession No. AA892238
ggccgccaaacattttttttttttttttttttttttttttttttcaaggaaggtaaggtttattattttggctcacggttccagaggatgcaatctataatggctgaggaggcagcagtggaagtatgggacagaggtaattcatacatcctgactggataagaccagcaggagtatataatcctcacccatcgatatccttaaggtttcacagccttcaaaatagagccttaagttgaaagaccaacagctcaaaacaagcctccaggtacatttcagattcaagcctcaacacacaccttaatatatttcaacgaagctacacattcacaatttaaatacagtttttcatcagggagacagatataattcataagagtgtttagactacaaatcagatacaatttagtcaaaataccataaagagtactttaagtaatcaggaaagagattttaacattattgcttactcttatgaattttaaccaaattgataattctataatcttagtttattttctatagacttaaattatactgcttgccaggtaatgcaagtattgatgcaactttctgaaattaattgaactgcaaacaaattataaacttagccagcacacacattttgactctactgcttcagaagtagtactataaaaagt

SEQ ID NO: 232 - DNA, 433 bp, Rattus norvegicus
  Genbank Accession No. AA892268
gaataccagcatataaaacgagtcctttaatttttcaagtgttttaaaaaacaaatttatacttaagccagccttgaagataagcataaaaattaccaatttaaaccaaaaaccaaaccaaaagaccccaaacccacaacatcggaagcactggctctgtgcacagctccacccaggcgtgcatgggggaacacagcagtagagaggggtcactgtctggaactgcgtcatctccttaccgggagagcgaaaaataaataggatcaccactgccttctacgcatctgcccagccttcttccagctcacaggaaagctgagaggcgatgagctgggagctgcttccctcaaacacgagcaaggccacagtcactcaacgagcattcccatgcagggtgtatgcattttcacttttaccttttaatttcttttac

SEQ ID NO: 233 - DNA, 665 bp, Rattus norvegicus
  Genbank Accession No. AA892271
agagtagataaaagtacttttattataaacttcaggatctaagaagtaatgttacatgactaagataaatctgagatgacttcttatcaagcatgtgtgccttgcagggtggcactgtgccctccggcaagagaaagacagtcccaccttccttgagggatggggtcagccaggtgatacgcgactgccgagtcccactagctacagtgagtgcctgggtccctctgcgtctgtggccctggtgctgcgctgaactcaggccaagaagtctcttcaatgctaaagattaaaccagaacctcagcatcagtcttggtcttaaatttaagtgatacctaataataaatgataaagctttatcatttatttcagtgatttacactgagtaaggattatgacccaattggttctgtaagccaaaggatgacagattcctacatgcagagacccacagagaagctgatgacagtccaacacccaagaacactactccagggttctagatggcatgtatgccatcagaggtgtcccttatcagacttatcagaagcacgtgggatggctggctatacctgtaagagctcaaatagacctcgccgggtcacgctgaccaccttcctgcttctaagaccaatgactgcagcctgtactctgccctggcaatca

SEQ ID NO: 234 - DNA, 665 bp, Rattus norvegicus
  Genbank Accession No. AA892299
ttgcggccgaaaaacttttttttttatttttttttttttttttttaaaggcaaaaaagttaactttattgactgttgatcttaccatgaaacacctataagaaataattacaaaataacaccgcttttcttttcttttttttaacatactttcagttatcatcccgacatgacgatcctttcacagaaaggactgtttgcagcttactgagatacaaagctcaaatgcagatgcagaagaggcagggaggcacatcccccagcaacgggcgtgctagcgagcgagcgtgagcgacagctttctacttccctctttttgtttttgatgacgatttcccaatacaaaaatgtcaggtcttcagagtggatctccacctatgtctgtgtgactctaccgtgggtcagaaactagaaactgttccctggctgtctttgtctttgaaaatctgtaagactgttcctgccggcctggaggagggcagctgaggagtggcagcctgggcagagccctgaagcctgggttctggagcagagaggaaaaggtacaacctattcgattaagcaacttcaccactttgcatctgcaagagacgctgagggctgcggggcgcacagctccacaatcagagcttgggagggcacgccccttaacagggtctgggccct

SEQ ID NO: 235 - DNA, 534 bp, Rattus norvegicus
  Genbank Accession No. AA892305
gactgctcacagcactgtttatatctctaagcctaaccacgtccagacccttcagtgcctgcaggaatgaaaaactacttggcttcccagggctcgcagtgttttcagtccagtcctatcagtctgggaacaggctcctcatagttccagtgacgatgggcatcctgcctcatctgtaggcagctgtgatacaggacctggctggctccacctccagagtgcagctctgaacagcacacattagtgctggttgcaacagggcacgggattgggctgtattatcctcgagcttctcaacacttactgggcatttaccctataaccctgtgggaaccctggcaaaggtgggccaaaggggcttcaggtccgtggggcacccttgtctcttcgctcttgagcaagctcttgctgttcttgctggtctagctcttggagctgtcgttccacatcttcaggtacctgcacctccagcaggttttccatggcaacctctggatcatccccaataagcacctggataagcttctcacaagc

SEQ ID NO: 236 - DNA, 662 bp, Rattus norvegicus
  Genbank Accession No. AA892367
gatgagaccccaccagctgcacaaagtactcctggcatcaggcaccttcctccttggcaatgcgatctttcttgagcggtcccatgaatgctttcttttcctccatggtctggaagcgaccatgtccgaatttggaggtggtgtcaatgaacttcaggtcaatcttctcaagagcccgacgcttggtctggaccagcaaggacttccggagagtaagcactcgcttcttggttcccaccacacagcctttgagcatgatgaagtcattggtcacctcaccataatggacaaagccacccagtgggttgatgctcttgtcagacaggtcgtagtcagtagatgcattgttcttgatcagcttaccatccttgatgaggtagccttgaccaatcttgtaaatcttcttgttgatctctgttcggtgatggtagcctttctgcccagctcgagccacagagaaggctacacgggcaggatgccaagctccaatacaagcaactttgcgcagacctctgtgggtctttcggggcagcttctttgtatgccaacgactggtcacccctttgtagcctttgccctttgtcacgccgatgacgtcaatcatctcatcttggccaaacacctggttcacagggacctgctgctccagcctctctcgggcc

SEQ ID NO: 237 - DNA, 589 bp, Rattus norvegicus
  Genbank Accession No. AA892378
gcgaagccacggcccaactttatttacactcattgcaaagcatgactgagggtaaaggacaggtaccaggggatggggggctgggggtcatggagactgtgcgggtgcacggtagggttgcaggagaaaaggaaggcggtggtgaggatggacagcccctctttcagtgtcccccaggctcccaggcgtccgggggcacagagcaggtgaggctgccttcaggatttggacttggacacagccagtccaatgagtccagccaggcccgccacacccagggccatgccaccaacaatggccatgcctaccagtccatctttcttcatggccttgtcaatcaggcgttccagctccttggcctggctgttctggggctcagtctgtaacagtccccgcacatacttcagagccttttcatattccttgagccggtagttgcccacggccaggtacaagacataatcccgctgctcctctttgctacctttgggcagcagctcctccagcatcacgatgcctctacggatgtcgtcattgtatttgcttcgaaccaggcaccaggcgtattcaaactgcgtgctcttggaca

SEQ ID NO: 238 - DNA, 650 bp, Rattus norvegicus
  Genbank Accession No. AA892382
gcagcaacaagcttttgttgttaatcacactgacatgacagggttcactggttcctgtagcagagtgcagggaagtgtgcttgctccacaggaactcaaggtcacagcctcccttcctaggcagaagggaaggagtaatttagttgaacaaaacgaatacccactaacctccagagcatactcgggaagtattggcctgtcttctggaaacccatgcccaggtagagggtcacagcacctatctgcatggtgctagtctcaaggacaacatcagtgtagccctggtcccgtgcaaactggagcacagttctgaccagtgctttcgctatcccctgtcctcgatgctgtgaggacacagccaggtggaagagctgcaactgcttcctccctgatggaggctccttgactggcagagcacccactgtgcccactacctgctccccagactcagccacccagaaacctgagccacgatcactcagataagacttggtgatgtcagccatatctgtgtgtaaacatttggacacataattcttccagggctgtccagcaaggaaccacaaaaatgggagcagaaaaaagatgcatacaacagccagcagccaggagccagacaccaggaccagggcaagggacaccccaagtaa

SEQ ID NO: 239 - DNA, 591 bp, Rattus norvegicus
  Genbank Accession No. AA892395
  misc_feature (1)..(591): n = a or c or g or t
gcggctgtgcctcttctctaaccaacccccggtaagtatgtttgttaaaatgcccttctccatccttcccttccgagctgctttgctcagtagtggctgtatgcatggaagactgaccttccatgtaaagcccgttcttctcttggatggatgttctggaacacggggaactggaggtgttcggagactactgggtgacgtgctcatactcgcacttcaacagctgattctgcttttctcctgtgtttatgattcgcatatgtggtgttttcaaaagttcaatcaaatgtgatctaatttccagggctgactgaagcctttcaggtctccaaccaaaatatttaggacaactggagcctggctggtaggtgacggtatctagtaggtgtaggaggctttgaagagtgactgcgtacaatcagcgcctgacgagcccgtgtgaacatactgtccttgggctgcctggcagttggccacagcccgcttcatgaaagcttcctgngttgccttcttgtttgcagccttgccgccccaagcagccaatgcactggcctggagggctctgccgtatgaaaagcttagcctcgtgcc

SEQ ID NO: 240 - DNA, 448 bp, Rattus norvegicus
  Genbank Accession No. AA892414
caataacatctacaaaaaatagttttctctaacaattaggaaacaaatgtgaaaggcaggatggttcacattatagactcaggtagagacttgtacttcatatagatgagaaataccaggtctacaatttgtttaattgactttggattttattacaaaagaaaatacgattgcaattataaatgtcataaaaattgtaactgtattgagaagttacaccaaagtatcaaatattatataaatggacaataaatttaaattttaatttaagcttaacatagtaaacactggaagacaccttacccctacaatgccaaatatcttaaaggaatacaagaaaagctacagtacagaaacaatgaatgtgcaaaaaatatgattagagaccacagagctggggtttacactctaactacatacagttaaaaatttaaaataatctttacat

SEQ ID NO: 241 - DNA, 513 bp, Rattus norvegicus
  Genbank Accession No. AA892446
  misc_feature (1)..(513): n = a or c or g or t
gaaggtgaaagaatgcactttttagtagatatgagtgtgagactcttgtctcgttattgctggtgtgcttctcggtctctggcagcagtgtaattatctgcgcatgcctgacctacagtcaggcggtagaggggccaagcatctccgctccgggcagcagtactggttgtgcgtctttgactccacattagcgtgctccttcagtgttgccttcctcctgccttctgtttattccacgcatctcagcagaggaaacagcagcgctgctcctaaattcactctaagccactgacaggaagaatttgggctgtgctataaagtttccaatacaatgtatgcatgaattataaaccagagacgggagagatggccaagtggttaagagtgcttcttgcagcagatccaagttcaggtcncagggcccacatcagaatcacctgtaattctagttgcaggggatcagnatacctcttctggttccgtgtgtgcaggaatgtgggcaaagtcctcgtg

SEQ ID NO: 242 - DNA, 395 bp, Rattus norvegicus
  Genbank Accession No. AA892462
tgcctgacattagactctcccgacatgcaagtgttgggagctcaaaggattcttgagctgggaaatcctcaagggagatgacgtatagggagccaggcgtccaaggcgtacgaacaaggtttaatgctgcacccgtcaaggcaggagctccccagatcgatgcagacttcttcctccgtgtcctccacaggactaagctgtttctgaggcctcagcgcatgctaccatcgaggcctgtggtgggggagggggctgcctaatcgtccttcttaaacttgccattgatgtacggcacccagtccaggatcagccgccagtccgtgacccacaccagtcccacggcacccacagtgccccacatgccggatgtggggatccagtttttgggcagttct

SEQ ID NO: 243 - DNA, 474 bp, Rattus norvegicus
  Genbank Accession No. AA892468
gggctcctcaagatccaaaccagttgaaccagtttctaggacagcagcctagaggtggttactcattcctgggatcccctccccccaggtccaaagctcccttttgttctcatcccgtgaaggtgaaacctggcctgggcccagaggggcagccaggtgtaagcagacttggcccagaggtcctgctgacctctcattcctctttcctcccacagtggactctgtctgcctcaagtgggcacccccgaagcacaaacaagtcaagctctccaagaagtgaatggcctgtgcccttctttggatctgtgtttcctggcctctaacctgtaaatatgtgtacagacctgttttgtgtcatttattaataaagcaaattctgctggtgtgctggacttcggaggcaggaagaagtgctgaagggtgatattcttcatttcatttcacatccagccagttgtgttaaaaacatttcct

SEQ ID NO: 244 - DNA, 470 bp, Rattus norvegicus
  Genbank Accession No. AA892470
aaaacacaagggagagacctggccagtcaacacatgactgaccacagggaaaggagtttatcaaacttcgagagtctaaaaacatacaaatgtgtcttctgtctacagcaattgtctatgctttcccacacaccgactggtaccctctgcccagtcacacacagtgaggacagcaggtcagtgactcacgtcctaagcagttttctgctgccccttctttccgatcagagacttgtggatgtgcggaatcacaccgcccccggctatggtagccttgatcagtgaatccaactcttcgtcacctcggattgcaagctgtaagtgacgtggggtgatgcgctttactttgagatctttagaagcattacctgccaactccaacacctcagctgtgaggtactccagaattgcagcactgtacacagcagcagtggcgcccacccgtccatggcttgtggtgcgagtcttca

SEQ ID NO: 245 - DNA, 568 bp, Rattus norvegicus
  Genbank Accession No. AA892483
gacagaagttacttggattttattttatcttaatactgaaagtaaaattagcataaactacagtccaccataagctatctctctctatatatatatcaagctatagatgcatcatatttggggttgtccaaaatagtttttcctaaaagtgtgattaatcataaaaatttttaaatgaattaaaggtattaaaatataatatttgattaatactaaaaatgagaaaaatactcaattactaattttttaaccaagaataagcacttgctagtcaacctaaagagaagatcacatttatgtggaaaagaaaccagtctgtctgcggagaaacaccaccacgtggctggaacctacaggagctggccctcgccaccatacccaggagtctgggtaacaacaggcaggacacccagttcacaagagcaacacagaacaaaaagagcacccggaagtgaggtgaacagggccagctatgcctggactgagagctgaggcatctgacaagaccaggagtcacagactcactgacgtggtcagcgaccaggaggtaaacaggaagcagggtggt

SEQ ID NO: 246 - DNA, 555 bp, Rattus norvegicus
  Genbank Accession No. AA892486
aaaattaagtacacttcacagtaagtttctcaagtctcagtggctgtgcagcctgatgttggtgcagacacgacgtccccacgccgagctccacattctctagtgggaggcgagggacagacagctggggtagggcaggcgaggcaagcctcactctcctcctaaccacacagagcttcaggggcgcatgcagcaacacaatgggaaagctcaaaggtgtgtcaggagagcaggacgcaggtcctcacaggagccaccagccagagcgagctcaaactcgcatggcctctaggggggcctctgtaaagtctcctaggaccaatcgatttgaaaccgctctcccatcagcagtgagacagggatggacaggctcttgtcgtccgggctgtaggtgaaattggagacagagatgccattggaaaggacctgggtgggagctgtggtcactcccaagatggtcacctccctcagttgcagttcacctccctccttggtcacgtgcactaacttgtttacaatggtattattcttggctgagaaggtgaccagtgtgta

SEQ ID NO: 247 - DNA, 541 bp, Rattus norvegicus
  Genbank Accession No. AA892507
cacagtaactcatgaggtggataacagagggagggagctgccctggatgacctgcagccttccctccaaaggaaccttctgacaccactccaaagaatcaaggaaaggttcctgtggtgtgtctgctctctgctgagctgcactgacactctggcctttgtcagcagggtggggtgacttcagtccatagtcatcctcctgcttgtctttatggtcgagtttattcttttctgtcgtagcctttctcggttcatcttctcaatcctgagtctctgaagctgagcatcttctttggatggctccttgggcacctggctggccttggcaatcatgtctcgaattttctgtaggcattctgccagattgcggaactggtatcggctgctctcggaggtaagtaccagctctcctgccttgttgatcgtgagggcaatcttctggcgtacaggctccgcaatccagtctgcactggccaagtgaaaccttacttcggccttggaattcactttgttaacgttctgccctccaggaccgctgctcc

SEQ ID NO: 248 - DNA, 547 bp, Rattus norvegicus
  Genbank Accession No. AA892520
gacacagacacaaaggcagctgtggtaatggggtgggggacacaaaagcaaaaatcacacttcctacatggaggcctcaattagacaagagagaggctgggtccctcccctcacactccttctgacagtggctggagtaacagctctctctaatccaagctcagaagcagcaggtgacccccacctagcctcaaaggtccccactttggctccagaagcccctgtccttttaaccagcccagtaattcccctacccgagctccttctcccccaccagtgtaaacagagtttggggctgaacaacagagctctgggaaggcaggagcctcctagatagcaaagggaatgtgcttggagtttcacttcggtcccagaatgagacccagcagtgtctcccagaactcgggctgatccagtatactgcctcttcattctccaccactgacagagataggccaggccccagaccacagtaaaaacaattgatccccagaggttagagctactccctacccccgacccctggcacatacacagatttttggca

SEQ ID NO: 249 - DNA, 560 bp, Rattus norvegicus
  Genbank Accession No. AA892522
aaatgaaacaaggtttatgccacacagtccaacaatgtataaagagcttgaagtagaaaagcttgtggaaaatgtatactctttacatggtacatacagttttatagctcataaataaacacagagaacaggagccattgttcacattaccgaccagcaacacagagcagcagtaacaacacaaacacaatttccttcgactcagccacaaaaacttgaaatggtctcaccatacttgaggaaaatgacaggtggtgaagtgttacagccacacccacatcaccaagtgctttaagttgtctctgggttagaaatatcaacaaccgtattaactccagagagaagaaggcagggtaagaccctgtcctataaggcacttaataaattgacactacccttgtcttaaaatactgcaaatttgccttgaaatatgctgatgttttacggcgaaatttaggtttcttttatccaggtttagacatagacataatttgaataaattgataatactgtctgatggccactctttacaccagcttcaaaatggacccatttaaact

SEQ ID NO: 250 - DNA, 572 bp, Rattus norvegicus
  Genbank Accession No. AA892532
aatggaaaaagccattaatattcaaacaaaggaatcacattttaaaaaccctatacatacgaaacagcttccaagaacattcaagcagcagtcaggagggaaaaatgtttcaatagcccaattttcttcaaaatatgccagagaatacaatccaattcactgctacaattcatagaattcttcagtgttttcttgagacgctgaggttcactgttggcagtttccagtggccggcgagtactgctcggaaaggccagcgcagacagctgaccggaagaacttcctgctggaaaactgctcattcccaaggaaagacatttgaaggccgggctgtggccctcacaactcgtccttctctaggtcatcgagctccacatcactgaggtcaatgtcgtcctccacaggaagctcgccatccttgccatcccagggctccctgggagtgatgttagggaaggaaccaccccctacgggtgctgtggagccacgcccgaaagacagttccctgagaaactcattgatgccttgttcactgaaagagcctttgagaagagcaaacttcatcttgcggg

SEQ ID NO: 251 - DNA, 605 bp, Rattus norvegicus
  Genbank Accession No. AA892545
aagaagaagaggttcttaagtttattgcttgactgggccaggtcgttgggttttgtggtcaccgggctttgtctcccttctgggacaatggtttcttccagaggaccaataggacaagcaagttcaccatgagttgcacatggcccaagatggagacaccatagctccggtacagcaggccacccagggtgggtcctacagtacgggtcaatggatgcacagatgcacagaggcccaacatggtccctgtgtctgaagcagatacagccttggtcagcatgctgtctgtgactatgttgagagcacagagactgaatacgagtccaggcaacaaaaggcagaagtggaacacattggacatcagtgccatgcccaggcccacaacagcaaagactagtacactggatctcagcagggcttcctctggaaaacgggtgcttagtctcccaataaccaggccttggatcatcatctggaggatcccaaagaaggacatgaggtagccagcctgtgcagcctccagctggaagaagtccatggagatgatggagaacatcaccatgaagagtcctgaagggaagccagagattaccttgaccaggaat

SEQ ID NO: 252 - DNA, 549 bp, Rattus norvegicus
  Genbank Accession No. AA892554
caacgtttgcagctgtgtggctttgcagcacagcaattcataaaccacactgtacagaatcaccagcaagactggaatgatgttatagaaggcaccatcatgcttattacattaccagagaacaaaatacaggaaagacagtttctactgtacacagtttaaagaaaggaaaggggaggagtgtgttgagcagccatccatccctgtactcaagagggcaggtagaaaactgacaaaacggagctactaaacctggtctagtatttaagaccacagcttttgaagttctcgtttttgttatttcgttcatagctaaaggacttccttctggaatatttgcagtcttgttaaggtttgtgtgcacacgctggtcacagcaagcagatagaatgccctcatcatttcacaaactattctctactggaaaagaagatcaactttttatttccctgttgcctcctggtgcagatttcaatgttaatgacttcagagtacccgacagtgcattctgatgaatacgtaacaagtttccgtttgtgttgggggttg

SEQ ID NO: 253 - DNA, 465 bp, Rattus norvegicus
  Genbank Accession No. AA892561
aagatttacttgtttattttttatatgtatattcatacactgttgctgtcttcagacaacccaatagagggcatcagatcccattacagatggttgggagccatcttgtggttgctgggaattgaactcaggacctctggaagagtagtcagtctcttaaccgctgagccatgtcttcagccttttacgggaaaggtaaatggctcctttgttaaatctgggcagtcgaccacagagacctggacatgagcaaagttgtcctttagccccttctgcaaaacttctgcgagctcctccagacttggcacgtggaaagaaaactcagtgcaagccattctctctcctctcagcaactcagacacagcagctgttggctgacctccaccagagttcacagggcaccagcgtgaacagtccctgctcttgtcacccactgaataaggtgtttgtaatcttccgttagaa

SEQ ID NO: 254 - DNA, 539 bp, Rattus norvegicus
  Genbank Accession No. AA892562
aacaaacttttcttaaaaaaatggagggcaggccagggccgtctgcggtgtcgctcaacatggcctccggcgaatcgccgcgggcggtcgtcgggggctcaagtgagtggaggggtcagtggtggagaccccgttcctacgcctcgcgtccttaaaacaggacgggatggtcgccgcgtgggggtcgggggtagtcgctaaccactgagctcctctgccgcccttgccttcttcttctttttcttccttgtggcgtcgccgtccccgtcctccgcagcctcctccccgccgtccgccttctcctttttcttcttcttctccttcttcacccggggcgtggtagtgggcgtcgcctcgtcggcgtcgctgtcgctatcgcgtttccttttcacgatgctggcggcgtccgcggtgaccccagggcccggcgtggcttcggcggccgtcgctttcttgctggagtcactgtagtccacgtagtcgcgcgtccaggaggcgggggtgccgtccgtgggtcggccatgtttgtccaggaggcc

SEQ ID NO: 255 - DNA, 443 bp, Rattus norvegicus
  Genbank Accession No. AA892572
acactttaaaaaagatttaatgataaatacatattggtagaaatggttaaattcttgaatgaagaaacatctgaggactttctgcatcatggctcccagcccttccctccaggctgatggggcaactggaggcccaccaaaccagcagactcctccactgagcgctcacccttgccatgaaattcctgatgaagggctacatgttgccggatactacgcaagaggcagagataggtggcagcttggaagtgaagctcgtgttgggctctgcacaacttctcactggtgacccgatgtgctcggaaagccttaaccaggtaccggtaggctgctgtgtcgcggtatggtcgcccggtggccgcgttcaggtagcgcagctcccgcagaaggcctcgcagagtgcgcgccggcgaaccccaagccgccattttcctgtccttggc

SEQ ID NO: 256 - DNA, 424 bp, Rattus norvegicus
  Genbank Accession No. AA892578
gaatgctaaggaaagttttaattgtgcatatgtattacataatatttcgggtacaaatggcaggccatcaacgtcgccatcgaaacatgtgggatgggaatatttttcttaaagtttggaaaagatgctacaaggggtccataaatctgccttcttatgcatctacgtgggaattcacatgtgctatgatgtgggcttgttttatcagtcttctgtattcatctaacaagtcggccttgaactccctatgtagacaaggatggtcttgaactcctcattctactgccttcacccccgagtgctagaattacagacaccatgtccagccactcatgcaaacaaaaatatgtagattggataatttccttccccttcagtcaatgctgctggagttgtgggggggccgggggaagaacacccgatg

SEQ ID NO: 257 - DNA, 512 bp, Rattus norvegicus
  Genbank Accession No. AA892582
  misc_feature (1)..(512): n = a or c or g or t
attagccaaagcacatactttattagctcctgaactctagttctccttctcctgtacagttttggttccacgtagccgtccagtccggcgagcagcaatgagacccactttgcgcccagctggggcatctcttcggatagtggaaggcttgccaatgtgctggtggttaccaccgccaaagggatgctccacaggattcatggcaacaccccgcacacgtggccagcagttcctctttgccttgtacttatggtaggcacggccagcctttaagataggcttgtcaattctgcccccgccagccacgacaccaacaacagctcggttagcagaggaaatgaccttcttggaccctgaaggcagcttcactcgggtcttcttggtctctgggttgtgggagatgactgtagcatagttcccggaggctcgtgccagcttgcccctgtcnccaggcttctcctccagacaacacacgatagtaccctcaggcatggtgcccacgggcaaaacat

SEQ ID NO: 258 - DNA, 658 bp, Rattus norvegicus
  Genbank Accession No. AA892598
acaaacactttttattttgtttttaatttagaacatgatacatattcacaagatttacactttatatcataccaaagcaatctagaaacactgtacagagcacacttgaacatttagaaggctatatataatctgtggtaaagtcataggcatcgtcttcttcactcattttatccaagataaaggatctgtcagatggtttacttgctgttgattgcccaggtgacatctccctggtctcttctacaggagtcacatctgagatctctgcatttttttcaccagtaacatgttcttgatcatcaccatcctgttggtcttctgtctgttttggtgactcttcggggatgtccttttcttctagtattccatttgtcaggcccgaagaccggaaaaggattttattagttaaatgagggcccttgaggacttgtatgctgtgtgcattattcttttctagttcttctagattaaagcccctcttcatgattgctgtaatattctcattaaaatgaggagaatgattccaggatgcagggggatggcagtagtaacctaatgaggcacctgtccactcagaccatagcagcttagcagcactttcgacatttgggcttccacctttttggtgcagacctcttctctgagcaagtttagt

SEQ ID NO: 259 - DNA, 421 bp, Rattus norvegicus
  Genbank Accession No. AA892647
catgctcgcccttttaataggaaaaggtgggctggccctgtaaaagggcctttggttttgtgagatcagacgacagacgagagtcccttaaccgccaaagccgtagagggtgcggccctgccgtttgagcgcgtagaccacatccatggcagtgacggtcttgcgcttggcgtgctccgtgtaggtgaccgcgtcgcggatcacgttctccaggaacaccttcagcacaccgcgggtctcctcgtagatgagaccggagatgcgcttcactcctccgcgccgggccaggcggcggatggcgggcttagtgatgccctggatgttgtcgcgcagaactttgcgatgacgcttagcgccgcctttgcccaggcccttaccgcctttaccacgtccagacatctctacaaagctggagagcagc

SEQ ID NO: 260 - DNA, 487 bp, Rattus norvegicus
  Genbank Accession No. AA892666
aaggtttgtttttaaccgttgtggatgtgtacgtgtggaggtgtccccggaggctagaagagggtgcttgctcccctcgagcctggcatgggtggactctggtcctctgctcttcactgctcagccatctctgcagctccggagaagaaggctctgacaggacagggcccaaaaccctgcttgtccttcagtggccctaggaatgcttaggcagactgaggtaggggcacagaaggggaacctgaattctcatagctcaagacctggttaaaacttctgcgggggtagtctgaggtaaaagagaaggcaggaaaacagttctgtcaaggaaaggaaggcttgaagaaaacagacacaatggagccaggacggagaggtggagcctatgaagtcaggagagtccagaggaccacttctctaccaggagcagaccttagtgatgacagagaacagagctggtcgttagacacagcctacagccagctct

SEQ ID NO: 261 - DNA, 606 bp, Rattus norvegicus
  Genbank Accession No. AA892773
aatgaccagcaaacaatttattggttaaattatcaatcgtggagttccttgataacattatataacaaatggattaattcaccagaaactggcttgaagatactgattttaattactttaacaaaatttggtttgtgtagcaagctcctactgtcactgctagacagtgaatgcagcggctatccaaagccagtcattccttgaccacgggggtctctcagagcacaggtgaataccagttacggttgtgtttgctgacctagcacctagttccagccttaggactcagaagcagctggacagaagatatggggggaggggagatgctggaaacgaacagctaactcgacttcgggccggtgttagatctgaggcaactcgcaggctctgagaccaaagaggaacacagctttggatgtggctgtgaagaaggcaggccccgggaccgaattggtgggtccagaatacagtgccaggtgggcatcaggaactacggggcttcttcttggcttccaggtcctttttaatctcctcaagttttttagccaggtttggcatgtcgtaattctggggccaaatacattccaaccacgttgcccaaagtaa

SEQ ID NO: 262 - DNA, 588 bp, Rattus norvegicus
  Genbank Accession No. AA892776
catgaatagatgggtttatttagcagtaagtttgaaactcttgctttaagcaagggtactacagtaattgtatcaggaacagacatttcctacattgtcaaatatataaaagttcctttgcactttcaacactgatcaacaagcagattcagtccatgttactttgatgtatatctactcagttaacccaagcttcttcttcagagactctggcatctcaggtggaggagggcgagggagcctgaagtagaccttcacagagtcatagatgaaccactgcagtgccgtcagagtgccaatcatgatgattcgggcgaagagccccttccatacacctctaaagccaagcctctgcaggacctgagaggcagtgctgcctttctctttattcagcacagagaccacagagtcagcagggtgagagacaatcgcacaaaagactccggctatgtaacctgccacaaatgtcacaaccagctgctctgcctttgtacattcacttcggggcttaggaaccacaaatttgtacaaagcttcaacagtccgttcaaagcaggcgaacttcatcatggtgtatgggatctgtct

SEQ ID NO: 263 - DNA, 694 bp, Rattus norvegicus
  Genbank Accession No. AA892798
cttgcggtagccaaactttttttttattttttttttttttttcacacttataactttattttacagtatctgcaagcatgcatgtcagaggcaaagacaacagcatttagtggatatttatgtttattaaaagaaaccgatggcaccgaaggtcaagctgccttctgatttcatggactaaataataaagtattacataacttcagctttacagggaaccacgctaatgacaaagtgtatgaggaaccgtgtaatatataaggagtctaaaatatttatttttacatatctacaacatgtattttcatatttctagaccaaccacaaatcgtattgggaaatatttaggtacatgaaaaagcttcaaaatataaaaaaaattaacatttggaaaaaaaatcacatgcgcgagctcattaaataacaacatcgacaaataaataaccggctttacctattagctgctgccttgcattgctggcattccactccaagagaggtcaacacgagggggataatttcacactgagactggaaaatgccaccgggcttatttttgaagtgaaatgtcacaaggtttgcctctctttcaaaggaagctaacccctggctgtcaaactattcccataaaaactactggaaaagcccctttgtgaaatgttctgtgaagatacattttttttttgattgaact

SEQ ID NO: 264 - DNA, 409 bp, Rattus norvegicus
  Genbank Accession No. AA892799
ccgtgtcagaaactgtttaatgttagaattacaggcttttggcaagtatatggcaagcccatctgtccgttcccatgtccactgagaacacagcagagggggcatgccccaagctctggcctcagtccagacttcagcttgggtttgtccagcgagatgtctccagtccatgaaagcccatctggctacagcttgagttcactgggcattggctcccctcttaggccagctgagcaataggcacaaactctgcctgaaactctgctgcttcctgaggcctgggctggcgccccgtgtagagaaatctctggacaccaaatggtttcagtcgtcgagcaatggcctgggcgagcgcagccctgccctgggccggcaaagggccagtgacgaacaccttcatcctcgtgcc

SEQ ID NO: 265 - DNA, 590 bp, Rattus norvegicus
  Genbank Accession No. AA892820
catggagcaaacattttatttaataagttataagatacactttccagtcggcatttgttccagtttggtctccatggctactaagcctgtatccctttcgcatccagcttcagctgctctgggtcctaacgggtggcttttagcacccacacctctctggctgccgtgccttggtgcgggacacctacttcacccctaccatatccacgacaacagccacaacacccgattttgagggggaaggggtatttgacagcctggaaatgcttacaccaaagcctttaaagagaccctaggtgcatgtgttagtgccttggtccttaaggcctctcatgggtcataacaggggtgggtatccaccccttccagcttttgcaaggaggaggtcctacagtaatttatcagtggcctctgccatttagcacaagcaatggactctgggggcagctgacagaggctctgcatttggccatgaccacatgtcttcaagaaagtaggcaagagcagaatccctcctactccagagctggctttgcgatgaagtcaaagtggtcagggcgcagacatggagaacgatctgggtcagactt

SEQ ID NO: 266 - DNA, 503 bp, Rattus norvegicus
  Genbank Accession No. AA892821
aggtcggacgcctgctttattcagacgggaaaagagcagggagtggatggagaccagcagaaaagaccacactaggtcagcactgggcaaggagtggccagggtgtgactctaagagttggcagaaaagccctggcgtcttgagtcacgacagtctatctgaagtagttgggacactcgtgggcgaccacgttccaggcttggttaaaggcctccacgacagcgggctccaggggaccttcctcagtggccgccaagttctgctccagctgctccaggctggacatgcccaagatgactgcgtcccctcgggtgccctggagctgtgagtgatggtacatccagcgcagggcagccgaggtcatgctgggggcactggtgccataggtggtcttcagggccttttctaccagggcaatggcctcaaagtggtgttccttccagaagcggttcctgtaggtctcagaccagctattcccaaagaagcggccctcgggctgtttc

SEQ ID NO: 267 - DNA, 600 bp, Rattus norvegicus
  Genbank Accession No. AA892843
ggacagcagcagcacccaaggcttctttattggtgttttagaaagaaagggtggacttcagggtgaagcagtactcttaaggctcaataccaatagattttcttgaatcttcgagtctcctggatccccatggcctccatcacatcttcttctaatgtctttagccggggcacgtaagttctttctaaagcatcttccactgatgtgtccttggggccatcagtccatgtttcagggacaatgccatctgctctaggaaattcaggtttggggataattctcccagatcttgtagagacacgaacacgctctcctgcctcagtaaatctccactggatctcagtaggtttcctgtccacaggatccactagcttgacttggtgatgaagcaagggggcttcgctagggatcatggtccctcggtgatccttggttctgccaatgtagcggtaatgcgtgttcaatccctccaggacaacccagttccgctgccgaacaacttggactactttgccctgcttcccagcatccttgccttctaagatttccaccatgtctccaaaagaataggtgccagtcttcatcagagatggggtctac

SEQ ID NO: 268 - DNA, 486 bp, Rattus norvegicus
  Genbank Accession No. AA892859
ttaataatttatcaggcaggggaccctcagaagggtcaatgggaaaatagaagactctagggacctcctgggagggctgttggggccagcacattctgtcccaggcacatagacacactcaggagatgagaatgacaacccaggtggcccaacaaggcacagtggcagagaaggtttggcagactgattgagtgtcaggggtcaacgaaggacaccatgatgtatcgagttcccctggtggtgggcagcccctcgtggtagtgtgtgaggcgaccagggtgcaggagagcccagcccttcctcggggatgagactctgcagtcgtacctcaggaagcggcagccacctccctcataatctacacccttgtgattgagggcaacgttgagcgtgaaggtggacgagtcatggtgtggccgaagtgagggctgctcatctggccggtagcggaccacaaagttcatcactgcccgtgtcttggtgtgg

SEQ ID NO: 269 - DNA, 515 bp, Rattus norvegicus
  Genbank Accession No. AA892861
caacattaaaatagatttattaattactggtgaaaaacatgatatattataaccaagtcatatactttattgaaaagaaaaaaatattcggtaagaagtttggcacggtcttctgctgggacctgtgtgaaatcccaggacttgtaggtcggggctgccttcgtgaggggtgtcaatgcagcccaagaagtgggtaaagtaggaagtgggggtcaaagaaaggcaatcaagaggtctgctcacaggggccttttcccacgttcatgcactgtcaggctgtatcctgggacagcggggagcctcggagagttaatgagaaacagaattgtcactttggcgaccaatgtcagaaaacaggttcctggtcaagcgttaggtactagcgaattctgaccctgagacttgaggtgtcactgtctttaaactgccaggcatggagggaagtgtccaaagatgggacttatagagagaagtggtcccggcttcctgtagtctccatctcaccagccccaggc

SEQ ID NO: 270 - DNA, 476 bp, Rattus norvegicus
  Genbank Accession No. AA892940
  misc_feature (1)..(476): n = a or c or g or t
acaaactgtggctaaggttgaacttgcaaaaaataaaatcttgaagaaaggccccttagggttaaacattttcatcttgttctcgttcttctctgggcccaagctcctctctgttccttgggaatggggccaggcagaggccacataaggaaccaggaggccttcctcattgggatggaggtttccgggttgttcagatggccccataccagttcccagatgctcagagcatgaaggcccagtcacacaggtccagcttgagtctagagctgcgtgctcacatgggataattgagccatctccactgtcttgactcaggccacaccctggactcaaccttgctttaggaacattatctgagaggtgttgatggaacaaatccctcncctcagcactttctcaggaggaaaacatggcctcctgcaagtcctgngaagtgctcaacaatgggtgtcatggaacttcagaagggccta

SEQ ID NO: 271 - DNA, 481 bp, Rattus norvegicus
  Genbank Accession No. AA893035
caaagatcaccagttagtctttttaactgtttaaagattacatttacttatttgtgtgtgcacatgcgccccatacctggggaggttagaggacaagtcgatggaatagattctctccttttacaatgtggttcccaggaatcaaattcaggttaccaggcttgactgcaggcacatttacttgctgagctctagtctcttttctaacaattcttacagttgtaccacacatactgtgtatctgtgtttgcatgtatagtagtttttacatattaacaatttaatgtctggtgagtgacatgagaacaaacttctccaacccataaaagcaaagctacagaaagccagaggaagtatgcctgtgtgcagggttgtggggggtcaggtcacaaaacaaacctactgactaatagccatggatcaatgagcctgcaaaatgaataggagagagtacaatttagccaaatgtgttacaggaatc

SEQ ID NO: 272 - DNA, 416 bp, Rattus norvegicus
  Genbank Accession No. AA893060
aacattaaatagaagtgctttattgagaaagatgtacttagactcaatagccaatccgggtttctatcacacagagacacaaggactaaacataggcatggaccagagatagcagagaatttggttggcctgtaaccagaccacaagggaccagaaaggaacctccattatgtacacatcaggtcatatatcgatggctataaatacccagcagtatccttgtagccgaggcttcagaggcctaaaggtgggacccactgaaacaactagtgtggcactgttcctattctcacagggccaaccctcatcccatgactctgtatggttcttggggtgattgtactcgggatcagtgtgtatagaagggtgtaagagggctctatgattcaacaataggagctgcagctttgtggtgg

SEQ ID NO: 273 - DNA, 424 bp, Rattus norvegicus
  Genbank Accession No. AA893080
aacttctgacaactgtttccacatgctgcgtcatcctttggcccacagacccacgtgctaaaagtgtcctccaagaagacatttcctatataaacatgggtgtgatgtgtgccacacatcctcaagatgacagaaccctttgcagataaaattaaaattgaatctgagtgagaaatgaccggatttcccactttggcaaagatcaggcagcagcctcccggcagccatccctgtgtagaagacagggtgagctgtgacctctgggaacaaggcatgagacctcgtctggggaccatcaggccagggaggcaggtgggcagtggcaggctgagggcagaggagaagggcagggcagcatgggggaggggtgttgtctgtacgtgcacacgggaggccatgggtggagacgaaatcaacttcctat

SEQ ID NO: 274 - DNA, 479 bp, Rattus norvegicus
  Genbank Accession No. AA893082
  misc_feature (1)..(479): n = a or c or g or t
aagacaggatgtcagtccctgaaaataacatttactggttattgcctttaaaactgtggattttttttaagttacagaaaatccagttctgcaccacaatacaactgtaaaaaatctgcatcaccttaaaactgtgcagtaatgccattttataactgcataaattttattagcgttctaaacagttttgcgattttttttttgtattatatgcttgcaggttatatcttagtgcaattcagtcccaaatactttaattttggaaaaaaaacatacagtttgaatgtaaaatacccctacagatataagcaggggcgtttcccccttttaatactttggttttcaatacagtccacggtatagcaagaactacacatacccaacttatatttaagttgcaagcacatgcttcagaagctacttttaaaacagtcnccttgcaaactctaccccccttaacatcacaacagtaaacgatt

SEQ ID NO: 275 - DNA, 654 bp, Rattus norvegicus
  Genbank Accession No. AA893191
ggtacaaagtttataacacacctttccctgaaacagtagcttgaagtgttttgaaacagatggggatggcagatccaggacttccaatgcctggctacacatttggtccatatggacaaagtggggacaggatacgacatcaatcctgagggaggggcttggaggcctcaggcagtaatcttatgcaggcttgagaaaaagattcagaccaaaagctacacgtgaccttccaggcaacccagactcctaggcagcccaagggttggcagccatcttcacacttgtgatccttgcccaaggccaaggccaaggccaaccgccccactcaggcaaacaaggtattcactccctgagggccatcaaggagggtgctgacttcatgaacagtctcggaccaaccattcctggggccatgctgggatggcattcctcgaaaacccattggtgatgggacatggcgccctcagagcaggaccgcatctttggaggccatggagtcaaggaacaatgaggacgggccctgcccacactcagagccagacaggcaccaagaccctggtccacagtcaccagcaggaccctagggcagctccaaagccagcagtgcctgatcagggacaaggggccaacacgtgactggcccacaagtggctt

SEQ ID NO: 276 - DNA, 626 bp, Rattus norvegicus
  Genbank Accession No. AA893192
caaagtagaaatttaattcaattaaagatcaaacaaagcaggtgtttgtattggtctaaatatttgatccactctaatgaatattattcttctcaccgctaggcatttatttttagatatccacaaacttcattgttaatttccctgtgaataaaaagataacagagaaccaatgtttagctcccgccctcaacccaaagtggctcactgtatgggtcagagggtgcgtctcctctttgtcaggggtcacgagcatcaaggcagaagacatggcttgtggtatacgttggtctgctgccccgtggtctcccaaatgaaggacaattttcgcagagtcatcgagaaggtaaatgcattgggtttctgaagaaacacaaaactttcttcaggttaaacactccattgttttgatgactcttctgaatctgtttccaccaggaagctgtctagataacatccagtacgtttactacttaactcttctaccagtatattaacatgaggctatgtgattcaaagtaatatctaagggattctggaaaatgttaggtttcaaaccagtcaactacagaactacttactaaatactatgttacaataagatttattgacctaaacattattac

SEQ ID NO: 277 - DNA, 460 bp, Rattus norvegicus
  Genbank Accession No. AA893205
agaaagggaagaagaatttaactttatttagaaatcgtatttagctcacagagcaaacaccctttagagcctacatgttcaaaaggagatgagcgtgatgaatttggtagaaatcaccgggaccattgctgaaaacaacacagaaattatgaataggaaagcacccccccagttagggctcatcgaagaatgacacgcagttctgtgctgatgattttcctctgtttttcccaaattctttctgcactggttttattttctgttgacatttactctgcagttcacccaaacatgtctttcatagtgattgtgcagaggacatggatctccagagatgtttggtagagatgtcatttggtaaaggggagcttgacatgtcagctccgggtgccagaaactattctaatcacttcactctccaaggatccttgggccgacgattcagttcttccctcgtgcc

SEQ ID NO: 278 - DNA, 646 bp, Rattus norvegicus
  Genbank Accession No. AA893230
gagttgccacgcatttattttcaagtcatcatcgtcatctttgtgaggtccaaaggctttgagaagtacagtgggtgagggggatgacgttgcagaggcagcccgtccatgctgcaaagggctgggtaatgttagtacggaaatccagacagacctcctcttacaggcaaccagtacatggccacatcatttattggtattcaccccctgcaggggttgtgccatgtggtcttactgctgtgttcgccatctctagacttcccttacaaaaaccttcagtccaggttttcaggccccggaggctgtcatcctctgctcccttgacctcggctccctagtagtctcgcacgggcagggtgatcctctggataaacgtgtcatatttcacttggccgttaggttcgatgcccgcttccttgaaaagctcatccacttctttgtgagtgagcttctctcccagtttcatgagtttcgaccgcaactcagacgccatgatgtaacctttcttctccttgtctgtcatcagcatggccagaaggatttctttctttgggtcctcttgcttgatttgcatgtgcataatggtcaggaaggtggagaaatccagttctccgttcttgtctattccatgagtctgcaggtgccg

SEQ ID NO: 279 - DNA, 643 bp, Rattus norvegicus
  Genbank Accession No. AA893242
aatgccgtttatccagtctcagaggtagcccttgaagggaagaaacttttgatttgacccttttttctaagatttttgtttcaggacctgaattaagaaaaatcaaaacaaaacaaaacagaaaaattaagagatgattttttctttctcttgaaagtttaagagagattctcagttcatcttttcatgactggaactttctaagacaaaccacaaagccatataccaagcagaaatcagagaacgaagcccagtccccatcagctgcaggtggaaaccacggagaagccagcacagcaagtggctcatggttaatacctcaggtctgttctgagaaaagatgccgatgaactgctctgagcaaggtttgaaacccttctggatcagcgccgagcctatgcactcagccatttctgcaacctgtttgtaagaaatccactcatatggctggtttggctttctagaacctaaacaagggccatcatttgacacctgaatccccctctggaagccatcgtacatcgttctgacatcgtcgtagtagtacagcaagagcttgtcgtcctcaaggactgctgatcttcggacaccctcagtagtacccgttactttcacagactgcatggacagatcacatgggggc

SEQ ID NO: 280 - DNA, 480 bp, Rattus norvegicus
  Genbank Accession No. AA893280
gggtccaaaggtgatatttcttcacatggaaaaaaactaaattcaagccacacaagaacatgccttgagggaaacagtgatgaagcctgctcggaccacacaggagcagatgcccattcagagcagaggccgcatgaacaaatctttattcggaacagacagacgtttacagccaataagaacacaaaggccatggacaagactgtaagcgcacctgagctttaaggttctggtgaggtcctcacaaaactaacacactccacataccagccgggtaagaagaactcatgtgtcagggccagcgggggcacgaccataagtgagctgtgaatgaccataatgaggacctttgttcacactagctgcttttctaatctaatcaggttaatttcaatacagcaaataaccgataaaaaataaaaggtgccacctggtcagcaacatcatacactggtgacaagagaacgttactgagttgtg

SEQ ID NO: 281 - DNA, 296 bp, Rattus norvegicus
  Genbank Accession No. AA893289
ggtggtgcataactttaatcccaacacttgggaggcagaagcaggatgatctctgtatgttcaaggccagcctggtctacatagtgagatgacccactctcccccgtaccccagtgaaagttctgaggctgcagctcagtcggcggagtgctttctgggcatgctcaaagccctgggtttgaaatctagcaccacattaaacctggcacactggcacatacttataatcccaacattcaggaggtagggaaaagagaaaatttaaggtcatgattatatacttattgagttcttta

SEQ ID NO: 282 - DNA, 452 bp, Rattus norvegicus
  Genbank Accession No. AA893327
  misc_feature (1)..(452): n = a or c or g or t
catcttgatttttgttgtcctgggacatttttttaaagaccttcaagtagtttggaaacctctgcccatcggctgcttcctccggccacggccttcgcaggcgtttccccaacctgtgctgtggagcgctgctctcgtctgggcaggagggctgctctggattgtactggagtgaggggccagctttgggaacttcttccgattctcttagttagcatgctaccacccaccccagcctctgctaggtcagatgtgcaagacaagcagggctgagccggcaagaccgtgacagtgtaaaacggttctagaagctcctgtgtggctcaagcctganggtggagtacagcctgctgagagccgaggggtctgagcaggccagcactcagtctgcagccacaggtggggattttgggaaatgccacagcccgttccacagaactggatggtgatca

SEQ ID NO: 283 - DNA, 512 bp, Rattus norvegicus
  Genbank Accession No. AA893436
aacaaatatccagtgtgtttaatgccacctcaaacaaagacaccacccacagagcaatgtgaaaccgaaggcaacacatgacaggctcactacatttcatcaatttatacacagaaataaaaatccagctaccaagaggtcctctcccagagtgccggtcgcctccgcgacattctcccctctccctcagcattcgaaccctcttactaagagaggtagcttgtgcccaggctctattccagtagagctggagaatttatgacacactaaaggaagccaccagaccgggcttccgggcaacccacttctgtcccgttcctccttttctcttgcttagaacacaaaagtgaccagcaggccactttgtggtctcgtaacccaatattcaaagccatcgtgcttctgatctgaagtgttttctgaaggttgtggtgttcagctgataaggcctttcgtaactgattggatcactatgcaatgaaggaagggctcaggcttcctcagcaagttaa

SEQ ID NO: 284 - DNA, 561 bp, Rattus norvegicus
  Genbank Accession No. AA893626
acattaaaatatgagttacatttccaataaaacaggaacaatttatattgtatctacaaaatttctacaatatatgctgtactttaagtgtgccaaaaaagctgaggaatgtcctatcaaccctgcgtagtctgaggcactggccctgaagatgctggtgtttaaattgggcagtcatagacatggatctcctggtcatctccaacagacacaatttttgatccatttccattatattttactccccaaacctgatcctggtggtcaaagaaggtgtgaatacaggtccttgttccaacatcccagacctttacacttttgtcggatgaactggaaacaaagtgagtgtcatctggacagaacgcaacattcaatacccaggatgcatggccactcagtgtgccagccaaattggcatgttgcacatcatagatcttgatgtagccatcatctgaagccgtgacgaggagctgggagtcaggggaaaaggtcaaggatcgaatgggcatcgcatggccttccagcgtgtgcagaagctttccagttgcaatatcaaaaata

SEQ ID NO: 285 - DNA, 472 bp, Rattus norvegicus
  Genbank Accession No. AA893717
ccacataatattccaaatacatgtcttacagataagggttagtatgagtatcagaaaacatcccagggaaggaagccattttagacactggaaaatgctaaccaaaaaaccaatgcttacatacacatgtctggaaaaagctcaccacctaaagtgcaaagacagaagcaactaacgttctcgctgtatgaaaatagacaatcttctgaactattagctggctttttaaataggctccactggacaaaggacaaagggtcagtcgtcagaatgaatcaggctttaaaccaatctggctttgaccccaatcaactgcaaacaaagtccaggttgaggctgactagagactacacgccacgtgggatcatagcctctagcactttctacaactcagacttaacccagttagaagtgagtatcctcagatcagtgcctcggcctacccgccgcacaaggctcccggacatgtgtc

SEQ ID NO: 286 - DNA, 520 bp, Rattus norvegicus
  Genbank Accession No. AA893743
cagaaaacaagtgttgcttttaatatcaattattggagcatgcaacattgctaaatacaaaagtcatagaagctcacagatgacttcccaggctgtcgctagtcaatgaaggaacagttccgggcctctaagacatcattatggatcctttcttggtttaatttaacgactatactttcccccttactacggcaggtctcattcagaagcttgctgcccaacagttacattttttcttattcctctgagaaggataaagatgtcatttttaaaatctacattggttccatgctgtcatgtgtgcggaagactcagtggtaggctatcgacgggctatgttagtattccctgaaaaatgaagatcgtgatttctgttacagggcagaaagcatttctgtgagctcaggatgaatatgtactgacataaaatattctcagttaaaaaaaaaagttaaactcaacaaattcaacagcttctcattcattgttaatgtgttaaaaatggaaaattctgtgtttc

SEQ ID NO: 287 - DNA, 419 bp, Rattus norvegicus
  Genbank Accession No. AA893860
gaattcatacaaaataacctgggtacagaaaacatcctccatgattttccattttggagagagacatttaatggcccccatctaacagcattctctaagacttgtccagaccagaaaggctgatccacgaagactcggcagaaccactccttgctcatcatgaagccatgtttcccagtgcacaaggtcacgtgatgggcacccatcttcctctacactgatccagctcgggccatgtgcctgttaaaactcctcctctgcctgcttactgcgcaactgcttgagctgctgcagccgctccactgtttcccccacagtccgctctccgtggaccttgttgtctctcgtgcggatgttcacagtgccactggctttctctttttcaccaacaacaatgatgaagttatactgtgccaact

SEQ ID NO: 288 - DNA, 355 bp, Rattus norvegicus
  Genbank Accession No. AA893905
caaacaactcaactttatttatctggaaaatggatgagttcattcagtggtgtttaaagcctgagtctgcacgttctccttagaaaggtcagctatgtttggcaggggctctgacggtttgaaatccgcctgattttccaactgggcttcaggccggtcaccccagaggagatgcttggggtcattgaggaaccgctggcttcgctggcatgtcagacaggtctgtactgtccagcgttgtccctttcggcgtctctggcgctgcgtgcaggtgaggccagggatgaggagagaggagcagtcgcgacagagcgtcctcttcacagaggggtcctgccgtaggaccagccgcttc

SEQ ID NO: 289 - DNA, 521 bp, Rattus norvegicus
  Genbank Accession No. AA893982
aaaacgttttaatacaacaaagttataaaataatatattagtagatctggatttaatttagaatcaggtatttacttatgtacaacactgtgcttcaaggcatggctaccacagggactttcatatcttcaagtaacactagtttctctgtgggcaggagacctctaggtagaattctcaaaactgaacatgcctggtttagtccaagcaacctgcttcctcattgaataccagtttcatttcctttgttccatatcagaaatatttcattatcctaacaagccatgaattcaatgaaaaattattaaaattaaacactttaaagatgttaataacaggctccgtttagttcttcagacaatccagtagttcagattaaaagagatgtaaagtaacaatgaaaaaacaaattacaaaatacaatagaacattccttctcccatcaaagcacaggcttccttatgcagacacagggaacacacagaacatagagtcctttgattaacacagagtacaatgta

SEQ ID NO: 290 - DNA, 445 bp, Rattus norvegicus
  Genbank Accession No. AA894009
acaggaaacaaaacactgacaaatactgtacagcttggatcatttatatattcttctcaaaaaagtgactgctttttctttacattttcctgttctttttcctcctcccaagaaatcaaaaaagtccacagaacaatggataaagacccctctgatggtttctgagtatgaccaaggcagattagaagtccaccgtgggtgggaacaactgggaattgcccttctggatgtttcgtgacaggaactagctcaagtctatttgatcaggaagcagtaggtacactgggcccggagacggaagcttcactatggcaatcagtaaaaactgacttctgtcttaattcaaactggcagccagttgtcacggaaacagtgttattcgtatggtccctgatcctgtatctgacatcccacctctgctgtgtctccacctcttcccccaagt

SEQ ID NO: 291 - DNA, 407 bp, Rattus norvegicus
  Genbank Accession No. AA894027
caattcaaagcaaggtttaatctgtgcacagaacagccaatctggcggccatctccccgtaaagtttgagttctggaactgaagggggtggggttttgcaagcaggaagaacaaggcagttaaggaaatcttctcagaacatctggtacagaacattctttggttatgggatggggtacagctaaattctgagaagcagacattggaacgtaagttttacagtaaacagagcctcgaaacgactcctggccttcaaatggacttgaactggtttctgactcatctgtcttatgtgttcctgtcacataagcctcttggaagctaacatttctggctattgtaatggctactagtggcaagcattttagcattctttatttgtccgtagacaagccttgtgaagcgct

SEQ ID NO: 292 - DNA, 302 bp, Rattus norvegicus
  Genbank Accession No. AA894059
gaaagccaagcaaaaaatcatttattaaatatagacatccaagacttaaattactgaaaactaggagttggattagaaaacatcagaaggatggaagaaagacattgcaatttctgtttgatgtattcaggcaatttttcattttctccatacctagttgtctgaccgtctggtgatgtataactgatggaagatactcctgcctggacaaccaactgtgacccatcattaaactgaacccacacagctccactagttagctgtgtaccccaaccaacatttttcacaaaaacagttttcaa

SEQ ID NO: 293 - DNA, 494 bp, Rattus norvegicus
  Genbank Accession No. AA894130
aaaaggcccactttattaaacacattctttctttcagaatcctgatttttaaaaaacctttatctactaaaaaacagacatataaatcaagcaaacagttaagactacaggaatggggctcctagtgacgctgaaggaggcgataggtggggaagggcagagggctgtggggagggaggtcaggaagaggctctacgcagcccacaggctgggaaacaaagaccaaactccctaatgatctcaggcacaagcgttgctctgtcatggtgtcccccaggctctctgagaactggggcctctacaagacacaggtattcttcaccagctgctccttgtcatccgcagtgctccaaacagtgcggagagcacgctcctgctttctgcgaaccattcggatcaggaacaccatggaggatcccaggaggaggatcaggaccatgatgaacagccccaccaggatcaccgcttttgtgcccggagtcaggaaaggatac

SEQ ID NO: 294 - DNA, 554 bp, Rattus norvegicus
  Genbank Accession No. AA894297
agccatcagaattccctttacatccattctgttgagcagtatccagtcaacctgctcatcctgcttcaggtcatcagttgtatttaggcacaaaggttttagttttgtctcgacaccaagttttaatcacttgaggtaactgctacagcaggaggaccttgttgaaaaatgtgctaaacacttttcatcttctgtcagtacaaattaatgtcctttccttaagtagagttaggcatttttggttttagaattggtacccatcataaagcaagacacctcacctgtggagtcagcattagaacacccagtgtcggcagcccctgcatgggcacggccagcacaggctctgccctgtggcctcggagactgtgctactgagctctttggtttgctgcatgcagccatgcttacctcttctgccaccacagggtcgcttttgtcagcaggtgccaggccgctgtcccatatgccacactaggactctggggctgcttcacatattagacatagtaagctgtaacacagtaatcgtgatggtacaaccacccagtcaa

SEQ ID NO: 295 - DNA, 569 bp, Rattus norvegicus
  Genbank Accession No. AA894318
tttttttttcaagtttccaaacaagaatttattctttattttttttcccttaaaaaatgtaccaggtacaatttttcctgttttttgttttgttttgtttttcaagtttcagcaaatgcttgttcccctcagccaagccccaagagttaagggttgaggctgggtcagagtcttaagtggggagtggagtaactgggaaccatatgactgaatgaggggcacccctcatcccagctgaggtaggtgggtcagagtctggtcaggtaagaggaggttccccagtccttaggcctgactctgtccctggacaccttcctcagtcaggacaccaaagcaaggagacaaaggcaggaggagagggacaactgagtctgagccctaggtaagaggtggttaaacccctgtgttacacatacactcaattctctctcgcgcaacacaccctacacaaacccaagtttgggtgcacacacacagttgtacacacacacactacacacacaccacacacacacatacacacactggctttcgaagatgggttgaagggcagggaagggaaaaggaat

SEQ ID NO: 296 - DNA, 477 bp, Rattus norvegicus
  Genbank Accession No. AA899113
tttttttttttttttttacttgtaatacatttatttttatatattttttaaattgcaattttcagaatatataagtatttctcatacagaaataagcattctgcattctttggtacagaaatcacactatacatgttgtgtgatcttttttcttttttcttttttttggagctggggactgaacccagggccttccgcttgctaggcaagcgctctaccactgagctaaatccccaaccccatgttgtgtgatcttaaagaaataaaatcactttgactatgtcaaaactagtctttgcccatccatttgtcccctaccacagctcccagtgagagttctagtcacagcaatgtatcgacacagacatcacatcaaagatacttcaaactcctatgtatcaaagtagtacatggcttgaagacagatggcactaaatacataaaacacagtacagataaactggaaccttaacacta

SEQ ID NO: 297 - DNA, 472 bp, Rattus norvegicus
  Genbank Accession No. AA899219
tttttttttttttttttaggacacaaaggtttatgtgattttagccattacaacaggagttcagaaagatctcaagtgttacattgatgttatcgatattacaaaaagagaaaaaagtgacaggcaacagtgaagagcaccagagacccagcacaaacctaagaccattctccttcttccaactgccaaggtattttcacagattaagaccccccaccccctcctttcacctcagctttccctaacctgcttggcctggggaactcaagcctcatcctcgccctcctcctcctcgaactcgccctgctcatcagcctccttcatggacatgcggccccggaaaatggcggctacggtcaggtagcggccatggcgtgggtcgcaggcagccatcatgttcttggagtcgaacatctgctgggtgagctcgggcactgtcagggctcggtactgctggctgcccctgctggtc

SEQ ID NO: 298 - DNA, 343 bp, Rattus norvegicus
  Genbank Accession No. AA899498
tttttttttttttttttcgcgtgttccagtacctttactttcaggtttaaacgtcgggtcactggctgggtttcttagcttctcacacccaagccctaagcatgatgttaccctagatcttaaaggccaaggagagcccgtcatccaggggcaggaggctaatgtagaccctggcgtcccgcaggatgcgctcgtttaggttccgcacacattcaacagccttgttctgcgtccaccaccgctatgtcgaaggttccggcctcgcccgccgccaggagctcatccaaagtctgcagggcgggctgcagccgaaggtcgatcttctgctccacttctgcctgct

SEQ ID NO: 299 - DNA, 522 bp, Rattus norvegicus
  Genbank Accession No. AA899563
tttttttttttttttttgcattaaataaatataaattttattaaaaacactcacatggcgttatcaggaatgatataataaacagctttaaaataaactgcattcataacattacaatacttacagtatttataaccaccctcagattgtataaacaaagccaacatctcatgaaactacattaaaaaaataaagcgtagaaaaatgcacacggagattcagttatcttagtgtcaaactgcaaaaaacttcctaacgagttaaccacactaccttataaagtgaactatacatcactgtgcgtcaatcaggatgaaaaagtcattcaagtaatgttgacaccaagcagaagcaatttcaagtgtggctatgccatcgagctgttcctacagaagcaaatcacagatctgcttgccacgagatctaatgcagatggggggatgtcattgcctttcttcctacatgatccatcctctcaaaccacacttactgctcctgttggccagcagtttgacaaatgac

SEQ ID NO: 300 - DNA, 518 bp, Rattus norvegicus
  Genbank Accession No. AA899590
tttttttttttttttttcaattttgaaacttgaatttattacttttaagtaacaataatttactcatattacagaaacatatcaatacaataaaccaaccagggtcatacatctgacttgcagttatctggttaacaaggaagctggagatcattgtgaactaccccagggaacgcttgctgttttggttaagagtcccacatatacaccaactggcctcgaactcgctaggtgaattctggctattgttccgttctctaaacacagattaatacacaaaaaggcagattaaggtgaaccagctgttatctgttatctactggtctgtactccagtctgaaaggaacacacattaacatctcatacagtactggttttctggtgtttaggaattcatcaggtaaagccaggtatggtcacagaaaccttaatcccagtatttgggaagacaggcaagtttgagggtaacctggtctacatagcaagttccaggccaagccagagttacatagttaaga

SEQ ID NO: 301 - DNA, 369 bp, Rattus norvegicus
  Genbank Accession No. AA899709
tttttttttttttttttgtaaggagacactttaatcagaaagcagacatcagcagacagaacccttgagcacgctcagagcgtgcctcacccccaggaatacccctcaggaaggaggttcactctctatcttcagggtaggtgtctgaagggttaaacaaatcacagctccagcccacactggacacagaatcatggcagatcgcctagaagacaggcaggtccgtaggtcacacatgactcctaacaactccattccccaatccccccgactacccttcatgtccaacagagaatgtgctcatctctctttctgctcgggacgccacaccttccagatgaccttgcctgccctctctgccccaagcgt

SEQ ID NO: 302 - DNA, 470 bp, Rattus norvegicus
  Genbank Accession No. AA899721
tttttttttttttttgtctataatgatccaatttttattttttgtcttaataagaatgtttatacttaaggttcccctttaattcatgatacaaaagaactctatttttggataggcactatttttaaattacatgttatttgtgtgtgcatgtgcaggtgtgtgcgtgtgttggaggacaacttgtcagagttggttctctcctaccatgtagatcctgggggaaagacaatctcaagctgtcaggctgggcagaaagcaccactatcactgagccatctcaccaggtcaataggcacagttttataaggaagttttaatttctttgttgtcttatagcactggagaatgaattcagggcactatagaagaaagtcaaatgcattgccactaagctatatcctcagtctctcacaggcacttaattcattatattaagaaaaaaaagggggggttggggatttagctca

SEQ ID NO: 303 - DNA, 454 bp, Rattus norvegicus
  Genbank Accession No. AA899762
  misc_feature (1)..(454): n = a or c or g or t
tttttttttttttttttcatttttagaaaagcttttatttcaaattccattttgcatattgatttttttttttttggaagaagacaagtgcattttccttgagcaaaagaattgagttatgatttagggacaggatcttcattcagcactcttaagcaaagtcaaggttagggatgtgatcttgcaggtgaataaatgcttgcttctcccagaaaccgcagcagatacaggtgtaagaggtgtggcgcatgccacctttagagtaacaatagtgctggaacaggctttccatctcgtattccttcatccccacttttacagccttcatcacctcacggtgggcctcactggagatccgatttgtgtancgcaaaacctccagctccatgtctgtcttgaacactcggcattccacgatctctgggtgaagaatcgtgttgttgacagtgaactt

SEQ ID NO: 304 - DNA, 545 bp, Rattus norvegicus
  Genbank Accession No. AA899840
  misc_feature (1)..(545): n = a or c or g or t
tttttttttttttttttcacatttagagcagctttattcattaacagcaaaaatgctgaaaatacatgaaatgtccaccaagtggtaaatgaatacaataacataaccataaaagaaaatactaaacaataaaattactaatatgtacagtaagcatgagttatctcgatgcttatattaagtgaaagaggctggacatatagactgtgtgaatccattaccagaaaacctagaaaaggcaaaactactgacgaacaactgcttcctgggcaccagagggtagaagcaaggaagggcattttacctgaaccagcaccggcagcaaatccatggcagtattatgcatatgtcctggtcatctcacaacttactagggaaataagaccacagttgattaccttagaacaaccaatgggtcttggataggacaaaagcaacatctttatgctanaggtagggactacaactggaaaacaaggaaggagtcaaaagtaggagaaaaacaataactctaataagcctgaaaacagccttgttttgtcaca

SEQ ID NO: 305 - DNA, 528 bp, Rattus norvegicus
  Genbank Accession No. AA899854
tttttttttttttttttgactttcgatgtttagaacatttattaaagtacaaaatagttggaattaagctgaatagacagacatattaaatatttacaaaagacactgataatagcacttaagtaacatatacaacagcacagaaggtctcggcattcacaagtcggaattacggagattggcacggatcacacttcctggctgagtgtggagatgtcaacagtcctgcctccccccagggatctcgagttcggaaggcacccccaaacaagagtcaagacttcacgtaactggcctaactttcttcatcctgctgcttgtgctgagtcatgaagacatggtcaaggtgacttcctccagcctctgatgatgttcaaaaggtacgagcaatttctcatggccaaacaaaagtccatcacatcagaggctgggcactgtatctgtactagaactaaccagctctttatgactgaattctacctataaaattgaaaacaagggctgtcttacctcatatttagtgggata

SEQ ID NO: 306 - DNA, 493 bp, Rattus norvegicus
  Genbank Accession No. AA899898
tttttttttttttttttaaacaaattaggtttattgaacttggagatggaccactttataagggccaaaccaaacgaaaatagaaacagattagactctaacacatgagaacaaaattaaatgtaatgaggattcttgttggctttaaggctgatgaaacgggctattaaatgaacagacttctccaggatggttttcctagcctaaatgggaaaagacctagataacttgaaaacagctgtcccacccagcactgttagaacactgcttcatacgtgagaatcaagcagcagttcataaatttagtgttagactgcctcaaggcgtggttggttgtcatacctaatgagaagtccaaatgcacaataaagatcagcagtgagccaggccccttccagaatgtggggtccctgaacagaggcacccacactaacacaggcaacgggtgacagcgacacccacactaacacaggcaatggggttgttctctctt

SEQ ID NO: 307 - DNA, 511 bp, Rattus norvegicus
  Genbank Accession No. AA899951
tttttttatttttttttcaagagagatttgtcatgtattggagtagcttgaatggaggatctccagacacaaaagtttgcacataaacctgtcttaggtcccctttgtccaagttctcagtttttagaagtctctggggatttgtaagaaattaggagtaagatgacattttgtagaacagaatggagggaggccagtctcaatcatgcggtgacatagttagacacctcaatgagatttctgtcaggatctcggaagtagatggacagaataggcccctttgctcctgttctggagactgggccctcttcaatggggacatcaaaagccttaaggcgcttcatcacctcctccaggggcgtctctgtgatcaaacaaacgtccaaggagcctggaatggggtgggctgctttgggatcaaattcctttcccacctcgtgcaggttaaatttttggtctccgaaacacagtgctttccggtcccccttgaaagtaatgacctccatgccca

SEQ ID NO: 308 - DNA, 587 bp, Rattus norvegicus
  Genbank Accession No. AA900148
  misc_feature (1)..(587): n = a or c or g or t
tttttttttttttttttgtaaaacaccaagtctatatttacatccacatataataacataactttaagctgaaatatatcataaataaagcttgtctactgacaacttaagtatcaacaattaaaataaatcaaactggaatgaaataaatacgttaacaaaaatgcaacgagtgtacctcctcacgcgtactgttgcctcccagggaaagacacacagccagtagtatcccagagttaatactgatgaccagacacacggaagcacaaagggctgtttaaagaaaaaacctggaattcccattaacgcattcagaaaatgtacctagaggaatctgaaagccccgacatttcagcatttcacacagacttgttttctaatagatttggtgattatttctttaaatacaggttttaacttttggccccgactgtataacccctccagattcacatgtacggtctctgaaagcgagcctcctcttacactcactgcattcagacaaagatggagtcatcaccctgcaaatgtgttaatcttcaaaaaataggctatgaaagtgcagacctaaaanaacagtctagatt

SEQ ID NO: 309 - DNA, 386 bp, Rattus norvegicus
  Genbank Accession No. AA900247
tttttttttttttttttcaacatataaccacgcctgactggcttgttttattgaggggggacatgggtaagaacaagtaagacagttgggaccttaggttgggaagaataccctcccctccccgtatgcacccactgccccaaataaaaaataaccaactatagggaagcagctgagacagtgacggggaggctgggaatgggcagggaaggatattcggaattgggggcagcagtgaaaagaccatgcgtgtgctgggagggcccgaggtggcactggatgagtctgtcttccttgtaggcatgtataaatataaagataagcctttcttctcccccctctgcccagtactgcttgccaccgtcccagctcgcctttcctcatcg

SEQ ID NO: 310 - DNA, 493 bp, Rattus norvegicus
  Genbank Accession No. AA900290
tttttttttttttttttgtttgtaagttcgtttattaatattaggtaatattcagaactcagacattaagctatttaccatcttaccacactggtcagttattttgtttggaagaggcttcaacaattggaagagaactccaggttatctttttgactcttacatttttttttagaaaatttgaacccaatcatctggctgtcttcgggatttttttcgagagagggtcttgatatacagcccaagctggcctccaagacagacttccttgtctcagctgagtgttgggatcacacctggcatcttgataggatgtctcactaatattcttagcagctgttctcaagctacttgtaaaaagcacattgcagaagaagtgatggagtaatcttcacatctaccaatgtcatcacaacagaaaaggcacaaatacccgacagtgactacagtggaaactagaaccgaacgctacagaatctctgaaacacaatga

SEQ ID NO: 311 - DNA, 383 bp, Rattus norvegicus
  Genbank Accession No. AA900465
tttttttttttttttttgtcagtggacaccatttattgagcacctgtagagtgctccatcctgtacaaaggattagggaggaagggaagacatataatggataaggggccatgttgttcagagccttaaagatctgtggctcctcctgggtggtgagaaaaggaaaaaagaactggggacaccctcccccacgccagatgttagctatcagatgaacttgtcccttatcacacttttccctcctggagaggggtcacagaagtggggaaggatcgttggcagcctagtgactagcctggaaccctacactggctagatgtggatctgaaagtctgcctccctgttggtatggattacatgtaagttggtgccctggtatggga

SEQ ID NO: 312 - DNA, 423 bp, Rattus norvegicus
  Genbank Accession No. AA900562
tttttttttttttttttatgtaagcctttttcttttaatttcttttctgcttcaacattcccctttccctctgcacccaattacccagaaaagccaggactgggcacttaaacaagagaccttaaaaagccaaggcaagccagcccaagatcagcaggctccctccaacaggccccagagtctggatgctagtgtctccactcagagcctggtagtaaaagctggtgcagaataaggtagttccagaagctagcagcaaccctgcccagacaggttttctgcaatagggtacccctaacagggccaggctgtgcaaaaagtggtgtttgttggccttgtcaaagagctccttcccgtaggcatccggaaactgtgcgccgtgtgccccgtaggtggccaaactcaaggccccagctccggaca

SEQ ID NO: 313 - DNA, 534 bp, Rattus norvegicus
  Genbank Accession No. AA900863
tttttttttttttttttgcctcaaaaagtgacatttattcaaagagagagagagagagaaaaaaaaaacaaaacaaaaaaacaaaaacaagatgtccatcccttggctcccttccctcccccctccagctgttcctcagccctgcccccaggactgaaccctgggctagggccaggtagcaggacagcccctcaaatgaggtcagcaacgttgaggggcatctcttcaatggaggtgttgtagaaagtctcaatgtctcgaagagtcctcttgtcttcttctgtcaccatgttaatagccacacctttccggccaaaccgaccacctcgaccaattctgtggatgtagttttccctgttggtgggaaggtcataattgatgactagggagacctgctgcacatcaatgcctctggccaacaggtcagtggtaattaatactctgctatagccagaccggaactccctcatgatcacgtctcgttccttttggtccatatctccatgcatggcagaaactgttaaatcccgggca

SEQ ID NO: 314 - DNA, 442 bp, Rattus norvegicus
  Genbank Accession No. AA900901
tttttttttttttttttggggatctgttatctttttatttaatacttctatttcaatagcttcctcttttttttttcctccccattagaagaaacgtagaaataaagacgggcaaagaatggcctagaaattcagtgcagaaacacggtcggtcacatggatacgatgggacacagacaaaccactccgggaggacagattttgaaaatgagctcaaagtgccagagggagggacagggacgcctgtgaccccagcttcaagggcctcacacctcaccattaggcgagagtcaacactgatatgcagggacacaggctccctaggctgaaggggtgaggggggacagtgctgtgttcagttgagagctccccactggtctaaaacaagacttgctggcaggggtttgaactgtgttaggttacccaggctagtattccaagg

SEQ ID NO: 315 - DNA, 479 bp, Rattus norvegicus
  Genbank Accession No. AA901017
tttttttttttttttttccaataaaaagctttttttgtttcactttacaattctccaattaaaaaacttccacagaactcccaactacagaaagtcctaatggtacatatgaccacaattgtgtagcttctgtttcttactcggtaatgattgcttctacacagaaacttgattctaaagtctgtggcaagtctggatcttctttttaggtttagtaaagcaaagaagacaagtcaagagctcaagtatttggaaggtgtggcggatgctctctcttctgagtctgttggccatgagacgtggatatggtaaggcttcagatcttcaggagacacagtgtctggagcattgctcataaggtcatgtcctcggtaggatttagggaaggctatgacatctctgatgctgggtgctcccgtgacaagacacaccagtctgtctaaccctaaggcaattcctccatgtgggggtgccccata

SEQ ID NO: 316 - DNA, 414 bp, Rattus norvegicus
  Genbank Accession No. AA901155
tttttttttttttttttccatgccaactgtaaattgggcagtgttttattttcctttacagtttaataaatacttcctgatgactgcacatggggtaaggctgattggtagttcagaaggatcacagcgatggtgttttcctgacactgtagtcttccgtagtgagtggagtgacttgtatgatgtcactgtcaaaccagctgtcaaaccagcaagactgcatttatgcacccatcattttcaggattgttggtaacttgagcatactttccccaaatgaccttgcctccttgtgtcacaaggcccagctcgcttacattcacttcaatgactgtccctttggtgatcacacccagggttgtatataacggggaggaggggttctttttcacaccgagtataggcaggcaaaag

SEQ ID NO: 317 - DNA, 580 bp, Rattus norvegicus
  Genbank Accession No. AA901338
ttttttttttttttgttactttgtttttagctaaatttaacgagcagtttattgtagaaaagaaaaccgaaggacagatcaaattgaaagaattactgttataataactttaatttatcttgcattttacagaagtctatgaacgattttaagaagcacctccttactccatcacgtttctctgacagttgttaaagtaggcaacgagtatatcaacagcttgaataccggtatcttgcaaggatttcagaacaatcactcgccaaagaacttggcagtttctatcttgtttttaactcaatggtacatccactctgatggtaacctgtccagccaaatctccaccacattttgaaaaaatcaatggtgattagcaaattagttagctttggcacggagctgtgctcgcttgcctgtgacagcctggaagccagttttgatactggccacagagcatcgagaatgacaagtttcacactgtaagaaatagagtcgggtgtccttctgtaagattgtgtccggtgaccggcatgtgtgacaagtgacgtattccttgatatatcttctcaagacgttttct

SEQ ID NO: 318 - DNA, 522 bp, Rattus norvegicus
  Genbank Accession No. AA923982
tttttttttttttttttacatcagacattctttatataaacagtccagtctgagcagcagaatcaaatgcagagcgaatgctttcaaaggtatgtgtgcctatgtggtgattacattctccacacatttaaaagaaagggacactaggagagaccacagtataataaagaattacagcacattaatacccgaagccattcaccaaggtcttgctcatattggcaactgaaacttcacatccacgtgggcttctttggctaaggtcacgatttcagagagctttacaaccattttagcagcttcatccaaatcatcgcaagcaagaattttaagaccactgtctgcaattagtgccttagcatcatcaactcgtgtaccttgtaaccgtaccacaacaggtattctaatttctagatcttttactgccatgactattccttgtgcaataatatcacatctcatgattcctccaaagatgttgaccagaatagcctgcacccttttatctgaagtgatcagttt

SEQ ID NO: 319 - DNA, 444 bp, Rattus norvegicus
  Genbank Accession No. AA923999
tttttttttttttttgtgattttagcatttattactaagttgtaaaacgtttcctatgaaagctctctaagcaaaagggggaaaacagaatgaatgaaaaagggggataagggaaaatatttcgctctcctctctttgtcctcagcacttatacatctttcagaatagaagaacgcatgttaaagggttgagcacaagtttacacagaaatttaaatcagacattgaataaaaagctaacatcagtgaatgtttacatgcatattattaggagaaattacctggctaaacgttcatcacctgtctcagcttccacaggttcatcaagattttaaaaccgagtaactaagttattggtgaagttttgtatggataagctcaggcaatatcttatcttctgtcttaaaataagtcattagttccttttgatgacctttggtgaacg

SEQ ID NO: 320 - DNA, 518 bp, Rattus norvegicus
  Genbank Accession No. AA924188
tttttttttttttttttcctgtatgcaggtgccatttattgtagaaaataataattacagctgtgagcagaccttaaattacaaaacaagaaaccacacagaaggcaagggagtccacgaggctccctggtgcaatgccatcagacccccgtaccttccacagactggccagcgtccttgaaatggacaacggtagggaattcagaggggcccacccagggtccttctgaagagggagggggtatacagagatcagaacatttagcaagaccgtatgggaaaggggtggggacaccctgggctgcttctgggtccccagccctagcactccccaaaccagtttaaaccacctccacccttccctcaaacctgtccagccactccacagaacttcattacgagggtaggtgggtgggtaaggccccagtcattgctaatcaccgggaggagtccatggcacaacccatcagctctcataggccccttcagtcagtcatcctcgacaccaagactccagg

SEQ ID NO: 321 - DNA, 458 bp, Rattus norvegicus
  Genbank Accession No. AA924210
tttttttttttttttttagaatacaaaataaggagctctttattattatttatacaaaactggtacattaaaaaaaaattaagattcaacaactctgctgaccccctgaggaagctaagagcttttatgggtccaccaaaggagcccataaatgattcagtcacccaactcctggccacaggaacaaggcacacagctccagggccattcatgtggctccatcactggctctgtaggctgacttcccttcattaggctcggcaagcaagccaggctttcccggaccaatgctcctgagcgaggtcttctctggcccaagctagagcattttatccgtgtaaaagctgagtacttttatttcttaaacacttccaataaactcctagcattagacactttattacaacatatacagatttgatagtttaccaagaaatctagaattcagctaaatcctc

SEQ ID NO: 322 - DNA, 441 bp, Rattus norvegicus
  Genbank Accession No. AA924301
tttttttttttttatttaaataaaatagttttatttatattaaatgacttttaaaatgataaaacacttaatagatactaaataaatagaactggctgtaaatctaagttctctgatgataaccatacaaggatccgcctgggctgattagtttgggagatgatctggaggttggtaggactctccttcatcctcaatgtaaactgtgcctctggtttccaaagttccccttgtttctccaaacgttgtatgtctagaaacatgttttaagaaacaaactggagaattgtatgggtttagagtgcagttgagaagagaatgagggttgttttgtttaaagtacagaacaagaaacttccactgcttaactgattatccagaagtgaaaaagaaactgagctaaaggttgtgctggtggcggagaaagggagcaacaaagat

SEQ ID NO: 323 - DNA, 355 bp, Rattus norvegicus
  Genbank Accession No. AA924405
tttttttttttttttctggttttgcgtttttattggggtttatcatgggcaggaggaactgccaccataaagtatgcccctcccaccaagcaggtccattctaatcctcctcccgggccttctgcgactttttctttttctttgtgctgctctttgtgcagcttgcagcagcctcaggctcctcagaaaatttccttttcttcttaggggtgatggggcttgctgcctcttcaggttcactggccacttcctctttaggtaaggacttctttttcttaggaacacttatgctgctagtagccatctcttcaagatcactggccaactcctccttgggaaaagctttctttttcct

SEQ ID NO: 324 - DNA, 365 bp, Rattus norvegicus
  Genbank Accession No. AA924428
tttttttttttttttttgtcttcaaaataaaaatttattcaatctgtaacaagaacattgaatctgcacatctgcgcacaagttcacatttaaaaacagcggagcacatcagtactaataaaaacaactatgatacaagtgggacatcccaacaccaggattaaggaaggagatgagaccactctttaggttctgcttcaaatgcctcagaaaggtcccagagattccagggagcacctgctgttaataaagtgagagcatagagaagtttgggatagcctggtcgaaggtaacagtcagtgcgagtcctttggacttgtttgggtttcaagcaagtcttacaaagcaaagttcaaaagggggtg

SEQ ID NO: 325 - DNA, 464 bp, Rattus norvegicus
  Genbank Accession No. AA924432
tttttttttttttttttcaatagtaacctcgtttatttgaaaaggagaggatgcagagactaaaacatccatgtggagccctgccactcagccccagggaagattggccagtggtttctcctgcctccaatgccccgaagctagtggaactgggttttgatgggcacccacttctcacaactgctgagaagctatgacttgtgggttctcatagcagtgagccactttgctggtcatatgggagttgctgtaggccttgaaggggcaacaaccagtcaccaggcggtcccagggctccagagaatggagccaaagtggcagccaggcccaggattgaagacggcgaggcaaccaagatggtcggtgtcgttgcaggacattaaccaggatgataaggagtaccagccccaccagaggaccccccactgcagccagcactgaacccccagccagggaaagtccaa

SEQ ID NO: 326 - DNA, 467 bp, Rattus norvegicus
  Genbank Accession No. AA924598
  misc_feature (1)..(467): n = a or c or g or t
tttttttttttgggggctctccaaaagcacgtggtttattatggtgagctgtagtgcacatcggtttctttagtaattctaagctgatacaggttccccactaggagtacacatggggagtgactgggcgcgcggtgacagtgacaaaccagtgagccactgtgatccatagaaagttacattagcaatcaggagagaaagggaagtgtgaggtggcccagaggcaggatgtgagcagagcacctccactgctctcatggtggtccacaggatacccagaagctgagggggccttggtggagggaggctgtccccctatctctaaggaactgggacttagtggttgagacgctccactgcctgcaggtggcaccttttcctcaaaagctcatcaggcactaagtccatggttgttgcanaaggtgctctgttctttcaggtactcggttctggttcctcccctcctt

SEQ ID NO: 327 - DNA, 527 bp, Rattus norvegicus
  Genbank Accession No. AA924630
tttttttttttttttttcaccgtgtcagaaactgtttaatgttagaattacaggcttttggcaagtatatggcaagcccatctgtccgttcccatgtccactgagaacacagcagagggggcatgccccaagctctggcctcagtccagacttcagcttgggtttgtccagcgagatgtctccagtccatgaaagcccatctggctacagcttgagttcactgggcattggctcccctcttaggccagccagcaagttgttagccgccagcaaggacatggtgttgcgagttttgtaggtggcactgccgatgtggggcaggatcacgcagttcttgagggtcagcagggggtggcttggaggcagtggttctggggtggtcacatccagtcctgctgctgcaatctgaccactggctaatgcctggtacaggtcttcctggtttaccacatctcctctgctgatgttgatgaagacagcagtgttcttcatcttctggaagaagtccttgttgcagagccccctgg

SEQ ID NO: 328 - DNA, 487 bp, Rattus norvegicus
  Genbank Accession No. AA924766
tttttttttttttttttaaaagtaagaaaagctttatcaaaaagtttaaatatataaaatcaagccagaggtatacaattgaggcagcttcctagcagtacaccgaggagctaggtgtcctgactcgattacacacaaattaacagcacagtactatacaaggacgagtagccctagtgggttgccaccaggcctcaccggctgatgtttcccaactctgaggcccaccaaagatcactcctgtcatactaagggccagctctaggaaagtcccagaactgtgaacagagtgtgctagtggccacaggagagatgattttggtacgccagtccccgctcgcaccccaccatgtggtccacgggatctttacaaaccattagttgtttttgtctatgcccaagacaccgttgttaacgggaaagtcacctgatgcaaaagtgagcatgccacgaggggttggcttgagactcaataattccacttaca

SEQ ID NO: 329 - DNA, 520 bp, Rattus norvegicus
  Genbank Accession No. AA924794
tttttttttttttttttcgtgggagtgttgttttaatacagtctgtgccaagcaacatcataatctccaagtttctcctatctttaataggcaatattcagaatttaaaaaaaaaacaataacaacactgcagtcataaaacaggccagcgacacttttgaggagacttaaaaatgagaagccatgaattatcttctttgaaaagcagccatttcaaaaggttttctttaatatcataaaatattctcatggacaagtgagcgagcaaacacacatgcaccagtgtgcctctgacaagagtacccacctaccccacccccaagtggacatgaaattagagaaatgaacacagcagatggaacaggtagaaggaaaaaaattcagtaaaaagaatggaatataactttgtgcttggttattttcctatgtcacaacaaaaacatttcggtgcaaataattaatttttcctcttttccatttaagactggtggagaaaaaaatacttttctataataaaata

SEQ ID NO: 330 - DNA, 402 bp, Rattus norvegicus
  Genbank Accession No. AA924813
tttttttttttttttttcattattattatttgtttattttacaatcagtatgccatcttttaccactatggctttaaattttcattctacccaacaggtgtcaaggaatagttaagtccatgccttaataaaacagttaaaatatttacagattcaaaatagatgttttcataactgaaaagttcacctgagagttcactgtaacggtgccgttggcttctctcttttctttccaagttgttagcatggctgagggccctcacgccatctccactatccgtgtcctagatgttgaattcctcacttaaaattggctaagcatcaagctacagtaaattgttctaaagtttgcaggtggacaaccaatgtcatatccatgtttactcttaatataagcaattt

SEQ ID NO: 331 - DNA, 497 bp, Rattus norvegicus
  Genbank Accession No. AA924902
tttttttttttttttttcaagttttaaaaatcactttattaggttgaatagttagagtggtgagaactgaatgtcaacactgcttacactgaagtgcagaattgaacttcactaggggagattgaatacacatagagacaactcaagatcttcctgggtttgtacatgttaacaaattaccaaggtaaggccatatctgagaatctagctggtccctgaatggccccaggttcccctaataattagttatgctatcatttaagtcttacagatattgatcatttagttcctactgtatgtttcaggagaattttaggagatggttaattattcgggtcaatttaattattcaaaatttgtgcttgagtgctgttaaatatacttgttcagccattcgatgagattcctcctcgcttcctcaatgtagggtttgtctgcaggggagcagtcttctctcttccgatgcacaaagccatgagtttgcccagaaaatgtct

SEQ ID NO: 332 - DNA, 413 bp, Rattus norvegicus
  Genbank Accession No. AA924964
tttttttttttttttgtgttggtactaagacatttattatatcataaaaagtccaatgttatttttccatatgtacatgctcctgtgggcagaccccccatcgagtcctacctgtccaccctccatggtgccaagcgactccaaactgaccaactatttaatgaaggaagaagaactggaggcagtggcccaggactgatggactggatagggagaggaacaaagtgcagagaggtcgggcttggctcctaatgcccaacctggcagggggcacatggcaggcactgcagggttggcacagcagggttggctctatgcctccccagggctgccaggccagaggcagagggtacaggttcagcctgcatccactctcagcttggaagttcaggactgaaccgcagaggaagaac

SEQ ID NO: 333 - DNA, 448 bp, Rattus norvegicus
  Genbank Accession No. AA925019
tttttttttttttttttagtacaaacaccccagcacatggcagcatatggcaagctgtcagtgaggtgctaatttattggatcgggatgaggaagtctcctctgttcaagaggatggggacagtcctggctaccctgacagtgagatatgcagggtctctggccagatgaaggtccaaatgggaagacacctgtcaatcagtcatgggagtgccacacaggcctggctgtaggtacaggaaccatacagacagctggggcaggtcccctgcacattcatcatgaactatacaagatgaggctgtacatgagttaattacaaaagtcattatttacaaaaatctgtacacacatttgaaaaactcacaaaattgtcatctatgtatcacaagttgctacaccaaaatattaaaaatgggataaaattatatgtttctcttctcaattct

SEQ ID NO: 334 - DNA, 455 bp, Rattus norvegicus
  Genbank Accession No. AA925026
tttttttttttttctttataaaaattagtttatttttaattgtgcgagtgtttgcgaatcatgtgtgtatgacctcagaggacctcctgccgctgtaagcgctggtgctctggaagtctcttaattgctaggccacctttccggttccatgtcaaaggaattcttttctcccagaacaatggtgcgttatgagtgaagaacagaagccaagtgtggtgatgcgtgtctttaaaagatacatttgggaggctgaggccagcatgggccatacagtgaggcttccctctaggctagagcatagaccatccatgcctgtttaatggagattctaccctagcagctagctgtgtgaccttaggaagctcgcatgccctctctgagtatctctacttccccactgcagcactgttgtgtgaccaaaaaaagagttggtccaagtagagctgacacgtgac

SEQ ID NO: 335 - DNA, 118 bp, Rattus norvegicus
  Genbank Accession No. AA925049
tttttttttttttttatcagtcttataaacaaaactttattaaatggtacagaagatcctgtgggagataggaccaccaaccgtgcctgtccagaacaaaagttggctgacccacacc

SEQ ID NO: 336 - DNA, 487 bp, Rattus norvegicus
  Genbank Accession No. AA925061
tttttttttttttttttccaaaccacgaatcgccccaagttttatttgtagtccatacaaaagagggggggaaaattaagatttctaataccacctacttggggagatagggaattgggaccatgccagtcaccgtcagctaaaacatcagtggtaagcagggatttggacacataccaactgactgtcccaacaggatctcagtctcaacaggctacacggacagtcagggtcccctggactgctggcacagcacataggaaatggttaaagtaactctttcctggcctccctcacatctaaaaagaataacgcgccgcctgacctcagctgtaggttgtgtcacctccaaacaaccttaagtatcgcgcacaaaaataaaagggagccaggaaaaaaaaaatataaaagaaattcccattttggggagatggctgggtagagggaaaaccgcagatctaaagccagtagcaagatgtgctgctga

SEQ ID NO: 337 - DNA, 502 bp, Rattus norvegicus
  Genbank Accession No. AA925087
tttttttttttttttttgcatctgattactttggtttatacaagagattcttacattgtttaaaattaatgacagagcacaaaagcacaaaagcaagtctcaaggtgcaaagaacgctctgggatcacaagaagcgaagccaaaaggttgacatttcaataattggtggattgtactttaaacacattagtaccccaagtcagttatacaatgacatatactatcacttgtagacaaagattaaagggaaaatcagtacattcacagtttcaacagaaatatatgattacatacatgattacatatatttaatttcactttacatagacacaattatattgaaattagatatggttagagcataagtcattaaataatgattttacttgtattacataataaattttacaacaagaggattatgtatttcaatatggcatatataggttttggatcacaaaaagcaaaaatatggtaaaataatagagttaggagtgtcaca

SEQ ID NO: 338 - DNA, 469 bp, Rattus norvegicus
  Genbank Accession No. AA925126
tttttttttttttttttgatttgaaagaacaaagacacggctttatttttccaagtctgaaaacctagcagcaaaatgaacttgcatatcatgtacttcagtgagcatctgatcagaaaagactcacaaagtcttgagagactactatacaaaccaggatggactccattaggataaatgatttgaaggtgtccagaagagcttcacaaggacgactggacactctcacctgcatcaagggttcatgagaagacttaagcaaaaccgtgctctggataactgactctgattgcaccccagtaacaagctcggataaggcaaatcaaacctaacagataagcaattgcccaagacacataagttgcatgaaatcgccttgaaaaatcttgtgtgccaacagttaacccaactccaatgaaaatacatatcattccgatggtgacgtatgcacagcagcgtctccggggaa

SEQ ID NO: 339 - DNA, 505 bp, Rattus norvegicus
  Genbank Accession No. AA925145
tttttttttttttttttgacaagcaacacactattttttttaaatcaatgttccaaagaaatcaaaatttagaaaaggaaaattattcgcaatttcactaatggttactcactaatttgttacattgtagcaaaaaacaaaagtagggcgcagcatacaaaccaaacatgaatgtggaaagtgctagaacaagatgaacttgatctctgacttctagaaaggtcttccaaggttcatgcattttacttgaatcagcaagtgtttccctgagcgttggtgattatgtttgtcgtaatgctaactagagaggaaggtaagaagcacgttctatggtccttggccatcagtagtttatgatctagctatgcctggttataaagatgcacttactaattctaagaccttaaagcgataatcgcctttgaaagccaagcatcatgactgttcaataatcctgccgtcactcgcaacagctttggcgtctcctctactgagactgtaactc

SEQ ID NO: 340 - DNA, 495 bp, Rattus norvegicus
  Genbank Accession No. AA925150
tttttttttttttttttaagatgtgtaagcacattcagacctttatttttatttttttatttatttttattatttttaccattttgacagtttctttttctcaaaggtgatttgaacatgttcacctgtacactttggattcattttttaaccactgtttctctgtggttttttttccacacttgttttcctctcttaagtcaatcttttctctacagcagacaattatacaccttattcctattaaagaagttttttggtgttctgatgagcatttctagtgaaaactagtttttctagaggtgagaacactgaaacacaatacttttgttgcaaatgcaagggataaatttagagttacctggtatcacaatttcaaacaaaaccaaatgatgccattgttctgtgtcaaagcaaaagaagaactttaataagcttttacaccactgcaaatacaggaacagtaacccatgacatgcaacaaaagtaattttg

SEQ ID NO: 341 - DNA, 527 bp, Rattus norvegicus
  Genbank Accession No. AA925167
  misc_feature (1)..(527): n = a or c or g or t
tttttttttttttttttgaaagagctcttacatgtgtttattaaaccaaggaccagtcacggggtgggctgggctgggctagtgtgagaagacagagctctcactgacttttgagcatcccagggaccagccccaatgcccacatggttactgatagccaactggcttcttcccaagatccccagcccacacccagaacagagtcttacaaaagcgaacaaatacatttatcttcctttccatcccctggccagcagaggtgggggttaaacagttcattttaaaaaagacaacgactcataaaatgaaaacagaagaaagaatccagagctggagagctgagatgtggccctggcggggagcacaatgtgcatgggagaccctttctgccatactcttggagggggaagcgggtctttgggctccggcccatggacaccaagcccacgagtcccttggagctcatggccacatggtcacaactgcattgacttcttanaaaagcatcttaagactgtgtccctgng

SEQ ID NO: 342 - DNA, 479 bp, Rattus norvegicus
  Genbank Accession No. AA925318
tttttttttttttttctggttgtcaggtctgaaattttattaaattggaaactatattaatattagatcttaagtcaggcagggttggggtcatcaggaagaggtttggctgctggggaaggaggtggctggttttggctcctgcgactgtgaaccacgatgtcatcatattcatcgccttcatctctgttgtcactgtcgctgtcactgctgctgttgctgcaagggctaagcttatcatcctcatcctcgggctcaggttgggttgggttgggggtccgtggcaacaggggcatggctggtgtctggggtgtggtcctggctctgagtgaggtaggtatctgaggcatctcttgggtggctgggacggggctgaagcagtacatatgcacacgtgtgtgccctcacacggcaggccaagtgcagtgctgtgtggccccctctctcagtcaccaacactcctgcgccagctgcataga

SEQ ID NO: 343 - DNA, 511 bp, Rattus norvegicus
  Genbank Accession No. AA925353
tttttttttttttttttaaagcttgcagctgttttattggcccttcttccaagtcacacacaagcaatgacacaggcacagtgggaacatctctcggccctctcagccctgtagccccatctacaccacaagcaggagcaaattcctagcaacccctagaaccccgagcaatgggaaagtgggcagagacacctggactgaccctccttgctgccaccatgggacacaagactctggctggctcttcacaccccatgggctagcctgcccccaactaggcagccatagtgacagacatagtgacagacaactgcccacagggcagccaattccaagcctgccaccccctgagcgtagccctgagcaaacaggctggaacaacctggctgttgggatgtcatggtgataaccagaccttaaatccgccagtggctaaagtgaccctggcaggaacctccccattgtgtggctatggggaacacttgactgaagataaggacagcttgcctca

SEQ ID NO: 344 - DNA, 424 bp, Rattus norvegicus
  Genbank Accession No. AA925418
tttttttttttttttttccagatgttcaagtttattatacagtcacaagttacacattggaaaccaagcagagcatggaacctgcttttactaactcaaaacaagctagccaatgacaggtttcagaagagactcgttttatgtctcacccaatgtgggcgatcacaagagaagccaaaaaaaaaaaaatatcttccatgttacttagagagcaaagtaatttgatacacacagcttccaagttatcttaatatactgaagatggcttaaaactggtagggaatagtttgtcttccacctaaaataaaatgcagattggatggtttagaggtaaaacaaacaacaaaaaaccaaaacgaatcaaaaaaagcaaaaaacaaaaaaacttcacctgtatatctacaactacagcagaattgttctt

SEQ ID NO: 345 - DNA, 472 bp, Rattus norvegicus
  Genbank Accession No. AA925539
tttttttttttttttttgtccgttcccgggccagagacaaacttttattgcaaaatggggacacaaagaggtcagatatggcttctgtcctgataaggagggctggaaacatccaacagcactcccctgctccatccctgtttgaccagttagtccttccaggggaggggtacatttccagcactcccatgaggacttgtaggcagcctgagatcagaatgtgtttgagagcaggcccctgataatgcaattatgtaaaacacgactgggaattttttcctctgggtctgtggtccctgtctgtacaaggtctgtgagcgcagttacagaccaggaaacagttatattggggaaatttgctggaaggagcatgtttgaggggcaagggtgtggaagcggcgggggaatagtttgtcgtcacggtgtgtctcagtgggaagacgtttggaagagccaagatgttgtcgtgtaa

SEQ ID NO: 346 - DNA, 598 bp, Rattus norvegicus
  Genbank Accession No. AA925541
  misc_feature (1)..(598): n = a or c or g or t
ttttttttttttattttccaaacaattttattgaaatgtgccaagatacatgggcagcacaaatgtatgaacaggaaaaaaagaatcacacatacagttattttaaaaagtgaaggttaatcttgggagataccagttcccctccccccctccagagttccagcatttgttgtggttaagcctctactgacctagcatttaaatggaaaaaaagaactgcaaaaataaagacaaaacaaagaaaccaacagcataaaggaaagaaacatcttcctgctcggatggagtcttccttcccagcatctaattaggaggcgtgctgtgcggtggagaagcacaacttcagagtgtatggatacgggccatttgggtttttcatctggtaatggttcaggaagcccaaggtctccagggcgtcattcttggagtcncactccagcagcccagaggagctacgctcgcttttgcctgaaaatactttcacagaggttggccgcttcactcccagttcatcgcagatctcaaagaagttctcctcagtcacctccaagggagcattgaagaagtgcagaacattgctaaggtgctggatgcggtt

SEQ ID NO: 347 - DNA, 621 bp, Rattus norvegicus
  Genbank Accession No. AA925554
  misc_feature (1)..(621): n = a or c or g or t
tttttttttttttttttcaagtttcagaaagggtttatttgacttacaattactggttaaagtccttcatttcaaggaagtcagggcaggaacttgaagcaactagttatactcatgaataaatgcatgcatggagagtgctcagcttgttcttatacattccagattcctttgtgtagagaatggtggtgcccacagtgggcggtcttcccttcacaattaacataatcaagccaatccctctaagacatgcccagggaccaagctaactgacacaatcctgcactgagaccctcttcctaggtgatgctagattgtgtcaagttgacaaagctagccagcacatactccatcaaatatacgtagaaatatgcaaatacctctcccctaaacaaggcactggcttgatacttaccatatccaaactttgcttcaaattattaaggacctgccctacttctctattttccatttacattttaacattccttaaagtctagtttagtatatggcacagagaatatacaanacaatacttgaaaaccacaactgcttcagctagacaggggaagaaaattgtatttgatatttcagaccaatagataggactaaactcaaata

SEQ ID NO: 348 - DNA, 408 bp, Rattus norvegicus
  Genbank Accession No. AA925662
tttttatttttttttttgttcaaaaatagaaatttattaaggtgtgtttgtttttaattcccaaagcttcttaaaaccgtcttttcattgagcccatgaggtacttgaacgtagacattatacagtatgtagcagtgattgtcgtgtgtatgtgtgtgtgtatgtttcactgtgtatctcaggctgacctggaactctctctggcctcaaagttacaatcgcctgcctccacctcccagatactggagattacaggtctatgccccattcctgtctcttttctctgtaaagtgaaaaggctcaaatatctgaagtccacttaacccctgacacgacctagctttggtttgactattattgcacccccagtcagtacccagcccccagcacacccctgttgagtcagta

SEQ ID NO: 349 - DNA, 379 bp, Rattus norvegicus
  Genbank Accession No. AA925844
  misc_feature (1)..(379): n = a or c or g or t
tttttttttttttttttaaggatcatgacgctaccatttattggagaaaagaaaaaggagaagatagccatgtaagggagaggtagctctctccagcaacactctttctctttgaaaggagtcaaaagagaacatgaaccagagcctcaagacagaaaaggcagtactcaagaatatatattttgaatataaaaattcagttatacaatcagtagcattcanaatcaactacacctacacaattataaaaattgtttgtgtttttttttaacaatgtgttttaaaagctcactgtattggaacagatacagtgttctgaaggcatataaacccaccacggtcatttggatttggctttgctgctgggaagtgtgcccag

SEQ ID NO: 350 - DNA, 557 bp, Rattus norvegicus
  Genbank Accession No. AA925863
tttttttttttttttttcattccaaattttgttttaatgaagtaatgcaaatcatttaaagaaagaaatatttaattttaaattctgatttatgcataaaactcattttgtatcacagttaaatttagtacaaactatgaaaacgttaacaccgaggtttcaacagaaagtcggttaagatcccttagaaaattacttaaaggaaacaacagctagtcagttactgctctgatgttaatacataaagaaaatttcacacactttactgaaattttcagtaaataagtttagccataatacttgtaaaattaaaaacttcgaaagctgcgtgtggctctgagcaattacagtctgcaatgaaaatcctaagccaaaactttttgctcaacagaacaatccgagctttggaaaagctggttgaatttgcaaaccttcagaataccaattatgaacagagtagctgtgttataactgagcttaaattaactccaagacagcacacacacttcccaggccgcactgcagagagtgtggaagggaaacattgagccagaact

SEQ ID NO: 351 - DNA, 458 bp, Rattus norvegicus
  Genbank Accession No. AA926051
ttttttttttttttgttatatctagatgtagagtttaattttgtaaaaataaagaaatatacctcatttttcagacagtcagtgttcgtggacaattaagcagaaaaagctcctttgcacagtaactcacatcaacataaaaagttcaaaatagattgtctaagagaaagagcctttctttgctatgattgacggtaattagaattatccattatatggccatgaaaccttatcatggtgctatttcaaacacagttctaggacaacttggcacgcagaattaaagttatcaaccatctatagctctttacctcctagcagacactctcactcagagtctcgtatatacatacattaatattaaaaaacgcacagcgctatagagcaaaagtttgtcctaaaattatatctctacaacaaaagcagaatggggtgtacacatgtgtatgtatctgtat

SEQ ID NO: 352 - DNA, 558 bp, Rattus norvegicus
  Genbank Accession No. AA926080
tttttttttttttttttaactgttcaattctttattagtgtacatgtcattagagttggcattcaactactaatacaaagatagatacctacagtaactcaatcaaagcaaatgagattaatgagccctgatcaaaagaaatacatacaacttaaagatgaaactgtaaaagttacatacacatataactaatagcactaggaatgtacagtatcagtaattggaaaaataaatgagtaattcacagtcatagaaattattttaatattactatgtacttttccttttacagacaaatgtgacatacacacagttctacctcacacaagacagagtagaaaactaagcattacttcatttaccccaaacacagcactaactgtgccacaggtaacctggtccaaaatagtcaattctacagataggccatggtatgaaatacatggccactttaacggtttcaagaaaggcatatacttgcagaagtccgttaattacacaaatatcagttgtataaataacaaaagccatcagcaaaactgttaagctcaaatgttc

SEQ ID NO: 353 - DNA, 314 bp, Rattus norvegicus
  Genbank Accession No. AA926129
tttttttttttttttttgatataataagtatatttgagaagccagagctctggggatgacacgtatctcacacaggagacagaggagtcaaccccgagcccaattaggggaagggatttatagggaaaactacatggcctcagttcaactctaggccaccctgcttctggggcaagctgaccctagttcttgttttcctcagaactgttgtgtcaggccttatcgaggccagatggtttgtggtggctatagccaggctacctcaccaaaacatgtgatgctattcttttgggaggtgcacttgtcctcacagc

SEQ ID NO: 354 - DNA, 362 bp, Rattus norvegicus
  Genbank Accession No. AA926196
tttttttttttttttttaaaaaaataactgtttcctgggacctctcccctatcttcccagtgtggtcagcctgagaaccctgctctgatgtttcacccagagaagccaaggcagggtcctgggtagggtagttaggaaagaagggtaaggaaagggaggaggtgagtctctgaaattccccctaccctcacttctaacacagatgggagcactctccgactcctaacacagatgggagcactctccgactcctaacacagatgggagcactctccgactcctaacacagatgggagcactctccgactcctaacacagatgggagcactctccaacttctaacacagatgggagcactctcc

SEQ ID NO: 355 - DNA, 493 bp, Rattus norvegicus
  Genbank Accession No. AA926247
tttttttttttttttttgcaatctgccatgattttattgatttcagcttctaaacgtagaattctcagattaacctgacataatttgttcgggagagagggacactgccattgtgctttagtgtgaggtgggtagaaccggtggtgtgccctccgggcctgtgaggtgggtagacctggtagcatgccttccataccaaatagattcaccttctcaccaaccctcttcctcacttgtctggtcctacgccgtcgcaagagagtagaaatgtatataggaacagaaaatcatcctgattttctcttgagtttgttatgcttcctagcttgttgtggcaattctgggttctttagtataaagagaaatcaaaaaggaaaaaaaaaactcttatcttggcttaagaagtccagggatatctggtagcctacacatatgcacagaatataaacatatttatatgttctatgtacacagtggatggtgacctattcat

SEQ ID NO: 356 - DNA, 421 bp, Rattus norvegicus
  Genbank Accession No. AA926262
tttttttttttttttttaccttatagcttgcatatttattgaacaaatacgactaaaatagctaaaatacattgggtacttatggaaggaccacatgttacaaaagcctgcgttttcagcagcgtacaactgcaactctacgtaaatgccacaaatgcacaataccgtttccttgctctatttacatagctgatatatctaccctaacagaggtgggtcaattacagttttgtgattgctcccgctaccgtgactgcacatccacccagggccagtcacgagaggacagcctctcacactcttggtagcatccgctcagcctacaacactgaagaagaaagccacactcaagacacaaggaaaacaagtcagtccagtctagagaagaacattccgggaaacagagtaccaacaccttctt

SEQ ID NO: 357 - DNA, 423 bp, Rattus norvegicus
  Genbank Accession No. AA926316
tttttttttttttttttgggccaatcacaactcacgctgttattgatcgagtgattttagtgaatacacggcagggaaagcaatgagaacaaaacacatctgggaattactattaacataagtgataacatcaaaacatctggtcaaatgtagttaaaaaaaaaaaaacaacacgaacgaaatggaatgtaaaacatcttcacagtatccaaagcttttgtataaaaggtttaggctataaagtggagtcctcacggggcaaggggggcaggggcgcggggactagggccaacagggattccacatatgtgcttaggacccgcagtgccaggtcagagcagtcagcatgccattgtgaagatgaagcttcaggtttgcttctgaagctcatcttgaaacacttccagctatgaaggtacaaca

SEQ ID NO: 358 - DNA, 512 bp, Rattus norvegicus
  Genbank Accession No. AA926365
  misc_feature (1)..(512): n = a or c or g or t
tttttttttttttttttgcacagaagatcatcatctttagacagggaacaaatggctgggaattccgcctggcccgagctcgcggctcctcagggccaagctataacaaacataagggacacaaagcagggaatcatcagatttggtctcggaggtaggggagggaaacagcaggaatccaaatgaggacagcctgggtgactggactgggagggaaggcacttggctcagtctcctgttcccacccgggcaagagccagttgctcctcaaccttcagtggcccagaggctgctcctggttgagcctgtggaagaagcttttgccaaactcgtaagtgctgatcatgatggcgcaggagggcgcagccttgatgatcctgnggaggaaacctgcaaagagtcccctggtgccagattcagcctggattctccgaagcaggagccaggtggagtcaactcttggcggcttcactctcatagcctccactgctcccagtgacatttgtcgctgt

SEQ ID NO: 359 - DNA, 609 bp, Rattus norvegicus
  Genbank Accession No. AA942697
aacaaatcctaactttatgtatgatatatatttaaaacaaaaaaaaaaggcgagaacgacatcaactatcgaaaagctgactcggaatgcgtcatcactcccaggcagtcttctccctcgcttgccgattctgggatcactccttccgcacagctcccaggagacccgacagtctctcgatgacttgttcggaaccgtccacaggtaagcaggtcaggcgatacacccaacggagaatggtcgagaagcaggagtcaggaggatcggtccacagatggcagatggggaaggctgggaagcgctcgcctcagttctcctccggcttgtccgccggcggcccgctgggctgcagcattttctccatcaggttgaaacgcacgcgcgctttgctctcattctcagcaatggcgaagtagttgaggaggtcgaagtgacccatgtaggagcagtaggaatcccgatgctggttcacaagccattcccacttggtggtgtcggcgtggcccgtgccgatgtacttggactgcagatgctcgagctggctgtggatggtgtaccggtccgtcatctcgccgctctgttcttaggcttcgaggtcaggccacagat

SEQ ID NO: 360 - DNA, 588 bp, Rattus norvegicus
  Genbank Accession No. AA942716
aatgaaacaaatccaaaagatgtacagtcaggctcacgttgtgcagttcacaagcatggaagaaacaaacagacagaaggacagagttccaacagaagaagctaacccaagaccaggctggacttgccgccaggggggtttctcctggatggcgctggggccggagccactgggctgggcacaggagcagcgggcaccggcttctcttccacctgtgccaggctggcttggaagtctgtgtccacattttcatgcacatcactttctcccttgaggtctaagaaatctccagagcttgcttcagaagagttacttctctgtgttccaggcgactccgaatcctccctgccacctgctgacttggcccaagatggggggttttcttcaggtgtcccaaagatgttagaagccatcttgttcttcctcacgggctgttctgttggctcatcaaaacctaatgaaaaattggacccaccacctggaggccgcaaaacccgggagctgttcctgctgttagggtctacacccttgaaggtggtggcagtggtcatggcgcaaaggggcgaggtagactggccctgaaaacgc

SEQ ID NO: 361 - DNA, 452 bp, Rattus norvegicus
  Genbank Accession No. AA942745
agtcatctctactgttcgagaatagtccggtctgcaccagtcaagcgcccccaacccaaatcctcccaacacgtggttttgttccttttttttctttctttctttctttctttctttctttctttctttcttttttttttttttaaggccttcagataaaaacgaaggatgaaattgtagggggaaaatgggcgggatgggggcgtggctgaggaatagggcgtggctaccgcagagcccattcctcagactttccgtcattttctgccagccctttgcccctgccaagagctttcctaaaccactttttaaaacctaaggtcaaaacacagccactactctctcagagaaagaagacaaggaaagggaaaaaaacaaaggtgtcctaacgtaaagcacgaaatgaagcggggagggggagtcccatcccaaagcaaaggggatgattgcaa

SEQ ID NO: 362 - DNA, 550 bp, Rattus norvegicus
  Genbank Accession No. AA942770
acaatgttccctcataatgcaagacattttggacttcacatttttaagccagaggccactcctgtctgtttctttagagtggtcactttagaaagcattgataggcggttgttgaacgttgccacggaaacacattcaagatgttggtggtcttctttgctgcctgctttgggttaaaatcaacatgaagcacacaaacagaagcatacgtacatttgcagcaaaggccgctgcaaatacaaccccaaagagaggtggggctcagcgatccatctcacagcaatgcagggagcctttgtgcctcctgcacaaaattagcacattcaggggagacgtgtgcctcacaaagggccatgtggaaagagttattcactctcatccaaaaatgaagacagtctgagggacaaaattgttcatggactctgctcccaacgctccccccattccccaaacaagccaatgctcaagacacctaccaaagccatgggcaaacttgaccatgagcaaacaatatgaatgagaacagaatgacgtaatgccgttgtgcctg

SEQ ID NO: 363 - DNA, 522 bp, Rattus norvegicus
  Genbank Accession No. AA942774
attctccacagagttcctttctacagctctacagtataaatacacagaggtgaccttctctcaccaggacaaaggggtacacctcacctgcttggtccccactgccaaaccctcactgttctgtgtggggcccatcagcagagagtcactcatgcggctcaagtgtgcgcgccaagtccatgcttgggtagaaacagctccgctgctactgatgcaagttcctgaagatctgccccaagggcggtccatggctacagaagggtcgcaggcagaagcccctcatcgttttcatcccaccctgtgctgcatgctcccaggaaccatgaaataaataaataaatactctgaaaaagctctgggggaggggcctgagccagctcatggcttaagaagaggtgcagcgcccccttggcagagaagagggaacataaaactggccatgtgccctatcctacgatgtaaactcctctctaggaacagccctgaaatccaggcgatccatacttcccccaacctcaaagg

SEQ ID NO: 364 - DNA, 503 bp, Rattus norvegicus
  Genbank Accession No. AA942889
atcgttgccaaatatctgaagagggctgtcagaaaccctgacgatctggaagcaaggtctagcatgcacttggcaagcgccttcgctggcattggcttcggaaacgccggtgttcatctgtgccatggcatgtcttacccaatttcaggtttagtgaagacatacaaagccaaggaatacaatgtggatcaccctctggtgccccatggcctctctgtggtgctcacctctcccgcagtgttcaccttcacagcccagatgtttccagagcggcacctggagacggcagaaatattaggagccaacattcgcaccgccaagatccaagatgccgggcctgtgttggcagatgccctccgaaaattcctatttgacctaaatgttgatgacggtctcgctgcccttggttattctaaggatgacattccttcactggtgaaaggaacactgccccaggaaagggtcacgaagcttgcgccgcgtgcccagtcagaggaagattg

SEQ ID NO: 365 - DNA, 596 bp, Rattus norvegicus
  Genbank Accession No. AA943028
gactgttaatgaggacgagtcagtttggagaggagcacgcagtatttgcttggcgttgtcagccttgcaccaaggtcccatgcctgtcagcctagaatgcagggcactaagtaaagcatccctggctctcagctgccactgggctcctagtgtacaagatccaggatgagacgggactgtagataaagagaaggtcaagagtggcgaccagtctgtgagcttgggaagggccgcctgccccaagaagcctgcagtctgagcctctgtcagggaggcaagcttctgctcacctacaacctgagacctgtctttttgagacacaaatcagtctttccattgaaacgagagttggggacagttttttcaagtgggaacaggatgaagaaagtgaagtatgggttcaccagttggtgtagtaaatagaggctagcactgtgagaaccccactggcagtgatggcccaggctatgggaacccctcatgttcagaagcgtcagagctgggccgagctgaggacgaagttcatatgctctccccatgtcgcccatccatggagctcactggagctctcctcttcaggctcactgctgcctcgt

SEQ ID NO: 366 - DNA, 492 bp, Rattus norvegicus
  Genbank Accession No. AA943066
  misc_feature (1)..(492): n = a or c or g or t
gggatcaactgagaatatgtttatttaaaagcaatcttaaatattaaaaaagtagaaattaacacatacagtactgagaaactcacatcaaatacatgtgaaataaaaagtgtactgatgctccatggtaactctcgggtacgaatgtgggatttaactagtggcagtcataaatggtcttcacacgcctcactttatttttccccgtattgatttttctgggcagtggtacgggtgtctctggcagcgtgggtgtgaggtcgttggagtcctcagatgcttgcttctggatggcatctctggactgcacatttggagacagatccccagtgtgtgacctctgtgtgacctctgagggtggctgcaccttggccgacaaatcgctagcctgagactttgccagcaggtcncccagctgtggcttggggggaaggccttcatctgtggcttgggaggtaagtctgagagctgtggcttggngggcaggtcacc

SEQ ID NO: 367 - DNA, 522 bp, Rattus norvegicus
  Genbank Accession No. AA943149
ccagcattaacataaaactttattgaagatgcacaaacaaaatcaatgcaaaggacaaaagggagcctacttcgggtgaattggttcactgtcacttacggggagggaacagtaaaaatgtttcaatgtgggcagcaagataaaatgcaacacgtttcaggacaagtagtgaaatacattcattcaactcaaacctgaaaacaaacttggctaaatatcaatcaacattgatgatacagtatgatattcatcattcaaaattggcagctgaaagggttcctttgccatataaacaaagtggagataaagaatagtttacaaggtgtgttgctgctatgctacaaagccaccaagttattcctggctctttgggaacatccgctcagtcagtttggtcacaaactttccaaccttgactctcacctggaaatcatggtggctttcaattcccaggactttatcagcacacacttgaaattcttttaaaaaaaaaaaaaaaactctagcggcccggcacgaggc

SEQ ID NO: 368 - DNA, 508 bp, Rattus norvegicus
  Genbank Accession No. AA943508
aagaataactttggttctaagaattccaccctcgattctgtaatactttccattaaaaaaaacaattatacaagagcaaatacaaaaaatattaaattatgaaaacaaatccattaaggctcctttatatatattatgtacactcaaatggggtgagattcttggagtagaagaataaagttgactgttatagcttagaaagcaacactactatattagcaggagaccacaaaacacagagctatcttaagaaaactacagagtggaaaaatggagccttccccctataagtggctcaaagcatgacactgctcaagtgggacgtccgactacacagtgttaggtgcagagtgagcgaccgactgcactcccagtgagcagagctgagagactcctaaggggcccactccccggatgctctgagacctggcagaagccatcacatcatgctgtgcccaagtcctcttctggcttgactctgcagcactaatcaccaaggaagacgcag

SEQ ID NO: 369 - DNA, 597 bp, Rattus norvegicus
  Genbank Accession No. AA943531
gggcaaaatagatatatatatatatatgtataattatatacatgtacatatgtggacagacaggactggaagtgcaattaggtagggcaaggagtcagggaaaggaagcagcagagggtgccccaataaattacattctgtagagagcacagtaggagatgcacagcaaacggaggagggacctgggagcctgaactctcagagatgccccaagctaggtctctaagtcccatgtaagggaggctgaggcctgggctctgtggtccctggacaggtgatagaagggtgcagtctatctggttttgcctggaggctggtggtggtgaggcgtcgtgtgaatagcgtctctgctcttagccagagctttgaatgagctctggactcgagcaagacgtttgaagcttaggggttgcaaagaacaggacatataagctagagggaggatgacctcccacctggaggcccaggtagagcctgcttctgccagttagagaagcatcgggcctgagtgcaggaagctgtcaggagtgcaactggctggagcctttgggtagacaggcacagggtctcagagctgctgcctccccctgtacagga

SEQ ID NO: 370 - DNA, 560 bp, Rattus norvegicus
  Genbank Accession No. AA943532
ccacaaagaaatatttattgagcgcctgccacgtgccaggcaccgtttaccccccaatgagaaaacaaaacggaacaaaaacaggacagaggcagcagaaagaaacaaagggcagttggaaaaaagctaagggaactaagcagcctgaggtgacgcagggcttccgccttaggcctcttcttctgcctcctctccgaaatcctcttcctcttctgcggtggcgtcctggtactgctgatactcagagacgaggtcattcatgttgctctcagcttcggtgaactccatctcgtccatgccctcacccgtgtaccagtggaggaaagccttccgacggaacattgccgtaaactgctcagagatgcgcttgaagagctcctggatggccgtgctgtttccgatgaaggtgactgccatcttgaggcctcgcggtgggatgtcacagacagccgtcttgacgttgttggggatccattccacgaagtagctgctattcttattctgcacgttgagcatttgctcatctacctccttcatggacatccgtccacggaagacag

SEQ ID NO: 371 - DNA, 556 bp, Rattus norvegicus
  Genbank Accession No. AA943537
ggaaaatgaggttttataatcttagctgtggccacaacctagcagcacagagcaaggtgggtgtccaggctgctggagccacgttcccagagggttggggcttccaccctcagcaagcacgttgcataggctgctcaggccagccaagggcattggtgcagcagtgaaagcagcagcactaaatgtgacccttgggttgggggcctcaggatgataggtgatccctgcagaagaggcaagggttggtgcccagggctgggcctcagcaccaggacggggcctcagtacttctaggccatgctggggccctgggtcagggcacttgagacacaagggagggatttggaatgcagggagggtggaggcaaggactggcctctgtgggtggtccacggtggcggatggccctgtggtgtggaaggaggtccatcttcaactcaggtctgggctctagcagcgtggcacttccgacaaaggacatggccatccagagggaaacagccgttgtcatctgcctcaatggacagggcattcccacagtcctcctcgtgccgaa

SEQ ID NO: 372 - DNA, 555 bp, Rattus norvegicus
  Genbank Accession No. AA943558
  misc_feature (1)..(555): n = a or c or g or t
ggggtaggaggctttattcttttggcagatcttctcagtcattatagatattgctgcactgttaataaaaaatatatgcttctctgtaaagcatttaaaaaaaaatccaaggatgagatggctgaggtctcagctcaagtatctgcaaatacatgtcgtccattcctgactgttccctgtgctatttcttggttgttttccggatcaacgccattctctgtttgtgagcttctgtggtacaagcttttttgtagggccggatctcctcagagccaaatcctgggatccacatgttccattggcgctctagatgcagctggacatctttcacctccagggtgctggacttgcggtgccgagcgagctggcaggcagctgtcaccacactctcgataaaatcatcagcgatctgcagcagcatctcttccacatcttcatccagctgctcgttaggatccacttctcttactaggtcttgtaatttcttcttggncaatacctggntgttttcagggctgagacgaccacctgtgccaggagtgcccggcatctttc

SEQ ID NO: 373 - DNA, 650 bp, Rattus norvegicus
  Genbank Accession No. AA943773
gcatgaaatggcttaaaggatctgatatagaatttaaattacaaaagttaaaatacaataaaatacaatgccaactacacataaataaaaacctaattttcatataaaaatactgtaccgctgttaatacaggaagctactgtttttcctccccgtgtggaggattaaacccagagagttgcatgtgcttcgaagtgagctatagtcccaggaaagaattttgatggtattatttgttttaaaagtcccgctgtgtaaatgatattaaaatctaagtccatgcaattgcaaagtcttcagtagcttatgaactcaactgtagtgtgatgtgtacctgttctaagtacctgtgcaaacttactgagttaaggtctaagtctgaactgctttacaatcctacctgccctaacgtaacaccgcagagagaagccccacacagtaaattagaagcagtaagtgaaaaggtactatgctatacaacgtggtaactcgggtgctatctgtcttatgtacactgaaattccaccacttaaaggcctaaaaacacgtcagtgtaatgtgaagtaaatgatctgaacttatttataaagagaagtcaacaaatacccatttcgaatttgtgggtaaactgaagctgctgggtgccctca

SEQ ID NO: 374 - DNA, 363 bp, Rattus norvegicus
  Genbank Accession No. AA944154
aaaatagatgaaccctgctcacaattcatataatgaactcaagacacggtacacaaagttcacccatcacggggagattgtgggactcgggtgatgtaccagggggagctgatctcgggtgacaggcagacaggcgggaaagcctgctgaacagtcaaggccagtgagacagcccacgccacttcccagactggcagttagggtgaggcgagctccagaagagagagagcacagatgttcttcatatcccagtcccctgtcgctgtacctcagagccgtgaccatggtacagagtccctcccagaatccccagggtagtaaaaatcaagtccctgcttgaggggctgggacaagaagagagtg

SEQ ID NO: 375 - DNA, 448 bp, Rattus norvegicus
  Genbank Accession No. AA944155
caaataaataggaattctctttaaataaccatctccttgttttgcatccagaccaggaacaaacgagagcaactcttagtgcatccagggggcgaagcgcatggagaggcgggcttggggtataggtcatgtggttggaggaatcccagaccaaaaggcccaatggggcagacatgcattctctatcgctcctgcagagaaggcccttgtgaagggaaaaggagagtgaataatccccagaaagaccagcggagggatggaggggcaggggggcggaggggcagaggggcttcctctctgccacagtggctttgcttctgatgccagccactggaagctccaggtaaaatccctggaagcaacagaaagaacaagcgaggccgggtgagtgtgactgtctgctgggacagcggccttccagggccaggcacacgcggggggggggggg

SEQ ID NO: 376 - DNA, 641 bp, Rattus norvegicus
  Genbank Accession No. AA944161
ccaacagtttattagaaagaatgtagacatttaaaaaaatccccactgtcatgaacataaattgaggttttccagccagggcataagctgaaatcaaaacaggaaataaaaaatccaatagtgtattaacattttccactcatttgccatactgacaatgcaagtacaaatctggtctaaaatgtacatattctcaagcaacaatgtacagctttctttgtcctccatgctaagagatgtaaaagcttaagggccaaacaataccaaaggtataggcttcaaaaaccatctaagttagggcatccactagtcttagctaaaatacacctgaacactgacaagtgatcacaaacaatgatgtaaagtacatttttttgaaaaataaactttagtggaataattctgaaaggtatcctggaagaatggcggggcatcagcttaagatattagccaatttgtttccacctccttcaagcccattatctaggatctaaaacctttatctttccctaagctgagaactttcttaatggagaagttaagtgtattatgacaaaagaagacttagatgagatgcagttattcatcagagctgctgtagcagttgcctaagacctcaactgcttcatggaattctggga

SEQ ID NO: 377 - DNA, 622 bp, Rattus norvegicus
  Genbank Accession No. AA944180
aaatgcaatatacaaactttatttaacaaaacaggtaaagtaaaacaggcatttatattaagaaaaaaactacaagaaaatttatctttaacaacttaaaataaccctacttgcagttgcatttaaccgagctctgttgctgtgaagaatacagctcatgcacaggtatggatgaaagatttgtacatttttcaagtattcactgaatactaccttatatacacatatacattaaatttgaaaaagattattagatgatcccagctgtacttcatttttgttgttcttttggaagaggccgtctaaagagaagaatatgcggttctggctcatggatcatgtaatgaacccatcctagactctgttgaacaccaagtctcctccactcctcttcggacatcagatgagttttgggtacttgtttagaaagttctctgggtaacatgacatgccggtactcgtagtgctcgtcgaagtacttgtctgagtagtagatctgcttgtgggccatcctgctggcgtgcgaaggaaaaaaaccgggacaaggaaacggggcacaaggagctccacgtccgcctaaggccggggcaacatcagaatggtacctcgtgccgaattcctg

SEQ ID NO: 378 - DNA, 508 bp, Rattus norvegicus
  Genbank Accession No. AA944244
acaaacatacaatttcttaaatatagactgtaaaactccatttgcaaaagtctgctattggaaggagtgcacaccagcaggaaggattcttaaactttttatttctatgagtttttctgtcagttttgctagttagtggtaaatacgggacccgccattttacagacctgtctgaagcttctggctgtattcacattgctctttgaagcagccctgcttgtctcacaattcatcagaatctgagcttcaacctacaggcagtgagatcaccagcccgtctggactctgctttgaacggttttcaggaagtgtggtttctggatgggtactgcacttcatggatttgtttgaattgcccatgcagctgtgtttgttaaagtgcatacttcttttaaaaaataagaggaataatctttactctttaaccaaggtacttaaaaaaatgaactttttggtctctcagcagatatttcccaaattgattctatcgctacaaattttagtgttc

SEQ ID NO: 379 - DNA, 507 bp, Rattus norvegicus
  Genbank Accession No. AA944353
ataagcttgcggccgcaattgttttttatttttttttttttttttttttttttttttcaagtttcttcagattttttttaattataattattattttaataacaacctgaatccaagaagttgaagatactgtccataccccctccctgggcagaggagagggggcacttgaagagaacaaggtgggatggtgagggggcctgccagggaacctccaaatctttctgagccatctgctgctgaggggctccccagaacactgatacccagggaaggaggtggggctgggttctttcatggatgaggggcttcagataaacatcccctcctgggttctttctcttccggcaaggcctgaggcttctggggagaccaggtgggaagggacaggccaatatttagcctcaactcccatccctgggcattggggtcgggcgtgggcattaaagctacataggaagagggggcaagctgctggcacaaggcccgggggccagtcctcgtgcc

SEQ ID NO: 380 - DNA, 636 bp, Rattus norvegicus
  Genbank Accession No. AA944413
  misc_feature (1)..(636): n = a or c or g or t
ggaataagcttgaggccgcaatgttttttttttttttttttttttttgctgataagaattctttttatgttattcgaataaaaaatacattcatacagaaatataacaatctcgcaaaaaacaatttcaaataaaatcttgtaaaacaaaattttacaaaaatcttacaaagattctttagataacagggtgcttcaaaaaaaaaagaaataaagaaatttcactaatagaaattttttttttaaatttcaagcaaaagtttctgcttgattgaggctcagctgtcacctgaacagaatgtactcgcttattattaaaattacaggcattgacacatacggcacccagccccacccagtccaacaacatctatgtgtttcataagtgagacaagccagcacaagtcctccttctcttctgtttaccttcttacttaatggaattgttgtggataagcacacagcagggccaaaaaaaggagttttccaaaacccagcaaatcaagtgctaggattttgaattgccaaacaaaagtgcattttccccttaagcaaaacgaaaccagttccgtagagaaatgtattcgtcaggccagatacgacaaaacaacacaacaacaacaacaaganaaaaaca

SEQ ID NO: 381 - DNA, 508 bp, Rattus norvegicus
  Genbank Accession No. AA944439
ggcaatttcagtctgacgtgaagggcagagttttctgcttccttctccagtgtctccagccatcttcttatccccttggctcggctcctggctcctggtcccacggaaggaaccaagggctgcagtgcccacagcccagctcaggtgggagcctcagcttgcagcagcagagccttgcgccctctgtggtgacttgtccagccaccctggggtggcacgtccgggaacctcgctcagtccctggggcggcacgtccgggaacctcgctcagtgagctgaagaatccaagagctgactcctcacgtatctggcaggcgaaggagggttccagaactggtggggacacagtccaccagcttccagcatcacggacagtgaggactccagcattcaccaggtgcgtgatctccgagtccctgaagccgtaagtctgtgtcatctggtcctgctggaaactaaggtccccacaggctgggagcaccgatgccaggaacttctgcaccgcccc

SEQ ID NO: 382 - DNA, 570 bp, Rattus norvegicus
  Genbank Accession No. AA944481
aagggatataagcttgcggccgcaatgttttttttttttttttttttttgttctgaggttgtttttattgtaagaatgttgtgagctgtgccttggaaccacagttggcacctgttcatccacagcacccacaagagcaccattgagtgtatccagggctcctgggaaccctatctccagtcggtcaatatgaccgagtccgccattaagggcccagctagttggactgaaatggtccctctgcatctccaacttctctggtaggcgagaagtgagagtcaatgccccttgagcccacgttttctgggtctgggccatttgtttcctgttgctctgactgtttcagacaacagtgcttgcagaccccaacacggaaaaggggtcctccagtcactccagttatgggcttcttctctgtccacgagactccagatagccctacttagagctcctgctctcagcagaaaacagccatatcttaaggtcacaaccaaagtcactgtcttcttaggcctggaaccaggctccagtgaggaggctaggaagctgctgtaacctccatgggctgga

SEQ ID NO: 383 - DNA, 513 bp, Rattus norvegicus
  Genbank Accession No. AA944605
cgagcaaaacaaaatcaaatttaatggtcttaaatgcaaaagtaaaaacaaacaaaaaacacaaaaaagcaaaagaaaattaacagaacagaaccccaaacgtcaaggcagttatgaagagaactttgagggttaatccttaaaactacaaatcaaaggtttgtgttaatagataactggcaagaagtacttttctgctgagtgtccatacaaaagcaaaatttcaaagcaaaaatctaagattggaaaaagcctagtgctcacaagaagggatgcgagaaatacaatgctcaaatgttctgtgtcattagaaacagagcagtcattgtgcattcaagctaggttaaatggtctcagaaactcgggaagttgcatgaacaatagtatctgatgtgtgggcaccatgcatgcaatgtgtggacagacactcaggatgtcagaggagggggcatcttcaggcatgcctggagctcaagcttgactctggaatatactggagctgccctgaaactc

SEQ ID NO: 384 - DNA, 441 bp, Rattus norvegicus
  Genbank Accession No. AA944727
cttaatatccactgcatcgatgtctgcgccacgctccaggagcagcagaacagcttcctggcacccggtgttcacggccacgtgcagggcagtgagcccttcataattgcgagcctccaggtccacagagcccggggttgcgctgtctagcagggcctgcaggcagctggggcttcggtgctcgcatgccaggtggactgcagtctgaccgtggcgatccagggccatggggctggcaccagctgtcaccaggagccggactatatctggtaatgtggtgatcacagccaggtggagcggggtctgtcgcatgttgttgtggacatcgacttccctgttcccaagcttgaaaaggctgagaattcggtagacggccgtcttgttattctggaccacggcaatgtggagaggcgtgtctccgtcctcatccacccgggtggc

SEQ ID NO: 385 - DNA, 368 bp, Rattus norvegicus
  Genbank Accession No. AA944792
cccaaagtagcttttaattctccggggagtcatggagaactcttaacagagcagtgacctcagggcgaggagtgggggtggggctgaagctctgaagttgctcatcctgcatgatgaaagccatgacccacacgctggggctcatgggagcagcggctctggactggtcctctgtgaggttgctggtgagctgcagctactgcaccaagcggtaggtgatgtaccggccggctgtctcactggggcggataatcttcacaacctgccctcgcttgatcccgaagtaccgtgccaccgggtccccagcctggatcctgggcagctggctctcacggagcttgtatcgcgccagcagttcccgtcactcc

SEQ ID NO: 386 - DNA, 400 bp, Rattus norvegicus
  Genbank Accession No. AA944803
ggcaggacatggtactcttttattgtgacgctcagtggaaacatctgtaaaccagcttactgtagtggtgacagctgcaacacatgctaaggcacttgtattatataaaaaaggggtgcgggtcccactcactcctgtgacagcaactgggacctgaattcagagcttttctagcatatgtagcttcatgatttgactgtttctcctttaaaaaaaaaaaaaaaaagccttcttgccatagggactctaatcacagcatttataacacagtgaggaggagcacagggaaactcagcgaccagtgtagaccattgtagggcaggctactctcttctaagcgtggctccaggggcaaggctgtgaggatccacaactagagcgcttactacaagaagggaaa

SEQ ID NO: 387 - DNA, 402 bp, Rattus norvegicus
  Genbank Accession No. AA944811
ggacgggttactttatttcatagaaaatcacactgaggaattgaaaagtcaagtatactcagcttggattcaccgccacggactccacactggagggtgagactgccagagcctacatgcccagacacatgtgcaaaggaacgcagagacaatctgaagccacgatgtccctctgcagggactcaggccccagagtttgctcactgcatgacagggctcaggtcccccgggttcacctcagtagcatatgagcccagacaagggcagggcacaagcgactgacaccgaaagaacagtcatggtgtcacggggacagaaaggcagctggtctcagaagggaaacactggtgtctgcatgggagaacactctcggaagtcccagcttctgtcagactgctttca

SEQ ID NO: 388 - DNA, 467 bp, Rattus norvegicus
  Genbank Accession No. AA944831
caggaaggaaggggccttttatttcctatatcaatcaggtccacagggagagcacagcccgatgagtacaaagcaactgcagaagagaaggggatggtaaaagggtccagcaccaggtactgcctttgggcccccaaatccggtgggatggtcgggatggcctttatggtaagtggctgagacgtccagaccacttgctgttgtgtctgggaacagggttatgggcagaagaatgatgacggagggttaggactctagtctgataaacagaccaaaacatctaccttccactgtgcccaccacaagtcctcggtgctgaatgagcggccagcgataacatggtcagaggaaggcagtgctggaagccacgggtgggtgcaggtggaagagatcagctcttaaataactgctcattgcacttcatactccaacaaggcttgctcggtccaagccagaagcaccagctg

SEQ ID NO: 389 - DNA, 561 bp, Rattus norvegicus
  Genbank Accession No. AA944922
cctcactaacataggaataagcttgcggccgcaattgttttttttttttttttttttttgttaaaaaaagttggcactgtttatttgggatgaaaatatggtataaaaaatattaacacggaatggtgggttgaaagcaggtaaccaatataaatacggtccaataagttaatgcacccgcacagcggggcaaggctcagcaagcacgggaatatcttcggtgaagaacagcggcggcgtcacccggggcatcctctgggctcctgggcccctggactccggtctgatgcggcagcgtaggctggttcccggctcgactactcccgtgggtctctgaagcggcgaaactcctccagcgcccgacggttctggtagtcgatcagcgccatggtgatggccgcgttccagcagctctcgactgtgcagcggaagtcgatctccttgtaaaagttgggggacgccgaccgctcgggggtcgcgtaactagttagcatgccagagtctcgttcgttatcggaattaaccagacaaatcgctccaccaactaagaacggccatgca

SEQ ID NO: 390 - DNA, 453 bp, Rattus norvegicus
  Genbank Accession No. AA944958
acagctagaatctatttatatgtcccaggtggggaggacagaggcagacaacagagggaaggccattcaaggtctcagcaagtcagcatcctgagtatctgagtgggctgatgcaagacgtccagatggccaggacagcagcttcaagtagaccctgcgtccatttaccagaggatgttgttcctggttctgacccattcttctcttttgcttcatctccagggcacaagagctgacaggttcagaaagcttctctagtccttcttgtccagatcagttagccggatagcgggtgttgtagactgtgtagacgctgtcccactggtcagctctgctgccacagcccagaagaggcttattcacgaggcagggtctctcagccaaaacccagagctaactgatatggatagtctcctgccgtggtgctctggaggtccttgtcttcatcttctg

SEQ ID NO: 391 - DNA, 470 bp, Rattus norvegicus
  Genbank Accession No. AA944970
aaaaatataactctttattaaataacatgcacaaatattaactagtaatttattaaacagatatgatttagaacaagacttaaagaaatacaaatccttaggtacgatttaatatcttgttcatgatgtttgaagagtttaaaaagaatcactgattaagttaagcatcctcacttttctttgagaatccaaaccttttaggtaaatactccattccaaattttctcctctatttcagaccttcagaaagtctctaacatcaagagtcctcaacggggtgtaactcacatctcctatcaagtgcagtaacctagctctcccgatggccatggcgtgaagaggaaatgcatagtcccagagtgcaggaggaggctccagcggatgagcctccggagggtgagcgctatggtcgaggaagctggactggggcggcaactgcgggtccctgcagacagacggacggacgtgca

SEQ ID NO: 392 - DNA, 664 bp, Rattus norvegicus
  Genbank Accession No. AA945076
aaaagctacttaattttaatactccacaagaaaattttaaaaagacttgacgctcttgacgttgggcatggtggcatatgtctttaattccagcagttggaagaaacagaggcaggcagaactctatgaattcaaggccagcttggtatacatagtgagttgcaggacaggcaggactacatagcaagaccctgcttcaaaaaaacaagaataccagtgaagaagcattaatgcactatttgttttatggatcaattggagaacaaaatgtggagatgttggcatcaccatgaaagagcaatagtgttagcagtcgtgttcagacctccttgactaactcaggtagacagaggtgaggcgaaagatgaagcctacagatatgttggtctcagctagagagactctactgataatggccttgggcctcgacaatggattttctgaaaatgctgaggtagaaactgtttagtctgttctatctgaatggttaaaggtgtttatcattccagaaaccacttctgctgctaattatctcctcggtgcatgtgaacaagtgttaaaaggtgacttgtgtctgctgaaacatctctgtttactgaactttcatctggaaatgagaaatgcgaataagaaataagaggtaaatttaatttaagtaaattta

SEQ ID NO: 393 - DNA, 646 bp, Rattus norvegicus
  Genbank Accession No. AA945181
gtgttcagcttctcatttttaatatttggttaaacaaaatacatctttgtaaacaaacccagcacaaggccaacaaagaaagggaataaagcaagaaaaacaaagcctagggttgcccttgctgggcatcagggtcaggatgccccttaataggaatggggctttttgcccttgggcatcaacatgggtccctgttcctaagcaccagaattggatatgaacagaaccagccctgaaatgcttaggcatctttatacatcccaccagctcatgggctccacgtgcgtgggactgtttgcagtgccatttgcaaaggcccaagcagatctgtagggaggagtctcctcttcccaagaaatggcttactctcaccgacagtgccaatggaccaaggtcctgcttgtgacaatcagcaaggtcggctgtaacttctggctggtagtgattggaatgtcattgtgcaggggcagagttagctccccgtggtgccaagcagatctggtgtagaaaatggtgcagatgaccatggctgagcgcaatgcagtagccacttgaggcctctgctacttgaataaaaaacggccttgttggattgaagatacatgtgcagaaaaagtgctggggtaaacatgcactccagtcacaa

SEQ ID NO: 394 - DNA, 455 bp, Rattus norvegicus
  Genbank Accession No. AA945487
aaaagtatataaaaacatttattcactagaaaacatggtgattggatcttggaaagtagcagtcaggggctctaagagaaaggccttgctcgaaaagaccatttacatgttaaaaacaaggaggcaacaagtattttccaaggggggggggcgttgaattctcgatcattcagtaagataccctgcacagcagggatgggaataggcaaaggcagctcctaggacctgtgtctttgcgcagatgctctgcggatgggggtggttttcttgggtgtctcttcttcggtcatctccgctgaaagttcatcttcactggactcgtcacttgagaagacaactttggctttcctctgggacttgcgttgctgagtttgtggacgacggggtttggtacgtccaggcttaggtgtgacaaagtcaatgtctgagtctacagaagtcagaagctgttgcct

SEQ ID NO: 395 - DNA, 640 bp, Rattus norvegicus
  Genbank Accession No. AA945569
aaagggcaataagcttgcggacgccacacttttttttttttttttttttttttttgtaaatgtcgtaactttattcaacatataaattttatgggtttttaattcctttccatttatcttgctgtcttggttcttcacgtgtggaggagtctttctgaggaaatctataggttcctatttttaagcatttccttgttcagagtcagaactgaaaggggcactgtattcttcaatggcgaattcatctgtctcataataatcgtagacttttactggggctggttttaagttctttactggaatgtcttgttccaccgcgaaggagaaacccatggtttgattggttagcttttcaatgtagattagaacgtggttggtgttcacttcagtcctctgaatgttagactggtcttggagctttttcacggatggcttcacaggtatgaagcctgacaccatcttcacatcaacaatgaccatgttggagttgggtcgttctccaatgtagcttacgttgatgtggatctggaactttctgtgatgttctgccttatcaaagtttaaggggagagtgttgaccttcagagtgaagggcgcttctccttctgcctccggaaggatgttgtactttagagatgtc

SEQ ID NO: 396 - DNA, 619 bp, Rattus norvegicus
  Genbank Accession No. AA945604
caccgaacaactcaaattttattctgtcttgattggtgtacattaggagcgggcagctggaaactagtgttggggcagaactcctctggactaacgggtcgtgggagacatggctggctttggcacacagactggataaaccatacactggctggaagatggcaggcaagacgataaaaaaagcacagacctaccaccacacagaaactatgtctgaattctgtagcgtgttagggagtaacatgcaaccccacctaggccacactgtgagactaaagcctatcttatttccccttcttagagacgtagagatgtggccttagtattcgggtcctaatagcgttccagagcaattaacacacggcagagagagaactgccaccgattcttacagcagcccaccggttaaagacataacgctaaatgacacattgcatctagctcatctcttcactagaccaacccacacggacccgttcattctaacccaacctatatacttagttcaacggaactcatgtctttacgatgttaagaagccttcttgttagtcttcccgtctccgtgagacaagggaacttgggtaaagacatctttccctttcatcacgctgatgagg

SEQ ID NO: 397 - DNA, 625 bp, Rattus norvegicus
  Genbank Accession No. AA945615
aatcaaacatgattaattttaatgtaattactaaagaaagatataccattttattatgacactctagccatacatttttcaaaatatgcttactaaacagtaaatgtaagataatgattcagttagtaacactttcacgagtcattaggactgatattgctctgccataaatgaattgaataaccacttcgaatacaatcaggattaatttgatagatttcctttgtgtctgtgtgtgggtgggtatataagacacatacaatgaatgaccaaatactactttaaggtttcagtagagaaatgaattcgatgtctgtaagttaatcatcacccttggcctttaagtgtgataaaaataaatgaagcaaaatgcatgttataatccaaattctcatagctccctaaatcttcaccaaaaacagatcaggtctgatgtaccatttggagctttcaaatagactgaatacacacggcacgatgtttggaaggactaatgatacagagacacagataggagataagaatggacagattgaggtttcctgagcctcctgcagagtgtttagcagtaggtacaatgtaaatatccaaatgaaatgagattaggggatagatcaacaggagc

SEQ ID NO: 398 - DNA, 577 bp, Rattus norvegicus
  Genbank Accession No. AA945624
catgtatacactaaatattttaataaatgaataagggtctgaaggggaggaaaggaatggaaaggaatataaagtagaaaggaatataaagaaactgcagatagaagtcatttgaagatgattaacaggaaactgagtgaaacatgttcagaaaattatgctacaaaagttgcaagaaaaattttagagaaacattaaagaacagaaaactgagtgaataaccaggcagaactaatacagtgcaacaaacttattttcaaaatatctgatggagttgaatgaaactgaagacactcattggtgggcactgttaaatacatctcaggatacatcaccaccttctctttgccgtgctttaggtctcttactatgttgcttgtcagctgtacccagagcataaaatgttatccttggaagtaccaagagggtgtgcaatggatgggttcttccttccagatgctcttcagccgctggacccatgatgccagcatcacttttctttgttcttccgatgaaacttcaggaccaaaactgatctgtggggcaaggactttaaatccacagaagtgcaatgtac

SEQ ID NO: 399 - DNA, 290 bp, Rattus norvegicus
  Genbank Accession No. AA945656
aatatgcctcaaagaaatttaatatatgcacaaaaatttcaagagtgaaactatatataatacaaaaacaaaagaacacaaaacagaaatgcatacaaggaaataatttatacacaaaggaaatcaaacaaagtagtttgttaagacaggaattcaatgctgttttataactgcctaatacaaaatattagcagctggcattgattagattgtgatcaaattagaatactgtatcagtgacagtgtaataaacacaactgttttgaccaacagtttataagaccttggaa

SEQ ID NO: 400 - DNA, 450 bp, Rattus norvegicus
  Genbank Accession No. AA945679
ctccggggtcccccgggaggcgacagcctggggctctccgggcgggggatccaaatctgctgcggggtggcggcgggcctcgctggcccgagccggcactgctggagagggatagcgggcgggcgggcccgtcggcgtgagtgtgaaccggtatgcgctgggggtggggtatgcacagtggagcggtgtgcagaatcggagttgcgagccaaaggcctttgcagcggcgaccccgggcgagccgactcagcgcgggccgcctcccgcgcacgctcaccgcagagttcgtactgggaaagagttaaaaaataaacatttacaacggcaaagaaagcggcttcccctccctggcgtccccggacgcgctccggggtcacggctgatccgcagccgggctacagtcccagagagtgaggggagctgatcccggtagtctgggcgcctgggggc

SEQ ID NO: 401 - DNA, 323 bp, Rattus norvegicus
  Genbank Accession No. AA945818
aaaagaactcaaattcaaattttaattacaaaaaatatttctgggaagctattaatactacaaaagcaagggattagaggcctaactggagcaagaccctggtgtctgcagagacacatggcggggctgtgaccttaaggtctgaaatccagagtggattgggcagtggtcacccagccccataacctctgcattgctcattccagtaggaaagggagggcagggaagcagggagaactgtagcaaagtcgggttcagctgtggctcccgcacctgcctgccaattaaagaataaaggcaagaagttgaaacaggcggcaccc

SEQ ID NO: 402 - DNA, 453 bp, Rattus norvegicus
  Genbank Accession No. AA945828
atccactttattaatgaggcgggcaagaggcccgggtgagggtgtgggggtttgctcctgtcccgctcagaggagggggtcacagaaaccaaaccaattcagaaaacttcagtccttgaagagaaggagctgggcccagttgccctgaccattgccagctgtagaggttttgcccactcaaggctcccagccccagagggcagacatgcatggggtggagcagcccctggaggccagtggagtgcgggtggaggcggcacggagccgaggagccgccccaggaagagggagcggcctgccgggagccagggagtagctggagtgggcagcaggagccaagttccaggccatggggaccctgcatcctgagcgcactgggtaagaagctgggacgtgatggatggcaagccagaggaggagaactctagccatcctgctctcttgctgttttac

SEQ ID NO: 403 - DNA, 477 bp, Rattus norvegicus
  Genbank Accession No. AA945867
gatacgaactattataaatatgcacaagcaaaggtcatctttttctaggagtcgtcagaatccaagttggaaggagacaccttttgtaaaaccttccatgggtccctgctttgagataaacatctaattgctgaagtctttattattattataaacgatcacagcgcatgctacttgatatggctctcaactcaagcgtctgctttcccagtgggctgtccctctccccttgcaacaccctcttcatccagccttaagaaacactgcaccatcttctggtcaacagtctggacttgtgggttgctggggagagagtatgagccaatgatagcatgcaaggtgtctattcctacaaccagacgggagggactacaggctctcaccccagcatacagacactcagctgtcatttcacctagctctcattatctatcgataatgcagcagagaggttgggggctacttctcaatggttta

SEQ ID NO: 404 - DNA, 606 bp, Rattus norvegicus
  Genbank Accession No. AA945877
gagagctagtcgcaagttttatttatataaaattcattaagaacataaaagattgagtttcttaaaaaaatctgcagttatttacagcagtattgctcaggtacagtggcaattaccctgtcaaaattcatcagtgcaaaacataaaggaagccagggaaactgcaatacaaatgctacatacgctgggttctgacacgttagtgatggggtacaatacagagatcagtgctgtttaccaaaggatacctgacagttctggatacagaaaccagtggtcacagaacctagacgataaaacacatttgaaagagatcaagtactttgctgggaacttgaggatgctttgtgcaacgctgtttgagaaggattccccgctgatgtagcgacacgtgtggacacaacccgcacacagacgtactgagtggatggacacacacaggcaccaggctaaatcagcagggaggacaaaaccatttacatgaagtcacatggctctagagcttcagtgagcttttttttttccatcttgacacccaggccagtgggggcctctgttgagcgaagcaagagcaagctggccaaatgcagtgaacagggtggggag

SEQ ID NO: 405 - DNA, 433 bp, Rattus norvegicus
  Genbank Accession No. AA945950
actagaaattcagaaagtttaatgttgctttgaaaaatacttctgcacaatggtatctctctccttacaaaaagaagaaataacatctggtaagtcggtggtttgctgaaagcacaggtattttctgtctccttgtcttagatcttctaacacatctgctttgagcttgttaagttcttctgctagacgcttcaggttagtaggaggtatttgttcatctaaaataaaacacattaacattcctgtaagtcagtctggactgcctgctgctatcaggcatttgatcccatcaaacaggccagtttctccaataaacaatcaggaggcatttataaagtgtataggtaagaaatcacactgatgtcatcagaagtcatctaaaataatagccatagggagttaggattagaatttctctgaagtgtttgagtag

SEQ ID NO: 406 - DNA, 484 bp, Rattus norvegicus
  Genbank Accession No. AA945962
  misc_feature (1)..(484): n = a or c or g or t
caagggagactttaattagcatttaacagaattcatttccgttcaatcaacagagtttctaatggccccatttgacatcagttgtttcagcaagttaatagcacagacatgtaggaaatctgactggaaacaagcaaccctttccatatgttgaaatctgaattaacataataaattaaacataaatgactaagttctcagcaacaattcattatttctgcatcaatagtaaaatagaaaatacttcccaacttaaaaccacaggtctaaaaattgattaggcatttgactcttaaggccaacgttacatagtgaaatatgtcattatgttaaaacacttcacacagcaagtaagtttcaatgaatataaaaacaagccctgtgtggtggtacacacctttaactcccagcacctggaaggctcanaggcaggtggatctctgttagttcgaagccagcctggtctacatagtgagttccagga

SEQ ID NO: 407 - DNA, 469 bp, Rattus norvegicus
  Genbank Accession No. AA945986
gtttctcttttattgcaacccattgcaaggtcaaaagattcacagaaatatagaaactacaaactgggtagattttctttattcattcaaaagggcattaaagacaaagggccggaattttccactacagcaatatatttcataggcttttttctgaaaatactgttgacatttggagaggctaaaaagccctgcattaaatgtgttcacatgtatttatgacagtctaagaaaaaaagggactatattgcccagaaaaaagtattttaagcctcatttcaaagcatctaatgagagcacatcccacaacctccccaggatcacttgaggtgatgcttttcctggctgcttcttttaaaagattaatgctttgaggctggatatgatatttctacagatttctacaaatgaaccaaggcagttttccgggttctgttgcgtcagggtttctgtattagtcagcgtcttg

SEQ ID NO: 408 - DNA, 489 bp, Rattus norvegicus
  Genbank Accession No. AA945996
acacaaaacagtttttatttgatgaaccacagtgactaacaagatcaggaaaaaaaagcgcattctgaaggtgggatgggggtggggaagagagcctgcctccgctgctgtctgtcccagtcatggttgagattcctgtctcccagaagcctcctacagcctgtactggctgctttgaggatggcctggcagatgaagacgctgtgtgaaagtttctggcctgagacatgcagagctcagctaagaaaagctgttttctccatcccccaccaccacaacccccttttctgccccaggagcaggatccctgccagagatggtccaactgcatcaagccaggctcttcctgtccaatggcacatgtcatgtccttggtttccagagccctccaagaacaaaaccggaatacacacacccatttccagctcacagaggccccgctattaatttgatccctgagagcccacaacggcttcagtcactctttca

SEQ ID NO: 409 - DNA, 479 bp, Rattus norvegicus
  Genbank Accession No. AA945998
  misc_feature (1)..(479): n = a or c or g or t
gttttctcctttaagttgtttatgattgagtattttgtcacagctatgaaaagctgactcacaaagatgagaacagtatcaaactttcacctaaaaaatctgaaacaagcacaataacccctttccatttatctcataaaattctcttcatatacaattgtttttctttgactattgccttgacctcaatcaatttataataagaaagtacccatgcaagccccacagctacattttgcttcctattagttgagagagaaatacatagcaagaaaaacagcatggtagagtgagatggcaaaagaaggaaaaaaaaggatttgtttcaatatatatttgcatcaacaaaagcaaaggtgctgagtggaaagccgccatctgttcaccacacccgccctgcanacaaaggacgggagatacaaggataagacaggtaggctcacattctgaaagatgcagtctcgtctgcggtaaggaat

SEQ ID NO: 410 - DNA, 454 bp, Rattus norvegicus
  Genbank Accession No. AA946040
aacctttccagtgagtttttattagtagttgcatcatgattcagggtcccagggtagggaccatcatatactgaggtcccccttttctatcggggagaaggtcaaagagcagaggagaggtgggcggagccaggtcagatcttcccaggaaatgtgccttctgctatgcggtcatcccaggctgagacccatgagacggggcagagggacttgtacactcgccggtaccactcgcacacggagacgtcaccgccctttgccgtcattgccttctcacagcggtggaagtccaggtagttctgccagcagttcttagtctggttctggtttgggaagcggctgtcaaagggggcggttttgtagttcttgattttagtcttgatgtcttcggccatcctgactcctaaagactgtcccggagcagcgttacttcaatgtgaccctttgcaaagac

SEQ ID NO: 411 - DNA, 629 bp, Rattus norvegicus
  Genbank Accession No. AA946046
gagaaagtagtaaagatttttatttgtcaatacaagataacacaaataaattaatttttacaacaatcttagactccagggtttctctatgaggttagctcattatgtaaacagactactatctaaaatgatcgagcaattatatgagtgttcaaaaccaacagaccatatccttccccctttcctcggtaatgtgtgttacagaacagatgaggttaacttggtggaaaatggtctcagtgttatcagactacagtggcaccaagttcatgtgaacctgtacctgtcatcttcttctctaacagagctgaagtggttgtcacacctgcaatcccagcactgggaggcagagatgggtacatcttctgactgagtttcaggctagccacggctacaaagtgagacatctcaaacaaaacacacaattaaaacagcataatatccaggaactaggggtgacacgcagtggtagagcacttgcctagcatgagccctgtctgggttaatcttcagtgatggaattggagtgggaaccatttgccagtatgaaaccaacatactgaattagaggttaaagtgcgaaagagaagaggctgcactcaaagcaagcagacctgtggatctctgta

SEQ ID NO: 412 - DNA, 447 bp, Rattus norvegicus
  Genbank Accession No. AA946108
ttgtattcataaagtgctctaaacaagatgttctttttagcagttggggaaaaaggttctctaaaaggcatttaattcttagtggaaaaataatattaacaaaagccttgtgcgaatgtttgaatgacaatttgctcattttcttcatgaattggggtttgatagaaaatgcatatgtgtcactgaaagacagagtgatgggtctgtgtggttggaactcaaaatgacattgctctgtcagtgtgtgctgtgccggcttgatggctttgatgggggaggggtacacttggctggtggtacttccaaaggtgaatcttgctatgtagggttagtggtcagggcagccattcaggctgacagaaccttggacttctgtggcttctgtgatggggacagggacatggttgacttgaatattcttcagacagccaaaaaatgagttccaca

SEQ ID NO: 413 - DNA, 428 bp, Rattus norvegicus
  Genbank Accession No. AA946221
  misc_feature (1)..(428): n = a or c or g or t
cagcgtggtaatacatttattagttcagagctagaaagagcaagagtccaatagctttttgagtaaagactgtcttatggctgaggtctggtctgccctcctgactctactcaatttgccctgctattaaggcacttgagaaaggggaagcagggatgtctcaaaccaaacagcctcacggtcctgaaggcagccagcaatgtcccctcctggtcccctcagccactgctcagcatggagagttggcagggcaggagctccacaggacagaaaagtggcccctcaaatgctggtgtcaggcagacctcatgggggctgctcctangagcgttgctttggatcaaggtgtgcagggatccatgtcgaggaagacactggatataaggctttacggcctgaaggccacagctccagtctgcccctctcta

SEQ ID NO: 414 - DNA, 574 bp, Rattus norvegicus
  Genbank Accession No. AA946224
agacgctcacagacacaaaccaggaacacttcgtgcctgatgatagaatgaacatctctaaacatccacgagatagtcattaaatacgcattgttagacatctcccgggaaagaaccacaataccaaagacgacaacagccccaccccagagacaaggctggcaagagtgtcatgaggaacattactgttgatttggcaacagctacaaatcatttggcattatgtattgaatgtacatacgcttagacacagcaattatctgtctgataatctatcttaactaaataatgtagaagggaaggggtttgagaacgtccgagacaggtgatgcttacaaggaaggggacagaaggcaggtgaacccggtcacagggtgttgtgtgccggacagtgtcacctgtggggacgaggtgacagaaagtgcttatgagaaaaggagcgggaaagcagcatcgttaggtaggtttgtgcagctgtaaagtaaacccacatcttaaggacatgaaagctaccttttacggcccagcacagagaaagcgaacacagacttgctgacttgcactgcagtgtgca

SEQ ID NO: 415 - DNA, 511 bp, Rattus norvegicus
  Genbank Accession No. AA946250
  misc_feature (1)..(511): n = a or c or g or t
cacaattgacatctttaatagcttgtctaacctatccagctctctgtgctgtggtactgaggtactcttctggcccctgccctggaggtcagctgaggagactcccacagcatttctagagctagtagtgcctaagaggcagtgtcagcggcaaggtcgctggctgtcccgtgcagtctcagccagaggtcctatatcagagaagtcccgtcatgaccttgctttctgtaagccagggtccccgctggaggggaccgagtgagactgttaatgtgaagaccgctggtggcattgaggaagaagangaacgaggcagtgaattcacaccaaaacatcaaggtgaagcccatgagggtgatctgattcttgaggaggatgataaaggtgaggagacccccagaggagagtatgaaggcaaccaggaggaggtaggaaccgatggcccacttgctccgtgagcggacatcctcacacacctgngacacgatgagcagctccaagccaaagatgg

SEQ ID NO: 416 - DNA, 481 bp, Rattus norvegicus
  Genbank Accession No. AA946275
aacataagcagcgacatttattacatatgaagtaccagcttgaaattcaaacccaacacccaccctccaaactcttgaccgagagctttcccggtagacaggctctctcctctcgtgacacgttaagaacaaacacataggactgtgtacacctcaatgcgatgctgaccatggctcctctcactgcccgggccccgaaagactcttgttcatgaactgtctcttcacaaagcaattccaccacttgcttgggttatcattctgagggtcaaaaactttgtcacaaagcctcagtccggtctcttgcctcagctgctgtaggtacgcgcgcatcgtttcatcctcctgtttgctggcaggtttggcgtaaatggcgttgaggggaaagccaggctcgccaggaatgggaaagttggtgattcctaccgtgtacatttctttctcgccttggcttctggagttgcacttttggagcttcttt

SEQ ID NO: 417 - DNA, 385 bp, Rattus norvegicus
  Genbank Accession No. AA946344
atcgattatggtgcattcaggaacccaatccccccccaaaccccactaggagggcaccctcccttgccctcccaccctgcttaagggtcccaaggcttaaggtggaggaatgggatcaaaccatccatccatgagactgtccttggcctgcctgaccctcctacggattggggtgttacacttgggcacaagctcccacatgtcctcctgcttgtgcacatatacatattatatatggcccctcattaagctgctcgattcctgagaaggaaggagggataacctcatttaaaataataaaactgattttaagaaactaataaaaagcccatacatcagaggcaagtgggacagatgggaagcaggcaaatgatacctcagaccc

SEQ ID NO: 418 - DNA, 615 bp, Rattus norvegicus
  Genbank Accession No. AA946348
aataagcttgcggttgcttccagtttttttttttttttttttttttttttttttaaaccacacacatactttcttttattccaaaagcctttaattgaatttctcaatgtttttcaaaaacaaaaagatccaaattagaggtaaaaaggaacatggaaaattcaactcaagtggtgtcacgatcttggggtcatgcttcaggcatggcaggacccaagaaggcacaatacctgccctgggcccagcctaaccctgctggttaccacaatcagtagaccactgccagtgtgcccggctgcttacctccctccaaacaccagagatgaaggcctgagcaggaaaacagcagacacggccctgccttgacctaaacctgccaactggccttcagtgtcaccccatccctgtttaaatggctaagggaggctaggggtcacaaggccgtgtaacattaggctgaggcggcgggcagctttgccaagtgagttgtgtggatcagcctgcaggaactggaagagcttctggcgcacctgagccatgacagagcccatgtggtctcgagtgatgggatcgctgtggtccaggtgcatcacagcctcttccaagtagctgaac

SEQ ID NO: 419 - DNA, 586 bp, Rattus norvegicus
  Genbank Accession No. AA946349
aaataaagagaagtactattttaatttcacatcttggctacgttccaacataggcaatgccacaacaagtcccgagctcccacgctaagccaggctcagctcccctctcatcctcctagctcagcccttccccagaccctccattcccaaccaaacaccacaactggcaggtgagttccgcacaaaacctccataaaatcccgactggagcctgcagcgagccagagggtcagcagtggccctcatcgggtggaaaggaagctgatgtttggagcatgctcttggtgcaacccttggcacagacatgctcacgcctttcccccatgcatttctcaggacctgggtggggcctctgcacggggacaggactatgggagggagatggctgaagagcatggggccgtacccaggtcggcgtggtgtaaggcatacagggtaagggaggccatggcagcaaggaaagcattatggaaagaattcccagccagcaggacagacgtggtgcctgatggtccagtttctgagactgagggtgtccagtttaaagcctattgtgagcatatcggacagaagtcagtttctatca

SEQ ID NO: 420 - DNA, 605 bp, Rattus norvegicus
  Genbank Accession No. AA946351
cagatatatcttttattatcacatgagaacttccccagtaggagcaaatgatagctgtttgatgtgcaccatgggctcctcagatccctcttcatcccatcctcagtcaaaaaaaaaaaatggaaccccaatcccagactccagcctagggaagtgatataaagactaagagtcacatggtccccagtaactgttggtgtggctcttggagagcattggacagaaaggaatcagaagcagagaaagggccatgggcctgccccaagttgcccaaagcagcaaggagggccacgagtcagagcatgacagcaggcccctgagcagtgcacaggcgtagtgcagtcttaccaggacagtggttaatgtgtttaactaggggctaggagtcttaactggaatccgttagtgtcttcccgatcctagcagtaagaggccacgggggactttgcgtatggtggatattaatgagggattttttgctgtgttgaagttggggtacagcccccagtgggcacaggtgattgaagggcagcaatgatactataccagagtccctagggaacccacagttgctcaccaagatgaggggggtgaatctaggaaga

SEQ ID NO: 421 - DNA, 532 bp, Rattus norvegicus
  Genbank Accession No. AA946361
acaagttagaatcaagaaagaaaagacagtctgggggccaaccggagaggtgactaaaatccccaggccccaaatggagtggaagtaaagggaagagtagaaaaaaaagtcaatgtaaaaaaacaaaaagagctccctcttcttccctccccatggaggctggagggcggaccacggcgctacacccccagccttaccacctagcttaaataaattaaaacctcaaaacagggcccttagaagtgaacaggacagctgcagctcagggggcttggtgccaggcatatgcccacacccacccatacccttgccccacccccatcatcctcaacagggacatcacacccaacagggctaggaattcaatcttattttgtctgtgtccctgcattcctccccactgcagagccagctctcctatggaggggtgagatgaagaagcgtcacagcaagggaaaagtggggaagggtggtacaggggtccggtcctgcggagccttcctgccccatctggcctggcccttagcccgag

SEQ ID NO: 422 - DNA, 615 bp, Rattus norvegicus
  Genbank Accession No. AA946391
agcttgcggttgcttccagtgtttttttttttttttttttttttttttcctctgtacactgcttttattatttacataatacaatatagcatcaatgctgaataccatgattatgtgcaatacataaatatgaactatctgtacacatctgcaaatctaacttagaactaaagtacataaaattgaagcaaaactgaatgttttaataaagaaaaactaggactgaacactgcaataaatcataagtagtgccttgtgtacatacttaactatttacagatgaaaacaggcattaccacaacactaatctaactatactcatttatatataaaaaacacaagtttcatacatcacaaaaaaccttccattataacacagaagtgatattaccagacaagcatcagtgaagtatactgccttttctagttgttattgtacaatgctgtacataatgcagcccatgcaatacacccaagaacactagagtcctacacccaaatacaatatgataaagcagccctctgcaagtggtgctggataccactaaagaagtctactgcagccatgttggttatgattttccatgcacaagggtacagttacattaagaactg

SEQ ID NO: 423 - DNA, 551 bp, Rattus norvegicus
  Genbank Accession No. AA946393
gtccttcaatatggcttttattttgtaacccaccaactgcagacccgcggccaccccaaggggccaatccatccccatgacccatcgggacagagggaggtggcacatgccctgtgtacttcttcagtggcaggtggcactggcctcagacccgtaaccagctgccaggttaacagtagtgaggggaacgagagtgcccagggccagggcaggaggctgacccccctcgtcctatgacacgagtgccaccagggtggcagccaccactgctgaaccgaggcagcctacggtgggtggggggagccaggcctcagcatgtgctatagggatgcaagcagctggtcttcatatggcctccactgccccgcctgacacctcctgggtcatattgctattgaatcaattgaatcaattcactgtggggtccctgaggtcaaccatcagcaccggtgtcaccctcccaaggccatcctgttggggacatccagggctgtgccaggccctggttgtcccatcagacactatgacagaggactggactccccaaaatg

SEQ ID NO: 424 - DNA, 625 bp, Rattus norvegicus
  Genbank Accession No. AA946408
cttgcggccgcatccagtttttttttttgtttttttttttttaaaaggaacaaacacatttaattccctaacagtggggggctcagtaaacactgactacaggaaagataacacaaggtgatttttaagaccacatttacaagctcacataaatattttgagcaacaaatatatctatcctccctttctgattgctcaacataatttgtcgtaggttctagtagataaactacactaaatacctaagagaaaaatgaattttaaaaacatgaaaaagtgaacagccagatgtgacaccaacagcaatgtttttttaaagttgagccattgatttgcaactgttattagaatcaacttcgctcataaaaagcgaaatttgtaatttgatcgtgatttgcttgaataacagctgaacttttacattaaagaattacaaaccctcaactaagggacaagtagaacactcagacttgagcttacactttcacaagggacaatgacgtcatatcagttcacattagtaccatggtccagaacacactttccccttcagttccagcctgccgctgggggctcctagtgggagttggcataaagtccgttcttgatgaagacaacactagac

SEQ ID NO: 425 - DNA, 616 bp, Rattus norvegicus
  Genbank Accession No. AA946439
atgttgcatggtgactttattgtgggtttccaaacctgaacaccagtcctcattcaggtccgctttgtcctataggaacacgaagcttcaactttaacttgaagagcatccgaggctgtaccctacaacgcctaatgggacccttgcagcctggcacgcaacattaaacgcctccgttaacataatcagcttggcatacaagaaaattcattcgcacagaccgaccagacacagcattcagagcgcttaccagttggtgggtggagccaccacacctagccctccaatgagaaagtgcacagaagagacttagtttgcatacgagacaatgcaacgctaataattgtagaccgtaacctagccagcataataagagttcacagctcatttttgatggtttgggggccctgaaaagggcctttgtgagtgggggagggggccaaggagaaggcctatacacacgaggacgccgatcaaccgccggagccatagagcgtgcggccctggcgcttgagcgcatacaccacgtccatagccgtgaccgtattgcgcttggcgtgctcggtgtaggtgacagcatcgcgaatcacattttcaaggaaaacctttatgacgc

SEQ ID NO: 426 - DNA, 568 bp, Rattus norvegicus
  Genbank Accession No. AA946443
ttaattggcttttatctccagaactctctatccatgcctcggctctagggttcctggacttgcatctccagtttgagggttcagaccagacagagaatatgcaagcagatgctggatctcccacataaggcagagaatctccctggcaagggagcccaggggttggcgcctctctcctgccaaaagcatgcagagggtcacaatgctgttcttttccatggggaacaccaggacttgcttgtccccaccggtgggctgtgggcatcagcctaggagtcactgcagtggtgatgaggaatggggaccaggcactggtgctgacagcgtggaatggtcaaacagtggattgcgcacctccatctcccctgttggcgccaggcctgggcactcgtacacagtgaagtcaccatcttcattctcctcatcggaggaggctgactccagttcctttggagggtccttatgccgctccaggcacagcatctgctgtctctggtgctgataatgatacatctctgcgctatgcgccagacgctcgtccccgggcgagattcgtggtgttgttggg

SEQ ID NO: 427 - DNA, 492 bp, Rattus norvegicus
  Genbank Accession No. AA946448
gctgagagaattatttttaattataattttctgtataaaaacgtccatcagacagaagtcaaagggtgaggtggttatcaggaacagggcgggtggctccagcagccctctgaccctctctcgtgcagtccttgcttagagtcccaggcgatccacaggtccagggtgaacaatgagggtcagaggtggaaggctcagcaggagagtagaggagcatcagcagaggtcgagagaaggccagagtccagggtcaggctgtcctggtcaaagttgagtttcttggctggaggagtttctcctagcccttcgacatccaccaggtcactgttggcgtcggagtcgttcagagcactgagtgtcacatcagccttctgtttctttatgggaggacccccagcttcagggacactggagctgctgggcggaggggcgtttggaggtgagaggacaccggatgtcatcttcttgggacctttcttgggtgactcagct

SEQ ID NO: 428 - DNA, 414 bp, Rattus norvegicus
  Genbank Accession No. AA946451
gagagaaaatttattcccatggcctacctaagagcagccttaagtaggcagggccagcagtgagctgggtgggagcacaagttctgcctggtgtcaagtccagtgcttacaggacaccatcacaccaccttgttgatgatgacaccaagctcttcaatctcacactggacttcatcacccttcttgagaaagacaggaggcttcctaaacatgccgacacctggaggagtcccagtcaggagaatgtcccctgggtacagagtgacaaactgggagacccaggctatcagatcttcagtcttgaacaccatctggttggtgaagtgggtccacaaatcctatcctgaacttcagagactactggtagtggtgtgtaggaaatttcctttggcaagcactcgacttcaatgagcc

SEQ ID NO: 429 - DNA, 716 bp, Rattus norvegicus
  Genbank Accession No. AA946467
aaaaccttatttaataaaaggtcttaagatacagaacattcaaaagtaaataagttacatgggtacattacaatcacatccgcaagattctctttagtgtattaattttttttataaaaagcacacaaaaaataaaattttcggtctggtctatcacaactgtacacaaagaggtaatatttatatatatgtacactatttaatatgtaacagtcttttttaaaaagagtgccacaggcaacaaacacatgaaaggcagtgtctgaccattttgtttcaaaataaaaggaatatacttactttatgctattaaaatatctgtacaataattacagtcaaggctgtttctgtgctgtcctctccaacaaggcctttaatttaagagacaaatgaagaagagctctaacagctgcaaattttttttttgaggaaacaaacacagccaaatgtgggttagacacaactgttttttttataaaaatatgcatacttcctgtaaaaacctaagggtttaggctttgccagtctagtaataaataacaacccagaaaagtgagccccaataaaaacacttaaacagctgaggctggagtatgtgttgtactcttcccctccatctttaacatctggcacatgagaagaaagaggttaggtgactgaagcagttaaatataggcaatccctttagacatcatcggcacagggccctgtgccaa

SEQ ID NO: 430 - DNA, 654 bp, Rattus norvegicus
  Genbank Accession No. AA946503
aactggggacatgtgtttattcagcagaaagggggagcccgttggtggggcagcgttaacacaggtggatggggagagctgatcaaataagagggatcagatgcttggtggaatcatggctggtggggcagccaggtgattctctggcaacaggaaagatggagcggcagacagacaggtgggacctgaaccatcaggccactgcacatcccagtcagccacgctcaccgtctgttcagttgtcaatgcattggtcggtgggaacagagaaaacgatgttgttatccttgaggcccagagacttggcaaagctgacgaatcgctccttcagttcatcggacagccccttggttcttccgtacagggtgactttgaagtactgtttgttttcagaggtcttctggaaaaataccatggcaaactggtcgtagtcagtgtcggccacttgcacatcgtagctctgtatctgagggtagctgtgaatattccccagggtgaactggccaggcctggagcttggaacgaatgttctgatccagtagcgacagccctggcccctgacgaggatggaagtgacgttgtagctattgtcttcctgtaactcatagatggtgctgtacatggtaaagcggctttgtctttctttctggaccg

SEQ ID NO: 431 - DNA, 486 bp, Rattus norvegicus
  Genbank Accession No. AA955104
  misc_feature (1)..(486): n = a or c or g or t
tttttttttttttttttccagtttgaaagtgttttatttcagcatactcaggagaattaaccatgtatctttaagcagatagccccttcttagattatttttcttatactatctttagtggggaaaaaacagtatttttagtgtagaaatgatactgattctttgttaaaaaaagaaaatgtgaagactatactttttactatctgtggaactcagaagtccaaaagcacagaacacagttttcagaagagcaagttcacccatttatggtattatttccatattagaatataattaggtcatgtgtagttagagtacacaagaaactgatcttcagtaaagcacacgcaccatggaaactgtatgaaaggagaacacacttggactaagtaagaaccgtgcaaagttccaatttaagaatatgtgataaatattggttaaggactttaaacgcatgctctgttcanatacagctttttctttttc

SEQ ID NO: 432 - DNA, 556 bp, Rattus norvegicus
  Genbank Accession No. AA955162
  misc_feature (1)..(556): n = a or c or g or t
tttttttttttttttttcatattttaacaaactttcctttattaggttactgactgatatgagtcatcataaaacagaacagaacggggatttcagaactatacatgccacaaggctttacggtgatggtgccgggacggcagggaggtgtggtgagtcctggggcggcggagtatgggggacacaggagagccttgctgttcgccagcatccgtgagggtacggccgggtggagatcaagctgggatctatgcggctgaatgtgatccgctccaaaaccagaacgagtaagatttctgtctgacaaaaggcccccctcccaaaaaaggagaatgacctcaaaacgcanagggaatgacttagattctttatctagtctcggcaccacctctgtgccttaaaaattatactctactggaagatgtttatttattttttaaaaaaggtaccctacagcagctgcttaaaatgattcttacaaatatatctatgtaaatatattaaacattttcaacaaataaagtcatctactgtacctgtgcagaaatgaacagaa

SEQ ID NO: 433 - DNA, 501 bp, Rattus norvegicus
  Genbank Accession No. AA955206
ttttttttttttattttacaaggctttaatgagacatgaaatgtaacattaattatacatcaatgaaaagaaatcctaaacgagagtttattgtaatcacacatatccattccagcttgaaaactttctgaggggcgaggggcagctattaagagccccggaccagccagcactgtgtgtgactcccatgcatcctgtgctttgtacacaagttctgtccatcagaggctgaagacatttgctgcattattacttttcagaaaaatggctttctcattcggtgatgggtgactcaaccagattcctaagaaattagttccactcagcattttaaaggataagaatgttcagccaaaaagcgatagttaagaccagcgttagccaccgagatgaagccaagactctaaaacacagacttgccaatagtgtccacctatgaggactggcatacattagtgaatagttaaggccaaggactattccaaccctcgtgccgaattc

SEQ ID NO: 434 - DNA, 361 bp, Rattus norvegicus
  Genbank Accession No. AA955282
  misc_feature (1)..(361): n = a or c or g or t
tttttttttttttttttggtgttttcaaaattttgtttattttgggaagttctaagtatcaacagggatcttgtctttattctcctcccttcttttctggtgcctccctgaacttccctcggcgcctccctcctctttgatgtgccgtaaattgtccagatctgtcacggtctatccttccgttcagtgtcttctcacatagacttgccgagtttccatttggatttgttttttcacttgtcacctacggaggcctttttcatccaaaattgtctgatttactgtanggaagatctgttggaatgtcgtcctggttaactgttgtgcggtcccagatgcctttgcagtataaaatctctgt

SEQ ID NO: 435 - DNA, 508 bp, Rattus norvegicus
  Genbank Accession No. AA955298
tttttttttttttttttaaagatgagcatttattcactttacaaagagaatggtattaaattgccataaacagctccatttatagacaaagaacaactgtacatcaatcgcaccagcagcttgcccaggatgcccttcccgcttcggctgtgcagcctgctctgtccctgatggaagtcctcccagggagcacttttcttagtcacaggtgggaaagcctcgcatctgctcagtccttctgcagacgacagctctccatctgcacccctgactgaacgagttagtactggcccactctttagaaacaagacaaattactggtaatttgaaaaagctgtgtagcacaccaaaatacttatttatacatacataaaaaatcttgagtaagatttatcattttgaaagataaacagataccctagccctgctaagagcgggtaatgaaaaggaaccaaaatgttaaattactgaattataaaaatagtctctttggaaaaaaattccagca

SEQ ID NO: 436 - DNA, 475 bp, Rattus norvegicus
  Genbank Accession No. AA955391
tttttttttttttttttggcttttataaagtcaaggaaatttatttcctgaggtcatgacacaggaagtcaactcctagccgctgtggagctctgctgtgaaggtcagagtgctgactacatgctgggttctggatcaatgcttagtgtttcacgcagtggcgtgcctttcccagagcacagcgtcaggagcagaccctgagcctgcgggtgctgaccaggcctggggaagcagccacagaaggccagcccaccaggctttgctgcgagacctcggggagggggagcatcaacaatttacgagggtccagctgctgagtcagattgagacaaaccattgtgtggttgggtttgggcagcaggctggaaaggtttctttttgatcattatcgtttggggccccacgggagggtcttgggggccacttgagccccaaagctggggaattcttcagagctgctcatatcaggagcctt

SEQ ID NO: 437 - DNA, 505 bp, Rattus norvegicus
  Genbank Accession No. AA955393
tttttttttttttttttcgtgttctctcaaatcatttattcagttcataatggcgcatttgaacaggatcagcaatcttggcagacaaaacacatatacccactgaccccaggtaagccagccccccaagggtttgttggtcccggggacttcctctctgaggtgaccaagtgaagccccgtaccattggcactggcattctctttggtgtgtgacctaaaggctgagggaggaaagccagcaggaaactgaatatgtggcaggtgccttccctcacagtgaggggcttggcttgtaaaatagagcaggccacaagaagagacctctcagctaaaggtcccggaagtagatttggacatcattttaagacagaatggtcattttcaaaggggtagaacttgatgtcccacataactttggtaaaatgactgtttgactgtacattttttcctgttttttgtttttgtttttgtttttttaagacagggtttctctcctcgtgccg

SEQ ID NO: 438 - DNA, 498 bp, Rattus norvegicus
  Genbank Accession No. AA955408
tttccatttttttgtttgttttgtttttgtttttgtttttttgtctgtttaggagaaagcaaatctgtacaaaaatactctggttgcaaggaaggctaggggacactcttgaactaggagaagttaagctgttggaaaaataagagcatttaacttttttatctaaaatatgtataaatcccctcaaaatggtaatgagtcatacacagtacatactaaaagtatttaaaatagagaatattcctcacagaggacttttttttcctttaattacggctaaaaaataattacaaagtccaaacaggcagggagattctccaatcatcctcctcactaactctgaaggagccaagcccttcctcactgacgctggtgggtccatctggccacgaatggccgggccatttgcaacgtgtttgcatgagctcagataatgtcttaaagtctctctcctggaatctcagcaatcgttaccttcacttacatctttaaaaaata

SEQ ID NO: 439 - DNA, 495 bp, Rattus norvegicus
  Genbank Accession No. AA955540
tttttttttttttttttactagaaatcatccagtcatttatttttgtttataccagagatataatgaacatattaaaaagaaaaaatgtttttataccaacatgtttttattgtttgtttctagactcctccatttagaaaataggaaccacggtttcattaagctgtggctccttttcctttaacctaagcttagtttaaggaaaacttccctcgtacaattatgtaactaactttaatcaatacatagtaattatgcaagcctcaatacagtagctaactttttgaaaatgacttaacacaaactattaacaactaccttctttgaaaatttctctatgcaagtatcagaacagatttacttctcttttaattttcatttcctattttttgggtatgccttagaaaagtaaaattacatataaacattgtcaactactttatttgtaaagtcaagataatggattatctcctctaagtaattaaattttgcaa

SEQ ID NO: 440 - DNA, 312 bp, Rattus norvegicus
  Genbank Accession No. AA955694
tttttttttttttttttcaggtttggatacatttaatggagggatactgtgaacagggagacccttccctggattggggtgggatggggtggcagaggagggtgtcatctgttagaccttggattatgatattccttcccagagcacagctctgtggccctggattcatcccctcctctgcccttccctccctcagcactccaggttctgaattccagaccaatcatagaagagaagacatacgcacactggggccaccaaagaacacacagtgacacggggcgtgtagagagatctgtcacctgtgcacgt

SEQ ID NO: 441 - DNA, 208 bp, Rattus norvegicus
  Genbank Accession No. AA955914
tttttttttttttttttggcagattagtcctttaatagaaaaatcccctggaaaaagtcaaaagccacatgtgcaacagtagcaacaacacacatttcctcaatccagacagtccagtttcaattcctcgccttgggaagtggcctgtacacacctacaaccacagcgtgggctcgttcaaaagggtccaatgtcaactggtcctgaa

SEQ ID NO: 442 - DNA, 227 bp, Rattus norvegicus
  Genbank Accession No. AA955962
tttttttttttttttttgggcttttacaaatctttatttacatttcaaaggaatctgattgtgtctgccctagatggccagcaacgacggccaccatgcacaggagcagctcaagggacacagattctttcattagccttcacgatccaggtcacagccacctcggcctgaccccctctgctgcagattcagagctggggcagctcgcttactcatctctctgggag

SEQ ID NO: 443 - DNA, 479 bp, Rattus norvegicus
  Genbank Accession No. AA955980
tttttttttttttttttgcaaagattcaaccatttaataacaaaagcttcccacccttactcctcgacagcatcctgagcacaggaagggcacagctatgtaggaggctgtagaaagctaaggaaaatgaggatgtcagatggattcctgggttaagactgggtcgggcacagtcccctttggccagacaatggcatgaaccacacaggaggctggggctggccacacaccaccaaaagcatgacagtgctggctgatgtgtctgtgtttcactagctgcttctgccaagtccaaatttcagtgagggacgactagagctcacacaggtcttgtcctcttggcctttttctcagacctcacagcgtcgtcatgggctttcctcttctctgcaagcttgttggcctctcggattttgcgccgcttgccaaacatgatcttttgataaaggtacttctctcgcttcttcatcatcatgatg

SEQ ID NO: 444 - DNA, 558 bp, Rattus norvegicus
  Genbank Accession No. AA956005
tttttttttttttttttggagaggaacacgacatttattaaactctgatgggtgcagatgaactttctggcaagtccttgttcttagccattttggaagacacctgggggccccaagcgccccctccccgagatatcccagtgaagccagggtcccaccccaccctctggcactccaccctgctccttagatactccccaagtccctcctcttccagacactccctgcaggttacaagaaaagtacctctgatccctgtggacaatctaaggtggcaatgagtcagtagaccgggtgggagaggagggtctctgagaacaaggggcagcaggacatgggaagtgctgttaaagcatcaaaccaacttttaaacaggtagtcacatggatactgaggaatacatctctgaaacatcacatttgggaatacgttgagcattaaagtaaagagctgcatgccaatgcgtggaggctacactaacacggagcgcacaaggcctgagtgggcagacacgcactatcacctgtctgtaaagaaaacgctctagtcatatctgca

SEQ ID NO: 445 - DNA, 473 bp, Rattus norvegicus
  Genbank Accession No. AA956164
tttttttttttttttttatctgtagagttgttctgctttattacagctctgcagatgaaggatgcttaaagacatctaatgaatgcagaaactgaagtcatatccttctccaagctctgagtaagtggaaccagttaccaaacagctgcttttattccagcatctacaggctgtgagaggacgagcagtaactgcagacgcagtactacacaccctttatttaatcacagtggtaatggtacagtttattcttcagattctccaggcttacggatgtcatcaatcttcagaatcatcctaaccatctgtgtggcaagagagatctgctgctttttaccaatcaaggtttctatgacatgctgatactgcatatcattactgcccttgtgcagacagtcaatccccagggcaaggttagactccttcacttgtctagctcggacttcagtcatggtctggatgggattcatgcc

SEQ ID NO: 446 - DNA, 501 bp, Rattus norvegicus
  Genbank Accession No. AA956278
tttttttttttttttttgcatttataaaaactgcagatttattcagcgagggcccgtgtccaagaagctatggtgtagaagtcggaggacctatttttcctcttctcctccccctcacttcgtcttcctggagggcaaaaatggtctggaccctgaaatcctaacccaaataaaaaaaaccacaaaactgaggttccaaaaaagttaaagaatcttaattccttatagaaaagagagaggagccaaggcaaatggggaggtatcccaggggtgggggaaatgccccctacttggtgggatacccctcctcttacatagctgcctctgatgggacaaagcttggggtatagcatttaaaaactcccacaccccattttatcaaaaccaaagagaacaaaaaatttcccttccccccacaaaacccaaatatatatatatactttttcttaaaaaaaaaaattccaaggcattaaagcgttaaagtgaatccagaacaagaga

SEQ ID NO: 447 - DNA, 376 bp, Rattus norvegicus
  Genbank Accession No. AA956294
  misc_feature (1)..(376): n = a or c or g or t
tttttttttttttttttagggttcagttccagctgattttatttccttctcaaaaaaagttatttacagaaggtatatagcaacaacctgacaggcagtgacggacaggattagctggtattttttttttcttttttctttttctcttcccccaaacattgcttttttttttttctttttagtggccttgaattttaagacaaatattctacacggcatattgcacaggatggatggtaaaaaaaaaaaagagagagaaaaaaaaggaaaaaaaattaaagtttaaaaaccaaaaacccttaacggaactgcctcttaaaaggcangggtcctcgtgcctgtcatgttatattaaacatacatacacacaatcttt

SEQ ID NO: 448 - DNA, 472 bp, Rattus norvegicus
  Genbank Accession No. AA956340
tttttttttttttttttcattcatgagagattttattccaaaacctacttttaaaaattataattcatgtaaatgttttgtcaagattgggtgagtatattctgtgaatttatgggacagaagttgatgcctttgacccaaaactaacaacatatgggagcttggaactgcattcttctactgagttttaattcgcactttgtttgtttgttagaatgttaaagatgttgtcatcctaaatgcctttttcaaagggttctctatataaggactgggccattaaagggattttatcaattccaatgggctaactttaacaataatagagcaataatagtctgtagtatttttttttaccgattcttcttttattaacaagccagatgacactcaaacaaatcaaagtgaccaaaatcatgcttcagattagggataatgagagtgtattatgttctgctaatcagactcgtta

SEQ ID NO: 449 - DNA, 379 bp, Rattus norvegicus
  Genbank Accession No. AA956476
tttttttttttttttttgtggggtggggggtgggaagggcaaggcagtcattaaagacaatacctctcaaaggggcgagggtacagtgagaacacatgcagcacacgtgatcctcactgacagacaggggcagagacctctccagaggtcctgtgataaaacaaaaaggcctggcctccatctcccagggtgatgcccgaatcctttgtggaaaagacagctctcacatcagaacccgaagaacctccccctctagggtcccaaatttacttggtgacccagcctagcctggtgacacatttgcatagttaccttatgactagattagagagagagagagagagagacagagacaccatgcttctgaaagtgaccctca

SEQ ID NO: 450 - DNA, 402 bp, Rattus norvegicus
  Genbank Accession No. AA956530
tttttttttttttttttggtagcggacataaacgtttattgtcacagatggagtgcattctgacaggcttttcaaaggaaggaatacagattccaactcaccgccacatttccacaagtctgaaaggcggtgaacataaacataaaggcaactcctaaaattacgatgttgaaaagctttttagattccggagacattttggctccgcttgctcggaggtcaggagcggcccaagataatcacctccagtcgaacccccttacagtcctgagggaagaaacgagatgagagaaccacgcagccagactgccgatttccagtcctgagatgggaatcgcaggcttatgggaaaactctccccaccggcacagtccggacactccagggacgcgaccgagtgca

SEQ ID NO: 451 - DNA, 524 bp, Rattus norvegicus
  Genbank Accession No. AA956534
tttttttttttttttttgctccataatctggtactttaatagagaaaagcatcaaatacacataaaggaacagtaaaatacagaaaaaaagaactctcaaatgtacagaggaatacatatattttcaccaacttaaacttttctttcttcagtgaaatctgtaaatgaaccatgttctcaaagaactttgttcaactcttccccaatgaccagaaattctaaacttacagtgaaaacacatgacaaaaacaaaacattgcatgacaatggacaccaagttcataaagaacttccttttaaatgagatattatgtaagaaaataccatgaaaataataatcctatgagaattgttttaagcacagtaaatttgagccttggtcttcatgaagatactacagtttgtatagaaaactataaatatacaagactccaagggaaaaaagtcagaatacatattgtctaacattctttaagctaaaaccttttgaaagggggaagatggctgatggccaactgaactgt

SEQ ID NO: 452 - DNA, 359 bp, Rattus norvegicus
  Genbank Accession No. AA956659
tttttttttttttttttctaggaaagaaagcggtttattttcctaccaagcaaaacaaaatgaacagggtcaatcagaaaaatgtcaaaggaaaatcacaatgaaataaaatacagaaacacagagaagtaaacttccgcctgatgaagccggagtacaaacagcaaaactaacacacacgagagcctttcttgctagtgtcctttgatttatacatcatcacttctgtttataggaagtaagagagtcctgttctaggtgaacctcacaccacagctcgcttagctctccaggtccaacataacaaacctcggggctggctctctcaggccataaataaaaagcccagccaactctgg

SEQ ID NO: 453 - DNA, 411 bp, Rattus norvegicus
  Genbank Accession No. AA956688
tttttttttttttttttaggggaagatcacgaattttattttagggaaactaacgttgagcatttatgtggaaagaggaacctgaaaattacaagcaggtaagcaatagctaaacccagacaaaaggggaagaggagaggagggccaagggcagagccttggggacatcaaaacttaagcaacataaaggaggttcagaagtggcaggagagatacctatccaggtctcataggctcccagaatgccatcctacattctatacacagaagactcagcacagctttgttctaacgtcttaaaacatcacgtaaaatcatctactttaatatacaggaaacacacgaacataaaagaatagtgtccaaataccagagttggtagcctgagcggaatcagaaaacaggactttc

SEQ ID NO: 454 - DNA, 446 bp, Rattus norvegicus
  Genbank Accession No. AA956723
  misc_feature (1)..(446): n = a or c or g or t
tttttttttttttttttggggaaggtgaaggggtttatttcaccttctacttacagtccttcactgagggaagacagggcaggaccgcggaggaacgatgctcactggcttgccatgaagacatggcccgctcagcttacacagcccaggcccacgtgcttagggacggaaccaggcgcaggccaatctgaaatcctggcatttgggagtgggaaggaatatcaggaagtcgccatctttggttacatagcaagtttgaagcgagattgttgcaaatgagatcctgtgtcaattcctcctctctctcttccaaggggaattacatcccgaaatcacgtgagcattangggtcatccccctgttctgtgcctgggcggatcttccggtgtttctctccatagctacagtgcctttgtttcagtctacaaactgttacacagtaactg

SEQ ID NO: 455 - DNA, 446 bp, Rattus norvegicus
  Genbank Accession No. AA956746
tttttttttttttttttacaaggaaacttttattttcagttctcatcaagaaatttgctgtggttttttatgcttttggttctttttcttttttttttttttccaactttattttagctgctcagtggctggagccgctgggttcctggtattaaaaaggtgccaacagaggtagctgtgtctcacccaggggcccggcccactctgaataccccccaaaaggagaaaacacaaagtaaaccaacaaaataaaaccaaaaagaggaagaaattcagatcattttcttcaagcctggcagaacccacaacagtttgtaacaggcgcacggtggggagaagccagggtccagaaggcagccagcccgccagctccttgctcggcgctgggctagctactgctgcgtgtctctccagcaggaagggcaccgttgcctctccctccctcc

SEQ ID NO: 456 - DNA, 542 bp, Rattus norvegicus
  Genbank Accession No. AA956907
tttttttttttttttttccaattatgtaagtattttatttatcaccaaagaaataaaacacagcagcaagttctgtgttggcttcaataagaccaaatggttactttttttttttttaaaacacagctacacactccaaaattgaagtcaacacagtcatcactacaaattacttgttgaaataatctatcctgaagaaaattaggaaaaagaatttaaacaattcctccaaaccacacatttataaatattgtcatatttaaaatgcttgaaaggcatgaattagtggaaaagcagttttcttttggcaacagaaaaaaagaaacccacaacagtttaccaaatgctctagggacccaaagctgtactgttctggacctgcacttgagcagcatcgtcatgatgatgactaaaaaatgcttttatactcacctctctcaagtaagtctatagaaaaccccattacagccagtgtttgtaatgtctaccacactgatcagaagctataaactgcctaaatatatttaacagtaaatacctaa

SEQ ID NO: 457 - DNA, 385 bp, Rattus norvegicus
  Genbank Accession No. AA957123
tttttttttttttttttgccttttcaatctgctttattaggttcacaatatgtcatatggaccttcccatgcatctgataaaagaattacaggccgagtaaaaaacacaagtttcacttagaagttggtaacaggaagagatctacataaaaggagtaacctcaaaacttgtacatcacaaagcaggggtccccatagcatcttcagagacaacctcaggactcagggcataaggcaaaactcatcattgtggtcatggtgaggggggtcagtgctcaccgcccgcagactatggctcagctgcctttccctcaacttgcccatgaggtgtctcatatcctccccaaacctttgcacattctcatctctcatcctgccctgggcc

SEQ ID NO: 458 - DNA, 484 bp, Rattus norvegicus
  Genbank Accession No. AA957264
tttttttttttttttttggtacacactgttcacacctatattttcaagtttggaaatgcatatttgcaagcagcaatacaaaagtattcatgaagaatgcataatctctgaaaattatgaaaacatccctgctaccaatacatttctaaatacaaaactgactaacatatttgttacttctgtgtagctagagaagttcgttttcaaaacagataaaattcagtctttaggtgtgaatggtatgaatgacagtcttttttttttttttaattcttagttgtttgggatccttaagcatgcaaaagctttgaacaggagggtccacaaaggaaccagtgttgtattatggcatccagttaggccagagcggggaatgcctctgggtcatctacatcaggagcagaagcacttgacttatcagtcctgctgccacgattaggacgaccaccacgcccacgtccaccacgtcctcctctgccaccac

SEQ ID NO: 459 - DNA, 430 bp, Rattus norvegicus
  Genbank Accession No. AA957270
tttttttttttttttttaaagttaaagattcttttattaataagtctccctcccctccaaactttatccccaaaataaatatcacccccttgggggatgggttgtgtttgtgtgtactgggaccagccctcccagagggccagcccccttagtgttatgaacaggtccctcaatctaacccactcccagggctaaaactcagggtagtggcatttcagtccatccgagtgggtggaacccagtgttgtgtctgcccctcaagtcggccaggcctccaggacttgtggggagcaagagattcccttgtgcaaatgctgcagatccttagtatgagtcgctttgtgacctagcttgaggctctctgtctgccccagaaccagagacagggcaattagacaccctggaaggctcccctgaaccctaagcccag

SEQ ID NO: 460 - DNA, 310 bp, Rattus norvegicus
  Genbank Accession No. AA957292
  misc_feature (1)..(310): n = a or c or g or t
tttttttttttttttttccttctcatgatttattacaacacattgttttaaatacaaaaggagggacaggaaagtgcggcctcatggggcaaggtcccaagggggaagctggcaccctggtcctcagggaccggaagccttgggcaagggacctctcctgtactgaacaacaggaggcggccaggtacattctgggccattccagtgccggcagtgaccagataagaggggtgggagagcangagagaaccatatactctccacaccgtggacagtgggtgaaaagccaccagggaaagcctgtgctcca

SEQ ID NO: 461 - DNA, 441 bp, Rattus norvegicus
  Genbank Accession No. AA957307
tttttttttttttttttcaagcctggggaggagactggggaagtcttgtgccctccccagagatgctttattgcgtggcttcaccagtcatcagtgaggagaccctgggcccattcgagatgatgggaacacccgcgcagtacccggcagatggacccagatgctgtgcagtcagatgggacagggtgaggagtggtactcggcctctctgttccagggcagacctgggatcccagcaggcagcaagtaagtctggcaaactgggaggaggcagtgttcaggcctcagtgacctccatgttctgcagctggttctccagggtgacctcttttgctttctttttgctgccttcatgttgcttcttctgcttcttagatggctcctggtcaataggtgctggcttcacaaatgggatcagttcttgcctcgtgccgaattctt

SEQ ID NO: 462 - DNA, 400 bp, Rattus norvegicus
  Genbank Accession No. AA957422
tttttttttttttttttgagcgtgatctctggcagctttattggggggtaatcccttcccattgtttagtgagcacagaggatcagggaaggaaagaggaatgaagcaaaggaggatgggagaagagaaatgtcagtgagtaagtctttggtggatatggggacattgatttagagcctagcatggttctgggaataaggtcagctagttccagaagcacggaggtagcacagccacgtcaatcatgagggcgaggagagaattaaaagcggaaaaggaatgcagctgagaacacgtgttgtaaagctattggggtggtttctcatgtttcagagtctcatatgtctcctggttccgggtgttcaggcccgtgtagacagcaaccgatttctcacggctg

SEQ ID NO: 463 - DNA, 215 bp, Rattus norvegicus
  Genbank Accession No. AA957554
tttgttttttttttattgaaatatatttctgggaaatacccaactatctaactcagcatggcctctttggcactgaaagctggggggaagagtaaaaaaataagcctggatttgtctgagtgcatagtgcatgagaactaaaggcctttggtatacaagagaggagtatgggggctgggggttataaaacttgagccaggggggctcaaggaaca

SEQ ID NO: 464 - DNA, 523 bp, Rattus norvegicus
  Genbank Accession No. AA957811
  misc_feature (1)..(523): n = a or c or g or t
tttttttttttttttttggcttttggtcattgtcaaatgtggaatgctatgggtttctagcatataatttaattctagtttttataatctgttagcccagttaaaatgtatgctacaggtaaaggaatgttatagataaaatttgaaagagttaggtttgtgtagctgtagattttttttaaagaccgatgcactaaatcgtttactgttgtgatgttaacgggggtagagtttgcaaggggactgttttaaaagtagcttctgaagcatgtgcttgcaacttaaatataagttgggtatgtgtagttcttgctataccgtggactgtattgaaaaccaaagtattaaaagggggaaacgcccctgcttatatctgtangggtattttacattcaaactgtacgttttttttccaaaatttaagtatttgggactgaattgcactaagatataacctgcaagcatataatacaataaanaaaaatcgcaaaactgtttagaacgctaataaaatttatgcagt

SEQ ID NO: 465 - DNA, 343 bp, Rattus norvegicus
  Genbank Accession No. AA957889
tttttttttttttttttggattctgggtactggtttactctcatgttgttgcttacatcaatgaggactttgcccaccagcagatgcctcaggtcccacagggatgtgtaatgttctctatggatagccacgaatattatatttgtcttcgttaaagcgtcttcatggtgggtgacgtctaccacatgaggaaaaaactcagacgcgaacttaggatttctgcttccgatgaccacgtgatagccgcacctgataagccgaatggtcagagacttggcaaaatccccacttcctatcacccccacggtgaccttccttgcgtctttgataccgtttatgccat

SEQ ID NO: 466 - DNA, 370 bp, Rattus norvegicus
  Genbank Accession No. AA957905
tttttttttttttttttcaatataagtttccttttattttgagactgcaaacagtggaatgaaattgctttgtggctgaaacaactttcaccgggaaggggcccggagtgctcatccatccaaaaatcaaacttgccaagtctgagccagctgcccctcccccagttcaagaacagagaagggtgggagggcggctcagtctaattcagagctgtgatggctggcagagttcttgtaaaatacagttccaaagtcgtcacgattacagattctaagtcacaagcagcagtcatccaatccctcccagatttccactcagaaaaatgaagtcctcactggaagccatgtcttatgactgtcaatcaatcca

SEQ ID NO: 467 - DNA, 532 bp, Rattus norvegicus
  Genbank Accession No. AA963071
tttttttttttttttttgaccatgagcagactttattggcagacaaggaagagaggacagcatcctgcagcacacagtggggtcaccacggcatctccaccttaggcgctgggtgcgtactgcagtgccaggcgatcgaaatcgttctccttggcctggtactccttgatgaaggggtgggtcctgtgtgcatccttcagctgtgacaagtatcggtttgtcacctcagggggcttgcccaggtgctgtgacagtacaatgaggttgatgagggtctcagggtggccactgtccttgtccagtgcctcttgaagcacgccctccgcggtctcccagcggccctgtgccgagtggcaggctgcctggccattgagcagcagcagtgtgggcgagcacttgtctgccagctcctggaatatgtagtaggcttcctgcagcttctcaccacccatggccaggttaacccaggcagtggccagctgggtgagggtggcgtcctcatcttgctcctgcatccgcttcagctccttcc

SEQ ID NO: 468 - DNA, 531 bp, Rattus norvegicus
  Genbank Accession No. AA963092
  misc_feature (1)..(531): n = a or c or g or t
tttttttttttttttttgctttttaaatttgctttattaatttcaaattacgaaaaagatttttttctaaaatgggttaaattgccatgctgataggaatgtttagaattcaatgcaacaattaaacaatgtttacgtagaaatcgttaagtggaaacaccaaaagtttacagaaaagataccccacaaaatacaagcttgtaaaacagtggccattttatgagcccagagaaaaccttagatttcaaggtatgaggcaaaagtcgtaatgattgtctttctccacagtgagatccagtatgacttgtttgactttggacgccattactcctgngcctatccttgccttctcctcttcctagcgatgctcaccaccaggtgtgccgcgaagcttctggtcctcagacctgttctgctcttcctcctcctcctgctttccgcgctgcccgggcccgcgtgctctgcgccaccaggagctgcgccaccaggaacaggtgcctccgttagggatggcgggcagaagagagtgag

SEQ ID NO: 469 - DNA, 483 bp, Rattus norvegicus
  Genbank Accession No. AA963201
tttttttttttttttttaaaggacaagatttaatacagcccgggatgtccacgacctctgtacagcactgaacagcaatccccctgcctcagcctcctgagctttgattctccttggtgcaggggatggaacctgagcttcctgcgtgctaggcaagccctctcccaaccgaccacatgcccagagagccggagcagtggtgctccattggtgtgctgcaggagacaggcacccgtcctgtccaccctacagccactgctgaggcttgagggtgtgtgtgtgagacaaggtctaatcctgccttgcctgtggctttcccaggggctggagacccctcccctcacccccggtgtcccgatggtcctccaggtctagaactttggaggattcaacaggaaatatcagaaaaattgggggggggcaaaattcaaagcacacggaagacgagagatcaaaacacgtgtgatggtgtatggacgctcc

SEQ ID NO: 470 - DNA, 508 bp, Rattus norvegicus
  Genbank Accession No. AA963259
  misc_feature (1)..(508): n = a or c or g or t
tttttttttttttttttgacaaccagaaaagcatctttaatatcttgaagccataggacacagctgaaatccctaaatgtgatccccgaggttgcagttaaaaggttcaagccacagcctcacaggatcttgtgtatgaaacttagggcaatgagctggaagcaggaccctgagactagtaaaaggatgtgtgggaggactcgaaccagcccaagtcctgatctgaggaacaacagttgagtggctaggtgctctgggggagttcctgttcataagccagtgtagatgctggccatgcatgtaccttgcaactcaagacagagccccatctcagcccttcaaaggaataagggaatttctagaaattttatctattactgaggtcatctgtttcctaacatttgaccataatacacaagctgggaactatctanggggcaaggactggttttagatcctgngctgtctggttttgtgagttgcaggctggtgacccccttaatctgac

SEQ ID NO: 471 - DNA, 449 bp, Rattus norvegicus
  Genbank Accession No. AA963488
tttttttttttttttttctactaaatggagtttatttctaaaagttaaaaagctccgtttacatacatatgtacagatctcagcttcgacccactcagggggtgggcacccttgggagatgaactggtcacagccaacagaagctgagactcagtgggttggctcggttctcaagacccagaagtgctagccagtctaaccccatccctgctgagactatcctcccccaggatgagtgttctgaacaggtgggactcagaagacatctcagtcagagtcacaagcctcttgtccggtggtggcgtccactgcagaggccaggttgtcttcctgcccttttagccgttcacggatcagctctgcaatggctctctgggtccgcttttctaacttctctagcttcttagccacatctctcttgagatcccaatcgggtttccggggtgcca

SEQ ID NO: 472 - DNA, 345 bp, Rattus norvegicus
  Genbank Accession No. AA963703
  misc_feature (1)..(345): n = a or c or g or t
tttttttttttttttttggattttgactcctgattttattattcaatttctttttctactaaaagtagtcttcggtggttgggaagcctggcctcccaacaccagagtcagtcggagctggtttttttgttgaaaggagtgggcgggtgggtgggggaccgggatgagggcagaaccccgctctgctggtagtcttgggtggagaagacgaactgcacttgacagagcctggggtgcggtgggagggggtgaggcangagtgacaagctggggaggggacccacctcagtcnccagctccattctcctctaatgtctctccactggtggcgttctctgcagtctt

SEQ ID NO: 473 - DNA, 242 bp, Rattus norvegicus
  Genbank Accession No. AA963746
tttttttttttttttttgcactatacgttttatttataagactagaacagtcgagagtgttcgtttaaattaactaatagaaaggggagaatggcatatgagccgctatttacagaagacaaactgaactagaggagatcagcttttgttacaaaacaggaatcacgacattcacagacgattgttttataaacattgatggaaatgttttatacttgcatactttcttccttggggaaaaa

SEQ ID NO: 474 - DNA, 537 bp, Rattus norvegicus
  Genbank Accession No. AA963797
  misc_feature (1)..(537): n = a or c or g or t
tttttttttttttttttacaaaaattcaaagattttttttttcataccaagagctagtcattggctgggggggatgtgaacactggaagatggtacttttatactacaaaattgctttacaaatacaatgtcattaaaacacaggacacacatcaacttggggtttcagtaccttagaaaacatcagttctgggatggatatggataacaaaggaacgaatcctgggcaggaacagaaatgtctgaaagctcaagggattacccttgaaaccagccacagagtgtttattgacaccgcgactcttgaaaatgggatttcgtattagtgagattccccctacaagtccctgtgttggttacatgtgagcagtcacatatgtacagtgaaggcagcttctggggcagccggctcatccagccaggtgaatggtactgttttgtgctatagaccattgtcaagactgcgctgttgacagcacctgngacatccgtgctttctccaaagaataagaaggttaaaacaagcttgtttcccta

SEQ ID NO: 475 - DNA, 220 bp, Rattus norvegicus
  Genbank Accession No. AA964147
tttttttttttttttttaaacaatcagtactatttaattggatgtctgtgccatgatggttacaaactatactctctgctctgaggaatcaaaaccaaaccagaataaagatgaacaaacatccccaaccccaatcccaagagagcagcaagaaggaatgcaggagtcttacagagcacactgattccaagggcatagcatggcattccggatttggagg

SEQ ID NO: 476 - DNA, 258 bp, Rattus norvegicus
  Genbank Accession No. AA964152
  misc_feature (1)..(258): n = a or c or g or t
tttttttttttttttttatcacagtgaaaatttttatttatgaacattgtaatcattacacacaactcagagtctctacagggccgagcaaggtcagaaggtcagctccctctcctactgtgaggtctaagtctgccaaggaggttttcttacggcagccattctcggttttgtttttggtgggaccaggagtcaaattcaggggcangtgtgtgatagctgagtgctgtacaactgaggcacaccctttgccctgtg

SEQ ID NO: 477 - DNA, 508 bp, Rattus norvegicus
  Genbank Accession No. AA964253
tttttttttttaaagatggcctattttgagcctttgtataggtacattcctgtttttgtgacaaaagaaaaactttaaactgtcccaaacagaaaataatggctatcagaagtatgttttgttttagtgtgagttaccgttactgtatttgtttattgtaaaggtgaacatttagcattcagtgcagttttcaataaaaagtaattaaaatttcttttaagtcctgacatttaagtacatctcacctatgtaaaagctagcccttgagatgtcatcacactgtcagtcagccagtttccaactcttgtggtgacattgtctgacctcacagaagtccaaattaggcaggctatcctgaagatgagacagtgctttaaggtaaagtcaattccagaaacaaaactggtttatttcagaattttgattttaatgtgcccaaatgtagtaggatgctctttttgtttgggggaagtgggggcataacctaagctaatatttacaaagtaac

SEQ ID NO: 478 - DNA, 363 bp, Rattus norvegicus
  Genbank Accession No. AA964368
tttttttttttttttttcgtattaatcacaatttattgtaaagtcatgaaaggccagcaacagtcagtctggacaatacttgattgcacccagttgatgggatgtggacagcagcactgagttacacgatgagagcaacacttcattttccacctcctaggaaaatattggttagataaggcaaaggacgggcagctactgaacggtgatattaaccatgcaagaacaacacataggtgtgcaataaacatcattgctaaatcttgggttgaataggcaagggataaaatggatttcagccaagaatttgtaacaattaatgcaaaagattttaaagaatgtcttgtagctacctttacatta

SEQ ID NO: 479 - DNA, 494 bp, Rattus norvegicus
  Genbank Accession No. AA964496
tttttttttttttttttgttactgcagcacttttatttctctttacacaatgacgtgttgctggggcctaatgttctcactgaacagtagaaaaccaaaatttgtcatttcttaaagaattgagtacaaaaaccttacataaattaaaaggatgaatacatttacaggtgtcgatgcaaacgttcccaactcaaggcaagtaacaacccatggaggtcaggagggaaaaaaccagaacagaaactgggtcctaaggctcggactttcccaccctgttagactggcaagaaaagaagtggtaactagttcaggaacccttgccagcctcgggaaatcctggaagtctgctgttggttaataccaagggaacagttaacttgaatacaaggtcaaaaatcagcaacaagttctacgatccagtgctgatatcagatacaagcttcaaggacaaatttcttttcaaaggcttattccagtttcatgaggctagcatg

SEQ ID NO: 480 - DNA, 459 bp, Rattus norvegicus
  Genbank Accession No. AA964541
tttttttttttttttttcgacaagaatgggttctttattatttcatttatttctcttaaaaaaagggtgctccttcagtataaaaaataaatatcttaaatacgacattgaataaataaaaataatctgtcagtatgaaacattcccacagggtacattcatcaaagaggaatttgtcacccaaggccaagtcccttccagaggaaaggacggaggcccagtgggctgaaccagcagtgcaaaagagaggctaggctgggactggggagtcattcgaatgcagacagccagatcatttcacttctgaagccactgccactcaaggctggcaaggtcctggcccacaagctatgtctgctcaggagtcagcaaaacagagcgggattgcttgagtcaggatcgaggacacagacacagacaagagcacagaggagacagaccagcaaactaacagtgctt

SEQ ID NO: 481 - DNA, 399 bp, Rattus norvegicus
  Genbank Accession No. AA964554
tttttttttttttttttaaaagaggaggctttaatacaaaagggggcggggcggggcctggaaatccttaaataagggtgtgtcaggagccagcaacaggggacacggggacccttcggagcgggatgatgcagactgagttccgagcctctttgatcctccaccatcgacccagcctgtgttcctgtcctactccagccaccaagaagtccccaccactggagaacttgaggctgttgataaatccaaccagggggatgtcacagagaggatcaagctgccggaagccctctccacactgccaaagtcgcacacaggcattatgggagcctgtggctacaaggtctgtattaagcagggctgccacggacgatatccataagggctgctccaggcccg

SEQ ID NO: 482 - DNA, 354 bp, Rattus norvegicus
  Genbank Accession No. AA964589
ttttttgttttttttttactgccaatgtcacgcattcacggttcaatttacatttattgagcattacacagatgatcaatcgaattcatgacgaagctaaggcacttatctgcggttccatagattattttaggttgggaaccctggagctctggctgccccttgctgtgcatataatttgaatatctattagaaatgctttcagctacaagtaagagactgctcaaaataaacaaatgtagacaatcatgtattttcaccaaacaagatatctggaggtggtcagatccccagatgatgggctatcccagcaataattctgtcaaggatccagcttccgttcttccaatctgg

SEQ ID NO: 483 - DNA, 522 bp, Rattus norvegicus
  Genbank Accession No. AA964613
tttttttttttttttttaaacatgtaaaaattaaaagtttaattcaaaaagaaataaaactatttacttacaaaccacttacacgttctttcccctgatgcacattttaaaagtacaaatagaatatgaggatcaatataaagttgtttcacaacagagaaccaaagcactcattcaaaaagaaaactattacaggatacaatgaattacctctgtgcatatgtttattaatgcaaagctgtgctttactcttttttcctactgagaacttatttacaaggatgattgacaagacaaaatacatttaacatttggtagtgataaacagtaataaatgtaatagtggtacttcctatttctttatgtctctctcttcaccacatattatcattaatgaggcatccatatggacttcaggcttttctcctgcaaaaaggcttgaccattgggaccattaccatgaactttcccaaagagtcatctttattctatggaggagtttgttacagtaattttaacagt

SEQ ID NO: 484 - DNA, 340 bp, Rattus norvegicus
  Genbank Accession No. AA964617
tttttttttttttttttgaaaaaaaaaattattttattggaactcatctgaacatcagatatacctggtgttggtcagcaagaaccgtttgtacatttgatatggatggtgccaaaaccaaaacagtgactgggcatgatgggaagagaagagggctgacaacaaaaacctgattttgaaaaggaaaataaaagccagtcagattcagtgaagatgcaaaccctggtacaacaaaatccttttacaaaatagaaatttattaccaaaacctggagggagactctgagaaaggctctaaagaagaggaagaggccagcaggaaggaggcgggagatgggga

SEQ ID NO: 485 - DNA, 539 bp, Rattus norvegicus
  Genbank Accession No. AA964687
  misc_feature (1)..(539): n = a or c or g or t
tttttttttttttttttcaggtttaaaatgtgttcaattgagacagttcccaaaaggatgccacagatgtggacaggatgccacagacgtatgggagagaggagtactgcaactcagtaggagggtgagacatagtgcactgtgaggagggaaaagcacaggacttaagcaaacacaggaagtaggtggggcaatcagaggaaggattaatactgaccagtttccagttcttaggaatcctggcatctgtttttcccaccaggaggctactaaatttagaactgtttgggtgggcagggctcgttactgatgaacaaataaactcactggaccgttctagtacttgcgaagattaatcacaataggtgtgcttgagatacattaactttcanacaaattctgcaatacaccaggtactgacatagccttaatcacgtctgggacaagtgagaatgacctggtccctgaaacagtctcacaaaaacattcttaccagggacacctccagggtggcctacgacggctggggaaaatggagg

SEQ ID NO: 486 - DNA, 437 bp, Rattus norvegicus
  Genbank Accession No. AA964752
  misc_feature (1)..(437): n = a or c or g or t
tttttttttttttttttagttttgtaaacagctaattttattccttgataccaattggttgttcatgatacatacttttctgcaagaaggcaatgaatgaaataaaggcatagaggggaaattggggaaaaaccacaatgtagtaggatgtcacttaattaaactcgtacttgattggctagttgttttagttacaatttcaagtcttatagatacagaattctactttttttccagaacaaacatatatgtccttaaagacagtgggggagacaacagatttttaactgctgagcttcttacttctaaggagaacagtcaacattgttacttcttgtccttcacagtctggaattcatgtgggtcattagcttctccaatttgattgctanggctatgtttcctttaatcttcaactttcctgacataaatgccat

SEQ ID NO: 487 - DNA, 453 bp, Rattus norvegicus
  Genbank Accession No. AA964763
  misc_feature (1)..(453): n = a or c or g or t
tttttttttttttttttagcatataaacattttaattaaaaaaaaatacaagtatggttacactaaaatatacattacaaatctatgccaaagttttaacttaatttcttttggttgaggtccggtctcagtccagctgctctgaaactcgtggcagccccgttgcctgagcttcacccacctcccaaagtttacataagaaacaaaatctgccagacgttcagcccagtggactaaagccggacgttcaggtttgcaccctggtgaagacggctgagttaatgtaatgcacatagggagaccttactccaccattgctaagtctcggaggctgtgggacttttgtctcttggccttgtanccgggccgcaggaactctatctttctcttctttgcttcacttttatttttatgtttcttcaacttcttcttggcggcaatgtcaggattggt

SEQ ID NO: 488 - DNA, 574 bp, Rattus norvegicus
  Genbank Accession No. AA964789
  misc_feature (1)..(574): n = a or c or g or t
tttttttttttttttttagtaactacgttctttaatcttcaacattcataattgcacaaagtatcactgatcatttaaataatacatgtgaaacaatctaaggaagaaactggtaaagcccagtgctgagaagcaaccgcgtcggagagtaacactgagtgcagaggggaccagctctcttggaagtttgaaatccttgccaacggggcaaagagctatggagaaacacatgggaatagattcagcctgctagaccacaccagtaaatacacagcgactctaacagcttcgctggaacagactctgcgacgtatatacaatcatttctaacactaacacccagtgcaggaatgcagaacaggaaccgatagagactttcgaaacaaaattgggtgaagaggtctacctcctgactagctgatgttaaactggcaaaccagaactttcttactgaggaaaagcattttccttaaaaatgtatatatgtcaaagatgactgaaaatcttctccatgctangggaaagctgagtgtggaaaaatttgcatttttctatctatgctgtaaagaanata

SEQ ID NO: 489 - DNA, 426 bp, Rattus norvegicus
  Genbank Accession No. AA964807
tttttttttttttttttcacaggacagtcttaactttattgaggttcttgatttaaaatggtttgcagtaaacagaacagcctgtaggggagcagcttcccaaatgttgcctgccctgtgacctacgggttgaagtccacttgacatatggattattccagatttctttttgtaattggtggtgaggaggtgatgcacggaagtagggagtatgaccaagagaaggcaaggtaaggctcagtctgcaaaacccaaactctagagggcctcaagttcaaccagttaaagcgtttcacagccactggtcaccccgctgtagctagtcaagaataaatcaaatactacagctttgccgcctcagcagatggtgagagagaactctaggccaagctttgagcctagagtgcactgggtgtcaacatcaca

SEQ ID NO: 490 - DNA, 328 bp, Rattus norvegicus
  Genbank Accession No. AA964814
tttttttttttttttttgcaattttctgatttttaatgtgacattacaactaaatgattcttccccccttcagcctttcctggctgtatcccctcttgtcaactgataggcagaccatcaaaagttttacttgtctgattcttaattcgtctctctagagcccacagtgctaagcgtgtggtgtgaatccaatcaacgtggtgaatcttcttgagcgagcagcaacactgagagtgcacagagaggtccaggtctgaagggaagagcagtagctgctgttagacactgccaacaatgatgttaaagcagcagcctccttctcagatac

SEQ ID NO: 491 - DNA, 395 bp, Rattus norvegicus
  Genbank Accession No. AA964815
ttttttttgttttttataacaatgttttattcatttattatcatttatttttatcttgtgtgtgtgtgtatgcatgcatgtgtatgtatgcaagaggggcgtgtgttcacatttgcaaatgcaggtacacatatctggtatgtgcagttcagaggagcaccttgtgcagcagcccttgttttccaccatggctgtggcaggatctcttgtctctggctgtgtgcaccaagtgagctggctcaggggcttttgggaatttttcaggctctgcctccggtttcttggcatgggttctgagaatcctaacacaggtcttcacacagcccagagttggggtgattctgggaagtcggctgctgtgccggtgatcggtgatcgtctccaagttcgtggag

SEQ ID NO: 492 - DNA, 404 bp, Rattus norvegicus
  Genbank Accession No. AA964892
tttttttttttttttttgcaaaaggcaattcatcttttattggatcaggagcgccatttggagtgtgccattatgggaggctcgtagctgtctgtccttctccttcagcaaacagaggccaacgaagcggggtgtgtttacgcaaatccctgtaaggcactttacggttttcatagtggacagtgaggtacataggatataattctagggttcgttgctgttaacaatacaaaaggaggggagaggaggacaaggagggagtagcaccatgttgtgacggcggcagaggggggcatcactatgttcttctcatgcacacttggcagcggctgacatgcgtgcgcagctcccctgccttcaaggtggacggcgtgggcttcttgaacatctcgcttctctctatg

SEQ ID NO: 493 - DNA, 289 bp, Rattus norvegicus
  Genbank Accession No. AA964962
tttttttttttttttttccgttttgtcacctgatatttaatgatgtcaacagacagcagggcggttttcacaaaagtgtttgtgacatacttagtgcttcagactttctgagcaacttggcactaataaatctggcacactcattgccagcaatggatgtgtcaccgggaaaccaggtttgtgggtcagcatggcttagtggatgaggatgtacatgccttcgacgttgattatcactggccatgactacttgacggattgttgttgcaatcccagtgagaatacacag

SEQ ID NO: 494 - DNA, 547 bp, Rattus norvegicus
  Genbank Accession No. AA964988
tttttttttttttttctaagagcgctgaacacacctttattcaagtagaaatacaaaagcacgttcctaacccaaatgcatacatgtgatttttacagattctgctacttagggatgaatcaaatcctctgcctcagtcaccagaagtgactattggtcgctataaagtaagagtatacatgtttgacagggacagaaaaacatgcatttttcatttgcttttacatttagatcaatttgatatatgttaattttcttgccctgatgagacactatgcttgctgatggcaaagaagtaaaatacagtggtaggactatccctatcctaggttagccacaaggtttacagagtgagcagcatattttatatattggttgaggatccctagtgaacattatgacatctgaactatgaaagcctcaactgcttgattgacaactagaattttaaataacacttttcttattcacaagatgttattttaagatgaaaacaaatgctttgacatcatgtaaagaatcatgaactctatgtagtatatagggc

SEQ ID NO: 495 - DNA, 386 bp, Rattus norvegicus
  Genbank Accession No. AA965023
tttttttttttttttttaccaagcactgaggtttttacaggagacgtttcaggcataccaaagttgaaacccatttctatatagagaaaaaaaatgcccattcattaaacattttcaccctcaaacattgttctttggattagataaggttggatgagagtagcaatttctctttgctctgtcctttcctacatctatggactgagagcatcatggtttagcaccatccacggatagaaatgcaatagtgggaaaagcccaagagaaaccaccacgagcttcatttggaagacatgcgagagccttgcaaccctttctcagggcactcaaagcaaacaggcgcttcccatttgccagatggaatggttcaaaggtgcctcgtgccg

SEQ ID NO: 496 - DNA, 524 bp, Rattus norvegicus
  Genbank Accession No. AA965166
tttttttttttttttttcagtaaaataactttatttcctaacatgataaacatatacatccaataggtgcccaccttacacatctatccacaaatgacttccatgtcccctcagctttgagagctaacatttagtaaaagttgtcttggttgggatgtgaggtgtctagatggctaaccttctgaacatattggaccagtcacagcggaatctaccccattaggtgagcatagaaattcagagcatggagaagttactacacttctgtgtctaatgcttccagatgaacaggatacagccgtatcagcctgcactcccaaggaatcgcatcagtttttctgatgatggaaccatttatccacgtccattggtagtgcgcaggcagactcacatggtggtggtaaagcatccacaatggctttggctgcatcaggatcacacttgaaggggctctcagacactgtggtgttcatgcaactgatccctttcccatctgtcttcttagtcactaatgccttccaata

SEQ ID NO: 497 - DNA, 442 bp, Rattus norvegicus
  Genbank Accession No. AA965207
tttttttttttttctataacggggatgtttttattgagactcgggaggtcaaaaaactcagaccagggaatccggacctgatggatatcagggctttgccagtggtagaggcggccccatgggggcaggacaagcacccactcctctgtcttcagcagcgtctttagcaaggatgccacccggatatagacatccctgcggagattaaagccttccggggggttgacatcatacagaaggtaccgtctgcgggatgccgcccccgacaggatgtccgccgccgactggccaggccagaattcttctcctgaagccgagaccggccgccaggatgctgctgccagcagcagacagacgacgctgagcgccgccatggccccggcggccacgcacttccggctgccgcgccccgctccggaagcgcgcctgtctgcccggcgga

SEQ ID NO: 498 - DNA, 482 bp, Rattus norvegicus
  Genbank Accession No. AA965280
tttttttttttttttttcacggaataaaagctgtatttacacaacatcactatacaagaatttttaaaagaaaaaggtagtgtcaagagctggtagtcaagagggaccactgtgctggctggcagccaagctcaagagattcgccttcaggaaagactctacctgcttcccagagatgccttccacctgttccaggtcctccacctcattaaaggggccatgcagctccctcgacagtcctctcggatcactaggtctcctgatgcaggatccaagaggtctaataccttttcctggtagatctccaaataggacatagcaacagaaatgtcccagggccggccctcagcactctcttcccttgttagttgcaggaggtccatgagagcccaatacaaagatggaggtgttgatggctccactctctttttagccgaattccctggtttgcctgttccacggttgtcctctgaaccagccaa

SEQ ID NO: 499 - DNA, 258 bp, Rattus norvegicus
  Genbank Accession No. AA996727
tttttttttttttttttaaggcttagttcatttattacagcacaaatatctcagaacacactgtatcagaaaagacctggcagtaaatctaagacaaacagtttccactttccaagtttgcagtcggtcaagcaggacatagatgcggagcccttttcaaatgacacagttattctgaaagtttaaggtgctacaggaacatacaaccaaggacttcattgtggagaggagaccagattcaaatctgccttcccggtt

SEQ ID NO: 500 - DNA, 203 bp, Rattus norvegicus
  Genbank Accession No. AA996782
tttttttttttttttttgcagttaaaatcagtgtttatttgaatgtacaaaagttcccagtagtaaaatgtatattacaaatcataggcagaaaagaaaaagtggaacacgtttggcatgcatcttataaaagaaaggatctgtagaagctgagcaatgtgtgcagtgcaggcggctcccagtagaagtgccactccggtaac

SEQ ID NO: 501 - DNA, 411 bp, Rattus norvegicus
  Genbank Accession No. AA996813
tttttttttttttttttacttagcaagagggttttattttacagaaaacagggagacagaagagtggggtacacaatgaggcttccatagcaattaatggtggatggtagatgctactggaatgtattttactccaagacttcagctcaggaaataaatgttgccagttagctggaagtgagaactttgacttcaaattcacatttaaattcctatttgcactcagcaaggagccaggttcgtgcacactgcttgctataaagatttggcttccacggctccacgttttttcactccaccaaaagataaggcccaggcccactgtccaatccgttggctgaaacttccgcagcctgagtgtagacaaacatcccctgaaattgctagaagttctcgtctgatagtttcagg

SEQ ID NO: 502 - DNA, 154 bp, Rattus norvegicus
  Genbank Accession No. AA996856
tttttttttttttttttagccaggaaaataggtttaatttttccacgtgcacctcagaagttacaaagcacaaacgtgatttttttccactttacattttaaccccattaaatgtgtgtgcacaaatgtgtaacctggggtgcacctcgtgccg

SEQ ID NO: 503 - DNA, 476 bp, Rattus norvegicus
  Genbank Accession No. AA997015
  misc_feature (1)..(476): n = a or c or g or t
tttttttttttttttttcaactgcacagtccaaatttattatgtgaatgaatgataacaagtaacattgagagtggatgggtgggagtgggaacatcttcagagaagcaggggaaggggttgggagaggggagaaagtggataacatttgaaatgtaagtacacaaaacatccaataaaaataaaaacagtaaaattggatgactaggtagctgtttttctatctcacaagttcacaggcagaaaaacaagcatatggtatgatactaaaccatgccatgggtgttgacaccatacaatgcacggatcccatcttaaatttccactttctcagttaaggctancanggctgagctaaagaattttgtggtatttgggttcagtaaagtcctaatacaagcaaggcatgagtctacttctgagagccacttgcaccactgaatgtactcactatgaaagatagctccccagtctttt

SEQ ID NO: 504 - DNA, 414 bp, Rattus norvegicus
  Genbank Accession No. AA997028
tttttttttttttttttcagctccaaaaacaacccaaatgctttaatagttgtctcccaaggcccagtctcatcgaacgaaacccttaaataagataggaacttgtcatccaccagctgaattcagcccactgcagggaggcgaccccaagagtcctgggaaataccacgagtacccagtccagaccatttcccagcattgggctcacacagccttgttgggtccagtccctgtagctgcttggctctagaagcatccaattctagacaatcctcctggggtgtgagatgcagcccaggtaggttacagctatgaatccagagtagacttaggctctccaggccagcaggagctggtgatggaggtggagcggaggctggggctggggaggccacggctatggctggtgggcta

SEQ ID NO: 505 - DNA, 396 bp, Rattus norvegicus
  Genbank Accession No. AA997237
  misc_feature (1)..(396): n = a or c or g or t
tttttttttttttttttaatggggcaacatttttatttctgtacattgacatacaaattttccccaaaggtacaacagatgcgacaccatgcagacacgcagctgtgaatgacagttcagagctcaacataaacttgtgctgtgaacaggtaccgcccccgtcgacacatacagtcacgcggctcttaagaggaaaagcacacatggttgggttgcagaaaggacagaggtanggaagcgttcctcactagacacaacacaccatattgtttttccaaaacacacacgatacattagagtgaggtggtgtccttcagaacagggaggagttgaagtgtgggcctccctcaacccatgtgccacccaagggctgggtgtgtgatggtcacgagattc

SEQ ID NO: 506 - DNA, 497 bp, Rattus norvegicus
  Genbank Accession No. AA997342
tttttttttttttttttgataaaaagctgtttactgtctgacaaagtcaagctcacaaagaaatttccttgagtttaataaagatgctaaaaatgttactttttaagtagttaacttttttttttttacaaagttctgtacataaaataaatatacagaagcaaaccccatcaactgtgtacatcagtaatcctcactggtgggctcaccatttataaggaagacatcattcaacgcatcctgtcacagagaccaccctgtctgtcatcaaggacttctgccccaaagggccatcactgggcctcctcgatgaagtctgagaaacagcaagaagcctccaacctactgactagcaagtggccacaaaaccaatagctgtctcgtctagagtgtggcctagtggcaatgtctatgaccaaagcccttaaaatatgaggtgttcagaacagaaatcagccctacctctccttggccagtcactgtgaaagtgtgcgtaa

SEQ ID NO: 507 - DNA, 468 bp, Rattus norvegicus
  Genbank Accession No. AA997345
  misc_feature (1)..(468): n = a or c or g or t
tttttttttttttttttgctgtatgaaaataatttttaataaaaaattttgaaagtgtcatgtcgatgggctattagaaccatgaaagttagtgttcctgtgaatgtaagttttctcagacagctaggaccagcccaccacaaggtacgcgtggaaccaaagtgcttagaggcttcggattttaattgtgcaaaagatcttgagcctaaaatgcctaagaaccatcaggctaacttgttaagagctagaacattgttaccaagcacatttgaagacggatcttttaattaaaatagggggcctggtgtcacagatcattggtagaattaacatgaaagggccctatcccaaaaatgatttggtagagtggtagagttgctcgtcttacagaacatcattctgcttgtgacaggttagaaagccattaaggcttctttgactccactgaatanaggtctgctcgtttct

SEQ ID NO: 508 - DNA, 456 bp, Rattus norvegicus
  Genbank Accession No. AA997362
tttttttttttttttttgggaaaggctttcttttactcatgattttacagctgtacttgtggccccaccacaccatgattatttagtcctaagacccccctaccccactgcacccccatcatctttccacagccagtgcttcctggtgctctcgcagggggaaggcaattcggaagatgtcgcggtagtgttccacgaagtgaacctccaggccctctgtgatgaagggagccaagtctgagaagtccttcctgttctcagcaggcaaaatgatgcaggtcactcccgcacgcttagccgcaatggtcttctccttgatgccacccacaggcaacactttaccagtgagggagacttccccagtcatggccaggttctgcaacactggctgccccagagctagggacagcaatgcagtgacaatggtgcaacctgcactagggccatccttggggg

SEQ ID NO: 509 - DNA, 478 bp, Rattus norvegicus
  Genbank Accession No. AA997374
tttttttttttttttttattttaagtggttttaatgaaaaagctattgtattcccagaagtacaaacagcatcatgatcttacatgcagactcaacaacctgcatggtgtaaggaggcttccccaggcatcccatcatccctccagccccacagtccatgattcttcctttagaagacaaagacacacatgctgaatggaaaagctctaatacaaataatctgccataaataaaattcacacttctgaatgaatcaaatacacaattaaaaatattcttttctttcttgctgtaatttaaaggtccaactctgaaaaatacagattttttaaactaaatctgtttctttcaaaagatggaagacagaactcacagccatgttgggtttcttcagccaaggctgacttctataccccaagatctacaacatgatcttctttttcggtatttttaagatgttgcccacagtttatgtgaa

SEQ ID NO: 510 - DNA, 369 bp, Rattus norvegicus
  Genbank Accession No. AA997425
tttttttttttttttataaagtatcttctctttatttaagttaaacaatttcaaggatggtttccatctataaaatggacaaagcacaagctctgtacagcagttctttttttttttttttaaaaatcaactggaaaaaaaaaattaccaaactatattttgaatttgcaaaacatactcacagacaccgtcattttcagcttcacggagactcgaggaccaccagagaggacagccaccattttgcctgtgcgtgcccaaggctcctgggagtttttaagttttttaaaaacaggagtggggttgagtttccctaaagaaaagaaatctaacgtcaaaagaaaacccaaagcaatacttgccaaaaga

SEQ ID NO: 511 - DNA, 487 bp, Rattus norvegicus
  Genbank Accession No. AA997608
tttttttttttttttttggggtgccataaagccctttatttcataactgtcattgcacttacacataaggtcacttgggttataggcaaagcgggtaaaagactgacagacacacactttcctcagggagaggagaagcggccacagaacagaatccccttggtcttaacatgctgaatgaagaaatggaagggatggtcagctaagaagcggggagtgaacctcaagcacctcatcgttatggtgctacctgtagcagctacagcctctgtaccctcctcattcacctctacaaaggccttatggatgaccttagacagaaacaagccttgcttggaagctattccagaaaagtcggccctgccctccataaaggcatcagtcatgcccaatttgccgaggacaaccttcatgtcataattctcctccagtttaaaccttgggagaaatacttccacctcttcttcatccacctcgtgccgaattc

SEQ ID NO: 512 - DNA, 309 bp, Rattus norvegicus
  Genbank Accession No. AA997656
tttttttttttttttttagaagggttgaacatcaatttttaataatgaaacttttatccagtcctcaaaattaacataaaaggcatgagaaattgaccacttctcatccccaccacggtgtaacaatcctttgttacaacatccatctactgtctccaaaaagcccaatacaaaacccacacattataccacctaatgttctaccaacagatgagagtttaacccacgttataccaggaagctattaccacggatacttcaaatcacatagctgaaaacatggagaaagggcaaggtaaaaaaatcatc

SEQ ID NO: 513 - DNA, 382 bp, Rattus norvegicus
  Genbank Accession No. AA997800
tttttttttttttttttggcagtgaatttcacagagctttattgggtaggacagagggccacatttctacctgtttacccaccaaacatttaaactgctattgctctgagagatccctggtgatcttcatgatctccattggagcttgaagagagtatgatcaggaaagctcaaagcttccttccttaagcacaggcaatattatttacagttcaccttcacactggagatgaaaatcatactggaatctatcactaaaccaaatttacttttccttcttaaatgtctttgctacacagtttcacttttctggtgacttcttgttcttaatatcttggtgtatacaatgtcttcatccttcttcagagtttttgcatctttc

SEQ ID NO: 514 - DNA, 596 bp, Rattus norvegicus
  Genbank Accession No. AA997877
tttttttttttttttttacacagtaacttgcaacatttatttagatctttataatatatcctttgataatagagaaactaaaatctgctttactgtccttataagataacatttgaaaaacgatacataataactatcagattgtcaaagctctaagacacctaaacagtagtgaacaccagaccaagatgagtgtttcctgtctacaattttcttcatatctcttaaaaaacaaaaacaaaaaataaccccaaactactagcatcctcgctgccacatgccctccccttagttaaggcttttattactggctcattgttttaaaccccaaaggggcaagaatgacagagggagagacactgaagttaaataattaattagaagaattacaataataggaaaactgagaacagatttgaatcctggaagaatgtttataagcactgttataagtctttaatgtactttagatcatatttaagtgttcatgctccttccaattatttaaagtactaacagattgaagcaaaccatgtaactgtttagatgttcagaaaaaccattctaacttaaggataggtctgtgactttgaaac

SEQ ID NO: 515 - DNA, 482 bp, Rattus norvegicus
  Genbank Accession No. AA998164
tttttttttttttttttgagctatgcaaagtaaaaaagtcacaacctttattgaagagcaaataaacatggtatcctatgtacaggcggcacatggtgccaactgcatctgcagacgaggtagtccattcgagttacgcctttgtcacggccttagacaaattctgaactagtgtacaattcagctgtgccagagtgctgatcttagcatgcttagatgttgcatacttgttcttgatcgtcatgtgctttgtgaggccacggttcaccatgactatgttcttagccaggtgctgcatcacaggaagcagagattcctccgtgtgggacaggtagtgctgcagagttggtgtccattcaccgttgtcaaggattttcagggctaagcaaaaagccccagctgcaataaacatggcagttacaccaaccagctgcagcatcttcttgggcacacaactgtcctgcatgaaccgatcgataatg

SEQ ID NO: 516 - DNA, 454 bp, Rattus norvegicus
  Genbank Accession No. AA998264
  misc_feature (1)..(454): n = a or c or g or t
tttttttttttttttttaagttcttggctaaaaatttattgatccgtccatgtatgccatttctcaggatgggaccctgggtcagggtcctagtcatactggtgggaggggtaggtcttgtgtctgtcttactcatgggcggtgaggcacagaagcatgaagtggccctggtcatgcttggatatgaccctcgagggcccttgtccatccagggtcactgtgtaggccccggttagtggttggtacccaatgtgtgggggcattacagccacgcatttcagacccgactcctgcagaatcttatgcatcctaatgtggtcatcggtcaggtcctgtangcgtgggagcacttgatcgggtcccagagtaggagggccaaggtgcaggccacggccttgtccactccatgtgccttcatggctgccacaatgtcccaagtgccctcggacattcc

SEQ ID NO: 517 - DNA, 249 bp, Rattus norvegicus
  Genbank Accession No. AA998356
tttttttttttttttatgatacaaaaatagtttattacaaaagaaatctgacccaaacctaataatttacatcgtgatcaatgtcctcccaatcccctctgttcctccgggtccgtcggggtagaggatggcagaggaggggctgtcctttggttcctccactcaaagaatcgaatatctagtggattccacagagggaaccttcgtgcctgagattaaatggggcttagagtcctgggcaatgggcgc

SEQ ID NO: 518 - DNA, 246 bp, Rattus norvegicus
  Genbank Accession No. AA998422
tttttttttttttttttaaaaattgacaagtttatttatgtcacagcatctactacagccagttcccctcctagatcactctttctccttcctagtttttcaagacagggtttatttgtttaatagttctggccaccctggaacttgctttgtacaccaggctgggcttcaactatagggagggaccactatcacgccccccaactcattttttcctttttttcggagctggggactgaacccagt

SEQ ID NO: 519 - DNA, 484 bp, Rattus norvegicus
  Genbank Accession No. AA998516
  misc_feature (1)..(484): n = a or c or g or t
cggccgcaaaggtttattcttattatcttgacagttggcagcaccaatgttaacaaaccaattaaaaattagccaaaatctaagatagacacatgtacaaaagatatacaaattaaaaccattttaaaagtaatggataacataatttgtctgtggctataccatctacattcagaaatgattgtgaaattaaaaccaaagataaaaactgtacagcatgaactctgagcgatttccatttcagtctttcactctcacacatttagtgtctctggtgggttgagaagagaaacactgtgatatctgttaagcagaggaaataaaaacctattagtaaacattcatcggggagatcacagaacanacaatttatgcgtcccaagactggagaaatgctacttttatttgattagactaatgagtttaaaaacatttgatacttaggacacatatctgttcccttaaccatctcttaccagatgca

SEQ ID NO: 520 - DNA, 617 bp, Rattus norvegicus
  Genbank Accession No. AA998565
tttttttttttttttttgtgatttttgttgggcctctttatttagaacctggcggacgaggagccctgggcagttggtatgggcagtacaggaaccatttttcgacagtctggtcaccaagtttaagagcaatctaataatgtggaggacactgtcagctaactgaagatgaatgtgtgggggcttttactcaacaaccattcctctagagtctaatacaaaagtagatttacatttgtgggtaatctgaagctggtgatttctagtgcctttggtaataatcaataagccagcagttgcgcggcagagggatccacgcatggataaatacaaacattaaattagcataatttttaactttttgttcaaatatacatgtttttcccttttctcggccttttccctcggtccacattttccaatttccccccccttttttctttttatctttttgcactgagagcgagtagagattaaacattttacataaatgatttaaagctttacaccttgggaccagcgtactccttgcacatggtacagagtgttctcaatacattgcacagttttcagatttccacaaaaccgtgggctgctctgcgcaaccatctccggtt

SEQ ID NO: 521 - DNA, 331 bp, Rattus norvegicus
  Genbank Accession No. AA998576
attacagtctgtctcagaggaatcaaaggattctttctcagacaagttgtaggtcctgcataatacatgtccagcaggacattagacagtcgtaaaggtgcaggacggtttgtgtgtgggactgacccatccacacacagcagggcgtttgttctgcctcaggctgcatctactcggtgaggttagtaaacttcagattcaaaaccaacagccatcactctctaatatgctacagtgggaaccactgatctagttaatggcagcactcttggatcaactcaattgttacttccactgttttacaactgaataagccagatccttgcctctc

SEQ ID NO: 522 - DNA, 557 bp, Rattus norvegicus
  Genbank Accession No. AA998660
tttttttttttttttttccgaataaagtttattaaataatatgtacagcgaagtagtaattcaacatgtctatcaaatcaatccacggcagtaaggaaaaacaataaatgaacagaaaaacctgtgtctgcgtagtacacgcgcttggtgtgcaatttaaatgcaatactctaataggttacatagatcggttttgtttttttctctcaataatgtcttcttttttggtagtaacctattccagcaatgtgacttaatactactgcagataaataggactgcaaacgtaaaactgcaaatatgatatgatagctgtcttctcttccccagagaacgagtgaatatgttaacaatttcccaggactatttttgtgctaaaggtccgcaagtgaattattcgaaattccttcatttaaataaaagtgttgggggggggaaacccttcgtgacttcattttactccctttctgctcaacttttaaaaattatttcttctatacaaggtaagtacatgggctccacaaagttaaacatacattacatatttacagtcccac

SEQ ID NO: 523 - DNA, 458 bp, Rattus norvegicus
  Genbank Accession No. AA999030
  misc_feature (1)..(458): n = a or c or g or t
tttttttttttttttttcacggtattccattatttattgacatcagctaaggctttcttatttaagcaaagattaatttcatcctctcctgtatataaataaagaatgtatttgtaccgaaacttcattcctgagtctctagaagatcgggcagaacagtggaattctgtagctccagaaccctcaaggatcctttgcagatttttaactgttatcccacctcctggtctgtgagctgctttatgagaggcagtccttccagtgctgaactgtcacacccactggtcagaacgcgttcaaaccccaaggtcaggagggtctccagagctgccattggatctctgtggaaagtgactggtanaggacggcagagagctacaagagacaagcatagctcttggtcaatgtgtccatcttcagtcaatgccccaaataccaaaccatcagcaccataaagc

SEQ ID NO: 524 - DNA, 200 bp, Rattus norvegicus
  Genbank Accession No. AA999169
tttttttttttttttataaagaaccatatttattttcatttacagcatcaagtatcataaataaacctaaacatcgcttgctgtgtgtgtaaaatacagggttccgtatggcactgtaaatgaattctctagggtcacagacatgccacgagatggagaggagactgtctaaagaggctgagagcaggggtggggtgcgg

SEQ ID NO: 525 - DNA, 403 bp, Rattus norvegicus
  Genbank Accession No. AA999171
tttttttttttttttttagatgtgcaaagacaattttattcaaccaatgaccaaaaagacagcaaaaaccgtttagcttggtggagtacagactgaagagagtactcatgaaaatgttcctacttctactggtgtttagttttgttcagccatagccaccaacaaagctaatcctgaagagagcaaccaagccttaagattaacacggccaatgcagaagctgcattaaggaacacgactgtttccttcccactctgatgaaggatgcccactccagtctgatatatcattgtatctaaagttgactttgaaccatgccatacgtaagacagtggaagacttgcagccatagaggataggggacatgtatctccaggacagaagtatccccacatcatgaagg

SEQ ID NO: 526 - DNA, 404 bp, Rattus norvegicus
  Genbank Accession No. AA999172
tttttttttttttttttcttcaacaacacatttattactcccactcagtggttcccgggggctttgacgttaggtcatacataattctagaaattccaggaatcttctttatctcagtgaccatctttagcaccacctctacaggaatttcattgccaggtgttgcaggtactccagtcatgaagtcactagtaataaaggttcgaataaccacagacctctggcatgaaggctgcttctgaagtggatctcgatcgaaatgtaatggggtcaaaatcactggcatctggctgattttcccagcatacccagactcccggagaatgttatgggcctcaaaatcagcttggcgtaaagtactgagcacccctgttgtcaaaaatgttgcctcgtgccgaattctt

SEQ ID NO: 527 - DNA, 6251 bp, Rattus norvegicus
  Genbank Accession No. AB000717
tctagagtggttctacatatggctttggttctttcagaacccccaagtccattggtttggtactaagttatataacaagaaactgagtgttgtctaataataggggaaaggcactttttaaagaagttagtgaccttgacaattggctccttagtgggattgtaacagatttttaaatgtgggggataaactagaacagttgtctttaaaatatactgtgaagttatttcctatggtaggctttgagatttcaagataaatcacctttttgactctgaataatttaagtttacatgactgttctgtatttaacaaaaaattgtttggctaggatattagactttcgaaatctgaaatatatatccaggtgtaactagattcattgtaggtgtaaatgggctaaggtgtgttaaatatgctgaaagttattgcctaattgaattggtgagcttgtgttactaatattaaggcctcaatattgtttctaagtaacatgtccctatatacaatttgtattccagcaaatagctcctgataaaaacagtgctttagtaatagtaaagctctccatacttcatgcactggtgttgaatttgttcccttcagagttccgggggtactgccagtgagattggtcaggcggttaagagtgcttgttcccaagcctgttgtgacctgagtttaatccctggacctaggacacataatggagagaagcccatacctcttaatgttttcagttgaacaccatcgcacaagtgtgagccatgtatcgaagtaatgcagcatttttaaaatttgataatcacctacaaattcatagctatatttgaacctcaggttagacataaacttagttacagaagatagggttaatagtaatagttaagttgaaccaggaatttttattttccagataagatttgtgaccaaatcaatgatgctgtccttgatgcacaccttcagcaggaccctgatgctaaagtggcttgtggtaggtacaaaaccctgcttatgagtgggggaaaagggttttgtttttgtttttgtttttttcccctcagagctggggaccgaacccagggccttgtgcttgctaggcaagcgctctaccactgagctaaatccccaaccccggaaaaagggcttttaaagcctacctaaagtattataggtaataccagctacttgggaggctgaggctggagggagcatgttaaataaagtcctatgtgggtaatttgccaagaccttatctcaaaaatagaaaatgaagcccagggatatagcatgtataacataatttgagtccctcagtcccaccccagtcaccctcattgaatagggtgatatctttaaatatcaagtctaaatttttgttttattagaaactgttgctaaaactggaatgatccttcttgctggggaaattacatctagagctgccattgattaccagaaagtggttcgtgaagccataaagcacattggctatgatgattcttccaaaggtaggttatagaggggtcccccccccccccgtaaactcaattttgcagataaagaatgtgatgctagagtgaagcttctagaatattccttccttgaaatctttgattctggttgcatagttaaacaatatcctctcatctttctgaggctgcctattctgtcctctaaaatgctacatttattgtaaaagcagtctcttatcctacaaataaacagatttatatcaatagtagccagatacgatatgcctgtaagctcagcttctcagtgtcagtgtgggagttaggtgtgcttagttgtagtttgaagctaaccaagttagagaccttgtttcaaactgttgtctagagggggcaggcctcctagagagtcttttaagagtgcttgaccacttactttggcatgtccagaattctagcagcagcacagcactgccattaacattttggaagttaaaacaaggattattggaacaccttgttttatagggtttgactacaagacttgtaatgtgttggttgccttggaacaacagtcaccagatatcgcccaaggtgttcatcttgaccggaatgaggaagacattggtgcaggagatcaggtattgtgatagtttgttaggatctcttaacttattctaaattctaaagcttgtattgaccacttcttcatatttttagggtttgatgtttggttatgccactgatgaaactgaagagtgtatgcctttaactattgtcttagcacacaagctaaatgctaaactggctgagctacgccgcaatggcacattgccttggttacgcccagattctaaaactcaagtaagtggcaatcctaaacctacatttgtctcaaatcacattaaaattcccaagtaagttaactatagctgaatggggaggataatacttgtctttactatatttaaacttgggaagagaacccctataaagctgttgagttagacaagtattctcgtctgtttggcattcaaggtgactgtgcagtatatgcaagatcgaggtgctgtgattcccatcagagtccatacaattgttatatctgttcagcatgatgaagaagtttgtcttgatgaaatgagggatgctctgaaggagaaattgatcaaagctgttgtacctgcaaagtaccttgatgaggatacaatttaccacctacagccaagtggcagattcgttattggtgggcctcaggtaatagatgaaatgcctatggtttatcattggttactaaaaactttggctgccactattttttttctagctaccctgccctgttccctttacacacactcacttgtaaggcagggaaaagttggatcagagttacggccagcctggattacaaagcaggttcctagacagccagggctattacacagactctcacagaaaagaaaaaattacatgacttaaatcctataattccagggtgatgctggtttgactggccgaaaaatcattgtggatacttatggcggttggggagctcatggaggaggggccttttcaggaaaggattataccaaagtggaccgttcagctgcttatgctgctcgttgggtggcaaaatcccttgttaaaggaggtctgtgcaggagggttcttgttcaggtatgtaatgagtgaacgttacatgggagaagggtacttagttaaatgtttcaaatactttcctcttttataacaacgtcttactgacttttaggtctcttatgctattggagtttctcatccattgtcgatctccattttccattatggtacttctcagaagagtgagagagagctattagaaattgtgaagaataattttgatcttcgccctggggtcattgtcaggtaaagatggtaaagcctattgctagtgagaaataggggggtggaacatatactaaaatctgaggaggtaaaggtagcctcctcatgagggaaaacattttaattgctggaacatgccaatattttaaattggctggagagggacctagttgttctgtgacttaacattctagaaaggtctccatctttgattcttagctttgtgcttatcttaaataagggtactacattaagaattaatgagttaaagtgggatgctcaaagttaaaagaaaataaccatagtgatcattggttggaccttggtaagtactcaattggaattcctgagaatgataagtttttgtatttgtcaagccagggctggaaaacgagaactgtagttattaatggggactgtgcaagtaacacaagggaagtaacaaacacttttgccatgaacttttttcctagcaaaccccagggagaactgaactcatttgccagagctcttgaaatgagtcttgctgattgttttgctttgttttaatttaatgctacatattaagttatggacttatatattccagggatctggatctgaagaagccaatttatcagaggactgcagcctatggccactttggtagggacagcttcccctgggaagtgcccaaaaagcttaaatattgaaagtgttagccttttttccccagacttgttggcgtaggttacagagaagccttcaagctctgagggaaagggcctttttcctaaatttttctgtcctctttcagctcctgatcagttgcagtcactctaatcaatgacatgaattttagcttttgttggggactgtaagttgggcttgctattctgtccctaggtgttttgttcaccattataatggatatagtaagcataggtgacccatgtaactgcctagaaacaaacactgtagtgaataatgctttgaaatcgaacctttgtgccctatcacctaatcctccaaagtcctaattgcaattactttcccaccagatgctgaaaatgtccttgtaatgtgcacgtaaagtacttgtgtttgactcacagccctgtcagcatgaatttgtaatgtcttgagctctatttattgaatgtgaagccccctccttcccttatcctccctgtaactcagtcatttctaattatgtagttctttgtcagggagtgttcctatccaatcaaacttgcatgaaacgaaaagtttcaattggagctctagcctgacttaaagaaaaaggcagttacaattaaaccatctccctggtgcttatgctataaattgccacctcaaacagcaccaaatcaaaatctctccacttttcagctgtctttggaggacgtagtaataaggttttatttagtaaaccaatcctatgcatggtttcagcactagccaaacctcaccaacttttagtctagaaaacaggcacttggcacccttgtgatgtcatacagagaagtcacagggcagtacccgagggtctgtaggttgcacactttggtaccaggtaacttttttttctttataagaaagagtactccacactgcacaatagctcctcccagggtttttaactttgttttattttcaaaaccaggtccaatgagctttctgaacagctggtgtagctacagagaaaccagcttccttcagagagcagtgcttttggcggggaggaggaaatcccttcatacttgaacattttctaattgcttatttattgtattctggggtatggcgtaagtacagagaagccatcacctcagatggcagcttttaaaagattttttttttctttgacaccatgattcctttaacatgtttccagcattcccaggtaggccaaggtgtcctacagaaaaaccttgggttagacctacagggggtctggctggtgttaacagaagggagggcagagctggtgcagctggccatggagaagctgacttggctggtgtggtacagagaagccagcttgtttacatgcttattccatgactgcttgccctaagcaagaaagtgcctttcaggatctatttttggaggttattacgtatgtctggttctcaattccaacagttaatgaagatctaaataaaatgctaggttctacccaaactaaactgtccattacttgtctgttgttgctttctgagttataatttatagcgtctgccacccattgccaccaataaagttttcaaccaggtctaagatagtcatgggggggttggggatttagctcagtggtagagcgcttgcctggaagcgcaaggcccttggttcggtccccagctccgaaaaaaagaaccaaaaaaaaaatagtcatgggtacttggtactgttcatacactggtgtgtggaggtcagaacctgagttatttacatttactacatgaggtcctggtaatgaatattcatgtcttaagtcttgggtaattagcccccttcccaataagcacctgtggcagaagcaagtagattctcaagttgaaggctcaacagttcccaggaacaggttaggggcttttgtggtgataggaatttagtttatttgctagataagcattttgtttagcactaaaaacatgagatttgtttatactgtgcctggtggtgatggtatgttccttaaatcctagtacttggaaggcaaagatgaacataatatagttcatcagtttctgggagtctaagaaaagtggcacatgtatctatcccagcattgaagagattgagttaacatgggcaaacccttatctcaagcttttagatgcttgtttgctcaagacaggaaccagagagattgctcaatggagtggtaagaaccaggacaaatgggaattc

SEQ ID NO: 528 - DNA, 4945 bp, Rattus norvegicus
  Genbank Accession No. AB000778
ccaaagttgagctttggaacaggccggcttcccctgtttttgtggatttgtaggatagccaatttccccccatctcgactttcaactgctttggacattagcttcataggaagaattcattctttagagtaaaatggagcgccgctttttgccaggggccccagcccctctgtttttaccctgtcagaagttagaatgtcactaaaaagtgaggcccgggtgaacacttctacactgcagaagatcgccgcagatatgagcaacctgatagaaaatctcgacacccgggaacttcattttgagggagaggaggtggagtatgatgcatctccaggagaccccacggctcaggaagcgtgcatcccattctcttctatttacaacactcaaggatttaaggagcccaacatccagatctacctctctggctgtcctgtaaaagcacaagtactggaagtggagcgcttcacgtcgacctcgaggatgccaagtgtcaacctgtacaccatcgagttaacacacggggaattcacatggcaagttaagaggaaattcaagcacttccaagagtttcatagagagctcctcaagtacaaagccttcatccggatccccattcccaccaaaagacatacgtttagaagacaaaatgtcaaagaagagcccagagaaatgcccagtctgccccgttcatcagaaaatgcaatccaggaggagcagttctttggcaggaggaagcaactggaagattacttgacaaaaatactaaaaatgcccatgtacagaaactatcatgccacgacagagttccttgatgtaagccaactgtcttttatccatgatttgggaccaaagggcctggaaggaatgatcatgaaaagatctgggggacacaggataccaggtgtgaattgctgtggccatggaagagcctgctaccggtggtcaaagaggtggttgatagtgaaagactctttcctgctgtatatgaaaccagacagcggggcgatcgccttcgtccttcttgtagacaaagaattcagaatcaaagtgggaaagaaggagacagaaacaaaatatggacttcgaattgataatctttcaaggacactgattttaaaatgtaacagctacagacatgcccggtggtggggaggcgccatcgaggagttcatccagaagcacggcactgacttcctcaaagaccatcgcttcggctcctacgctgcggtccacgagaacattttagctaaatggtacgtgaacgccaaaggttactttgaagatatcgcaaacgcaatggaaggggcaacggaagagatttttatcacagattggtggttaagtccagaaatcttcctgaagcgcccagtggtggaaggcaaccgctggaggctggactgcatcctcaaacggaaagcacaacaaggtgtgcggattttcataatgctttacaaagaggtggagctagccctcgggatcaacagcgagtacaccaagcggactttgatgcggctgcaccccaacataaaggtgatgagacacccagaccatgtgtcctccagtgtgtatctgtgggctcatcacgagaagctcgtcattatcgaccaatcggtggcgtttgtgggtgggattgacctggcctatggacggtgggatgacaatgagcacagactcacagatgtgggcagtgtcaagcgggtcacctcaggacagtctctgggctctctcacggcagcatcagtagagtctatggaatccttaagcctcaaggacaaacatcaatctcataaaaacgagcccgtcttaaagagtgtcgacgataccgacatgaaactgaaaggcatagggaagtccaggaaattctccaaatttagcctctatcgccaacttcaccgccgtaatctgcacaactcggacagcatcagcagcgtcgacagcgcctccagttattttaaccactatagaagtcatcagaatttaatccatgggttaaagccccacttgaaactctttcgcccttccagtgagtctgagcagggcctcactaggcacagtgctgacaccggctccatccgaagtgtgcagacaggagtgggagagctccatggggagactaggttttggcatgggaaggattactgcaactttgtcttcaaggactgggttcaactggacaaaccttttgctgatttcatcgacaggtactccaccccccggatgccttggcatgacattggttctgtggttcacggaaaggcagctcgtgacgtggctcgacacttcatccagcgctggaacttcacaaagattatgaagccaaaatatcgttccctttcttatcctttcctgctcccaaagtctcaagccacagcgcatgagctgaggtatcaggtgccaggggccgtccacgccaaagcgcagttgctccgatctgctgctgactggtctgctggtataaagcaccacgaggaatctatccatgctgcctacacccatgtcatagagaacagcaagcactacatctatattgaaaaccaatttttcataagctgcgctgatgataaagtcgtgttcaacaaggtgggcaatgctatcgcccagagaatcctgaaagcccacagggaaggccagagatatcgagtgtacatcgtgataccactgctgccgggattcgaaggagacatttccacaggcgggggaaatgccctacaggcaataatgcacttcaactacagaaccatgtgcagaggggagagctccatccttgaacagttaaagccagagcttggtaacaagtggataaattacatatcattttgcggtctgagaacacatgcagagctggaaggaaaccttgtcactgagctcatctatgtccacagcaagttgttaattgctgatgataacacggttatcataggttctgccaacatcaatgaccggagcatgctgggaaagcgagacagcgaaatggctgtcatagtgcaggacacagagacagtcccgtcagtgatggatggaaaagaatatcaagctggccgcttcgctcaaggccttcggctggagtgcttcaggcttgtcctgggttatctttctgacccaagtgaggacattcaggatcctgtaagtgacaaattcttcaaggagatttgggtttcaacggcagctcgaaatgctaccatatatgataaggtcttccggtgccttcccaatgacgaagtgcacaatttaatccagttgcgggactttataaacaagcctatattggcaaaagaggaccgccttcgtgccgaggaagaactgaggaagatccgtggcttcttggtgcagttccccttctacttcttatcagaagaaaacctgctgccttccgttggaaccaaggaagccattgtgcccatggaggtttggacttaagataaaccttttgtagttgagggtcttccaacctgaagactacagtatatgctgacttctaaggacttcacagccatagccaggcctgatgtcctcctgtgaactggtgtaaggatgctggacataaacagggcttcatcactcctccgacttgtccttgagaaaagtggctacatcctgttgatagcatatgctcaaataataccaaacatggagacaaattccgtgatatatttcaaaacccattccctttgctaacaagaatctgtctgtaactttgatccgggttgccaaacgttgcctgagcactgctgttcttcgctgatgtccgtttacacgctggggcccaccttgtcatccatacagcactgtttacaagattgcttatcaatgaaagacattggagaagctgccttgagggtcctcaaggatccaggtgatgcctgtacccaacctggtcctgatgtgagcttatttaccacgccaaaacttttctctctgttctttttcagtcactgtagggacagaacaggctttgcctacctacccacactaggcacttcttaacaacaggcaggcattaagtcctaatactgaagaagattccagttcccagagatgctgcccagctgtgtccttgtcatctgataacatttgtaaacatgtgcagcgcatgtcaatacatagcaaccagataagcacagatggagcctccaaggtgtcagtgggaacccagttcagataaaggacaatattcctgacagtctgtctttcttagccactggattgatagaaaaaaagttgattctctccactgtaagtccagtggatgttaatttgtcttccaactgaatcaaaggctttataatgcccttttcctaagaaacatgagtctaacctgatttacccttcagttttccactaggccttcttcaggggaaaaagcaatgattatacaagatctctcctttgcttgtactgtcaactacatagtaacattccaacatagcttccaaagaagcgataattcacattgttccaatgggatatccacattccctttcagatggtattgtgtcctttgtagaccaaatttcagagttccccttgtatcatgggagtgtctgtgggtgcctggaagcctggagcttatgcacgtgagataactatgtgactgtaagcaaaaggggttcactggagtaaaatctcttcaaagctgctcccgacccatgtttttatgaataaatatgctggtttaaaagatgacacaggaccacaaagccagtgatgtggattagtaacagagcagcagtcacatccaaaggaggatgtcacccctgaggaacactgtacaaatgaggtgggatttgtaatcaacaatggaaattaacatgtttttatgaataaataacttatttcttatatggccaaggatgataaaattatttcattctatagttatggtgaataaaacactttatgcagataaagatctgattacatttaaaatagtcaatgtatatgg

SEQ ID NO: 529 - DNA, 1587 bp, Rattus norvegicus
  Genbank Accession No. AB002406
cgcaggttgtggctgcacacactcgtcaaaatgaagattgaggaggtgaagagcaccacgaagacgcaacgcattgcctcccacagccacgtgaaggggctggggctggatgagagcggcctggccaagcaggcggcttcggggctcgtgggccaggagaacgcgagagaggcatgtggtgtcatagtcgaattaatcaaaagcaagaaaatggctggaagagctgtcttgttggcagggcctcctggaactggcaagacagccttggccctggctattgctcaggaactgggcagtaaagtccctttctgcccgatggtgggtagtgaagtatactcaactgagatcaagaagacagaggtgctgatggagaacttccgaagggctattgggctgcggataaaggagactaaggaggtttatgaaggggaggtgacagagctcactccctgtgagacagagaaccccatgggtgggtatggcaaaactatcagccacgtgatcatagggctcaagactgccaaaggaaccaaacagctgaagctggaccccagtatttttgaaagtttgcagaaagaacgagtagaggctggagatgtgatttacattgaagcaaacagtggagctgtgaagaggcaaggcaggtgtgacacctatgccacagagtttgaccttgaggctgaagagtatgtccctttgccaaagggagatgtgcacaagaagaaggaaatcatacaggatgtgaccttgcacgacttggacgtggccaatgcgcggcctcagggtgggcaagatattctgtctatgatgggccagttgatgaagccaaaaaagacagagatcacagataaacttcgaggggagatcaacaaggtggtgaacaaatacattgaccagggcgttgcagagctggtccctggagtgctctttgttgacgaggtccacatgctggatatcgagtgctttacctacctgcaccgagccctggagtcctccatcgcccccattgtcatctttgcatccaaccgaggcaactgtgtcatcaggggcaccgaggacatcacttctccacacggcatcccgttggacctgctggaccgggtgatgatcatcaggaccatgctgtatacgccacaggagatgaagcagatcattaagatccgagcccagacggaaggcatcaacatcagtgaggaggccctaaaccacctcggggagattggcaccaagaccacgctgaggtattcagtgcagctgctgacccctgccaacctgctggccaagatcaacgggaaggacagcattgagaaggagcacgtggaggagatcagcgagctcttctatgacgccaagtcctccgccaagattctggccgaccagcaggacaagtacatgaagtaacgtagggtttggaggtgcacccagaggacagaccccacaccgaggacagggtcttgcgttgagcatgctttgcagtgttacagtttgtttgtaaattatcaaacctccaaggttgtttggaaggaaccctttcccacctagcttgtttttctaataaaactgaatcttattttgatgataaaaaaa

SEQ ID NO: 530 - DNA, 4025 bp, Rattus norvegicus
  Genbank Accession No. AB003753
gatatccattcacatatatatgtgtatgtatgtgtgtgtctgtgtgtgtgtcaatatagatacatatatatatatgtgtgtgtgtcatatagatacatatatatatgtatatgaagacaaagacagaaagctatgtaaaaacaaagttattgaaagcttcagattttagtgcatgtattggtgatcaccctgttaaatggtatccattgatagcatgcaatatatattgtatatgaaatgcttgatatatgtgtatatatacatatatacatatatgtgttttgtccatatatacatatatatgtatagaagcatgaagacagaaaatgatggaaaaggcaaagtcgtcaaaggcttgggttttcaaagtgtgcattgatgacccaaaaggaagtatcattgatctgtaatcattctaatctgcacagtctgatcccaggaaggccgactttgcttggatgctgatcagctaaacagctcatgttttgatgacaccaatattagtcttaccgagtctgagtaaactgtttatgaaatgatgattgttactgagtggatgctaaggaaataaattttcagtttggataaactgggcctaaggttatcaaaggtcagctgagacaaagcaagccagggtagtatatgacatgtgacttttatagaaggactactgtgcttggtaatacaccttctcttagactagagagaaaagaggaagcacagtgccacttaattgatcactgactatagcagatgctgtaaatactgtttatagttttttcaattattcaggtacgggccaatcaaagactgactttgcaactagtgtcaagggaagacgctaaatcttagatgaatacgtagctatagggaatatataaaaggccaggtgaggaagacacaaccaaaactcagaaacttctcctcacagaacaaccaacttgactcctgacaccatggcctgctgtgctactagcttctgtggctttcccacctgctccactggtggcacctgtggctctaactgctgccaacccagctgctcccagtccagctgttgccagcccagctgctcccagtccagctgctgccagcccagctgcacccagtccagctgctgccagcccacctgctcccagtccagctgctgtcagcccacctgctcccagtccagctgctgtcagcccagctgctgccagaccagctgctgccagcctacctgctgtcagaatagcagctgtcagaccagctgctgtggaactggcagtggccaggagggtggcagtggagccacgagctgccgtgttagatggtgccgccctgactgccgcgtggagggcacctgcctgcccccttgctgtgtggtgagctgcacacccccaacctgctgccagctgcaccacgcccaggcctcctgctgccgtccatcctactgtggacagtcctgctgccgcccagcctgctgctgccactgttgcgagcccagttgctctaagcccagctgctctgagcccagctgttaagacccatgttcctgagttgttagaaatgaaatggaaagcactgaagagttgtgtaaactgctacggacatgttctgtgtggtgaacgctaagtatcttcactttgctaacctgttcatcatagtggaactcttcaacaggatccccacagacgtgttggaattagtgcactgaacacatgtctcaatcagaatgttctggggatctttctttgctcaggtgacacacaaggatgcatcagtacatcatcccagtgacttgtggacgttctcctctagttccctacacatcttcagccatgctttctacttgaagagaccccgatgctctcaaagtgttttatgcccaagtgaatagatttctgttcaccttctaactttacgctgcccctgtttaaatgatagtaaccttcaggcatagacacataatctaaagcaaaatggttttatgaaaattaacttatgtttgaattgtctgctaataaaaattttctatgcattaaatactcttcatggctatttaaatgtgtgaatgttttattaaaatagacccagacccatagagttaccctgcatggactttttatatcaagtttaaccttgtcccatttagtacagtagatttttttttctttattcatgcactgcttaaaagaaactagattatctaccaagtagattggaaaatatctgccagtactatttctaatagtacttgggtttaattcctacaacttggcctaactccactccaccgatgtccagctgtgtgagcttcaactctcaacatccagatgtacttactgggtgggtgagggatacatctgtacttgacagagagtagagccagcagctgtgaggtgtaactgctgagttccaccatcacatcatacagacgcattagaaatctcaaaccgcagtatcacagtttgtaacttacaagccaattgaaaaaaaaaatgcctttcttaagacgtgaacacaaacctagagcaaaaggacatagattctatcgtgtaatgttaattcttatacaagcagttgactacaatacacaaactacataaagacctaagaaatttttttcaggctatttacatatccccagcacttacctctctcgttaaattggctgccatgatgaattacaaacaaaatggtacattccagaaaagagagaattggatgactgtacatttgtccaaggtgtcatcgctcctggatatttttctcaagctttttccaaccactaaattcaaacaaaaatagctcagcattccccagtgtcttcatggcaaataagtcttcgtgggcggcgctacaacttgaaagtgtttttactcattcttgagtggtgcaggcgttcgtgaatcataccttatactccaccccctcagttaatgaccactgaatcagattcaataaacatttaataagaatatatgaaaatcaggctggaaactttctgaaaaaaaaaaaaacaagttgtttggttcacagtgaaggaactctctctagcctgaactctaaataatgcttacatatttccaatccattgaaatgaaaagaaccagaaagaccatttgactctggtgctggagtcaatgtggtagatgtttccattgcatgtgaccaaagttgtgctcaatttggccagtccgccagtgctttaaattcgatagaattcagtctacatatgcaagagagaaaagtcattcttgaaaagacccaattgccttctgcattaggggtttgggtggatgggccaagtggcatgacaactattcagaatcagggcgttgccctaacctacagtgagaagactctttgaacatggaaaccacaaacacgactctaaagagtatgtggccaatagaacgagtcacagcgaccttataaaacaaaaccatccccataatatgtcacaagtatttcaatggaagccaatcagaggaccactgaggaacaaatttcaacgaaaacaagaaaaatatgttaagaattttataaacagccactcgctcaactatataaagggccccatgctcaggtttgcactcaaacacagaaactcatccaacctactcaacatccaatcaactcctgacaccatggcctgctgctctactagcttctgtggctttcccacctgctccactggtggcacctgtggctccagctgcttccagcccagctgttgtgagaccagctgcttccagccaagctgctgtgagacaggctatggcattgggggtggcattggctatggcctagagggtggcagtggagccgtgaactaccgtgttagatggtgccgccctgactgccgcgtggagggcacctccctgcccccctgctgtgtggtgagctgtatacccccaacctgctgccagctgcaccatgcccaggcctcctgctgccgtccatcctactgtggacagtcctgctgccgtccagcctgctgctgctactgctgctaatctacctattaagagccagatatc

SEQ ID NO: 531 - DNA, 1902 bp, Rattus norvegicus
  Genbank Accession No. AB010635
tagcccgacgaactgagaactggccatggcacggaaacaaccacatagctggctgaatgctgtgctctttgggctcctgcttattcttatccatgtgtggggtcaggactcaccagagtccagctccatcaggaccacacacacgggccaggtccgaggaaagcttgaccacgtgagggacactaaagctggtgtccacaccttcctgggaattccctttgccaaggctcctgtaggaccgctgcgctttgcacctcctgaggaccctgagccatggagtggtgtgagagatgggacctcacatccggccatgtgtctgcaaaatattgatatgctggatgaagtaggcctgacagatatgaaaatgatactgtcttccattcctatgtctgaggactgcctgtatctcaacatctatacaccagcccatgcccatgagggctctaacctgcctgtgatggtgtgcatccacggaggtgcactggttataggaatggcttccatgtgtgatggatctctattggcagtcaatgaggacttggtggttgtcgctatccagtatcgtctgggtgtcctgggctttttcagcactggagatgagcatgccagaggcaactggggatacctggaccaagtggctgccctgcgatgggtccagcagaatatcgcccattttggaggcaaccctaaccgggtcactatttttggcgtgtctgcaggtggcacaagtgtgtcttcacatgttatatcccccatgtctcaagggctcttccatggtgccatcatggagagtggagtggccctgctgcctgaccttatctctgaaacctctgagacggtctccactacagtggccaagctctctggatgtgaggccacggactcagagaccctggtgcgctgcctgagagccaagagtggagcagagattctggtcattaacaaggtcttcaagatgattcccgctgtggtggatggagagttcctacccaggcatcccaaagagctgttggcatctgaggattttcgccctgtccccagcatcattggtgttaacactgatgagtactgttgcaccattcctatggtcatgggcactgctcaaataataaaggagctatccagagagaacctgcaggctgttctaaaggatacagcagcacaaatgatgcttcctcctgagtgtggtgacctgctaatggaagagtacatggggaatactgatgatccccagaccctacaaatacagtacgctgagatgatgggagacttcctgtttgtgatccctgcactccaagttgcacactttcaacgttcccatgcccctgtctacttctatgagttccaacatgcacccagctatttcaagaatgtcaggccaccccacgtgaaggctgaccatgctgatgaggttccttttgtctttgggtccttcttctggggcataaaagttgacttcactgaggaggagaagctgctgagtaggcggatgatgaagtactgggccaattttgcaagacacgggaaccccaacagcgagggtctaccctactggcctgtgttggaccacgacgagcagtacctgcagttggacacccagcctgctgtggaccgagccctgaaggccagaaggctgcagttctggaccaagactctgccccagaagatccaggagctaaatggagctcagaaaaaccatgcagagctgtagtgtctggtgaaaggaacagagtgtgggagtgagggcaggtgggatcattctgagtttcaaagtctaattttctgttccaacacgcagaatcctttccaaccccaatattttccctttctgacatgaatgagaagccctccgtgtgttactctttattcttctgggcaaaatttaattggactcaataaaga

SEQ ID NO: 532 - DNA, 5253 bp, Rattus norvegicus
  Genbank Accession No. AB012214
ggaattcgcggccggtcgacccggggtctcgttcagagctgtcctgtcgtctgcaacctgcaagatgccagcacgaacagctccagcccgagtgcctgcacttgcctccccggcaggctcgctccccgaccatgtccgcaggcggctcaaagacttggaaagagatggcttaacagaaaaggagtgtgtgaaagagaaattgaacttactgcatgaattcctgcaaacagaaataaaaagccagctatgcgacttggaaaccaaactacataaagaggaattgtctgaggaaggctacctggctaaagtcaagacccttctaaataaggatttgtgcctggagaacggaacactctctctcactcagaaagccaacggttgtcctgccaacgggagtcggccaacctggaaagcagaaatggcagactcaaaccgatccccaagatccaggcccaagcctcggggacccaggaggagcaagtcggacagtgagaccatgattgaagcttcatctagttcggtggctacgaggagaaccaccaggcagaccaccatcacgtctcacttcaagggtcccgctaaacggaaacccaaggaagactctgaaaagggaaacgcaaatgaatctgctgcagaggagagagaccaggataagaaacgcagagtcgcaggcacagagagtcgtgccagtcgtgccggagagtctgtggagaaacctgaacgagtaaggccaggaacccagctgtgtcaggaagagcaaggtgaacaggaagatgacaggagacctcgacgtcaaaccagagagctagcatcaaggcggaaatcaagggaggacccagacagagaagcaaggccaggaactcacttggatgtggacgatgacgatgaaaaggacaaaagaagttccaggcccagaagccagcccagagatctagccaccaaacggagacccaaggaagaagtagagcagatcactccagagcctcccgagggcaaagatgaggacgaaagggaggagaagagacgaaaaacgacacgtaaaaagccggaaccactcagcattcccgtacagagcagagtggagagaaaagcctctcagggcaaagcaagtgcaatcccaaagctcaacccgccacagtgccctgagtgtggccagtacctagatgaccctgacctgaagtaccagcagcaccctgtggatgctgtggatgaaccccagatgctgaccaatgaggcactgtccgtctttgactccaactcgtcttggtttgagacctatgattcctctcccatgcataagttcactttcttcagtgtgtattgcagtcgcggtcacttgtgtcctgtcgacactggtctcattgagaagaacgttgaactctacttttctggtgttgccaaagcaattcatgaagaaaatccgtctgtggaaggtggtgttaatggcaagaacctggggccaatcaatcagtggtggatcagtggctttgacggtggcgagaaggcgctcattggcttttctaccgcatttgctgaatactttctgatggagcccagcccagagtatgcaccaatatttgggctgatgcaggagaaaatttacatcagcaagattgtggtcgagttcctgcagagcaatcctgacgctgtctatgaagacttgatcaataagatcgagaccactgttcctccttctgccatcaatgtgaaccggttcaccgaggactccctcctacgccatgcccagtttgtggtgagccaggtagaaagttacgacgacgctaaggacgatgatgagacgcccatcttcttgtctccctgtatgaggtccctgatccatttggctggtgtctcgctgggacagaggcgagcaacaaggcgcacggtcatcaattctgccaaagtgaagcgcaaggggcccacaaaagccaccaccaccaagctggtctatcagatcttcgacactttcttctcggagcagatcgagaaggatgacaaggaggacaaagagaacaccatgaagcgccgccggtgtggtgtctgtgaggtctgtcaacagcctgagtgtgggaagtgcaaggcgtgcaaagacatggttaagtttggtggcaccggacggagtaaacaggcttgcctcaagaggaggtgtcctaacttggccgtaaaggaggcagatgaagacgaagaagctgatgatgatataccagagttgccgtcacccaaaaagttgcaccaagggaagaagaagaaacagaataaggatcgcatctcctggctcggggagcctgtgaagatcgaagagaacagaacttactattggaaggtgagcatcgacgaagagactctggaggtgggcgactgcgtctcggtcattccggatgatccctccaaaccactgtatctagccagggtcacagcactgtgggaagacaagaacgggcagatgttccatgcacactggttctgcgcggggacagacacggtcctcggagccacctctgaccctctggagctgttccttgtaggcgagtgtgaaaacatgcaactttcctacatccacagcaaggtcaaggtcatctacagagggccttccccaaactgggccatggagggaggcatggaccctgaggccatgttgccgggggctgaggatgggaagacctacttctaccagttctggtacagccaggactacgcaaggtttgagtccccacccaagacccagccggcggaggacaataagcacaagttctgcctatcttgtatccggctggctgagctgagacaaaaagaaatgcccaaagtcctggaacaacttgaggaggtggacggccgggtctactgcagttctatcaccaagaacggtgttgtctaccgactgggtgacagtgtgtacctgcctcctgaggcctttactttcaacatcaaaatggccagccccatgaaacgctctaagagggaccctgtgaatgagaaccctgtaccccgagacacttaccgcaagtattccgactacatcaaaggaagcaacctggacgcccctgaaccctatcggattggtcggataaaagagatctactgtggcaagaagaaaggtggcaaggtcaatgaggcagacatcaagatcaggctctacaagttctataggcctgagaacacccacaagtccatccaggcaacctaccacgccgacatcaacctgctctactggagcgatgaggaagccgtggtggacttcagcgacgtgcaaggccgctgcaccgtggagtacggagaggacctgcttgagagcatccaggattactcacagggcggccccgaccgcttctactttctcgaggcctacaattcaaagactaaaagctttgaagaccctccgaaccatgcccgcagccctgggaacaaaggcaaaggaaaggggaaagggaaagggaagggaaaacctcaggtatcagagcccaaagagcccgaggcagccatcaaactgcctaagctgcggaccctggatgtgttttctggctgtggaggattaacagaaggattccaccaagcaggcatctcggagacgctgtgggccatcgagatgtgggaaccagcagcccaggcatttcggttgaacaaccctggcaccacggtgttcacagaggactgcaacgtgcttctcaagctggtcatggctggtgaggtgaccaactctctgggccagaggctgccacagaagggcgatgtggagatgctgtgtggtgggccgccctgccagggcttcagtggcatgaaccgtttcaactctcgtacttactccaagttcaaaaactccctcgtggtctccttcctcagctactgtgactactaccggcctcggttcttcctcttggagaatgtcaggaactccgtgtccttcaggcgctccatggtgctgaagctcacactgcgctgcctggtccgcatgggctaccagtgcaccttcggtgtgctccaggctggacagtatggtgtggcccagacacgaaggagggccatcatcttggctgcagcccctggagagaagctgcctctgttcccagaacctctacacgtgtttgccccccgtgcctgccagctgagtgttgtggtggacgacaagaagttcgttagcaacattacaaggctaagctcgggtcccttccgaaccatcacggtgcgagataccatgtctgacctccctgagatccagaatggagcctcagcccccgagatctcctacaatggagagccacagtcctggttccagaggcagctgcgagggtctcactaccagcccatcctcagggaccatatctgcaaggacatgagcgcgctggtggctgcccgtatgcggcacatcccgctgtccccaggatcggattggcgtgacctgcccaacatacaagtgcggctgagagatggcgtcataaccaataaacttcgctacactttccacgacacgaagaacggctgcagcagcaccggggccctccgtggggtctgctcctgtgcggaaggcaagacctgcgaccctgcttccagacaattcaacacgctcatcccctggtgcctgccgcacactgggaaccggcacaaccactgggctggcctctacgggcgtctggagtgggatggcttcttcagtaccaccgtcaccaaccctgagcccatgggcaagcaaggccgggtgctccatcccgagcagcaccgggtcgtgagtgtgcgggaatgtgctcgctcccaaggctttccagatacctaccggttattcggcaacatcctggacagacaccggcaggtggggaacgctgtgccaccaccactggccaaagccatcggcctggagattaagctctgtctgctggccagcgctcaggagagtgcctcagctgcagttaaaggaaaggaggagactactaccgaggactagtgctctcacccagagccccacgtgcactgatgtttttaacccgtcgagccccatcatttgaagtgttctgctcagtgtctgtgaccatggctgacactaagctgtttggaggtttgttttgtgaccaagccgtgtagtctttgtgcattctgaattttaaggttttgtttttttgtttttttgttttgtttttttattctgtattctatcagatctgccactgtgtgggtggcaagtgagacttgatgtagttttatatgttgtaatatttcttcaaaataaagcgcttctataaagcaaaaaaaaaaaaaaaaaaaaaa

SEQ ID NO: 533 - DNA, 2351 bp, Rattus norvegicus
  Genbank Accession No. AB015645
ctaactccaatccaggggatgcaatgccatcttctggcctccagaggcactacatacacacatgatacacagaatatacacacgtgtatatttaggtaaagtgcctgtgcacataaaaaaaaataaaaaggaaaaaaattaaatcagaaggaacaggcaccggtcacttaccaaggtcaaggcctacagggcaccacagaaaacaccagcaagatggatggccccagtaatgtctcgctcattcacggtgacaccacgctgggcctgccagagtacaaggtggtctcagtcttcctagtgctcctggtgtgcaccctgggcatcgtgggcaatgccatggtgattctggtggtgctgacctcacgtgacatgcacacacccaccaactgctacctggtcagcctggccctcgctgacctcctcgtgctgctggctgcgggtctgcccaatgtctctgacagcctagtggggcactggatctatggacgtgctggctgcttgggcatcacctacttccagtacctgggcatcaatgtctcctccttctccatcctggccttcactgtggagaggtatatagccatttgccacccactgagagcacagaccgtgtgcactgtggcccgggccaaacggatcatcgcaggcatctggggggtcacgtccctctattgcctactctggttcttcctggtggatctcaatgtccgtgacaaccagcgccttgaatgtggctacaaagtgccccgaggactctacctgcccatctacctgctggacttcgctgtctttttcatcggacccttgctggtgaccctcgtgctctatgggctcatcgggaggattttatttcagagcccgttgtcccaggaagcctggcagaaggagaggcagccccatgggcagagcgaggctgcaccaggcaactgctccagggccaagagctccaggaagcaggccaccaggatgctggccgtggttgtgttgctttttgccgtgctgtggaccccttaccgcacactggtactgctcaactcctttgtggcccagcctttcctggacccctgggtcctgctgttctgccgcacctgtgtctacaccaacagcgctgtcaaccctgtcgtctacagcctgatgtcacagaagttccgggcggccttcctgaaactgtgctggtgcagggcagctgggccacagcggagggcagcacgcgtcctcaccagtaactacagtgccgcccaggagacctcagtaggaactgagaagatgtagctgggctccagtgaggtctcaggtcccacggcagcaggtcccctgggctgtcagcatgagccctacttcagtgtgctctgaggactcccgcctggcccctgaccccgcttgcggcctggttggcatttgggaggcatcaggagaggggcaggcagctccttgcttatgggtttccagaggttcctttaccatggaggaaggcgctggaatgttctcagctgcaccctgcgtgggtaattctcctctctgcagagaggaagctggaggcccagccttcagcgcctgtgggatcaaatcccctcatccgtgttcactcagtgctttaagcacctttcacgggtgtcacctaatgtccttccatgctgccatcgcatctgtccctcgctgagtccgtgcacacagggaccctggactctggggtttacatagaacgggtgtccagccagtcacgtcgcactctgggctgctccatgaggttcatctccagcctcagcaccccttccagtcctccatcacagtgggcagccctgcaagagactctgccaagtgagctcaaccactgtgcatgttcctgaaggagatcactatttgtctttccgatggccatcaggcggccacctctacctcctcgaccccaaatgtgcaggcctggctctctgaacccactttgccagctgctgccctgcataccacgtctactggaggcgcgctgcggactcagagacgaggcggcaggaaaagcctttgctgagggacagcccagtcgctggctgagcctgaggacagcaggcctctgggtcccaccctgcaaatgtggtcagtgatcctatctcggtcctgagacctcaaggtggagggactcagtcgcgaggatgttccaacaagcagggctgtttgctctgtgacgggagacctcaggaaggcaggaattggggggatggatgctttggggtgtgtggtcggcctgggtgactcagcctactcaagctgtttctggcttcctggctggatgtggtcctagtgactcatccctgctctggggagctcaggtgctccaaaatagatgtggctttttaggg

SEQ ID NO: 534 - DNA, 2436 bp, Rattus norvegicus
  Genbank Accession No. AF013144
agctttccggggcagcgagtggcggggccgggtgctgagcgagcggggcgtggagagcgtcgcgcggcccctcgcgccgggctccgtttgcaggccacagcccccgcgaggtggcccgccggccctgggccgcccgtcctctggcagctgtggtgagcgcagcgtcgggccggcatgaaggtcacgtcgctcgacgggcgccggctgcgcaagatgctccgcaaggaggcggaggcgcgctgcgtggtgctcgattgccggccctacctggccttcgccgcgtcgagcgtgcgcggctcgctcaacgtcaacctcaactccgtggtgctgcggcgggcccggggcggcgcggtgtctgcgcgctacgtgctggccgacgaggcagcccgcgctcggctgctgcaggagggcggcggcggcgtggcggcggtggtcgtgctggaccagggcagccgccactggcagaagctgcgggaggagagtgccgcgcgcgtcgtcctcacctcgctgctggcctgtctgtccgccggaccgcgggtctacttccttaaaggtgggtacgagaccttctactcacagtatcctgagtgctgtgtggatgcgaagcccatttcacaagagaagctcgaaggtgaaagaggcctcctcagccagtgcggaaagcccattctcagcgtcgcctacagaccagcttatgaccagggtggcccagttgaaatccttcccttcctctaccttggaagtgcctaccatgcatccaagtgcgagttcctcgccaacctgcacatcacagccctgctgaatgtttcccgccggacctctgaggcctgcacaacccacctacactacaagtggatccctgtggaggacagccacaccgccgacattagctcccactttcaagaagcaatagattttattgactgtgtcagggaagagggaggcaaggtcctggttcactgtgaagccggggtctcccggtcgcccaccatctgcatggcttacctcatgaagaccaagcagttccgcctgaaggaggccttcgagtatatcaagcagaggaggagcgtggtctctcccaactttggcttcatgggacagctcctgcagtatgagtctgagatcctgccctccacacccaccccccaacctccctcctgccaaggggaggcagccagctccacctttataggccacttacagacactgagccctgatatgcagggtgcctactgcacattccctacctcagtgctggcaccggtgcccacccacgccaccgtcgcagagctccacaggagccccgtggccacagccacatcctgctgagaccggtcggctaccagcgcatccccaagagcaactgtgacctttggattttttaaacttgtggacatttcatacccgtgcaatactgaagacctctctctgtcccgctgccccggtgagatggtgaggggtcagcaggcttgcagatgcacttcaggctaacccggaggatggtttctcgcgattgtaggaaggccaagccatgcccccctagcacagcggcgtgctaactactgtacttccagaagccccgcccactcaggaccgcctcatccttgcacctcagaagtcccggcttctcatttcaagtgtaaggcaatacacagtcgcagcaaagtaggagcaagctgtgctggaccaggaggggaggagtccgcccgtctgggaggaagcacaagtttcactgttaatttgaatttcggccaactttgtctgtctctgtcctctgtcacttcagggaagagagctggtcaccgctcagtcagaaaagttaaccccgctggatttgtcaagacaaaaggacctgcccgtctgaacccagtgtttctgaggttctgtctaggatcccatggaagctgttggtgtaaggagaagctcctgactcattggagtttcttgctcaccgagggctccttggtgaccttggactttggcatggtttttacaaatacttgaacctgtcccattgtatctctccctaaagcacctctggtgtcattcagaaagttgtcagaccctagaccaaaaaccacccctttgagggggtagcaggaactgcctgcgttctgggtcagtggtggtgactgacatactttttcagtttagtgtcctgtgtgctttttttgtcatccattgtgacaatgtttccctccctaccctggggagtcgttttcaaactactgattctggggtctgcatcgtttgcaatgtggtactactatgtccttcgtagattgtttttccaaggggggaaaggcaataagtcacccccaaacccatgtgaatgtgaagaaaagcagtgttgatgttttttttatatatatatatatacatgtagtacaaaattaaaaaaatgtcaaaaaataaaaataaaaagtgctaagtgaa

SEQ ID NO: 535 - DNA, 2046 bp, Rattus norvegicus
  Genbank Accession No. AF015911
cgccgcggcggccgcagaggcggaggccgaggccgaggcgcaggggggcgcgccccgggcccaggcccggccccagctgccgctgcggagcccgccgggaggccccggagcgcggccacagcgcagctgctgccatggcgcagaccctgcagatggagattccaaactttggcaacagcatcctcgagtgcctcaatgagcagcggctacagggactgtattgtgacgtgtcagtggtggtaaagggccatgccttcaaagcccaccgtgctgtgttggccgccagcagctcctacttccgggacctattcaacagcagccgcagtgctgtggtagaactgccagccgctgtgcagccacagtcattccagcagatcctcacgttttgttatacaggccggctgagcatgaacatgggggaccagttcctgctcatctacacagccggcttcctgcagatccaggagatcatggagaaaggcactgagttcttcctcaaagttagctctccaagttgcgactcccagggcctgcacccggaggaggccccatcctcagagcctcagagtcctgtagcgcagatattgggctggccagcctgtagcacgccactgccccttgtgtcacgggtcaagacagaacaggagttggactcggtgcaatgcacacccatggccaagaggctatgggatagcagccagaaggaagctggaggcagtggtggcaacaatggcagccgcaagatggccaagttctccacgccagacctggcccctaaccggatgccccagccagtctctgtggccacagctacagcagcagtggctgtggttgcagtggggggatgtgtgagtgggcccagcatgtcagagcggaccagcccaggtacctccagtgcttacactagtgacagccccagctcctaccacaacgaagaagacgaagaggaagatgcaggtgaggagggcacagatgagcagtaccgtcagatctgcaatatgtataccatgtacagtatgttgaacgttggccagacagttgagaaggtggaggctcttcctgagcaggtcgtccttgagtcccacagtcgcattcgagtgcggcaagacctggcatctctcccagctgagctcatcaaccagatcggcaatcgctgccacccaaagctctacgatgaaggcgacccctcagagaagctggagcttgtgacaggcaccaatgtatacatcacaagggcacaactcatgaactgccacgtcagtgcaggcacgcggcacaaggtcttgctgcggcggctcctggcttccttctttgaccggaacacactggccaatagctgtggcaccggcatccgttcttccaccaatgaccctagacgcaagccactggacagtcgtgtcctccatgctgtcaagtactactgccagaacttcgcccccaacttcaaggagagcgagatgaatgccattgcagccgacatgtgcaccaatgcccgccgagtggtccgtaaaagctggctgcccaagaccaagccgctacacctggtggagggcgataactacagcagcttcatcagcgacactggcaagatagaaccggacatgatgagcatggaacacagcttcgagacagccagccacgatggcgaggctggcccttcagctgaggttctccagtaacatacatgtgacacccccttaccggatgtcacattccccctcctatcacacccccacctaccacctacctggtcacgatctactgtctgtccctccccagaacctgtgagggggtgttcagtgccctctatcggatgcaagagctggctgaccaaggccaaagcactgtacctagcagagggcagtgccgacagcagctttctcaatgaccatgaggaagagctgaacttggtaggcatagaatacagcttccacacagacagccccctcagcagaggtcctccagtacctgcccaggaccctcccatggatgtcacactcccctcctgtcacacacatacccccaccttagtcacgagctactgtg

SEQ ID NO: 536 - DNA, 2225 bp, Rattus norvegicus
  Genbank Accession No. AF020618
ctgcagtacttgtacattgctaaataaagagagggactccaggaggagcagcctgggtctaagaggtaggcagaaggaggttttaggggcctgagcacaagcttgaggagagaaaggttattaaaaagccagacgcttacaggtctcagaagggctagccagaaactgtggctggggttaaggaaagggtttaagagtgtgggcttttggttctgaggatgtagaacgtgaatgttgagagaagaaccaagtggcggagttgggtgtgagcaatgctattaggaatttgaggcagggattcacgcgctgctgtgactattttttaacaatgactcagtgctgtgacctgatactgtttccagagcgacttctaaacaaattccccctttctaggccagacacatggccccaagcccaagaccccagcatgtcctgcactggaaggaagcccactctttctacctcctgtctccactgatgggcttcctcagccgggcctggagccgcctgagggggcccgaggtctcagaggcctggttggcagaaacagtagcaggagcaaaccagatagaggctgatgctctgttgacgcctcccccggtctctgaaaatcacctacctctccgagagactgaaggaaatggaactcctgaatggagtaaagcagcccagaggctctgccttgatgtggaagcccaaagttcccctcctaaaacttggggactttcagatattgatgaacataatgggaagccaggacaagatggccttagagagcaagaagtggagcacacagctggcctgcctacactacagccccttcacctgcaaggggcagataagaaagttggggaggtggtggctagagaagagggtgtgtccgagctggcttaccccacatcacactgggagggtggtccagctgaggatgaagaggatacagaaaccgtgaagaaggctcaccaggcctctgctgcttccatagctccaggatataaacccagcacttctgtgtattgcccaggggaggcagaacatcgagccacggaggaaaaaggaacagacaataaggctgaaccctcaggctcccactccagagtctgggagtaccacactagagagaggcctaagcaggagggagaaactaagccagagcaacacagggcagggcagagtcacccttgtcagaatgcagaggctgaggaaggaggacctgagacttctgtctgttctggcagtgccttcctgaaggcctgggtgtatcgcccaggagaggacacagaggaggaagaagacagtgatttggattcagctgaggaagacacagctcatacctgtaccaccccccatacaagtgccttcctgaaggcctgggtctatcgcccaggagaggacacagaagaggaagatgacggtgattgggattcagctgaggaagacgcgtctcagagctgtaccaccccccatacaagtgccttcctgaaggcctgggtctatcgcccaggagaggacacagaagaggaagacgacagtgagaatgtggccccagttgactcagaaacagttgactcttgccagagtacccagcattgtctaccagtagagaagaccaagggatgtggagaagcagagccccctcccttccagtggccttctatttacctggacagaagccagcaccaccttgggctgcccctaagctgccccttcgactgcagaagcggctcagatctttcaaagcccccgcccggaatcagggccctgagattcctctgaagggtagaaaggtgcacttctctgagaaagttacagtccatttccttgctgtctgggcaggaccagcccaggctgctcgtcgaggcccctgggagcagtttgcacgagatcgaagccgctttgctcgacgcattgccaggcagaggagcagctgggtccttaccttacccctgctttcagggccagagcatggacacgccttagaaacctaccccttcctctgtcgtcctcgtctcttccactgcctgagccttgctcttccactgaggccacacccctcagccaagatgtgaccactccctctccccttcccagtgaaatccctcctcccagcctggacttgggaggaaggcgggctaagcctgagtagttttttgtgtattctatgagtgttagtctcttaatacgaatatgtaacgccttttgcatttgtaaaaaaaaaaaaaaaa

SEQ ID NO: 537 - DNA, 4158 bp, Rattus norvegicus
  Genbank Accession No. AF024712
aatggacctggagcgtccttctgaggctggtttagttattggctttttttttcttttttctttttaatcaagaacattctaagaacccacaaacgggaagcccctttccccaataacgtttggacacacacttgtgttcactttggttgtttgtgggaattttgtagaaccactgagagtcatggggatccgctcccacacacccacaacgctataaaactccacagagaggaacaaagacccaacctctacaagttctccaaacacggaggatggggtccgtggtgccgcgcatcttcttctttttgctgctggtgacctcgccctggccccaactcaggtccacgccagtgagtgtggggtggaaagtgaagcgcttctgcgggaaggaggaagggcgctgaccagagatagcactgggaaagctacatcttggtcatcgcccaaccctccctcccctcctagaattgggccagcccctcccaggcttccttctgcaacccttgtcgggagccccacaccctagctctcctcccagagggtccacctgtccccaggtccacctgggttcaggctcacactccctgcggtatttcaccaccaccttgtacgatcctggctaccgcaaacctcggttcaccgtcgtgggctacgtggacaacacacagatcgtgaacttcgacagcgacttggcgagtcagcgggtggagccgcgggtgccgtttatagcgcaggatcctgagcatttggaggagctgacacgcctaggcagggggatcttaatacttggccgaatcgaactgtggaccctgttcggttaccatagccagagagagaatggtaagtgaccccatactcagaaggctagtctacagtctccgcatattcctatggaatatataccctgagttggtgaaatctgcaagttcctgccagcctggagatgcctgcaaaaatttactgtggtttcatttcagtttgaaataggctttgaccaatcacgcgcaggctatgtgcaatgagcgggactaacctaggacacggtgttgacctctttggcttcaacagagtctcacactgtccagtggctattcggctgtgacatagggccagaccgtcgcctcctccgtgggtataagcacgttgcttatgaaggccaggattacatctctctaaccgaggacctgcgctcctgggttgcggtggataccgaggaggctcagatcaccaggcgcaagtgggaggcatctggtattgctacatcatggaggtctttcttggagggcaggtgcgttgaagtggcttctcaaatacctggataaagggaaggagatgctgcagcgtgcaggtatgaggggtagcttctattgacccttgagcagagtttatgggaaggaaagagaatgggaccaattcctaagccacctgttgtgaaatactgtcccccccccctccaccccccaccctgccaggctgataatgtttcaaaatcagaatagctgtgattaccctcactggggattcaggattggtgtgtgtgtgtgtgcgtgtgcgtgtgtgtgtgtgtgtgtgtgtgtgtgtgtgtgtgtgtgtgagaattgatgaagtccgtggtggcacactctagtacgggagcttttgtgagctgtcatacatactggatgggcttttcggtgttgtaggcgctatgagtactaagtagctcctcactcgggcctgtaagtaaccttcaataaatgtattgatggacttggatggaaatccttcatttggtctgtggttgaagtcctttctggcctggatagatatctatcatcactctccagagaaagcaataagccgctttacacctcagaccaaaccactctacacagcaggcccaaaatgggctagggaggatcagtttcatggttcctgggatgtaaaatgtgaaattgaagccaaaccatccacggtgggaattactcgtgtggctctgctttctctgtgtggtgtggaatggcggctgagggttgcactgtggcatgggggacagggctcacatccgggactgctccatcctaaggcgtatggatacctatgccgggaaggatctgtcccgacactgacaccaatttctgaaacaaccctgtggggcaggattctaagcagacagtggcagcacttatgtgcccttccctatggacggttgagacttgcaactagggctgagccatcttcccagaaagaccttgcccacctaagggaggaattacaatgggaagaaggtgtccaagtgctcccccccccttttttttcttttctaacttcaaattggagtgaaaatcggaaagggggaacgtcagaattgaggtgctggcttaccacttgttatgactgggttggtggtggtgaaggaaggcataagggaaagagtagaaattagatctgctcccggaatccaaaaggctttcatgccgtggggatagatgcagctgggatctgagtgatgtagaagtggagaaattgagtgctgtcactgctcattcctgtgcagtctaaggcaaaacgaaagaatcattgggtcagcaagacgtttggtgctcgccatagagcctgacaacctgagcctggaaccctgagcacacatggcagaaggagagaacagttgtcttttgaccttcagatatgtgctacacatgtataggtacacacacacacacacacacaggatctcccagtaaccaactctcttcagctaccgcatccccttaaatattccactaggagtcatcaccatcaccagatacaaagcatcaaacacctgaacccatggggggaacattttacattcaaagcacggtagtgactccatctttttctgggatggaaggggcaccaactctgaagagtgggtgccagttccactttgatctcaccccgtttctgccaatgttcacagatcaggaatagttccaaggaataggtatttctacctcctaagtccatgctgttttaagagatgctttctaaattttcaacccaactacggggatgatcacatgaccaatgctcaaatggttcacaggaaaaaacaagttgttctcctctgatctcctcagatccccccaaaacaaacgtggctcatcaccctagacctgaaggtgatgtcaccctgaggtgctgggccctggacttctaccctgctgacatcatcctgacttggcaaagggatgaggaggacctgacccaggacatggaccttgtagagaccagacctacagggaatggaactttccagaagtgggcatctgtggtggtgccttcaggagaagagcatagatacacatgccatgtgctgcatgaggggctgcttgagcccctcatcctgagatggggtaaaaggtagtgtgtgggcacacagtctgtaccctggggaaagcaggagcccttctgcagaacttgagcatgtccttcacttctatcctccctcaccctctctctcccagaaagaccttttaccccccccaactccatcatggggacattctctggtctggttctccttggaagtttggtcactggacctgtgctgccattatgaggaggaggaagagtgcaggtaaggatggtgtttgagatttgggtcttactgagaaatttcaagccctggaaaccaaatgtgccatcttctgtttttgttactataaagtgtatccatttgtgtgttttagctacatggagactgtttttaaactaactctgtaaggaacacctggaaatagaggacagggatttcaagttgaggattctggtgatgtggacacaaatctgaggcagagtctccaggaggaggaaacaggtctctgggagggcactccacttttttttcctgtacaaatcctttcctcacgtttcctgacctagttccaggtctgtctgtaccatactcatggaatatttattgcctgaggtctaggactaggagtttcctctagaaccaaatcattctgcacccctttctccacctttatcctcacagagatggaaaaggaagttaacttaatcatttttatcattttatttccaccccttgacgtcaagtcacagccaacactgaaagtctagaaaggaaacagagacctagtccctccatcattcagttaaacatgcctgcag

SEQ ID NO: 538 - DNA, 3044 bp, Rattus norvegicus
  Genbank Accession No. AF030358
tgcactccagccatccagccatggctccctcacagctcgcgtggctgctgcgcctggccgcgttctttcatctgtgtactctgctggcgggtcagcacctcggcatgacgaaatgcaacatcacgtgccacaagatgacctcgccaatcccagtgaccttgctcatccactatcaactgaaccaggagtcctgcggcaagcgcgccatcatcctggagacgagacagcacagacacttctgtgctgacccaaaggagaaatgggtccaagacgccatgaagcacctggaccaccagaccgctgccctgactagaaatggtggcaagtttgagaagcgtgtggacaatgtgacacctaggatcacctcggccaccaggggactgtccccaactgccctggcaaagcctgagtcagccacagtggaagaccttactttggaaccgactgctatttcccaggaggcccgaaggcccatggggacttcccaagagccaccagcagcagtgactggatcgtctccctcaacttccaaagctcaggatgcagggcttgccgccaagcctcagagcactggaatttctgaggtggctgctgtctctaccaccatttggccgagttctgctgtctaccaatctggatctagcctctgggccgaggaaaaagctactgaatccccccccactatagccctatctactcaagcgtccaccacttcaagccccaagcagaatgttgggtctgaaggccagcccccatgggtccaggagcaggactccactccagagaaatctccagggcctgaggagacaaacccagttcatactgatattttccaagacagaggacctggcagcacagtccatccctcagtggctcccacctcctctgaaaagacccccagcccggagctggtggcctcgggcagccaggctcctaaggtagaggaacccattcatgccactgcagatccccagaaactgagtgtgtttatcactcctgtccctgactcccaggcagccacccggaggcaggcagtggggttactggcctttcttggtctactcttctgtctgggggtggccatgtttgcctaccagagcctccagggctgtccccgcaaaatggcaggggagatggtggaaggcctccgctacgtcccccgtagctgtggcagtaactcgtacgtcctggtgccggtgtgagctgcctgcttgcctgcctgtgtccagagtgtgattcagacagctgtctggggacccccatcctcatacccaccttcatccacgctgggagaatgggaatgcagaagctagatcctccaggggccatgtgctccaacccccgaggagtggccctggaggccaccctagaccattattcacttatcagagacagacagagcaggtggccttccagctcccccatatttgaaagaatcctctgctgctggctggttagaggggcccttgacatcccaaactctatgagcaattatttattggattcccagccccctgagacacccgtttccccgtgcgcaccgtggtccacccatcttacaagcagcagccaggcctctctgcctgtcccctgacctcctcgtgtctcctggctttgctgcagtcgccagccctgtctcctccccggccagctgcggtgctatctatcccggtctctctctctcgtgtacagagccatcaccaccatcaccaccaacaactcgttctgtctttgcttgcatgaggttaatgctgtgttttctggagctctctgggacgggagatgagcttctgtgagggtttaaagtgttcctccccagactttgatgtgccgtgaagcatgctgcctctgaaggaaggctctggtccccactccgctgccagcacaacaaagtgccccacctgtaaaggaaaagagactcggcccagagctggcaaaaacccatggccctgacatcatcactttctctgagatctttgtccccatccctggatgccaccccccccccccagcccttatcaacatgaatagtcactgccattccactggactgacacttttgtatgctgtgattctgagggctggcaagggatgacttgagagtgcagatcctacccatgggcccccaaatggaggctgagctggggacctgcaggaagagaggccaactcagaaggctccgctgtgttctcactggcacccctcccctgtgcaccaaggtgacagtcacaggtctgccctgcctgaagaacaagccacagaaggaagattatgacaagtccctgggaggccaaggatccagggcaaaccctggagtggccacacacccaatttcagcttagggacttgtgcatgtgtgtacttgcacagcccagatcattcagaagctgccaggatcctttcctacatctgagagcgcagttcctgccaaggtctcaccttcgcctcacttcaggcagggcagaactcccataacattctccaagagccctgtgacgtgttctggaagggactctgccctgggcacaaagtgtctactgaagcagagagcagcgccccagccccagccccagcgccccagcgggagctgtaccggcagaccacgccctgggggggagggccctccgtggcagctttccgctctgaatagctccaaccgtcacctttggagcctcccaggggcgggcttcacccagccagtgactcactccttgataggtggaagctcagaacaggtggtctcgtcccagagtgaggaagccagccccttggcgaccctcctcttgggaagcttgtgggaggctctggtctggctccagagtactagttgtaggcctgaggagcagcagcccgagtgcactatatcctggttcttcggtggggagccttcaagggttgggacacccatggttggactttgttggttcccgcgcctcgtgggccaaaacaatctgaggaggactttggaaggagttggtttttcaagcatcattaccaatgtctgtgccattttgtattttactaataaaattttaaagtcttgt

SEQ ID NO: 539 - DNA, 1892 bp, Rattus norvegicus
  Genbank Accession No. AF034218
cgggcgggcttagctggtaccaggatggcggcggccctggcgtgggtcctggcggcgcctggtgcgagttcctgagctgctaccaggcaggtgacacttcctgtagcccccagcatgcgggcaggactgggtcccatcatcacactggccctagtgctggaggtagcatgggcctcggagcttaagcccacagcgccgcccatcttcaccggccgaccctttgtggtagcatggaatgtacccacacaagaatgtgctccgcgccacaaagtgcccctggaccttagggccttcgatgtggaggctacacctaacgagggttttttcaaccagaatatcaccaccttctactatgaccgtctaggcctgtatccacgttttgatgcagctgggatgtctgtgcatggtggcgtgcctcagaacggtagcctctgtgcacacctgcccatgctgaaggaagctgtggaacgctacattcagacccaagagcctgcggggctggcggtcattgactgggaggaatggcgaccagtgtgggttcgaaactggcaggagaaagatgtgtaccggcagtcttcacgccagctggtggccagtcgacaccctgactggccatcagaccgaatagtgaagcaggcgcagtacgaattcgagttcgctgctcggcagttcatgttgaacacactccgttacgtcaaggcagtcagacctcagcacctgtggggcttctacctctttcctgactgctataatcatgattacgtacagaactgggatagctacacaggccgctgtcctgacgtggaggtggcacaaaatgaccagttggcctggctctgggctgaaaatacagctctctttccctccgtgtacctggacaagacgctggcatcctccaaacacagccgcaactttgtcagcttccgtgttcaggaagcccttcgtgtggctcacacccaccatgcaaaccatgcactccccgtgtatgtcttcacgcgtcccacatatacccgaaggctcacagaacttaaccagatggacctcatctctaccatcggtgaaagcgccgccctgggctcagctggtgttatcttctggggcgactcagtgtacgcttcaagtatggaaaactgccagaacctcaagaagtacctaacgcagacgctggtcccctacatagtcaatgtgtcctgggccacccagtactgcagttggacccagtgccatggccatgggcgctgtgtgcgccgcaatcccagcgccagtaccttcttgcacctcagtcccagcagcttccgcctggtgcctggccgcacgcccagtgaaccccagcttcgacctgagggggagctcagcgaagatgacctcagctacctgcagatgcactttcgctgccactgctatctgggctggggtggtgagcagtgccagtggaaccataaacgggcagctggggatgccagtagagcctgggctggagcccacctcgccagtctcctgggtttggtagctatgactctcacctggaccttataagggatctctccccgcagatagcagtccagctggcctctggcacaaggatctccttggcacaaggagcctgttagggggtaggcaaatgagtctggagttggagtgggcagtacccccaggatgcctagaagagcatccataccacctgtcacccccctgttctaagggggagagaaacatcccctgagatgccctcatcttgccagagaagacgaggatacagttaggccggggaaggcctacctctactctctgttcctggatagtttataatcttggggtctcttttgtaaattaaatacaaaacaactgcaaaaaaaaaaaaaaaaaaaaaaaaaaaaaaaaaaaaaaaaaaa

SEQ ID NO: 540 - DNA, 529 bp, Rattus norvegicus
  Genbank Accession No. AF035955
atctttgcatatggacagactggcactggaaaaacttttacaatggaaggtgaaaggtcacctaatgaagtatatacctgggaggaggatcctctggctggtataattccacgtactcttcatcagatttttgagaaacttactgataatggcactgagttttcagtgaaagtatccctattggaaatctataatgaggagctttttgatcttctgagtccgtcttctgatgtttctgaaaggctgcagatgtttgatgatccccggaacaagagaggagtgataatcaaaggcttagaggaaatcacagtacacaacaaacatgaagtctaccaaatcttagagaggggggcagccaaaaggacaactgcagcaaccttgatgaatgcttactccagtcgttcacactcagttttttctgtcacgatacacatgaaagaaacgacaattgatggagaagagcttgttaaaattggcaagttgaatttggttgatcttgcaggaagtgaaaacatgggccgttctggtg

SEQ ID NO: 541 - DNA, 2539 bp, Rattus norvegicus
  Genbank Accession No. AF035963
cggtgcctgtgagtaaatagatcagggtctccttcacagcacattctccaggaagccgagcaaacattagtgctattttacccaggaggaaatctaggtgtagagagctctacggatctaaggtttggatctgtacccagtgcttttttaggtgtctttagacatttctcaggaagatgtagtctctgtcaccatgtgtggctgaattctagctcagtccatcttattgtgtttaaggtagttgaagtttaggaaccaaccagtatgtctctgagcagaagagtacagtgtccatcttgaggacaagctcatctttaccattagagggctggccttggcttagattctaccgagaacatactctctaatggctgccctcagttttctctgtttgctgtcttatttgtgtcatggccagaagtcatatggatggctctatgtgagcaaggacccagatagaagagtgtatttgggggaacaggttgccctaacagagagtcctgtgggattcatgcagtcaggatgaagacctgatcagacagagtgtgctgagtgccacggctaaccagagtgacttgtcactgtccttcaggtcaacaccatggttcaacttcaagtcttcatttcaggcctcctgctgcttcttccaggctctgtagattcttatgaagtagtgaagggggtggtgggtcaccctgtcacaattccatgtacttactcaacacgtggaggaatcacaacgacatgttggggccgggggcaatgcccatattctagttgtcaaaatatacttatttggaccaatggataccaagtcacctatcggagcagcggtcgatacaacataaaggggcgtatttcagaaggagacgtatccttgacaatagagaactctgttgatagtgatagtggtctgtattgttgccgagtggagattcctggatggttcaacgatcagaaaatgaccttttcattggaagttaaaccagaaattcccacaagtcctccaacaagacccacaactacaagacccacaaccacaaggcccacaactatttcaacaagatccacacatgtaccaacatcaaccagagtctccacctctactccaacaccagaacaaacacagactcacaaaccagaaatcactacattttatgcccatgagacaactgctgaggtgacagaaactccatcatatactcctgcagactggaatggcactgtgacatcctcagaggaggcctggaataatcacactgtaagaatccctttgaggaagccgcagagaaacccgactaagggcttctatgttggcatgtccgttgcagccctgctgctgctgctgcttgcgagcaccgtggttgtcaccaggtacatcattataagaaagaagatgggctctctgagctttgttgccttccatgtctctaagagtagagctttgcagaacgcagcgattgtgcatccccgagctgaagacaacatctacattattgaagatagatctcgaggtgcagaatgagtcccagaggccttctgtggggccttctgcctgggattacagagatcgtgactgatttcacagagtaaaatacccattccagctcctgggagattttgtgttttggttcttccagctgcagtggagagggtaaccctctaccctgtatatgcaaaactcgaggttaacatcatcctaattcttgtatcagcaacacctcagtgtctccactcactgcagcgattctctcaaatgtgaacattttagaagtttgtgtttccttttgtccatgtaatcattggtaatacaagaattttatcttgtttattaaaaccattaatgagaggggaataggaattaaaagctggtgggaagggcctcctgaatttagaagcacttcatgattgtgtttatctcttttattgtaatttgaaatgttacttctatccttcccaaggggcaaaatcatgggagcatggaggttttaattgccctcatagataagtagaagaagagagtctaatgccaccaatagaggtggttatgctttctcacagctctggaaatatgatcatttattatgcagttgatcttaggatgaggatgggtttcttaggaggagaggttaccatggtgagtggaccaggcacacatcaggggaagaaaacaatggatcaagggattgagttcattagagccatttccactccacttctgtcttgatgctcagtgttcctaaactcacccactgagctctgaattaggtgcagggaggagacgtgcagaaacgaaagaggaaagaaaggagagagagcaggacacaggctttctgctgagagaagtcctattgcaggtgtgacagtgtttgggactaccacgggtttccttcagacttctaagtttctaaatcactatcatgtgatcatatttatttttaaaattatttcagaaagacaccacattttcaataataaatcagtttgtcacaattaataaaatattttgtttgctaagaagtaaaaaaaaaaaaaaaaa

SEQ ID NO: 542 - DNA, 1039 bp, Rattus norvegicus
  Genbank Accession No. AF036335
gaaacgcctcctcgttttgctcagcatggcacatttgagtatgaatattctcaacgatggaagtctttggatgaaatggaaaaacagcaaagggaacaagttgaaaaaaacatgaaggatgcaaaagacaagttggaaagtgaaatggaagatgcctaccatgaacaccaagcaaatcttttgcgccaagatctgatgagacgccaggaagaattaaggcgcatggaggaacttcacagtcaagaaatgcagaaacgtaaagaaatgcagttgaggcaagaggaggaacggcgtacaagagaggaagagatgatgattcgccaacgtgagatggaagaacaaatgagacgccaacgagaagaaagctacagcaggatgggctacatggatcccaagagaaagagacatgagaatgggtggtggtggaacaatgaacatgggagatccctatggttcaggaggccagaaatttccaccgctaggtggtggtggtggcataggttatgaagctaatcctggagttccaccagcaaccatgagtggttccatgatgggaagcgacatgcgtactgagcgctttgggcagggaggtgcgggtcctgtgggtggacagggtcctagaggaatggggcctggaacgccagcaggatatggtagagggagagaagagtatgaagggccaaataaaaaaccccgattttagatacttaggctttcattccagtttggttttgtcttcttgtttagataccacttaaattcttggcattttagtaagaaagctacctttttatggatgttagcagtttattgacctgatatttgtaaatggcctgtttgggcaggtaaaattatgtaacgcagtgttcaaaacaggagaaaaattttttcatttactttttttttaactgtataatgtttctcaagttaatggcagtgtaccttgtgccactgaatttccaaagtgtaccattttttttttactgtgcttcaaataaatagaaaaaaatagttatgaacaaaaaaaaaaaaaaaaaaa

SEQ ID NO: 543 - DNA, 2015 bp, Rattus norvegicus
  Genbank Accession No. AF036537
agagacccaagctgagcctaactggccgaaagagtctccagacttggtcactgttacctgaggaaaagtagctgtcccatgcactgtggctgtcccggccatgtagggagcagcagctggcaaggagtcaggggaatcaagccttagaaagaggaagagtctgccaagggagctgggagagcagccctgccagggctgctgttggctgagggagaggaggagggccatgccatccagacccaacaagaggtcaaagactacaaaattcctaacgacagaaactaagacttcagaaactccaagctgcatcaagttgaggaagtattcaaaccaaaccactgagcgagcatccttccaaacccatgatgtctaaactctcagccgtagacgttgtagacgtcggggttccagctccatctttgcacacataatccaggaagccgctagctctcgatgtcttctgtcaagttatggctcaatggtgcgtcatcgatctctctcgtgggctctgaagaactggagaacctaggatttgtgggcaaaggcgggttcggagccgtgttccgggcacgccacacagcatggaaccttgatgtagcagtcaagatcgtgaactcgaagaagatatccagggaggtgaaggctatggtgaatcttcgtcatgagaacgtgctgctcctgctgggggtcactgagaacctcgagtgggactacgtgtacgggccggctctggtgacaggattcatggagaacggctccctctcagggctgctgcaaccttcatgccctcggccctggcctctcctctgtcgcctgctagaggaagtggtgctggggatgtgctacctacacagcttgaacccttcgctactgcaccgggacctcaagccctccaatgttctgctggatctagagctccacgccaagttagcagactttggcctgtccacatttcagggagggtcacagtcagggtcagggtcaggatcgagagattctgggggcaccctagcttacttggccccagagctgttggataatgacggaaaggcttctaaagcaagtgatgtttacagttttggggtcctcgtgtggacagtgttggctggaagagaagctgaggtggtagacaagacctcactaattcgtggagcagtgtgtaacaggcagaggcgacctccattgacagagctgcctccggacagccctgagactcctggcttagaaggactgaaggagttaatgacgcattgctggagttctgagcctaaagacaggccatccttccaagactgtgaatcaaaaaccaataatgtttacatcctggtacaggacaaggtagatgctgctgtctccaaggtaaagcattatctgtctcagtacagaagcagtgacacaaagttgtctgccagagagtccagccaaaaaggtacagaggtggattgccccagggaaaccatagtttatgaaatgctggaccgcctgcatctggaggagccctctggatcagttcctgaaagactcacaagtcttactgagaggagaggaaaggaagcatcatttgggcatgccacaccagcagggacatcatctgacaccttggctggcactccccaaattccacatactctaccctccagaggcacaacacctaggccagcctttactgagactccaggtcctgacccccaaaggaatcagggagatggaagaaacagcaatccttggtacacctggaacgcaccaaacccaatgacaggcctacagtctattgtcttaaacaactgttctgaagtgcagattggacaacacaactgcatgtcagtacaaccgagaactgcctttcccaagaaggagccagcacagttcggcaggggtaggggctggtagcccgtccacgtccacgagtagacttcggagaggacctgcaagtgcctgaagcaggaaatacaccattcaggcagccagtataaatagagtgaaaataaaagcactttctaagtaaaaaaaaaaaa

SEQ ID NO: 544 - DNA, 538 bp, Rattus norvegicus
  Genbank Accession No. AF038571
gggaagatcatagaagttgaagactgggaaattttctgcaagttgggcctttatatggccactgtcctgagtgggcttgcaatccactccctcgtagtgctgccactgatctatttcatagtcgtgcggaagaaccctttccgctttgccttgggcatggcgcaggctctcctgacagctctcatgatctcatctagctcggcaacccttccagttacattccgctgtgcggaagaaaagaaccacgtggacaagaggatcacaagatttgtgctgcccgtcggcgccaccatcaacatggacggcactgcgctctatgaagccgtggcagctgtgttcattgcgcagctgaacggcatggacctgagcattgggcagatcatcacgatcagcatcacagccaccgctgctagcattggagctgccggtgtgccccaggctggcctggtgaccatggtgatcgtgttgagtgccgtggggctgcctgctgaggacgtcaccctcatcattgccgtcgactggctcctggaccggttca

SEQ ID NO: 545 - DNA, 1076 bp, Rattus norvegicus
  Genbank Accession No. AF044574
cacacagcaaacatgacccagcagccgcctgacgttgaggaggatgactgtctttctgaataccaccacctcttctgtccggaccttctccaggacaaagtggcttttatcactggtggtggttctgggattggcttccggatcgccgagattttcatgaggcatggctgccacactgtcatcgtcagcaggagtctgccgagagtgtccgaggctgctaagaagttggttgctgccactggaaagcggtgtctccctctgtctatggatgtccgagttcccccagctgtcatggctgctgtggaccaagcgctgaaagaatttggcaaaatcgacatcctcattaactgtgctgcagggaactttttatgccctgccagtgcattgtctttcaatgcctttaagactgtggtggacattgacacccttggcaccttcaatgtgtctcgtgtgctttatgagaagttcttccgggaccatggaggagtgatcgtgaacattaccgccaccctcagtatgcgggggcaggtgctgcagctccatgcaggcgctgccaaggcggctgtggatgctatgacgcgacacttggctgtggagtggggtccccagaatatccgtgtcaacagcctggctcctggtgccatcagcggcactgagggtctgcggagattaggaggccccaaggccagttcgaaatttaagtatctttcaagtcctattccaagactcggaaccaagacagaaatcgcccacagcgtgctgtacctagccagccctctggcttcctatgtctcagggattgtgttggtggttgatggtggtagctggatgacgctcccaaatgacattgggcgactgctagagtttgaatcctcctctgctaagctgtagtgtttgaagagcacacccaaggcttcaagcatgttaaagcaacagaatcaactgaactacgtcctctaccccaagataccttttttgacacataaacattgattgccttaagaaagttgtactgaggaggccgtgttcttccatggggaggcttccctgtctcacatagtctatagtcacacgaa

SEQ ID NO: 546 - DNA, 2611 bp, Rattus norvegicus
  Genbank Accession No. AF047707
atacgactcactatagggctcgagcggtcgcccgggcaggtagcggccgctgaattctagaacagcgggccgggggatggcgctgctggacctggcccaggagggaatggccttgttcggcttcgtgctcttcgtggtgctgtggctgatgcatttcatgtccatcatctacacccggttacacctcaacaagaaggcaacagacaaacagccgtacagcaagctccctggagtctctcttctgaaaccactgaagggggtggaccctaacctaatcaacaacttggagacattctttgaactggattatcccaaatatgaagtactcctttgtgtacaagatcatgatgatccagccattgaggtgtgtaagaaactgcttggaaaatacccaaacgttgatgctagattatttataggtggtaaaaaggttggcattaatcctaaaattaataatttgatgccagcatatgaagttgcaaagtatgatctcatatggatttgtgatagcggaatacgagtcattccagacacattaactgacatggtcaatcagatgacggagagagtggggctggtccacgggcttccatacgtagctgacagacaaggctttgctgccaccttagagcaggtatattttggaacttcacacccaagatcctatatctctgccaatgtgaccggcttcaagtgtgtgacggggatgtcttgcttgatgaggaaggatgtgctagatcaggcaggagggctcatagcctttgctcagtacattgcggaagattacttcatggccaaagcaatagcggaccgaggctggaagttttcaatgtctacgcaagttgccatgcaaaactctggttcatactccatttctcagtttcaatccagaatgatcaggtggaccaaattgaggattaacatgcttcctgccacaataatttgtgagccaatttcagaatgctttgttgccagtttaattatcgggtgggcagcccaccacgtgttccgatgggatatcatggttttcttcatgtgtcactgcctggcatggtttatatttgactacattcaactcaggggtgtccagggtggcacactatgcttttcaaaacttgattatgctgtggcttggttcatccgcgaatccatgacaatatacattttcttgtcggcactgtgggaccctactataagctggagagccggtcgctacaggttgcgctgtggagggacggccgaggagatcctggatgtgtaacaaggcctctgtggccgactggacaggatggaatggaagtgttatagattatgtttatagagactttccaggacctgccttcagtggctcatccgtgtatgtgtggtatccgctctttaatttattcgcatggcccttgcatctgtgaaaagcaaaaaaacaaaagcaaaacatgtctgtagtcgtggccaaacagtgtattttatggaggtagagaatcaagacaattggttctaggaagtgggttttgttgttgtttatttttttaaacaaatatatatatatatctatcaatacacacacacacacacacacacacacacacacgactgctctgcagcagacactatgacagtatccttcagtagggaaagtttcttacctgagttactcactctgaggtccgcacgggcagaacagcagctctgtgagagggaaggggcaggtgctggccgcccctgtgtgaagggaatgggttgtacagggaggcgctgactgagaaactttttcatgctttatgcctacctcttgtagttgttgcagagcaaatagaagttagaagttgtgatatggtagctaggccttgcaaaaacaaatgggaaactttaataataaaagagccgagtctagtatttatataaatctgtgaggttttttttgttttgtttttttgtttttgttttgttttgttttattttttggtctcattgcaatgaaccaaaagtggttgagattggtttttagtggtaaccatgaattgaaggcatcttttggaccaactgttgttggttctgtcttgaaccatattaatcactgtgctgtaattaggagagctgaatctttccttccctgctcctcgcccagcccgccccatctttccattaatattcattctctctctctctccctctctccctctctccttctccctctctccctccctctctctctctctctctctctctctctccttctctccctctctctctctctctctctttctcgccttatgatgaatttgtttgaagggcattttctccgtgagcaaaggcttggatgcatattccagtttttatttttttttctgtgaaatgggtactattaccccctgaggaaaagttgcacagtgagaaccagtctagttatgacccactacatgtttatttttttacattactctctcacgagctgagttttgctgagtgcgtttgtcggtttgtttagtggcgtttggtggaagcccttctttgcgctgctgaagtgaaatcttgctgactagttagcttttttgttgatctcagtatgggcaaagaaacaaaatccaaatggctggacagacttctgtaaata

SEQ ID NO: 547 - DNA, 5617 bp, Rattus norvegicus
  Genbank Accession No. AF052695
gcttcccttcttctttaaatttttttacttttataggggaggaggtgtatgctggttcccgtggagcccatcagagggcatcgatgtcctgggccgggagctgcaggtagttgtgtgctaccaaattctggtcctgtggaagagcaagaagttcttaaccactgagcaatctctccagacgtggattcttacctttctctttttatgaccttgggtaaattccttgcattgggccttagtgtctctatcagtatagcctggttcttggcccggtgtagtggcacgccttaaattccaccgcatctctgagatccagtcttttctagaaggtcagttccaggtcagcccggactgcatattgagacccttgtctgaaacaaaccaaatgggcgttgctctggcaggtgatgcgcaacctaggtaaggacaatctctaggactcttaaggatccaaagacccacaagagtccgccacaggatgtccccaagaacagcctaacctaaccttcacaacgaaaggctggaattctgatcattgttttgacccccaccccattcctctcactttgtgtttgttgaactccacacaggcccacgtaattccttcccagcaggcgccctccccattcagaccgctacctgcccaccgtctctaaccaattgggtgctcgggtcgagtttacgtgtgtgtatataacctaaggaccacccccactcaggttttgatgcgaccttcacagactccaagatcttctaactgccaggtccaacccagcgaaaagcccaaacacgagcggtccagaggactgactaccaggtcccgcccccgggctccgatttgggctcggactaaggctcccggaggtgggatcgggatttcgttccaaacgcttagcgatcgcactctcgtgagatttgctcccggaagacccgcccctcttcagtgtagcgaccaatcgacaaaggcgacggttaagacagttgggttttgaaggagccaatgaacactagcagcggagagtttaagaataactgttcggcgtgcctttagccggtcagaaaagaacgcattcggcacttctacagacgcactgaggagtcagggatttgtgtttgggagaggtttacgaagaggtgctgggctggtgcgaactgtggcaggcagagcccaggagtcctgcgaggtcctgagtttggtcgcctctcacccccctccccggtagacgggccatggcgcagttcgtgttcgagagcgatttgcattcactgcttcaactggacgcgcccatccccaatgcaccgattgctcgctggcagcgcaaagcaaaagaagccacaggcccagccccctcgcctatgcgggccgccaacagatcacacagcgccggtcggaccccgggccgaactcctggtgagtgggtggcaggtggagggaggatggaatcgctgagagtcgaccttcatgctgccttcaggctgacttctctctccctgccccaggcaaatctaattctaaggttcagaccacccctagcaaacctggaggtgaccgctatatcccccaacgtagtgcttcccaaatggaggtggccagcttcctcttgagcaaggagaaccagccggaagacgggggtacgcccaccaagaaggtatgattccacaggggcactgagacatgagacctggtgtgtctatcccctggttgataccagtctgcctcaccacccgtgtatttcaggagcatcagaaagcctgggctcggaacctgaacggttttgatgtggaggaagccaagatcctcaggctcagtggaaaacctcagaatgccccagaaggtaagaaatgacattcatggaggttggcgtcagcccttcctaaggggagacatgtgggtgggtatcagtttttaaggctagacccactctcttgccacaggctaccagaacagattgaaagtactctacagccagaaagccacgcctggctccagtcggaaggcttgcagatacattccttccctgccagacaggattcttgatgcccctgaaatccggaatgactactgtgagtgccctattgtctttttatgtggatgctgaagatggcctgggattggaccagtccaacagaaagcctcctgatttttcttcctctggcagacctgaatcttgtcgattggagctctggaaatgtattagctgtggcactggacaacagtgtgtacttatggaacgctggttccggtgacatcctgcagctgttgcaaatggagcagcctggggactacatatcatccgtggcctggatcaaagagggcaactacctggctgtgggcaccagtaatgctgaggtgcaggtgagcctgggccctatattgtggctccgtggtcagtgggctcagagatgaacttgtcttgctggaaggctgttagtgctcagcttcaggctgtgaccctgtggtctcgcctctgcagctatgggatgtgcagcagcagaaacggcttcgaaacatgaccagccactctgctcgagtaagctccctgagttggaacagctatatcctgtcaaggtcagtggtctttgctagtctatagcaaaatcattctggtttctgccatccagagctaactctcatttttcttcttttagtggttcacgatctggccacatccaccaccacgatgttcgagtagcagaacaccatgtggccacactgagtggccatagccaggaagtatgtgggctgcgctgggccccagatggacgacatctggcaagcggtggcaatgataacattgtcaacgtgtggcctagtggtcctggagaaagtggctgggttcccctgcagacattcactcaacatcaaggtgctgtcaaggtgagagcacttagtccctgtaaactagggaccgctaagaagagaagacaggtggggttgggtttaattgtaacacttagatgttgggagttggtttgatgcactgtgtgtgtgttcagatgattactgtcccctgagatctggttggcttctaacatgggcattggcgtgaagcatctcctgtcggtgttggttgtgtgcatattatcacctctgatggtttaataaagagccggtcagcctatagctggggagcagagtttacggtgggtcgatcccagtgagcgtgtgttgagtagaaagaggagagtggtcaccgtgaggggtttccaggagactgatggaggagcagccagggctagctgtcaggtaacagagcaggtgctgggtggtaggcagcacagttggattagaataggtgagaaccctgcccagctatagtgcaagaagctctttaacatacatataccaaggcttctctgtcatttcaagggaatggagggcatagaaaggctcagtgcttttactgtctgtctgctgacctgacccagcctttatccattccaactaggctgttgcatggtgtccctggcagtccaatatcctggcaacaggaggaggtaccagtgaccgacacattcgcatttggaacgtctgctctggagcctgtctgagtgctgtggatgtgcattcccaggtagttttgttgtgattgctactggtgatagacttatggttcaacctgtcacaggcttcctctgatttctgaacagccaattctactccaactatacctgatcatttctaaattcccgactcagccctctttcgcattcccgtttcctagtttggcttatctccacctaggtcctcaagcatcacctcttccgtaggtcccagttaagcttgtcacttcccttgccttcctgaaatgtactgttgatcctcttgcactgtttcagatagcagaacctgcttagaaacctggaaagctgcccactctgtcatcctcttcaagatattccagttttactttggaatatcattcacatctgtcccttcctcagcacagagtcctcattcattcattcagagacagggtctcgccctggctggcctcagacttgcaatgagcctcctgctttagcatcccaagtgctgagattaccagcatgcaccctgtgccaaggctcccacacattctcttccagtcttttatacttaacagtctgagtggtaggtatattactgtccttaaacctatgatgactccacaacctacagcataagatccaagtacatgggaacgtccacggctcttgctgctgatgtgccttactgtatctgctccagccctccctgttcgctcccctcacactcagccttcactgcaggcacaggctctctgaagccagatggttggagttacacaagggcgcagtcctctgtggcattgcttctggtggattcgtcttacacagatacttgtcttggggcttcagtaagcactgtgaccattaagacctgatggggtttctaatcctagagagcactcagttctgagtgtgtcgtggaggaatgtcatgcccacgacgactctttccacaggtgtgctccatcctctggtctccccactataaggagctcatctcaggccatggctttgcccagaaccagctggttatttggaagtacccaaccatggccaaggtggcagagctcaaaggtaggtgggaaaggaagccagacagaaaggccacatagtgtatgtttccattcatatgaaatattgagaataaacaggctaatatggcttgccaggaactttgtgaggatggtgggaagattccatttatgtgaaatgttgggaataggtaaataacagactaattaacaggctaattaatggctcgccaggggctttggcaagattgataggaagtgtgatttagaatgttcagacaatgcacacaacctcaccttataaatactgtaatcccactcagttataaagggtgagtggcattcacatttcgttcctaggtgactaacagaattggaggagggctgtgggtatactcaaatgcaccgctcttgccgtaggtcacacagcccgggtcctgagtctcaccatgagtccagacggggccacagtggcatctgcagcagccgatgagactctgcggctctggcgctgctttgagctggaccctgcccttcggcgggagcgggaaaaagccagcacatctaaaagtagcctcatccaccaaggcatccggtgaaagacaaccctttcttttcccttcttgattttgttgttgtttatttttttctaataaagttcatatcttcctttcttgtgttccagcatccttcctataggctgcccctactctgactagcgctagaagtcttgtgggaacttttagccacccgcagagctttgtttttagagacagggtccagcaggctaacctcgaacttgtgagcttcctgctttgtacccttcccagtagctggaattactgcctacgctaccacccttctgtttgtaaacaagccagagccaaagctatgtcccccacctcgcttacacacacacacacacaatctcagtggtttcctgtcactttaattaagacacagttgagtgcacagcctgcattgccaggcctgtggcctgcccatcctgaactttggcccagaagctcatgcttccatgaggagtgaaaagggcgc

SEQ ID NO: 548 - DNA, 4069 bp, Rattus norvegicus
  Genbank Accession No. AF061266
ggcttccatcctaatacgactcactatagggctcgagcggccgcccgggcaggtctgcccccgtcctgggccgcgatgatggcggccctgtacccgagcacggacctctctggcgtctcctcctcctccctgccttcctccccatcctcctcatcgcccaacgaagtgatggcgctgaaggatgtgcgagaggtgaaggaggagaacaccttgaatgagaagcttttcttgctggcgtgcgacaagggtgactattatatggttaaaaagattttggaggaaaacagttcaggtgacttgaacataaattgcgtagatgtgcttgggagaaatgctgttaccataactattgaaaacgaaagcttggatatactgcagctgcttttggactacggttgtcagaaacttatggaacgaattcagaatccggaatactcaacaacaatggatgttgcaccagttattttagctgctcatcgtaacaactatgagatcctcacaatgcttctgaagcaggacgtggctttgcccaagccccatgctgttggctgtgaatgcacgctgtgttctgcgaaaaacaaaaaggacagcctcagacattccaggtttcgtcttgatatctatagatgtctggccagtccagctctaataatgttaacagaggaggatccaattctgagagcgtttgaacttagtgctgacttaaaggaactcagccttgtggaggtggaattctggaatgactatgaagagctagcccgtcagtgcaaaatgtttgctaaagatttgcttgcgcaagctcggaattctcgtgaactggaagttatcctaaaccatacatctagtgatgagcctcttgacaaacgaggactactagaagaaagaatgaatttaagtcgtctgaaacttgctatcaaatataaccagaaggagtttgtctcccagtcaaattgccagcagttcctgaacaccgtttggttcggacagatgtcaggttaccgccgtaagcccacctgtaagaagataatgactgttttgacagttggcattttctggccagttctgtcactgtgttacttgatagctcccaaatctcaattcggcagaatcattcacacaccgttcatgaagtttattattcatggagcttcatatttcacattcttgctgttactcaatctctactcacttgtctacaatgaggacaagaaaaatacaatggggccagcccttgagagaatagactaccttctcatactgtggattattgggatgatttggtcagacattaagaggctgtggtatgaagggttggaagacttcttagaagaatctcgtaaccagctcagctttgttatgaattccctttacttggcaacttttgccctcaaagtggtggctcacaacaagtttcatgattttgccgaccggaaggactgggatgcgttccaccccacactggtagcagaagggcttttcgcctttgcaaacgttctgagttaccttcggctcttctttatgtacacaaccagctctattttgggcccactgcagatttcaatgggacagatgttacaagattttgggaaatttctaggaatgttccttcttgttctgttttccttcacgattggactgacacagctctatgacaaagggtacacttccaaagagcagaaggactgcgtaggcatcttctgtgaacagcaaagcaacgacaccttccactcgttcattggcacctgctttgctctgttctggtacatcttctccttagcgcatgtggccatctttgtcaccaggtttagctatggggaagaactgcagtccttcgttggggctgtgattgtcggaacttacaatgtcgtggttgtgatcgtgcttacaaagctactggtagcgatgcttcataagagcttccagctgatagcaaatcatgaggataaagaatggaagtttgctcgagcgaagctatggctcagctactttgatgacaaatgcacactgcccccacctttcaacatcattccttctccgaagactatctgctatatgatcagcagcctcagcaagtgggtgtgctcgcacacctccaaaggcaaggtcagacggcagaacagcttgaaggagtggagaaacttaaaacaaaagagagatgagaactaccagaaggtgatgtgctgcctagtgcatcgatacctgacctccatgcgacagaagatgcagagcacagaccaagccaccgtggagaatctcaatgaactgcgccaagatctgtcaaaattccgaaatgaaataagggatttgcttggctttcggacttctaaatatgctatgttttatcccaaaaattagccattttctaaatcttgtagaaataattttctttaataaatctgaaagactgtatttgcatacctttcaattaaatcaataagatatatatgggcataaacaattacacagaagccattctttaaatatttatagcataaacatatgttgtgtaaatatgtatatagagctagttttttaaaacctgtctgtgactttttgtagaagcaaaaccattttgttagcatgctactttgttttcttagttggtcagtgcttacattcgacgtgtgtaagaggggcagctctcagtgtacgcatggcccactccatttatacgcgaagatcagcaaacgcggctaccttaagacacacttgaagagctcatgctgttgaaatctcttgttttaggagttcacacagagttcagtatatattgtttaggagtttagcttcatctaaaataccctactttttcttttgttagaatcttaagcagcagagaaaagtttataataaatatttgaatttaacccagtcatggtgatgaatgcctttaatcccagcactcgggaggcagaggcaggcagatctctgagttcaaggtcagcctggtctacagagtgggttccaggatagccccggctacacagagaaaccctgtcttggaaaaataaaaaacaacaaaaaaaaatttaaattatttatttatgtctatctaaattcacgttggtatttgttgtgtagtatatttacttttacatggttataatttatatttttaattttgttttgacataacattattttatatatatttccctatattaaggtagtttatatgtttaaatatttatagacgtctgtgaattttgaaaaatagtagccatcttttacccatagaatacttgtttctatttataccctcgcagaggtacctcttaagcatttggctaagtttagcttttccttccaatttttcaagttggagtaaaactcatcgttacaaagtagaagctgcttatcttcatgtgcggtcacagtgggcttggccggagagcactgggccttgcttgcagaaggctgctttccgttcactccaaggctcttgagctcctcttccaaagtttctcccacagagcctaccacagcttctacaaaactggcctcgtgcttgcggcttgagatgtaaagcattgtttattcaatttgaaaataaaaagaatttgactgcttttcagtgttcatgtaaaggtggagctgaaggtttccccagctatggcacagacattcctgcagcacgtttggtgagaaattaccttcggaactgaacgtcagctggcattgaggccacagagtgcagacagccctggtctgtgagcgccgcccaccccggggcagctgaagatcccagtgtaggtttcatcttgctttttgcatttgtttttaatgtcccaggtttaagtgttccctcttttgggcaaattcttataaaaatgtttattgtaaaattatatattttgtctacaatgggattatgcgcttccaagttgatattttacatcaggatttttagtcattctaaaaaaaatacctaattattaaaaaatttatagagtacctatgtgtgcatgaattactgacgaggtatattttgaatgacagcatattgtaagaaaagagtgaataaaatttggcattagattataaaaaaaaaaaaaaaaaaaaaaaaaaa

SEQ ID NO: 549 - DNA, 2426 bp, Rattus norvegicus
  Genbank Accession No. AF062389
catcagtgctgttctctctactggtgcttcgggaactctagaactccttcctgagagggaagcaaaccaagctattgccagagagagttccataagagctctgaatatgcattggctgtggaaaattccaagactttgcaccttctggggcactgagatgttccaccgttctttccatatgaatatcaagaaactaatgcccatacagtggggccaccaagaagtccctgccaagttcaacttcgctagtgatgtgatagatcactgggccagcctggagaaggctggcaagagatctccaggtccagccctatggtggatgaatggcagtggggaagaactaaagtggaacttcagagaactgagtgaaatcagtaaacagacggccaatgttctcaccggggcctgtggcctgcagcgtggggaccgtgtagcagtagtgcttcctcgagtcccagagtggtggctggtgaccctcggctgcatgcgttctggtcttgttttcatgcctggaaccacccagatgaaatccacagacatactctacaggctgcaatcatccaaggccagggccattgtggctggggatgaagtggttcaggaagtggatgctgtggcccctgactgctcttttctgaaaatcaagttgctggtgtctgaaaaaaatcgagaaggatggctaaacttcaaggcactgctaaaggatgcatcccccattcatcagtgtgtggagactgtaagccaagaatcagctgccatctatttcactagcgggaccagtggccctcccaagatggcagagcactcccactgcagcctgggcctcaaggccaagatggatgctggctggacaggactgggaccttctgacacaatgtggaccatctcagacacaggctggatattaaacattttagggtcatttctggaaccttgggtattgggaacgtgcatatttgtccatcttttgccaaagtttgatccacaaactgttctaaaggtgctttccagctaccccatcaataccctgctgggtgcccccctcatttaccggatgttgctacaacaggatctttccagttacaagttcccacatctgcatagctgcttcagtggaggagagaccctcctcccggagactctggagagttggaaagccaagacaggactggaaatccgagaaatctatggccagacagaaacgggaattacctgcagagtttctaggacaatgaaagtcaaaccaggctacctgggaacagccattgtcccttatgatgtccaggtcatagatgagcagggcaatgtcctgccccctggcaaggaaggagacatggctctcagggtgaagcccatcaggcctataggcatgttctctggatatgtggacaatcccaagaagacacaggctaatattcgaggagacttttggcttctgggagaccggggaattaaggatacagaagggtatttccacttcatgggacggacagacgatatcattaattccagtgggtaccgaattggaccttccgaggtggagaatgcactgatggaacatcctgccgtggttgaaacagctgtgatcagcagcccagaccctatcagaagagaggtggtgaaggcatttgtggttctagcccctgagttcctgtcccatgaccaagaccagctcaccaaggttcttcaggaacacgtgaagtcagtgacagcaccctacaagtaccccaggaaggtggagtttgtcttagacctgcccaagaccatcacaggaaaaattgagcgagctaaacttcgagccaaggaatggaaaacatcaggataagcccaggcccagtgagactcccaaggctcttgctctgtctttcccaatccttttcttatgactccttagtcttcctatagcaatatgaaattattcatgtagaggcatgtatgtgatttaggtctttgcttggttattgacacagaacaatgacacgtttcatgctaaaagaagaaagaaagagggaataagaggtttgaagtcagaaaaggctaaaacagcaagggaaagaaattgccaattcaagtggtcaggaaggggtagagagaaggggaaagcagaatgaggagagagagagatgagaaggaactggagagaaatagaaaaagggttgtgtagaaggacactagtgtcttcgccaagttgtgtcaatccttagggacatcatgcccaaaggagaaggaaataccacttacagagcatgcccaaggcactgttatacacttgtcatgagtcctatacaggtcatgagccatcttacttcatctgggtgacatctgcaggctcatcttctgcaccccaaaatgtaccacttcctgtagctcacattttttgttctagctttatttccttgaattaataataaaatcacttcaaaatc

SEQ ID NO: 550 - DNA, 1607 bp, Rattus norvegicus
  Genbank Accession No. AF062594
  misc_feature (1)..(1607): n = a or c or g or t
catgctgaaatatcgcggtttaccatatggggatggtggcgacaatctcctggagcccgtcagatcgcggaaattaccgatgcctgcgcagctccttccgctcagctccgcgtccgagcctcctggaacgatatttggagttcttaaaagatggcagacattgacaacaaagaacagtctgaacttgatcaagatttggaagatgttgaagaagtagaagaagaagaaacgggtgaagaaacaaaaatcaaagcacgtcagctaactgttcagatgatgcaaaatcctcagattcttgcagctcttcaggaaagacttgatggtctggtagacacaccaacaggatacattgaaagcttgcctaaggtagtcaaaagacgggtgaatgctctcaagaatcttcaagttaaatgtgcacagatagaagccaaattctatgaggaagttcatgaccttgagagaaagtatgctgttctctatcagcctctgtttgataagcgatttgagatcattaatgcaatttatgaacctacagaagaagaatgtgaatggaaaccagatgaggaagatgaagtttcggaggagctgaaagaaaaggccaagattgaagatgagaaaaaggatgaagaaaaagaagaccctaaaggaattcctgagttttggttgacagtttttaagaatgatttgctcagtgatatggttcaggaacatgacgaacctattctgaagcacttgaaagatattaaagtgaagttttcggacgctggccagcctatgagttttatcttagaatttcactttgaacccaacgaatatttcacaaatgaagtgttaacaaagacttacaggatgaggtcagaaccagatgattctgatcccttttcttttgatggaccagaaattatgggttgtacagggtgccagatagattggaaaaaaggaaagaatgttactttgaaaaccattaagaagaagcagaaacacaagggccgtgggacagttcgtactgtgactaaaacagtttccaagacttctttctttaacttttttgctcctcctgaagttcctgagaatggagatctggatgacgatgntgaggcaatactggctgcagactttgaaattggtcactttttacgtgagcgtataatcccaagatcagtgttatacttcactggagaagctattgaggacgatgacgatgactatgatgaagaaggtgaagaagctgatgaggaaggggaagaagaaggagatgaggaaaacgatccagactatgacccaaagaaggatcaaaacccagccgagtgcaagcagcagtgagcagtgactggccttgaggacggcctccctgtaatagcctaaacatgactcacttacttacagccttatggttttgtattttcttgatagaatcagtaagtttctaagggaaaggaaattgatattttgcagaccaatttgttctaaccagcatcccaactctagctctgtagccacgttaccgagtccagccctttactgcatgctcaggtcgctgcagtctggttctcctgagagatttcatcatgtagctattggtacattatgaaaccactgtgaacaat

SEQ ID NO: 551 - DNA, 1750 bp, Rattus norvegicus
  Genbank Accession No. AF062741
tggtgaggagaggacgaggatactagaatgtcaagtactgcgtcctaccggatcttcaattttgcaaggaatcgtattgctgtattacgagggggtagacgcttgtactccagggcagccacgagtaggaatcaagtgaaatggaggctcttttctcccgcatcattggccgtgaacgacagttctccacatggtggctttgctctgcggaaagcttacagacacacatcaaccgaggaagaggatttccacttgcagctcagccccgaacaggtcagtgacctgctccgagctggcgagtcatcccacaaggttctggatttcaacagcggagttccaaattcagtgttaaggtttgagagcaaccagttggcggccaattccccagtggaagaccgacaaggtgtggcttcctgcgtgcagacgagggggacggtgtttggtatttttgatgggcatggtggccatgcgtgtgcacaggcggtgagcgagaggcttttctattacatggcggtgtccctcatgtcccataagaccttggagcagatggaggaagccatggagaacatgaagcctttgctgcccatcctgcagtggctcaagcaccccggagacagtatttataaagatatcacatcggttcatctggaccacctccgagtctattggcaggaactccttgacctacatatggaaacgggactaagcactgaagaggcattgatgtactccttccagagactggactccgacatctcgctagaaattcaggctcctctggaagatgaggtaacgaagaacttatccctccaggttgctttttctggggcgacagcctgcatggcccacgtcgacggagttcacctgcacatagcaaatgctggcgactgccgagctatcctgggtgtccagggagacaatggagcgtggtcatgtttacctcttacctgtgaccacaatgcctggaatgaggcagagctgtcccggcttaagagagaacaccccgagtctgaggacaggacactcatcatagatgacaggctgctgggtgtcctcctaccctgcagggccttcggggacgtccagctaaaatggagtaaagagttgcagcggaacgtcctagagaggggatttgataccgaggccctcaacatctaccagtttaccccgccccactaccacactccaccctacctgactgctaagcctgaggtcacataccacaggcttaggccccaagataagttcctcgtgctggcctcagatggcctctgggacatgctggacaatgaggatgtggtaaggctggtggtggggcacctgtccaaggtcggtcaccagaagccagccctggatcaaagaccagccaacctgggccacatgcagagtctgctgctgcagaggaaagccagcggactccatgcagctgaccagaatgcagccacacatctgatcagacatgccatcgggagcaacgagtatggggaaatggagccagagcgtctggctgccatgttgacgctgccagaggatgtggccaggatgtaccgggatgacatcactgtcatggtggtgttttttaactcagaatcaattgatacctattttaaggagggttaagagtctcaccctgttgccaaggctaactcgaatgccctttatttagaacatttccactcattccttagtgagcaatccaaaccttagtaaagaacaggcagacataggttgctgagtaattccggaattc

SEQ ID NO: 552 - DNA, 672 bp, Rattus norvegicus
  Genbank Accession No. AF073839
cccggagtgttggtgattcggagctgctgtgtctgtccgagatggcagaggtggaggaaacactcaagaggcttcagagccagaaaggagtgcagggcatcatcgtggtgaacacagaaggcattcccatcaagagcacaatggacaatcccaccacgacacagtacgccaacctcatgcacaacttcatcttaaaggctcggagcactgtgcgtgagattgacccccagaatgacctaaccttccttcgaattcgctccaagaaaaatgaaattatggtggcaccagataaagactatttcctgattgtgattcagaatccaactgaataaggcactgtcttggcttcctgtgtcattccttaatttaacgtcccccgagaataatagcgttaatcatgtcagtgggcacatgtggctgcctggagccatgcagaccttggcattggtgaagggcagctctgcccaccccaccaaggagtgcctctgatgatccggtcagtccccagaagagctcagttctctctccaggctttggaatgagagctcttgatgagcccacagccagcttccttctaaccttcatttcactttgtcccccttggaagctgtttttgtttttttaaactaaaaataacttcaaccccaaaaaaaaaagaaaaaaaaaaaaaaa

SEQ ID NO: 553 - DNA, 3803 bp, Rattus norvegicus
  Genbank Accession No. AF074608
acagcccaaggttcaggcaaagtcttagtcgccaggctgtgaggtaagggcggggcaggggattccccatctccccagtttcacttcagcttttaacctgtgtcaggtccttctgctcgggtactgatgacgctctggaaattctcattcccattgggtgccgtaaaccctgtgaatcaatcagcgtcgccccaggcactgcacgtaaagtcgaagcagcccgacggatttagccaggtccgggatctcagatgggggcaaaggcacttcaggcgctgctcctgctggtggcggtcgccctggccccgacccagaccagcgcaggtgagtgcggggtcgggagggaaacggcctctgcgtggaagagcgggtgaggggaatcggggaagccgggtccccgcgtcgcataccagaccctcgccctttctcaacccgcgtccagagccccgcgccctgctccccgcccggcccgcacacccgcccgggatcccgggaggaggtcggggtctcaccgcgcgccgcccccaggctcacactcgctgcggtatttcgaaaccgccgtgtcccggcccggcctcggggagccacggttcatctctgtcggctacgtggacgacacggagttcgtgcgctacgacagtgacgcggagaatccgagatacgagccgcgggcgcggtggattgagtgggagaagccggactattgggagacgcagacacggagagccaagggaaacgagcagatttaccgagggagcctgacgaccctgctccactactacaaccagagcgaggacggtgagtgaccccgggtcggaggtcacgaccctccgggtccccacactgccagggacttccgggtccgaagtccgaggttcttagcagaaccgacccaggcccgtttccctttcagtttggaggagtccgcgggtgggcggggctggggcggggccgggtctgaccgcggggtcccgcaggctctcacaccatccagtggatgtatggctgtgacgtggggtcggacgggagcctcctccgcgggtattggcagcacgcctatgatggccgcgattacctcgccctgaatgaagacctgaaaacgtgggaggcctcggacagagcggcgcagaaaacccggaacaagtgggagcggaaaggtgttgcagagagaagcagggcctacctgaagggcacatgtgtggagtccgtccgcagatacctggagctcagaaaggagacgctcgtgcgctcaggtgcggggactgcgggcttctcctcctctgccctcgggctggggctcagtcctggggaagaagaaaccctcagctgggtgatgcccctgtctcagaggggagacagtgtctcctgatccctcatcacagtgactggactgcctctcccagggcccagccttctccctggagagttctgagtccctctcaggagggaaggagagaatttccccacttaacagcaggggctccctgctgtcagccatggcctctcccaggccaggttctctgcccacacccactctctgaggacactgactcctgtcctgctgagtgtgtcagcccttacacctcaggaccagaagtctcctttacctcagaggagacatggactccactgcactaggctggttcccccagtttctagaatttccatagaacacattctcacagatccctccctgaatgtgggttttgcatcccttcaatacctcatttctctctattcctacagtggagaatggtcccatgagcccttatggggtaccctggaggaatataaatcatgggatttctttttctattttctcttttttaatatttctttcttttttctttcccttttttttgaaggcatacttttgcttctagtcagtctttactgcaaacacatattaaatcaattattttccattccctcttctgttctatgaccacccacctcatgctatagaacatcacataaggacggccatgttgacccactggctcatgtggattccctcttagcttgtgagtccctcaggaaagtgtgcagttctctactgaggggaccagctctccctgcagctctctagtgagatgacagttgaagtgtcagacacacacagttcagtgtcatccttgatttaactgtgtcttgtgtagatttcagtttgtcttgttaactgtgtgatttcttaaatcttccacacagatcccccaaaggtgcgtgtgacccttcaccccagacctgaaggtgatgtcaccctgaggtgctgggccctgggcttctaccctgctgacatcaccctgacctggcagttgaatggggaggacctgacccaggacatggaacttgtggagaccaggcctgcaggggatggaaccttccagaagtgggcatctgtggtggtgcctcttgggaaggagcagagttacacatgccttgtggagcatgaggggctgcctgagccgcttacccagagatggggtaaggagggagccttctgtagaccctgagctggtcaagtctgagagctggggtcatgaccccactttcatttcctgaacctgtccttgcagagcctcctccatcaactgattccaacatgggaatcattgctgttctggctgtcgttggagctgtggctgtcattgtacttgtggccctcattggagttgttgtgaggaggaggaggaaaaacataggtaggaatgggcagggactgagtgtctcctcagcccactttagaagagtgctgttctcattaatggggcttgcagccacaccctgcattgcgactgtctccaactttgtccattctggaaacttcctcctgtgaagaccttccttgaactctcacagctttccttctcacaggtggaatatgaggagattacgcccctgctctaggttagtgtgggggcaggattatccctgagggtattggagtgaagctggagatgtggggagctcttggaatccatagtagctcctccagagaaatcttctggggtctagttttactgtgatgtacacatacacatatacatatacatatatacatatacagaaacacatacatatatacgtatgttttgttttaccctaggcagggacagctgccagagctctgatgtctctcccagattgtaaaggtgacactggggtctgactggggagtggcaatgtggacatgattgggtttcagggactcccagaatcccctgtgagtggagggttgttgggctgttgtcttcacagtgatggtttgtgactctccttctctagcatgaagacagctgcctggagtggactgagtgacagatgatgtgttcaggtctctcttgtgacatccagagccctcagttctctttagacaccagtgtctgatgttccctgtgattctatggcttcagtgtgaagaactgtggagcccagcctgccctgcacttcaggaccctgtccctgcactgccattccttcccttcctaggccaaccttagtggtccagcctgggggtggggggtggggacatctacatcctgtccctccttgctgccctgagtgtcagcccctcacttccacactgagaataagaatctgagtgtgaacttgattgttcacatccttgactcaagtgtggatggctttttcaattactggatggaatacttagaggtttttcagttttggggttttgttttgaaaaaaaataaatggcagatggagaagcttccagaatctgtgtcactaagctgtgtgtatctggtgggacaggatgaggatgtgggaggtgagtgtgaaca

SEQ ID NO: 554 - DNA, 3312 bp, Rattus norvegicus
  Genbank Accession No. AF084205
tctgcagtatggtagattattatttatgcatttatgccagtgtggcttcattcatacagatgaaccaagctttgggatagcagtataaaattagaatcagacagctgactgctcagcaggatgccatcaactaacagagcaggcagtctaaaggaccctgaaatcgcagagctcttcttcaaagaagatccggaaaaactcttcacagatctcagagaaatcggccatgggagctttggagcagtttattttgcacgagatgtgcgtactaatgaagtggtggccatcaagaaaatgtcttatagtggaaagcagtctactgagaaatggcaggatattattaaggaagtcaagtttctacaaagaataaaacatcccaacagtatagaatacaaaggctgctatttacgtgaacacacagcatggcttgtaatggaatattgtttaggatctgcttcggatttactagaagttcataaaaagccattacaagaagtggaaatagcagcaattacacatggtgctctccagggattagcttatttacattctcataccatgatccatagagatatcaaagcaggaaatatccttctgacagaaccaggccaagtgaaacttgctgactttggatctgcttccatggcctcccctgccaattcttttgtgggaacaccatattggatggccccagaagtaattttagccatggatgaaggacaatatgatggcaaagttgatgtatggtctcttggaataacatgtattgaattagccgagaggaagcctcctttatttaatatgaatgcaatgagtgccttatatcacatagcccaaaatgaatcccctacactacagtctaatgaatggtctgattattttcgaaactttgtagattcttgcctccagaaaatccctcaagatcgccctacatcagaggaacttttaaagcacatgtttgttcttcgagagcgccctgaaacagtgttaatagatcttattcaaaggacaaaggatgcagtaagagagctggacaatctacaatatcgaaagatgaagaaactccttttccaggaggcacataatggaccagcagtagaagcacaggaagaagaggaggagcaagatcatggtggtggccggacaggaacagtaaatagtgttggaagcaatcagtctatccccagtatgtctatcagtgccagtagccaaagcagcagtgttaatagtcttccagatgcatcggatgacaagagtgagctagacatgatggagggagaccatacagtgatgtctaacagttctgtcatccacttaaaacctgaggaggaaaattaccaagaagaaggagatcctagaacaagagcatcagctccacagtctccacctcaagtgtctcgtcacaaatcacattatcgtaatagagaacactttgcaactatacgaacagcatcactggttacaagacagatgcaagaacatgagcaggactctgaacttagagaacagatgtctggttataagcggatgaggcgacagcatcagaagcagctgatgactctggaaaataaactgaaggcagaaatggacgaacatcggctcagattagacaaagatcttgaaactcagcgcaacaatttcgctgcagaaatggagaaacttattaagaaacaccaagcttctatggaaaaagaggctaaagtgatggccaacgaggagaaaaaattccaacaacacattcaggctcaacagaagaaagaactgaatagctttttggagtctcaaaaaagagaatataaacttcgaaaagagcagcttaaggaggagctgaatgaaaaccagagcacacctaaaaaagaaaagcaggaatggctttcaaagcagaaggagaatattcaacattttcaggcagaagaagaagctaatcttcttcgacgtcaaaggcagtatctagagctagaatgtcgtcgcttcaaaagaagaatgttacttggtcggcataacttggaacaggaccttgtcagggaggagttaaacaaaaggcagactcagaaggacttagaacatgcaatgttactgcgacagcatgaatccatgcaagaactggagtttcgccacctcaacactattcagaagatgcgctgtgagttgatcagactgcaacatcaaactgagcttactaaccagctggaatacaataagagaagggaacgggaactaagacggaaacatgtcatggaagttcgacagcagcctaagagtttgaagtctaaagaactccaaataaaaaagcagtttcaggatacctgcaaaattcaaaccagacagtacaaagcattaaggaatcacctactggagactacaccaaagagtgagcacaaagctgttctgaaaagactcaaggaggaacagactcggaagttagccatcttggctgagcagtatgatcatagcattaatgaaatgctctccacacaagctctgcgtttggatgaagcacaggaagcagaatgccaggttttgaagatgcagctacagcaggaactggagctgttgaatgcatatcagagcaaaatcaagatgcaggctgaggcccaacatgatcgagagcttcgagagctggaacaaagggtctcccttcggagagcactcttagaacagaagattgaagaagagatgttggctttgcagaatgaacgcacagaacgaatacgtagcctgctcgagcgccaggccagagaaattgaagcttttgactctgaaagcatgagattaggttttagtaacatggtcctttctaatctctcccctgaggcattcagccacagctacccaggagcttctagctggtctcacaatcctactgggggttcaggacctcactggggtcatcccatgggtggcacaccacaagcttggggtcatccgatgcaaggcggaccccaaccatggggtcacccctcagggccaatgcaaggggtacctcgaggtagcagtataggagtccgcaatagcccccaggctctgaggcggacagcttctgggggacggacggaacagggcatgagcagaagcacgagtgtcacttcacaaatatccaatgggtcacacatgtcttacacataataattgaaagtggcaattccgctggagctgtctgccaaaagaaactgcctacagacatcagcacagcagcctcctcacttgggtactaccgggtggaagctgtgcatatggtatattttattcgtctttgtaaagcgttatgttttgtgtttactaattgggatgtcatagtatttggctgccggg

SEQ ID NO: 555 - DNA, 7867 bp, Rattus norvegicus
  Genbank Accession No. AF102552
atggctcatgccgcttcccagttaaagaaaaacagggatttagaaatcaatgcggaagaagagaccgagaaaaaaaagaagcaccgtaaacggtcccgggatcgcaagaaaaagtcggatgccaatgcaagttacttgagagcagctcgggcggggcacctggaaaaggcccttgactacatcaaaaatggagtggacgtcaacatctgtaaccagaatgggttgaatgcgctccatcttgcttccaaagaaggccatgtggaagtggtctccgagctgctgcagagagaagccaacgtcgatgcagccacaaagaaaggaaacacagccttacacatcgcatccttggctggacaagcggaagtggtcaaggtcttggttacgaacggagcgaacgtcaacgcacagtctcagaatggcttcacgccgctgtatatggcggcccaggagaaccacctggaagtcgtcaggtttcttctggacaatggtgccagccaaagcctggctacagaggatggcttcacgccattggccgtggctcttcaacaaggtcacgaccaagtcgtatccctcctgctcgagaacgacacgaagggaaaagtgcgcctcccagccctccacatcgcggcccggaaagatgacaccaaagcggcagctctgctcctacagaacgacaccaatgcagacatagagtcaaagatggtggtgaatagagcaactgagagtggcttcacctcactccacatagctgcccactacgggaatatcaatgtggccacgttgctgttaaaccgagcggctgccgtggacttcaccgcacggaatgacatcactcctttgcatgttgcctcgaaacggggaaacgcaaatatggtaaagctgttgctcgaccggggtgcgaagatcgacgccaagaccagggacggtctgaccccgctgcactgcggggcgagaagtggccacgagcaggtggtagagatgttgctggacagagccgcccccatcctttcgaaaaccaagaatggactgtccccactgcacatggccacacaaggagaccatttaaactgcgtccaactcctcctccagcacaacgtgcccgtggatgacgtcaccaacgactacctgaccgccctccacgtggcggcccactgcggccattacaaagttgccaaggttcttttggataagaaagctaaccccaatgccaaagccctgaatggcttcacccctctccatatcgcctgcaaaaagaaccgaatccgagtaatggaactccttttgaagcacggtgcatctattcaagccgtaaccgagtcgggccttaccccaatccatgtcgctgccttcatgggacatgtaaatatcgtgtcacagctaatgcatcatggagcctccccaaacaccaccaacgtgagaggagaaacagcattgcatatggcggctcggtcggggcaagcagaagtggtgcggtatttggtacaagatggagctcaggtagaagcaaaagctaaggatgaccagaccccactccacatttcagcccgactcgggaaggctgacatagtgcaacaactgttacagcaaggagcgtccccgaatgcagcaacaacttccgggtacaccccccttcacctttcggccagagaggggcatgaggatgtagctgccttccttctggaccatggagcatctttatccataacaacaaagaagggattcacgcctctgcatgtggctgcaaagtatgggaagcttgaagtggcaagtctcctgctgcagaagagtgcgtctcctgatgccgctgggaagagcgggctaactccactgcatgtagcagcacattacgataatcagaaagtggcccttctgcttttggaccagggagcctcaccccacgcagctgcaaagaacggttatacgccactgcacatcgccgccaagaagaaccagatggacatagccacgtccctgctggagtacggtgctgatgcaaacccggttacccggcaagggattgcgtccgtccaccttgcagcgcaggaagggcacgtggacatggtgtcgctgctcctcagtagaaatgcgaacgtcaacttgagcaataagagcggcctcaccccactccacctggcggctcaagaagaccgagtgaacgtggctgaggtccttgtcaaccaaggggcccacgtggatgcacagacaaagatgggctacacgccgctccatgtgggctgtcactatggaaacatcaaaatagtcaattttctgctgcagcattctgcgaaagttaatgccaagacaaagaatggatacacgccactgcaccaggcagcccagcagggccacacacacatcatcaacgtcctgctccagaacaacgcttcccccaatgaactcactgtgaatgggaacacagccctggccatcgcccgacgccttggctacatctcggtggttgacaccctaaaggtcgtgacagaggaaattatgaccaccactaccatcacggagaagcacaaaatgaatgtcccagaaacaatgaatgaagtcctcgacatgtcagacgatgaagttggtaaagccagcgcccccgaaaagctcagtgatggggaatatatctcagatggtgaagaaggtgaagatgccatcacaggggacactgacaagtatctcgggccacaggacctcaaggagctgggcgatgactccctgcctgccgagggctatgtgggcttcagtctcggagcccgttctgccagccttcgctccttcagttcggataggtcctacaccctgaacagaagctcctatgcgcgggacagcatgatgatcgaggagcttctggtgccatccaaagagcagcaccttccattcacgagggagtttgactccgactccctcagacactacagttgggcagcagacacactggacaatgtgaacctggtctccagccctgtgcattctgggtttctggttagctttatggtggacgcgagagggggctccatgcgaggaagccgccaccacgggatgcggatcatcatccctccgcgcaagtgtacggcccccacccgcatcacttgccgcctggtaaagagacataaactggccaacccaccccccatggtggaaggagagggattagccagtaggctggtagaaatgggtcctgcgggggcacaatttttaggcccggtcatagtggaaatccctcattttgggtccatgagaggaaaggagagggaactcattgtcctccggagcgagaacggagagacctggaaggaacaccagtttgacagcaaaaacgaagacctctcggagctcctcaatggcatggacgaagaacttgacagcccagaagagttgggcacaaagcgcatctgcagaatcatcacgaaggatttcccccagtatttcgctgtggtttcccggattaagcaggaaagcaaccagattggtcccgaaggtgggattctgagcagcaccacggtccccctcgtccaggcgtctttcccagagggtgccttaaccaaaaggatccgtgtgggtctgcaggctcagcccgtaccagaggagactgtgaaaaagatccttggaaacaaagcaacgtttagcccaattgtcacggtggagccgaggaggaggaaattccataagccgatcaccatgaccatcccggtgcccccaccctcgggagaaggcgtgtccaatgggtacaagggggacaccacgcccagcctgcgactcctctgcagcattacaggagggacctcgccggctcagtgggaagacatcacaggcacaaccccgctgaccttcataaaggactgtgtgtctttcacaaccaatgtttcagccaggttctggctggcggactgccatcaggtgttagaaaccgtagggctagcctcgcagctgtacagagagttgatatgtgtcccctacatggccaagtttgttgtttttgccaaaacaaacgacccagtggaatcctccctaaggtgcttctgtatgacagacgacagagtggacaaaaccctggagcagcaggagaatttcgaggaggttgccagaagcaaagacatcgaggttctggaaggaaagcccatctatgttgattgctatggaaacctggctcctctgaccaaaggagggcagcagcttgtttttaacttctattctttcaaagaaaacagactgccattttccatcaaggttagagacaccagccaagagccctgcggccgtctgtctttcctgaaggagccgaaaacaacaaaaggattaccccaaacggctgtttgcaacttaaatattactctaccggcgcataaaaaggctgagaaggcagacagacgccagagcttcacatccctagccttacgtaagcgctacagctacttgactgagcccagcatgaaaacagttgaacggagttcaggaacagcaagatcccttcccactacttattcacacaagccattcttttctacaagaccataccagtcctggactacgactcccataacagtgcccgggccggccaaatcaggctccttatccagctccccctctaacacgccgtcagcgtctccgttaaaatccatatggtctgtttcaacgccttctccgatcaaatccacgctaggcgcctcaactacgtcatcagtcaaatccattagtgatgtggcgtctcctattagatctttccggacaatttcttcgccaataagaacggtggcatcgccgtctccatacaatacccaagtagcctctggtacccttgggagggtacccaccatcacagaggccacacctataaagggggtggctcccaactcaactttgtcctctcgaacttctcctgtgacgaccgcagggtctctgttggagaagtcgtccatcaccatgacaccccctgcctcccccaaagccaacatcaccatgtattcctccagcttgccatttaagtccattatcacgtcagcggcaccgctgatctcctcccctttaaagtcagtggtgtctccgaccaagtctgcagctgatgtcatctcaacagctaaagctgcgatggcatcgactctctcctcccccttaaagcagatgtctggacatgcagaagtagcgctagtcaatgggtctgtttctcctctgaagtatccttcctcttccgctttaattaacggatgcaaagccactgccacattacaggacaaaatttctacagccacaaatgctgtgagctcggtggtgagcgcggcccctgacacggtggagaaagcgctctccaccacaacagccatgcccttttccccactcaggtcttacgtttccgctgcagcgccctctgcttttcagtcccttagagctccctctgccagtgcactctacaactccctcgggccttcagtaggtgttactacctcatccgtaacttcatcgataatcacagtgccagtatactcggtaggcaatgttttggcagaaccagcattgaagaaacttccagactctaactcgctcacaaaatcggcagcggctttgctgtcgcccattaaaacattgactacggagacacgtcctcagccccatttcaatcgaacgtcatctcccgtcaagtcctctctgttcctggcatcctcggcccttaagccgtcagtaccatcttctttatcttccagtcaggagatcttaaaagatgtggccgagatgaaggaggacctcatgagaatgaccgccatactgcagacggatgtgcctgaggagaagccattccagaccgacctcccccgagaagggaggatagacgacgaagagcctttcaaaatcgttgagaaagtgaaggaagacttagtcaaagtcagtgagatactcaaaaaggacgtgtgtgtcgagagcaaagggccacccaagtccccaaagagtgacaaaggacactctccagaagatgactggacggaatttagttctgaggaaatacgagaagccaggcaggctgctgccagtcacgccccatccctgcccgagagagtacatggaaaggccaacctcaccagagtcatagactacctgaccaatgacatcgggagcagttcactgaccaacttaaagtacaagtttgaagaggctaagaaggaaggagaggagagacagaagagaattttaaagccagccatggccttgcaggagcataaactcaaaatgccgccagcctccatgagaccttccacctccgagaaggaactgtgcaagatggcggactccttttttggaacagatgccatcctagagtctcccgatgacttttctcaacatgaccaagacaaaagtcccttgtccgacagtggctttgaaacccgaagtgagaaaacaccttcagccccccaaagtgccgagagcaccggccctaagccactatttcatgaagtccccatcccccctgtcatcacagagacgagaactgaagtagtccacgtgatcaggagctacgagccctctactggggagatcccccagtcccagccagaggaccccgtgtctcccaaacctccccctacatttatggagttggaaccaaagcccaccgcccttagcattaaggaaaaagtgaaagcattccaaatgaaagccagtagcgaggaagaggaccacagtcgggttttaagcaaaggcatgcgtgtcaaagaagagactcacatcaccacaaccacgaggatggtgtatcactccccgcctggcagtgagtgtgcctccgagaggattgaggagaccatgtcagtccatgacattatgaaggcttttcagtccgggcgagacccttccaaagagctggcggggctgtttgaacacaagtcggccatgtctccggatgttgccaagtctgctgctgagacctcggcccagcacgcagagaaggacaaccaaatgaaacccaaactggagcgtattatagaggtccacatcgaaaaaggtccacagagtccttgtgagcggacggatatcaggatggcaatagtagccgatcacctgggacttagttggacagagctggcaagggaactgaatttttcagtggatgaaatcaaccaaatacgagtggaaaatcccaattctttaatttctcagagcttcatgttattaaaaaagtgggtgacgagagacgggaagaatgccacaactgatgccttaacttcggtcttaacaaaaattaaccgaatagacatagtaactctgctggaaggaccaatatttgattatgggaatatttcaggcaccagaagctttgcagatgaaaacaatgttttccatgacccagttgatggttggcagaacgagacgccaagtggaagcctagagtccccggcgcaagcgcgaagaataaccggtgggttactggaccgtctggacgacagctctgaccaggttcgggatcccattacctcatacctcacaggagaagctgggaagttcgaagcaaacggaaaccacgcagaagtcattccagaagcaaaggccaaggcctactttcctgaatcccaaaacgatatagggaaacagagcatcaaggagaacttgaaaccaaaaacacacggatgtggtcgcgctgaggaaccagtgtcgcccctcacagcctaccagaaatctctagaagaaaccagcaagcttgtcatagaagacgcacctaaaccctgtgtgcctgtcggcatgaaaaagatgaccaggactccggctgacggcaaagccaggctcaacctccaggaagaggaggggtccgccaggtcagagcctaagcagggagaaggctataaggtgaaaacaaagaaggaaatccggaatgtggagaagaaagcccact

SEQ ID NO: 556 - DNA, 510 bp, Rattus norvegicus
  Genbank Accession No. AI007649
caaaatgaatgtacagtttattgagaacatcggtggatggtggaaggaaaattgccctgtaccgcatcatggccaccactgactgggagctccactaaccatgattcaactgacccatgtcagacggtggaaggaacaaaaaccaggcccaagcgtctggctttacattgcaaatagggacagggtggttcttgcctttcagaaacaggcttggcagataggcaaactaagaagtaaaaatagaaacaaccagaaaaacagtcctcttacacataattaagacagcacctgctctccagggcccaaaactggcagcagggcctcagggagacaggccagaagtcttcaggaaacagtggtttggctgagacagtcagctgcacataattggccagtcaccagcacccagcaagactccttccatgctcagacaaggcaagaaagcacccggccctttgggatatcctcgtgccgaattcttggcctcgagggccaaattccctatagtga

SEQ ID NO: 557 - DNA, 537 bp, Rattus norvegicus
  Genbank Accession No. AI007668
  misc_feature (1)..(537): n = a or c or g or t
gacaaggtgaaaagcagcctttaattgtggtgaatttacacatacaaaatacaccctccatgacgagttaccaactctttaaaaaacaagactctttacaattaataatttatagaaaagcattattctttagaaattatacttgctatacattattgttttctaaacattggcataaaatgaaggctaagaatgctacttggcaaaagtacttctagccctatgttcatggaaagttttaaataaaggtcaagactattactgtgctctagctgcttgtggaaggtcaaaaaacacagctaagctatctgcaatcatgggttggagctgacctaatgtgcaagggctcaagccatctacctggtgaggactgtgggaaaggacttggcaggttccacctcctgactggaatgttaccaaatgtttccaggcttcanagggctcatgttgacaagtacaacttcccacctacagctccttaattgctacctgtataagaggcagagagaagctttggaatccttcaatcccaccagt

SEQ ID NO: 558 - DNA, 239 bp, Rattus norvegicus
  Genbank Accession No. AI007672
aagctaaaattgcacctcactaataggaataagcttgcggccgctagagattttttttttttttttttttttttgaataaataagcattaagtttattgaatcatgaataatttaagactggtacaatcgtcagatttattctctatgacatggggcagatctccagcagattgttctcaaacccaaaaacctgatgacacatgagaattaaatagggagagggaggggtggggggcag

SEQ ID NO: 559 - DNA, 480 bp, Rattus norvegicus
  Genbank Accession No. AI007725
gaaatcacaaacagtaagaaactttattggttttttttcctgtgtcaataaagtgtaccaattttaaggaacagtactgcgagtgcctgtccccctaaagccgtgcacaatacacacaaaataaaaataatcaaacaaagaaaatgaaatcatttacacataattaattaagaaccctgaacatccagaatcagattttccctacagcatgaagactgagaaggcaaacaaaccagaaagcttgaacttgaaactgaccaatagcaagtagttttggggaagttctctgtgaaaattcactacagaattactgacatgcgaaaaatggcttaaaaacaaaacagaacagaacagaacgaaaaccagtgcaaaatcttcctaaggtttttaaccatatatatcctttgactatatttactggttatttctagtctagctttccacttttaaaatctaaaattaagattaaaacaatcaaaa

SEQ ID NO: 560 - DNA, 577 bp, Rattus norvegicus
  Genbank Accession No. AI007820
accctcactataaggactaagcttgcggacgctaaagtttttttttttttttttttttttttttattttgcatacttttaatttcagaacaaaataaaacaaacaaaaaaacacaatacacaacacccaaccctgctattctgtgggaggggatcttcctgccttaaggcacaaggacaggatagaagagattcttgtagacatgagcagagagccaggtgggtcagggccagtcaaggctgttgggggagccacagggatactatacagagggcgggggcttcccaggagcctttaatccacttcttccatgcgagaggcatcctcatcaccctccagtggggggatctcatcgggaacagcagcactgggctcttctgcagtgacctcatcttcatcaatgcccaggcctagtttaatcatgcggtagatgcggttggagtgggtttgggggtcctcaagtgagaagcagaggagagcagagcattctcaaacagcagcaccaccaggtctttgacagctttgtcctttttgtctgcctcagccttctgccgcaaagtctccacaatggggtggg

SEQ ID NO: 561 - DNA, 545 bp, Rattus norvegicus
  Genbank Accession No. AI007857
ctcactaaatagaataagcttgcggccgctagagtattttttttttttttttttttttttttttttaattttgaaatacattttattttcactgttctgcactggagagatgacatccaaggagtaggggagacagagatgcctgaaacttctacccttgctgtgcatgggtcacatcgttcttctgggtaccagggccatgcctggacaccacacagttcacatcggactctgggccaggctaaccatccccacagcagtcacctctggcaggccccgacacagctgggcattctccagaaaaggtcctacttgtcctgcagagtcccagtcccgggaaggtcggactgcatcaggaccaaagcagggaaccagtgacaggagccagaccactgaggacagggaggagggccaagggtgaaggcccaccccttgctcacagaagggacactacagggcagtaatgggaggaaatggctagttagacatataagtggtttctggagaactgtactgttactctggatggtgagcgccagactcaa

SEQ ID NO: 562 - DNA, 635 bp, Rattus norvegicus
  Genbank Accession No. AI007877
gctccaaaagtaatagttaaaattaccagtgggtaaattatcttacacttactaaactaacattatatgttttacaattttgaacaactttacaagttactgttattttcaattctgagtagaaaggtaaactccaagcaagacaaagccaatagaggcttaagttcatcaccaacaagtttcaacaatttaccccaaatttactgttaaacagtacctggttgaagacacaagctgcgccttaaataagctggagcgactctgggatgttatgaacttaaccttgaaaggaagaaggtataggaacttctatttggtttggattgtaagaacagacaaattacttacagaaactgaattacttcaatacacatgtgaagacatagaagaaaacaataaaaatttacaatccaatcaggatataaacatcttttatatcatagaagttgtcaattatctatgcacatatagttagattttagcagtaaccaaacagttgcttataagttcaacaaaattacagatgtttttcagcatttcatagccacatcgttgggaatgggttgttgagcttcctttcactttaatgagtatctgggataagcaacttataaagacaaaagctttattttagc

SEQ ID NO: 563 - DNA, 565 bp, Rattus norvegicus
  Genbank Accession No. AI007893
aaaaaagcaaaatgtatgttcatctcaaatataacagttaaaaatggagaagcaatacaaacaacgtgttagccagcagcatccggtcctcagcttgcccacccgcttcagtcaggtttgggtgagctcagtcactgcctgcctgcctcctgccttacagctagcccaggtgaaacagactcatataaaattaacaagttagggttaaataagcttaaataagagcgttaaatacaagacactttgtcagaggttctgtacaaagataaacaggtctgggttgtacacagggccctgctggtactcagcagcggggtctatggggagggcagactgactgactgcagcagagcaactatgagaaagcaaactacacgcagaagtgactaccaacaggtccagctgttcacaaggcattcgcatctcttttcttaaaaaaaaaaattcagaacactgttaatattcaggcaccgtttgttcctgcaaataaatacgtctctacggcaacagtgttcgtgctagtgttaaacttcagggcttgtctctgacagagctctgcagactg

SEQ ID NO: 564 - DNA, 435 bp, Rattus norvegicus
  Genbank Accession No. AI007948
tgtttacccggctgcattgtgggagtttgacctccgccgccaaccgccgcctcagctcgcgccgccgccgccgccgccgcgcacgccatgggagccgtgactgacgacgaagtcatccggaagcgtcttctgatagatggagacggtgctggagatgatcggagaattaatctcctagtgaaaagcttcattaaatggtgtaactctggatcccaagaggaaggatacagccagtaccagcggatgctgagcacgctgtctcagtgtgagttctcaatgggcaaaacgctgctggtgtatgatatgaacctcagagaaatggaaaactatgaaaaaatatacaaagaaatagaatgcagtattgctggagcacatgaaaaaattgctgagtgtaaaaagcagattcttcaggcaaaacgaatacgataaaatcga

SEQ ID NO: 565 - DNA, 493 bp, Rattus norvegicus
  Genbank Accession No. AI008074
gccgctgtcatcctcctcatcagatcccacatcctcaatcttaggcttctcctcatcctccttatcttcctcctccttctcccctttctcttcctctgcctcatcatcactgatctccttctcgcgttccttctccagatagagggtgatggggtagcctatgaactgtgagtgtttcttcaccacctccttgaccctcctctcctctaagtactctgtctggtcttctttgaggtgaaggatcactttggtaccccggccaatgggctcaccgtggtctgcacggacagtgaaggatccaccagcagaagactcccaggcatactgctcatcatcgttgtgcttcgtgatcacaaccactttctctgccaccaggtaggcagagtagaagccgacaccaaactgcccaatcatggagatgtctgcaccagcctggagagcctccatgaacgcctttgtaccagacttagcaatggttcccaagttatttatg

SEQ ID NO: 566 - DNA, 496 bp, Rattus norvegicus
  Genbank Accession No. AI008160
  misc_feature (1)..(496): n = a or c or g or t
aaaagcaaaatgagaactttattgatctgaaactaaagggaggctctccatttcttggcaggacttgcgatggaaaatattttcccatctttctctagtttcctcaagtgaagcaagagattatgctccgccatcttatgtaaattctctggaacgttcttgtaaatcattttcctaagttcgctcactgagaatgattcctcaaggttatcacggaatacggtgataatttgttcttctcggttatttcggtgagaaatatattccagaattttagcttcggcattatggatcactgggccatgtcctggatatataatgttggctttgacttttagtaagtcttttagggagttcatgtaatcagagaggtcttcaaatatcgttgtcccttctcctaggatgcagtcnccagaaaagatggcattttcctcttccaggagtaaagccatgtgatcatcagtgtggccaggagtgtataagactctgagcgtgg

SEQ ID NO: 567 - DNA, 423 bp, Rattus norvegicus
  Genbank Accession No. AI008190
aaatatgaagcagaaatgtaaggtcctggggggtgggggggtagcagaaaagaagtgacaccaatctcgttttttttatacactcccctcctccaggccggtctgcagggtcagatctctaaagttaggacatggaatcaagctttcattctcatgaggggacagttctttaaacatgcacagcccggagtgtccaggatggttctccttcctctctttaaatgctgcggacgataaaggcgcccactctgctaggaactctacatcaatgtcccgggagccccgaccatcttcagcctcctctcagagacttaaaggatggcgcagaagaacttcttctcccgaaagggattttctgaagccgggactggggtcagcaggggatcttccttggcatgtgcctcacaatatgccatcaagtct

SEQ ID NO: 568 - DNA, 429 bp, Rattus norvegicus
  Genbank Accession No. AI008203
cagtacagagcacggttatggtaggccattctacatttcttcagtatagagcatacagatatacacgggtaccttaagaaaatcaatagctttatttttcatcaatacacaattagaaaattaggttttgtgatgtaaactagaatatatacaaatctgagaagcacacgatggaaggaagcccggctgcctagggtctgcccatcagaggggaggccaggtctttgatggttctggagttcagctgagggatcgtgctgatcttcaggagcctgctgctggcatatttgttcttgacagcgatgaacttggtgaggttttcattgactttcacgacgttcttggccatgtgctgcatgacttccagtatttcactctccatgtagcctgtgtaatactgctgctttaaattccattttccttggccca

SEQ ID NO: 569 - DNA, 234 bp, Rattus norvegicus
  Genbank Accession No. AI008309
aagacaaaaggtttttttattcaaaaaatgccaagtataaaaaaaaaaataagatctcttttattcccctgtacagtatctctcagagaaaaaccagcgggctacacgctgctcaaagcacaaccccagagaggatccggaaggcacaccacaccggaactgcctttctgtcttaggtagcgaatccactctggaggactgtacactcgggttccgtcaaagtccgtgtagact

SEQ ID NO: 570 - DNA, 428 bp, Rattus norvegicus
  Genbank Accession No. AI008441
  misc_feature (1)..(428): n = a or c or g or t
gccaagccagcctaaaaagtttattacaggtgtgtgatcgggcggatgtcacgtgaacatccaagtgtgccagtaagaaaagacccaagagagcctctgcccacccactccttggctcctcacctccccagacttactcattaccctaagttaacgtgtcctgtttcagttggagtcttaggaaatcaaatcaaatcaatccccaatagtgcagacctttctaccaggcgcaccagaggagtgaagagtgtccccacacactcctactgggtgtaggacatcagaacccacactcatgatccacggtccggctgtacaaccccacccacccctctgtgtgcggggagcagcaggctctctgacccacatggcacagctcagtcagggagcgggccatcacgcagtggagcacaaggtcagttcctgng

SEQ ID NO: 571 - DNA, 505 bp, Rattus norvegicus
  Genbank Accession No. AI008458
tatttttttttttttttttttttcaattccatcaaatttattatagactttgaaagttggcggttcacctgcttggtgtacagaagacagactctaagaaaggatctggaggcaccgcctcttctgtcaattgtaatgtatttggcaaaagtgaagactttgtaaacaccaactccatggctcaaagcagactttctccacagcacagttcaaaagccaggagaatgccaataagttagaccatgctcaacctgccagccaccacctgcggcctagagtgtggccctgctgttcccaaatcagacagacaacaaaacaacccaaacagaccagttcaaccaacagccctggatggagttctcagggcaggagatgggcaacctggggtccaccctaagcctatgcagtgtagttgtgtgggaagtgcaccatgcagaacttggctgtagttggtgttggtctttttgattttcctatattcctgaagaatctgtccgcgggttgc

SEQ ID NO: 572 - DNA, 328 bp, Rattus norvegicus
  Genbank Accession No. AI008578
ctgcctccgctgctgtctgtcccagtcatggttgagattcctgtctcccagaagcctcctacagcctgtactggctgctttgaggatggcctggcagatgaagacgctgtgtgaaagtttctggcctgagacatgcagagctcagctaagaaaagctgtttcagtcactctttcacaaccttacccccccccacacacacacacacaaaggagcaagaggagccagcgaagccaagaggctcagtcctgacagagaagagaccaaaagctcaccctgtaatctttatcctgtggcaagaaagtgtcctccttaggaagagggacacag

SEQ ID NO: 573 - DNA, 439 bp, Rattus norvegicus
  Genbank Accession No. AI008579
caactaggacaagggaaagcgtaaaggcacaagcaccatggagcacaggaggcacgccggggagcgggaagcgccaccgccaactcagaagcgggcaccttggtggtcaaagcccggaacgctccaggagcaccgcaaggctcacacaaagcagggcgcgtgcacacaccattcgggaagggtatgcaccgcagcgggtctaccaccttcccccggcacgggggaagagggccgcgaagcagtgaacggcgtgggggcaagcgcccccgacacgtccacagggacaccgcgaaccacagcaacaagtgtgcgcgggtcagcgctcgtgccggacagccgcacccctgacttccacacaccaccctgcaaaggaatggggaggagagacgaggggcccgctggcagaacgagaagagcggtcgccattcgcgctgaatga

SEQ ID NO: 574 - DNA, 407 bp, Rattus norvegicus
  Genbank Accession No. AI008629
  misc_feature (1)..(398): n = a or c or g or t
tcagagctgcgaggagctacttacaatagggtaagatttggaaagagtatgtatcagcctccaggcagcatagttgagcttttagttagcctggaaatgggagcattaggacctctgatgtggtcaagtagtaaactccttttttggaattttcttaaaggtgcccctatagtgctatcagatagtgaagaagaagaaatgattattttggagccagagaagagtccaaaaaaaataaggtaacaaatttctggtctctttcaaatatacatttaaaaactggccgtagttctataaaatggtccaagtggtctaatccaggacagatgggggtacagtgagctgttatattactttattcacagagctcagatcagtgcataccagaaggcactannaaaaaaaaa

SEQ ID NO: 575 - DNA, 624 bp, Rattus norvegicus
  Genbank Accession No. AI008643
aaatgtaaatatatttaaaaaattaaaacacctaagaaatgcaatctatatacatgaaaaggtaagatatttatacagtaacagctagtacaacatcgcccacaagcagcggtgctgtccattgtgttcagattttggtttaatgtcgtaatggtagatcagtgtcttcagggaaattatgtaaggtatacagcatgaggggctcacagaagactgcaaatgggaaattaatgccaaggaacagtattttctctaaaaacaaatattagtaaacaaatatcttaaactaatgaaccacaaaatgagcttattaagttcaagatatatagtcaacttgcataaaattacatgtggccatttcaaaacaatgtttctaaaataccagtaactctgactattgggatgtccacaggagacaaaatgtcattcattctcttcttatgaggaggtctggtttaggaacattacaaccatgttcttagaaaatgctacagcatccttgagaggtcacaatagtaaagcatcaatgcattctggtgccagcccaacacagcggttctggatgtgacccagactgcatttctgatgactttggcttttattctcctccacatatgtcacata

SEQ ID NO: 576 - DNA, 534 bp, Rattus norvegicus
  Genbank Accession No. AI008697
ggaagctgaattatgccaatttattaccattttcagaacagtgtcttcaccccggctgacctagaacttgtggggtataccaggttgactctgaactcagattcacctgcccggccatcgtgcctgacccaaacttttgatgctgaaagagacttgtctgctgttggggggagggcctgtgagaagtaaatagatgtctgatcagtctcagttctgggctctatccgacagtgcagacagggcgtgttggttcagataggtctggtcaagcacaggttgtagaacgaattggaatcaaagacatggtttaccttttgccagcccacccatccagcagcttgcaattcacaacggttttttggagtgccccagtagtgtgggtccagtatcaagacatagacttccatatctggcccctcacagattcccagcagggccttggactgagcatctgcatctcctcccaccattactgggcccccacccgctgtgaagtgtgaataaagccgctccagttctcccctaagctctgct

SEQ ID NO: 577 - DNA, 437 bp, Rattus norvegicus
  Genbank Accession No. AI008758
ccattagaaagataatgaagttaaaatgctttaatgaaaatgctcaaagaaaggaagtaggaagaactgacgcaagtattccttcatgttagaatttgtgacacaaatattttcaacttttaacggggcaagtcgctatgttccaagctgcctcttctcactaggagacattggtaattttttaaaagcacatttacaatgctttcccatcacccttgctgtgtttatgtagcacctatagccataactggcagtgagcagctcttctcgaggcgagctgacagtagcctggttgggtttgtatgcttggacctgggtttctagccatattctctgttcccgcttctcttgttgctggcctaatgacatcattacccacgtcttgccacccccttaaataagggaacaagattttggaccagcctagtaagggggga

SEQ ID NO: 578 - DNA, 478 bp, Rattus norvegicus
  Genbank Accession No. AI008838
aaaccgacatttctgtaatcaacaacaactacttagacagacccactgctgtctgattatgtccataggtcaggggtgttctgcttacgcatttggtgcctcataattaagttcagctaacactagggcctatagtttgctgtcagtgagaccaggtctggtcttgacagtaaagccaccatcaaaagctgcattgagaacttcatccaggcggacagttgtacttttgttccaaggaagctccaccataagttccaaataatttctagtcagagcatattcaggcattgactgaggcatttttttgagtctttttatctgcttgacacagactttatgagcctgttctggcatactagatgttcttatttttttctccagcatgacaatgtcatcattatcttcctcttgctcttcatcttctaaagctcctgggatgtgtgtaatcctctgatggggcgtattgctataacccttt

SEQ ID NO: 579 - DNA, 504 bp, Rattus norvegicus
  Genbank Accession No. AI008930
aaacatttttaaaacagggttgatcacaacagtcaacagcacaacagagggggagcatagctattgccaaccctgtcagctgaggctctagcaagagttttagctttgtgatgcaagggacccccagtcccccaaggctgcaggctgtcttgcctctcccccagccctccccccaccagcgaggtggcatctatgaggcccagagctccttgtgctgtttacgaccaaacccctcatcgtagttgcctttgctcttaaacagctgctgaaagtgaggtttgcagtaaaattcaccgtgcattgcagcgtaactgcccaggctgagtttggtgtggcagtgtttgcaacagaaacaagagttgtggaaaatgagcttgtctgccaccagccgctccatagggtacacagtcttctggcaggctgcacaggtctccttcacctgagcccgcaagctaaaggacttagaccgctgcaccgtgctgttgccactgctgcctttggctt

SEQ ID NO: 580 - DNA, 649 bp, Rattus norvegicus
  Genbank Accession No. AI008971
gcactctaaccctaggtttattcaacagtcctttcactctacacaagtacaaacacaaccttatctaaaatgctacaaagttataaaactcaaaacagattttatagtactgactgtacaacaaaagcaaagaggcaacgcacacattgccaaggctaacctgcgacatcaccatgaatggcaggtgacaatggggtgggctaggtttcatcaggaccctgtagaactggttcaccaattttagaaagtaacagagacactgggacagaaaagacaaccatttatggaggaatccttcaaaggttttaaccctagaaggtgaagggtactcagcaggggccatgggcaggcctaacagaacagacagaggcttggtcctttccactgctgtggcacagcatggcttggccaggttgtctgacgggtcctaggtcatctggaaaacggtgtgctgccctatgttccagttggctctgctactgaacagactatcaagaactgaaggggcgaactttctagccagaaaactacagggtacctctacgggcacagtcctgaatcaacagtacctctacaaggcagaaccctcctgcagaggaaacatctcaactgctgtcttcaaagcctaccctggtaagggcctcgtgcc

SEQ ID NO: 581 - DNA, 632 bp, Rattus norvegicus
  Genbank Accession No. AI008974
  misc_feature (1)..(632): n = a or c or g or t
cctgtcagccgacagtttattgaaaggaaatcttgctttatccatgaagtcacttccatggaggtagctgtgataaagtgtctcttccccatgacaacgcatagcgaccaatccctactgaaagacctgcccgagtacaccaactgtcctggtggaatgacactctggagcaggaaaaacaaatttctaaaaggcatacagtgattgtcttctgagctttgcagctggcaacatgtatgttttcacacaagatatttttaagctagcgaaagaaaatactcaagcaggattagttcttaaagcaataaacaggggaataaaaacatcatgtatatataagaaaaccaaggcatgctcacaggtttgagccaagaaagacctggagccctaatccccaccttgtcccaggatgcacctgtcatgatcacagggaagagatgagtctgggatttacaaacctctctctaaacctcagtccagtgttgtgccgctggctgtaccacacacaccgnacaagccccgactgctcccattccattacggcacaggagacatgttctcaccctgcctagcctgctttggtggngggaggcggcggcagggaactctacaagtgtttccagtggtgacct

SEQ ID NO: 582 - DNA, 587 bp, Rattus norvegicus
  Genbank Accession No. AI009167
cagcgaaatggattcttttaatcactgaagacagtacaaactgatacaacttataaaaatttagaaatatgtttctaggccatgaaaatgtctatatcctttggcccgatgaacccattcatggaattttaaacaaagaagaccaagaacagtaaagctcaaccgacataggtatgttgtagtcatagcgacagatcgaaaccaccagctgtccagagaagtggtcgggtgagtgctcctgccacacatgtgggctcaaggcagtcagcactggagggatgccgggcagggtacagggtgggggcggagcttcacagtggtaaaacgaaggcgggctcctcgcatgttgtcatgcttccacacacagctagaaatacatgttacaagatgcatagagaaacagatgcccaaaacgtggagaacatgcagggtgaagttctgatgcgtttatccttctaggcacactgtgtggcgtaactgcacccctccagggactgggtgctgtcctcacactgtggggtgagttcactgccccagggactgggtgctctgttcgcactggtgtgagtgcagtgctccagcgttgg

SEQ ID NO: 583 - DNA, 519 bp, Rattus norvegicus
  Genbank Accession No. AI009168
ggcaagctttgactgggaacacagtgggcacaggagaaaaagtgaagatactacatgaacagggtgggtcaggctcactctcctgcagtgggaagatagctttgctctattattgtcctgaccagtttagaggaggagtagaaaacggtttcttccacgacagtccgtttttgaatgacagtaaggctttgcaagagcagaccccctatcacctgaagcatttgtaggttgatctttggccaaactcggggagctgtaataattcacaggatgctttcttttaaaaaggttaaaaacattatgggtctgtcagtttataaaagttgtaatttttttttttgtaattaggcattcagaggtacatggcagctctaagaacattggcagagagccactgtcagttggcataaacacaatccagcttgtctttcggttattttgatgtggatttgtaaggctcaagtgattggacaacaggaaactgcagtagaaataaatgaacggcaaggggcttgagta

SEQ ID NO: 584 - DNA, 536 bp, Rattus norvegicus
  Genbank Accession No. AI009197
gaccaacatagaaaaatttattgttcaaaatccttctctttgaccaatagcagaaagcagcccaatggggacagaacctagaggcacatttggtcatttttctgtgtgtggttatagaggggtgtttgaatgagggtgatagggccttttagggacccacacacgatacacttgggcaaggctcatgtgctaaggcaaagcaagtcatgtcagcctggcatgaggtgggacctcagggctttttgaccttgtgttctggcaccttctggaagctaagcaacatcaggcccgcattgatggcataggtggtgatgcaaacaatgcagaaatcatacaggacaaagaacaggatccaggccaggtacagagaaccagcgacagacaccagggaactcaggatcagtaggatagaggcccaacgtcccctcaagcaacctaacaacagctgtatggtgtagaacatgcaaccaaatatgctgttggattggttgaggatgctgtcagctcctaacacatgctccaccagcccaaagccc

SEQ ID NO: 585 - DNA, 358 bp, Rattus norvegicus
  Genbank Accession No. AI009321
atttttacatcaaggtgacaaccaattcatttgttacaccaagaagcgacccattattagtgttgaacagtgaacttgcctaggatcctcagcacttctgagtgaggaggaaggaggaaggaccctaaacgtcaactgcgctgggaacactcagaattctcaacagactctacaagccaggacaaagcttatgcattgaatctactgagcgcttaatttttggcatctctggaagccagtcacgcaactgctcaagtatcagaaaatacttaaaatgtactctcggtatataaatacaatcttaaatatctttatttttgtttttattgctatagaaagtgctctacattgaataaaa

SEQ ID NO: 586 - DNA, 487 bp, Rattus norvegicus
  Genbank Accession No. AI009341
aaggaatcacagaaaatgcattactttattgcaccaagatcttggcactatctgggcacccccacagaggaaggggaagagtacagggagtcctgcacacacacagacgcagccacacaggatgttggacagaaacagcccctaacaggcaggtgagcaagaacagaaacaccagggaggtggccctctgcaagtgggcctaagccacatctactgccaagcacaaagttcaaactgatttgatccaacagcatgactacttttagaaaagcttcatttatgtcagtacatgtcaccgagaactcattccgcctatggcctgttcctaatggcttctaaggaagaaaaggacttgccttcagtgacagcaacacaagctgccattagtcaggatggcgtcctgactgatggctgaaggctcaccatcccaggtcaaaatggtctgggcttgcactccccaagttgaactgctcttgggcctttgcat

SEQ ID NO: 587 - DNA, 437 bp, Rattus norvegicus
  Genbank Accession No. AI009362
gaaaggaaaactaacatttattgagcgcctatgggtatgtgtatatatgtgtatacatacatacacacccttatacaatgtatgcctggtcttgtgcaaggagttctcatctacaacattccgtttgatcctcaccccaaccctgtgaggtaggtattatcctcacgtgtcaggtgaggactacgaggctcaaaaaggttaggtagtttgttcagggacactgaactagagaccagtgagctgagactgagttttaagtctccggcagttctatcctatcccggttctttcctacccccttgagccctgtagcccatggctccccaaaaagaagcctgccccatcctgctctgcaaggatgcagtcagttgaggattaagacataaataaaataaatagcagggtcaggttcccaaaagtgaggacgtttccatact

SEQ ID NO: 588 - DNA, 473 bp, Rattus norvegicus
  Genbank Accession No. AI009427
cacccttgttccaaactctacatcttaggccactttactccacctccatagcctgcacagtttcctccagaagttccagggtcagagctctcacttcctgggtctggacaggtgtggttccaggagcaaagcggtactggccagctctctgcacaggctctatgggtgagctcaaagctctctgcagtttggcgcctcctgcagtgatcacacaggcatccacactgcctccagagcctaggtcacccaggatccctgctgtgatggcttccaccaacagctcttgcgcggcctccagcgtcatgtttggctggaaccggtcctccaacagtgccacggctgcatcctgaccagagccaagggcagtaaaaggcagacggctgtaggaaccgcgtgggtcacgctgtaaagctgcggtccgttcaaatcaaccccgcccacgatcaatgatgctcccacgtggccttggtacc

SEQ ID NO: 589 - DNA, 478 bp, Rattus norvegicus
  Genbank Accession No. AI009460
gggtgggaaagagaactaggaggtggttgtacataggacttccaccctcccagaaccaaagaagacatgctctgccaccaaataactccctctgcccaagtgaaagcccaaaggcaggtgaacacagcgcagggcaagggcgactgcagtgaatagtggctagagtgactcagggaagggagggtccagggcacaggaaggaaaatggggcttcttggggataagacaggtatggggatgctcattgccatgggagcttctggctggcaaagtggcaagctcagggcaccataatgcggtatgggctgcctgggatatgctcatcaccccacttgaccaccaatgtgtattcccctttgtctttgagcaggtaggagacactattaaggcgactgcccatgtgtttcaccaggatctcttcacaaggtgtccttgggccatgcacgcccaccagcaacatgttgttacctgctttgct

SEQ ID NO: 590 - DNA, 531 bp, Rattus norvegicus
  Genbank Accession No. AI009467
aagcaaggaaacatttatttactacactcacacagtaatcatcaagcatcctgatgtttgcccaggtagcttaaaatagcaaatattcagtccccgcagaagaactgtcttcggttttaagccaagtcaaagaacagaaaggaaaactcatcactgctgagcactggcgctcaggctccactctcggatctgggacgaagaaacacaatcccaagtcagcttcctttctactcggcgtcactcagttaccagtcacggaacacaagctaaggtcctagcagcttatctgagacaagtttaactaactctaagatcacatgacttgacaagaaatgtacaaatgtttgctaagaacttaccgttctgtcaatcattttaaagagtccatgaaatatacatagcagtatttttgtaaccagaaactacactaattagacacatcatttagtttgttaagttctacctgaaaacatgccattttaagtaaaatcctaaacacataactcttaagttctatggtttaacaatcaa

SEQ ID NO: 591 - DNA, 583 bp, Rattus norvegicus
  Genbank Accession No. AI009589
ccaggatgaagtaacagtttaaataattaccagaattacgtataaatgaaacattcattcagacaaaacatcactgttcacaagtagctaagaaatattttgcaatttatataataaatatatctgtgtttaggttaacaggcaccatcttgataacagcaaagttttttaaaaccaataaataaacattcaagaaaacaaggtgtttatatttgaaatatgatacagccttaaatgcttttcttcatatagcacccaaatttccaaactgtctagaaagtttctgaaaatataactcctaccttaaatcattaaaatagcgcccaagaaaaaggttaattaaagacagaatttataatctatattcgtaattctccattcaataaaatatcaattaccaacgtattaaaagtcaatggactgtatatatgcatctgttaatggtgaaagcctgtaatacatacatttaaaagtcactctcctgacaggacttaagacactgcctctctggtgcagacctgaaaaccaccaagcatgtctgctgctctggctgtgtcttccaccacactcctatcccccaacc

SEQ ID NO: 592 - DNA, 555 bp, Rattus norvegicus
  Genbank Accession No. AI009592
aatttaaatcatgatttatttaggttcacttctaagttatgtaaaatatgtaaatgtcacaactgtacaatgattttctgattccgtcaattttttgtaacacatgtcttatcacgatgcgtcaataccctgtgggacagtaggtcttcctgggacagctgatggtgaaaggaaggctgcagctcgttgtgagctggctacgactaggagttagtcacagaaggttcaagttaagccatgtcttcccagctttaggtcctacgcagctcctcatcccacacacttgggcacatcccaacctcaccattggtgtaacctaagcgattatttaccaaatttaagattcagtgcaccaaaacttgactagtcatcagctgcccagaagcattccttgtttcgtttccaagatgatgttgattcttcatatatttccttcttccatatgggcaccttggcttttaaagaatcaatggcgtagctcacggcttcaagggacccggctctgtgacctgaggacacagcaataactgtgcttgcttctgacactggaaccag

SEQ ID NO: 593 - DNA, 149 bp, Rattus norvegicus
  Genbank Accession No. AI009675
cctactcaggctttattaaaaaaccaaaaggtttagggccaagggagggaaaaagggcctggtcaaaaggcaaccccggcaggaggcggctaaacggtccttggaggtcaccccagggctcacaaaggcaaggaatttgcccaaaaagg

SEQ ID NO: 594 - DNA, 546 bp, Rattus norvegicus
  Genbank Accession No. AI009747
aaagaattttaatacaaacttaatataaactatttcagtccctcttaacatgtaagacactgactcaaaatacttttataccgtttttttttcaagtattgcacaatataggtacaaaattaatatttacgattacattttcttccataatatatagcaaaaatctttaaacctttaacagaaaatacatttttttgaaaaagcaaatattcgtacattttaattccaccactaaaggaatatcctgtacacaattttcagaatagttgatgtctttaagatggatattttacaatttcagtaaaaaaaatacaacatgaagccgctgccacagatcactgtagtaaaaagatagaaatgcaataccgtgtcgtagaaacaatatatatatgtatatatatatatatcctctgatagtttacaaactttgtactaaattaaattatacaattagaaaagaccaataaacccacttattagtgccaattttttatatatatatataaaaaaaaatcagccatgtccttgctatatcttaaatactgg

SEQ ID NO: 595 - DNA, 547 bp, Rattus norvegicus
  Genbank Accession No. AI009752
aaaattataaaattcttttatttcaattatatgacacttcagtttgcctcaaattttactgaggttttggtcattttgcattccactctaccttgtaacagtagtatgaattcacatgattctgtaacgtgtcaacagcagtcatacagtaatcctctggtgattgtatatgtgctaatacttttagattcaactttacagttattttctaaatgattctttatatagaaaatacatacttccttcaggcagataaaacaacaactttccaataagaaaaatatcgagaaacaacaaataaaaatatctataccagatgcaaaattttgaattattacctaatgggtccctttgcacaagaacagccttttgtaatttttaagtagacattcaggcagaaggataactttaaaattgaaaaaaaaaataatggctgtttctcttcagtactaaagtaggaaatataatttcaacatgtcattagcagagaagagtaaaaaataaaatattcgatataaaatgaatttatcacatcacccgcatcttt

SEQ ID NO: 596 - DNA, 590 bp, Rattus norvegicus
  Genbank Accession No. AI009756
aaattataagatttacaatgccttgattatgcaaaatatcataatagaaattaaactaaatcaataaaccaagagaaagaaaactttttccttaaatatcagtatttaagccatccttgtcccaacctcatcttataaagtatgctaatttcaaaggtttcacttgcaggtttaattgtcattttcagcgttttatggaactgtaattttttccattgctatcatagctagcgtttatgctgcaacagcagcagaatctcacaagtgcgatcaaatgtggaggtggggcccagccttcggttttatccacagacagaaatcatccacaggcatcaggagagcgagatattctcgagtggccagagtgtggcttagagcgtggtggcagccgctgtcctgtcgctctgatctgaaccagcagcgcgtggtggcattactgctgtggatagtatgactgctgcgggggctgagggaaggggtaggtaggctgctggggtcctgggtacggagcctgtccagggctctggtgatacaccggtgggtacggcatattgtactggccatatgtgtaggggttgtagcccatgggc

SEQ ID NO: 597 - DNA, 565 bp, Rattus norvegicus
  Genbank Accession No. AI009770
aaagtaaaatgggaaggaacactttgtgtgcttcagagtttacaaagtttaacatttcccagccgggggaaatgatatcgatacatctgaaataatccccatcacagttaattttctttctggcttcactgctttcaacttggaaggaaagaagaaaagagagaaaaagaaaaattctccttaagattttcatgactcacagatgaaaaaatatatatatttagccctttatttcaagaatatatataaaaaaagctggttaaagaaaatatctgacatcaataatggattttatgccaaactatagtaaatgtctaaaataatagaaaactacagagatgaactgatttgccaagaaagaaaaaaaagtagcagcgattgtgctgggaagatggttcagtggtaagagcagctatggctcaagcatgaaaaactgtgtccaaatccccatcatccgtgcaaaaagccgatatggccaactgtcaggagaatctcatgttcaaatccccatcatccgtgcaaaaagccgatatggccaactgtcaggagaatctcatgttcaaat

SEQ ID NO: 598 - DNA, 513 bp, Rattus norvegicus
  Genbank Accession No. AI009810
aaagtcccaggatgtttattacaaaggtaaaccctgatccttgagactggcttatcggtaggatttctggtaccgggcacgggcaccgggaccgccaaacttcttggattcgcagcgacgggggtcagctacaagcagggtccgatcgtactggatgaggatatctttgatctccttcttagaggcttcatccacatatttttggtaataagccaccagagcttttgagatagactgccggatagcataaatttgggccacatgaccaccacccttcacacggacccggatatccacaccagcaaatctctccttgcccagaagcagaacaggctccagtaacttgtactgcagcgtgcgcggctcgatcatctccaggggacgtccattcaccttgatgagcccatttcctcgtttgcagtgggccacagctgtggctgttttcttgcgtccgaagacttgaacggactgcagcggacccttggacggcatagctacaagtatgaacacgag

SEQ ID NO: 599 - DNA, 383 bp, Rattus norvegicus
  Genbank Accession No. AI009825
gccttcataagaatttttattattatttagaaatgcagttatatacatagaacaattaaaattaaattaaactttgtacaaatattaaaatactatcttcatacccactgcaatgtacaggataccaaaaaatatatatataaaataaaataaagcaaacccagattgacatcctgcacagtcaattaagcatgtgttgttttaaaccatgacgagtaccattctgcaaaggatcccatagtggtgcacagcctcaagaagccaggccagtatggatacagccatgcaaccctcaactacttcctctccctactccgcattccccacggtgagctctgctactgggagaggacagggtagggtgtgtgtgtgtgggggggggg

SEQ ID NO: 600 - DNA, 381 bp, Rattus norvegicus
  Genbank Accession No. AI009898
cacacacagactttactgggtagctgggagacatagattggctgtaggtcacagacctgtgatcaaaacaaatcatgattgggaaaatgctatctgtggggcaaacacccacgccaaggtatcccaaaatctccacagtagacatccccactagtgggcaaaaccaccttagagagtggtaggtcaggtcaggtacggttaggaacaccaggtggggatcagtctgtggtcatccaagcccctacacacccatggctcctatgtcatctaacacccaaagcaggtgcaaggtgtgtatgaaagagaggttgagagctggtagccaaggcacataggagtggatatagagggagaagggttcaaagatgcccatggaacaca

SEQ ID NO: 601 - DNA, 516 bp, Rattus norvegicus
  Genbank Accession No. AI009946
gataatcagataatgtaaaataaaacgagctcagaggtagtcatggcccctcccaagcaaatgttaaatcttagataatctgagaatttattcatttatttttctgagacaaggtttctctgtgtagccctggctatcttggaactcactctgtagaccagggtggtcttgaactcaagagatctgtctgcctttgcctctggagtgctgggatgaaaggcgtgggtcaacgctgcccccactcgatctgagcatctttaatagctattgctcctgtgcttttaatacaagaatcgcttagagggcttgtaaaacaaaaaccagcatgaagcctcttgcaaagagctatgggttggcttgtgagctaaactatgattaaatggtctgtgagacacagtccagtgtctgcgtattagtggtgtaagtctagaacaaactcggtgtagaatctgtcataggcatcaagaacacgatgttcttcacctgatccagcatcacgctcccttacctgaggtc

SEQ ID NO: 602 - DNA, 480 bp, Rattus norvegicus
  Genbank Accession No. AI010067
aaaaaaatcacaggataactttatttataaatgaatgctattttctctgaactttaaaaacccatgttttaaagtgtacattagcccttcttcctgtctccattctcctcaataacaaattttattaaaacgccatttaaaaaaaatcacaggataattttatttataaatgaatgctattttctctaaacttcaaatcatcagttactcttataacagagaagaatttaaataacaccaccgaaacggaatggagacaaacagtgctactacacggcaccgtgctgcaggccggacggattgccaatcagtcttgcaacacggtccacttccagtgaaatgttcaggacagctaggaagcactttccttcatactgactttattgcaaaatgtcctaggtgtgggctcttgatcgttttggagctgatcaaaagtgtgtgttctgtagaggcagatgccgaggaaccaccgagagttcg

SEQ ID NO: 603 - DNA, 540 bp, Rattus norvegicus
  Genbank Accession No. AI010102
aaaggttaaggaattttctttattttttacaaattaagactatgtagatatattttttttaatcaaaaaccccgttgtcttcacagtttgagttagagaatgcagcttgagccggaaacaaagaaccggggatagagtggagacgcagggaggcctgggttaaaaacctgacaggcattttatttaaaagtagtttttatatctttatcattcttggcactgtttctaaagaaaaactcctttttcccaagcaaaaaagcacaaaaggtggagtctggcttcaagaggtggaactcagtcgggtcctgaggcctcgtggcatcatttttctggagagctgctgccgtccctcaggttgtaagctcgagccaggggaggcaccaggcaaacagggtggcaagatgtcgctctgggcgcaccacaccagaagcagtttcatgggacagtgaaccagcagccactgtgtcaactgcactggttttgagtgaagaaagtcaaaaccaccatccttctggtaacgggcttgtcagggcttggtag

SEQ ID NO: 604 - DNA, 427 bp, Rattus norvegicus
  Genbank Accession No. AI010178
gctgaagattttctatatacatatttatatatacatatatagtattttatttaaaatgtcattgagcatatacagttcttgagtttttttccaggggacgttgcacctaaatttcaaaacacacaaaatagatccccctttaactaaacaggttctcgtttggggtttacaaaagtcgaggtttcacaatcacgaagcataaaggtacatggtttggaaaccaatctccagacagattcttatcgattcactgtatgtagagtaattttttggaaacccagatcaccatgtatgtattcttacaaatgatcctcactggggcccttcctgggtttccaaagaaacaaacaaaattagaggcaaattgggaatgaagaagtgatggctggatcccctaaacacacacacaaaatactcatctaatgat

SEQ ID NO: 605 - DNA, 543 bp, Rattus norvegicus
  Genbank Accession No. AI010216
  misc_feature (1)..(543): n = a or c or g or t
agaacagtgaagttcttttattacaaaagtctgtacaatgaagtgccaaacaaacacagcaatgcaattataagtggacacatatatatctatatagtattgtatatagatatagtttatctgtaccaaagtaaaactcttgcaagctgcctaactatcccgggacacagctaaccatgagtcagtgtgcgagtcacttcgcttctctactcagccaaaactaacactgaacgaccaaatcatgaagcagctgtaactcagtgaaaccagttaggctgcagacttataaaaatattgtactcaaatagatttagcgttatagagaaggaatatattatttaaaacatttaaatagtgcacatgaacatttttgcatgtggtatacaaaataaaacattcataaaaatatacagtgcacataaaaaattacattagcaatccagtctggaaaaaaactaaaaagtacaccacatgatgggttcaaatcaaatgatacanttttttttggcattcttaattacttttctaaaaatacattatgag

SEQ ID NO: 606 - DNA, 540 bp, Rattus norvegicus
  Genbank Accession No. AI010220
cccttatagaaaggcacaacagaaaaaaatgattagtatataactataagaacatttacatccaatcaacattcttcaaattcatattttaaaaaaaaaaaaacagcttaagtgataattacaggggagccttggaaggaccattgtgagaacagttctcttgcgcaacaaactcgagacgcggcttgccagagctctttagacataggcatttttatcaaactgttttgaagggcctgtggttttaaaatctccttctccgccttgatacttggtccgggaagacatgactgacgtgggtccattgtacgtgtagcccattctgggtgttttgttgttgtcggatattgaaaagcaaaatatgacaccgccaatgatgcagagagaagctcctgcccatccgatgaagagggcagcccccaattcatacttttgctccataaagaggggatcaaagaattccgttgtgattttgttcgcgtacagggaacagcccgtcatggaacacagacctgacaatatgaatacaaccccagccaa

SEQ ID NO: 607 - DNA, 716 bp, Rattus norvegicus
  Genbank Accession No. AI010237
gttgccgttttcattttttttttaattaaaaataatttctattttgacttacatgattgaaagagggatgaatacaaatatcacaaaccgaaaagcactccccaaccaaaatcaaaacacagaagtgaatacaaaagatgtggaattaattatccatgcaatattcaaaaatgtttcaaatccacaagtaaaccaaacaaaagccctgtaatagctgtgatttcactttctacaaaagagacatttcaatcattaaacaaagactatagcctatacatactataactgtacaacatacctttaaaatgagagatatgtgcatatatgtataaatttacaaatatacaaatatgtacaaaggaacttcacagttgaaagaatgtgttgccagaagcctggcaaacaattttcactttaaaatgaaaggaatccttttaaaagtctggctaaaatgtaaatattgaaactaatatctaattggtattttatacaaaaacatccagaatacagttcaaattgcactcacatgtactgttgtgatgtcttggcatacccaccccttgcacacttagtaagagactcaatctttttcctggtactgagctgctgtggaaactacagggcagtttccatctctcaaggcctcctgtttcctagcctcatggagaatttgatagaagcaggaaccactttcagcacccccatattctatctag

SEQ ID NO: 608 - DNA, 572 bp, Rattus norvegicus
  Genbank Accession No. AI010256
gaataaacaagtttatttgtaaatttagtcaacatacataattgacctaaaaacttcaataggatacttttaaaaaccacttgaaggccatctctataaaagggatttttttgccaggatagtaaccaggtgtaacctaacccatcttcattggcagagtccaataagctcaagctgtactcttacccccatgtttataaactccacaaggaaaagcaaaccttgtacagttttcccccttaaagattaaaaacaaaaccaaactcagtctaggtgtaagaccaaacacaatgaaaagctcactaactagattaggaacagatgatgctggtgtgaatagcttgttgttttactctagagcccttaaagaaaatccccgttagtgttttgtgttaccagccagagggtcaggggttagtgaacatgtggtagaatgaggacttatgcaaggtttaatacgcatagcattcttctactttgttaaaaacaaatgcagtctagtcagaaataccaactggactaaattacacacaccttaatgacaagactccccaccacttgtgaatgtaaaa

SEQ ID NO: 609 - DNA, 545 bp, Rattus norvegicus
  Genbank Accession No. AI010262
caagataaagagtctttattgacatagagctccacgtgacctcttctgtcctgccctccttgcaaacatactaggtgtcccaaaggtagggacacgagcagacagtcctgagcctggtcccgtcctccaaaatgcagtcagactgcagtctgccatctgccatccctatcatctggccaccaaccagaaccagccccacagttcccttgtggtctcgccttggctgccagtggtggtgtccactgggacctgccactaggctgctgtgtttgtttactgggatcccacttccacatcctgggagccctggcttctggccacatgtgggtaactggcagtgactttgggcaatcaagtttgcgttcttgttgctttccacaactgggccaagctgggacagcaggctctgcttctagtctcagtccgagctgttcaatgaatagcctccttggggcagtatctaccctcccttaactcaaaatttccactagttagggcctcccaagccactgccaggccagctgcgagtttctaggaccaacttc

SEQ ID NO: 610 - DNA, 507 bp, Rattus norvegicus
  Genbank Accession No. AI010303
  misc_feature (1)..(507): n = a or c or g or t
ccagattcataaggttttattgtcaccacaggatcaggattcatcttcaccaaaaccctgcactaggtgcttaagagcggctgtgacctatagcaagaggaagcaggcacaaatgaaccgaggtcgattgccctgagagacaggcagggccggctgccccctcctgcctgcccacagcagacacttctagaccatcaggcagtggggtttcctggcccctagggactagctcacatggtgtctcactaagtgtcagggaaccctggccattccaccttcccaaggtcattcacataatacagaagtgcttgtccagaagggagctgcctggtctcgtaaggagtatgtaagaaatgaaagaatattttgccaaagggcctatccacacatggagcactcagcaagaatagggcagccaggctggcaggtgtccagtcaccccaattgatgtgacttgaagcaaagggtacacacaggcctattatcagcgatntgacaaagcaatct

SEQ ID NO: 611 - DNA, 559 bp, Rattus norvegicus
  Genbank Accession No. AI010407
gagaaatagaaagctattttattaacacgctttacatttacagttcattagctaatcaacatcaacatgcaaaaataagcgctagatacaaacctctacaatatggttttgtgtgaattacaatggttcatgtctggaaaacccgtcagtacttactttagctgaactatcagtttccgtaatgaaaagcatgtacactctaggactacggaaccacctggcaaggcctctgcagaaactcagtccagtggctttcccgtgaatacattctcaaagcaggagataaggcggtgctggaaggtgagacgctgaacctgtgcacagacacagccccagacaccctggccacaagggcagaggctcgagtagcagcccaggtgcatgtggtggatggtgctttggcagcagctagacagtgaagtcaggaaaggcctcggcaccacgtcacaagtcactgcagccaacctggtacggccagcaccttgcccaggctatgaccaacaagagttggcaaaggaccagcctgctcctcaagctcccctgagtcccatcactagca

SEQ ID NO: 612 - DNA, 439 bp, Rattus norvegicus
  Genbank Accession No. AI010470
aaaatatgcaatatatttcgatatcgtatacaatttaaatatggcgtgatagcacatgtcttgttaatttagaatatagcttttgaggggcaaagtctatagttgatcacatttaggagctttggaatcctggctcctggatggaactggtgatggaggaagcccctgagctgagggactggtcttgttgcagggaaatgagctgtacaaccatcttcatttttagaatgttcttgaaaacaccttattttcctggctactccttggtagatatttggaataaagtagtcatgctgattaacagtgtatagagtatgttccaggtcatcctgtagctctgagacgatgcttgatttggtaaaacagtgtaggtagttaccatccccgcatgaatatggtcagtcacatggcagtggagtaaccaggttcccctcgtgcc

SEQ ID NO: 613 - DNA, 394 bp, Rattus norvegicus
  Genbank Accession No. AI010542
ctttctttgtgtagactgtgggtctgtgtctctttaattctggaaaaatgttctccacttagaaaaaaaatgggcttcaaatttggtaacaaaccttatttacaagagacttttagctgtgaaaatgcacattcagactagcaggagaaaaataacaatgcaattctttcccaggaggcttcggtgtctctttgaaaatttaaattaacacaaagtagcaaaccttgaattaaaaaaaaaaatcactgtataaaccttatcttttaaaaagtctcctcaatatttttttcattctatgacattctacaaatccttgacttttttttaaactggagacattatgccctagaatttccttaattgcactttaaatatacttgaatttacccaccct

SEQ ID NO: 614 - DNA, 477 bp, Rattus norvegicus
  Genbank Accession No. AI010568
ccaagaaaataaatttattgaactttgaggggaaaaatccacagacataaaagaaagttaaatacagactgcaggacacaactagtcacatggtgaataatggcttgtgtggccagcaaagtaccaaaaatgacattctgggactgattgaggtatttagctatttttggctatagcaacgtggtcagcctatggtgaaatggtaagatagttcatcaaaacacacatctttaagctgaataggttctaaattgatgatacttcatatgaactaaatcatgtacccattggggaaaccatagcagcaaggtatcagaaaaaaatctattaaaatctactacagaataacacagtgaaccttaaacacccaagtctaaatttttcactgtctctcctgcatgaaagagatttaaaaaccactaaacattaaccctgtttccccacaaaggtctctgcaaaatggtaaatatcattgaa

SEQ ID NO: 615 - DNA, 437 bp, Rattus norvegicus
  Genbank Accession No. AI010642
attggttaagtagttttattatataaagagatcctgtaacttgatatgaaaaacaaagcaactccaaaagatatcacaaggacattaacatttgaccaaagagaaaatgtagcttttcaaaatacacaagtattcaaccttactattaataaaaaagaaaaaaaaatcaggatgcaatttcttgcttgcttattcaatacacaaagttagtagcaatttttaccttaacttctaaaagcactcaaatatgtctgaagttaacaacaacaacaaaaaaaaaatggagtcattttaaaaaaacaaagtatgaaaattctgttaatgaagaaatcatgaaaagcattaaaatgaatcaacacatgtatgtatgggcagtaagtaaagttcagatgccagaagccaaatccttttgaattacattaaaggactgttaatgg

SEQ ID NO: 616 - DNA, 519 bp, Rattus norvegicus
  Genbank Accession No. AI010962
  misc_feature (1)..(519): n = a or c or g or t
acagaatataaagatttccctcattaatctctcatgtgaaggggattacaggccagaaggaagacacattctgcacacaaagtacacctcgtatgtgtggcactggagacaaatggtgtcgtgctcctgcacataaattaggaccaagtggtgacatcacacatcaggggtggggagaaatatcctagtcaatcagattcaagaagcacacgacacagaaactgcaaattcgagcaagtcggcagctttagtcagaacactgcaggtctacagggctgaggctacagtgcacacggagggacacggtgggaagggctacttagaaaggctggagaagtgagggagtttccactaaagcanatgaacgtcttgccaaacagacagaatgaaagggagcgtgagtgttagtacatccagggcgtgcgcgtttgttacagcagtgtctgcagcatgctaagttagttacaacgtcttcattggtacggacgaatcattcatgggcttggggtttgcctcttc

SEQ ID NO: 617 - DNA, 490 bp, Rattus norvegicus
  Genbank Accession No. AI011285
aagatttctttgatagtaacttttattagttgtacaaagctcattcagtctattgctcatttaggatgactgttgacaaatatagcacatggggcaatttgagccacactgaattacactccagaagaaaaaaatgacatgctaaatcaatgtattttaaaatttcagataaagattttccactgtaggtaccaaattacaggtactagtttttgttttggtttttactaactttaagacattataatgtttaatggtaaatattactaagtacattttgatttataatatttcaacaatgttttcttacacttatttagcctgtttattgacattcacgtaaaagagcacatagtccaaatgcaactcagaatggtgacctctaaaccttctgttaaactaccgtagtaatttatacaattaccatagtaatttacacagttaagaacaagacaaagatcagagcaagtgatggcttacttgattttac

SEQ ID NO: 618 - DNA, 394 bp, Rattus norvegicus
  Genbank Accession No. AI011361
atttgtcacaatcaactttaataaaaaataaattacttctggggtgggcatcattttcagtgtgaagtgagggctggggctagggtgtcttatgctgatgtttctcatttccacccacgacacaactgatcgctacactggaaaggtgtggtccttctcggtcgggtaaggtacggtagcagtggctgacccccacccctgctaatctgggtggtaggaatacagagactagattaggcagggataggaacaagataagttagatgtgccgactgacctggttgtgaggattggggcacataactggaacttctggggacacacactctccatgtatctcagattactgtggaaatataaccttgctttctccccagcccagaaaagcatgaga

SEQ ID NO: 619 - DNA, 418 bp, Rattus norvegicus
  Genbank Accession No. AI011380
gcaaatactaaacgttttattgtagacaaaatggtacacaattattacacattatgattttaaaaaaacacttgaaacttttacatacacagaaactgttaaatcattttttttttttagcaaaaaagtaatttctttaggttttcatcacaacaaatgaatctgctcttagtgggatttctaccatgtccacttctgaacagatgtgtgtcagcctatcgacctgctacatggaccaaattcttaagccttctatacccaactgtaccagtaagctatgcttgcccaatccctgcacggtagatcccttctgtgctgctgtcactttagtgggtgttctctccaaggacgacggtaaggaatacaatgtgctgtgtctctcggcttcagtactgtctgggaacccttctcccacagg

SEQ ID NO: 620 - DNA, 399 bp, Rattus norvegicus
  Genbank Accession No. AI011382
aggctgtgggaaatttttcttaaaagtctggggggcccctggcatcgcccagtcaccctcccaaagctacagaaagtttcctcatctgggcgatctgagacccttttacaaggagttcactgagcagcagctgaggcgccgctgccttgggtcaccgcacctcaggactcagggccgtctgctccatcttgatgggtcgcactgacccatttgggtcgccatcgcagtcccctggaagcacgggctgcgagcgggcagcctctactctgtgtccggccccgcagcgtgcgttgccctccacgccccggtgcgcaagtggcttgcgggacccgggcgcgctggggccggaggccaacacagccgcttggtctcgcagcagccgcaccaggaagccgatgt

SEQ ID NO: 621 - DNA, 554 bp, Rattus norvegicus
  Genbank Accession No. AI011460
acacagcttggcccttaactcttaaaagccagaaggtaagtaaacagcatcattaaaaatccatatacaaagcatttacaaaggcagagttctgactcacttttcttcatatgttaaaatttacttactacgaaaatttgctttatgaaactatttttaaattgtaataaaatttgcaatcaaacacttgtttcaactatagctatcaactgataccaaatttaaggacactaactgtgctcaaagtatcttagatttactactctgccatatgcacattccccacctcataagaatccctaagaacctataaaggtacaggctttgtacctttcccacgagtgaagtggttttacacagggatcataaattacagataccctgggctactacaaagtgagatcttcaatcttaaattccaaacttctcaacgcctttaaaacaggccaagaaagcaatcccattaacaatcttactacaactcaaccatctaagctcttgttcagtcttgccactgttagcataatctcttgtcttcatttgttcagatttta

SEQ ID NO: 622 - DNA, 522 bp, Rattus norvegicus
  Genbank Accession No. AI011492
ggtttgtggtttgtttttttttttttttggggacagcttatggtgaaattcatttgtagatgccagcaagcaaacagttcacagaacacttaagctttctgtgctcctttcagtgggaccctaactgggacttactacattcattctgtcccattaataggacagctttgaagactgtcagatggggactccagccagagttgaggacccttcatacataagtagagtggaatatatgagcagacacaggtaataggacattccagcacctgctatcaccccacgtagggcgggggaggccaccacatgtgctctggtcgtgtctcagccgctgggtctcttgtgtactcacggcattgtctggatggaagacgtatgaggcgggtgagttgtctaagattagcacccgccgcaggtctcggcccagcctgctcaggtcctttacgtagtttccccgatggaagacacaggactctcgaaacagcctggcacggaaggctccccacttgtccagcagatcag

SEQ ID NO: 623 - DNA, 199 bp, Rattus norvegicus
  Genbank Accession No. AI011560
acaaactccaaatccagcatttatttcgggggaaaaacaaaaagggggctcaacccaggttaggtcattcccaaacagaaacagctgggcaggaacccctgggaatgcctatctacccaactatgagtttggaaggaagaaaaaaggctaattctggatctgctaccaacacagctgccacagccagaagctgggaaac

SEQ ID NO: 624 - DNA, 471 bp, Rattus norvegicus
  Genbank Accession No. AI011598
caaacaagtcactttaattccatacccacaattttacagatctcagtactgaaagctgtcgggcaagagggacaaagtataaatatgtctgttccgcagtgtaaaccagaaatgacttgttaatcacaaaaagtgtacgcaaacactaggtctgggaacctcaatgccagcgtagcgggaagacactggggttggcctgcctctgggtcagtgcctttccctgcttggaaattgctagggttcctgaggggcatccgctcatccccactgctccctggatgcgtgcagaagcagtcatgttgacaggggccccgttgaacagcagcttcctcagacatcctcggtaggcagggggctctggccaggcagcttcaaacttgggcgggctcccaaggtgcaaaagcgctggagaatcagccaaggtctctggcaaacggcctgtggtgtggttgctgtgtgtgtcgacttcta

SEQ ID NO: 625 - DNA, 426 bp, Rattus norvegicus
  Genbank Accession No. AI011607
agaatgcgtttgcattctgatttagctgaagacaaactatgtaatagaatttgtttccttttaatatggagattatttcttatgtacagtgattataattatatcaaaaaggtgaggaaaagattagactcatgttttaactagatggtgatgttagacaactcagaagccctctttctttatcaggcttctcctagaaaagtaaggaaaaatctcttctgtagaatggaaaatagacaatctgaaacaatttttaatacaatattgttctgttgatataaaattctcgtagtagggtaccgagtgtattcataatcctagtgctttaaattttaggcatgaagacctagaattcgagcagtattcagtacatcatctctagtcaaatagcagccacacagttgacggtagccagtgaatgactcc

SEQ ID NO: 626 - DNA, 396 bp, Rattus norvegicus
  Genbank Accession No. AI011634
acagttgacacacttgagtttaatttatggttgattcacaaggaagcatagttgtgggtttaaagctgatgaagtcgctcagctgctgttactgctcttcgtttttctttcaggatcaaggtgggtgctttcatataaaatcttgttttttattccttctctggcaattctttcctggatcctctgcttagcaaaattatacctacagtggaaccagcatcctaaagtcaccaggataaatcctcctactccaacatcacaggatcttctaattctgctggtcaccaagaaatgtccaagtccagtcacaatagatcctagtgagccatacagtatagattctcgagcgcatggagtgttctcaacatctaaaatacctaggagcttgaagggctt

SEQ ID NO: 627 - DNA, 426 bp, Rattus norvegicus
  Genbank Accession No. AI011678
cggcacgacagactttattttggcacttaaacaaatttgctttacagcagtgacaaaatatttgccagtattttttccctggcatagatattccaagcaagtcattctacaattagggtttcactgttttgcacagttagaggtataaccactacattctcagcctccgtgattgagggcattgtgcagctttggaagggcccatcatttcctcttaattctaaataaggtgaattacggctataattggacagaaattaaggccattaaggattcagacacaacactgttccaagtgttactttagttttgtttgaatgagttctgtgacaagcccagggaaggtgctcaaagtagtcaaacttttatcgaaagttgactgtatgttggaaaagttgcggttcttgctgtcttctttctacttcc

SEQ ID NO: 628 - DNA, 351 bp, Rattus norvegicus
  Genbank Accession No. AI011706
gaagtctcaaacaaaactttaatttcctgtacatactcctgtcaaatgaagttatttcctgtacaccacttttgccaactggtcttctatttcctttcatttgacctagatcggctacgagacctagagaaggatcgagacggcttgtgatttctctcacgagacagagacctttctcttctcctatctctagaaagagacctgctccggcttcgcgaaaagcttctccttcttggggattagttttgggtttcaacaagaagaaatggtgaggtgaggctgccggactgacggccaggaagaatttgctgaaaaggttttgccagatgttgcgttggatttagttggttg

SEQ ID NO: 629 - DNA, 683 bp, Rattus norvegicus
  Genbank Accession No. AI011757
ccagaagtttatttaggaacaattgttaagcacagaaaggggtcatcacccaacgccggtgctgctgctttgctctgacaacaaaatgtttggggcagagaaagagtaaaactctgaagcatcgcttcttgggagggcagctgtgtgctcatcgctgctttgctgttggtcctggaagaccccaggctttctctttcccctgagattgtccattggagagagacaaacaaacaacaaacatacaacaccaaaaaaaaaaaaaaagttaggggaggggcctctgtattattcctgccactcaaacttggtgccgatgcagatggtgaggtcgcaagtccacagggaagctaatagattctacgctattgctctcctcatcccatgagacgagggctcacttgtcctgaggttccttgctccagtgaagtttgggttcctcatagactgccacggaactttgaagactcctctgcaccgagaaatacagcactgtgtctattgcaaacaagagtcctatcagcaggcagaaagtgatttgatgccacggtagaaagctggagggagacgtcggatctcctatgcttatctgcaaggatgctgaagatatgttgttgcgtccaatgatccctctgcaaaagtaggaaccactgtcggcgtgcgtagcttttgaaatactgagttta

SEQ ID NO: 630 - DNA, 542 bp, Rattus norvegicus
  Genbank Accession No. AI011799
ctgacagcttttcctctttattctcaccccgctgacatgcaaacagaaccgaaacagtgctgctcaaaaaaaataacaaaatgttttatacacatttccatatatacaaccgaacaacattttacaggttatcttttgcacagcaaaagaaatataaacattcggctccaagaacacagatatatgtacaaaaaaaacaagtcaaaaatacttcacaacggtgcaaaaatattttacatagcatcatggagtaggagctttggggcatgaggaaggtgtgtatttctaaaggaaaattccttttgtgtgtgtgtgtgtgtcttagatattagatttctttaactgtaaacaaaacacaactttcataccccgccctccgccccccataaaagagttatctgagaaatttggcatactttcaagagtttgagtctgacgtaaacagcccaagctctcatatccaaatgaactgggggcaggtaagcggcattaaagcccaacattatgaaagtgactttgttaatgagatattgaagacagat

SEQ ID NO: 631 - DNA, 533 bp, Rattus norvegicus
  Genbank Accession No. AI011812
aagagcaataatctttattgagtttttttaaaaaaagacaaaataatattaaaactcaactgtcacaagtaaacaaaacagtgacttaggttagacaacgttataatgtacgcccaaaccatgtttgggtgtaataccccatgatacagtacagtgtttggacccattcccactcaggagcaatgagaactggacactgtagatgtcagcactgaacacagaaccgttatggagtctacggccgagcctctgctcttcgcacctattggtgtctcctttaacgtcgtagtgcacatctgcgtttgctaacggagtccagaggtccaactccaggttagccagtttccactgatcaggatttctatagcttctgctgggacacggtccttcagaatgaacctacctcactttccacttctaactctatggcctcctcctttcctcctctctccagggcacagctctctcaccttcaaatgctgctcacacagtgctgaacgtgaggcggtaacttctgacaaagttgcagttta

SEQ ID NO: 632 - DNA, 454 bp, Rattus norvegicus
  Genbank Accession No. AI011982
gaaaggataagtctttatttcaccttccagtatttttgacagtttctctgatgccggatcttcaatcttaggagtccaaatatacagcgctcagacttcagctctccagagcaaagtacccagatcagtcctcagggaatttttaggtgggaaaaatgacaatgacagatttctctgtaacaatccatgtcaatcttctcgcttcactgaaacacttttaatttaagtactccatcatccctaaaactgtgaaatctaggacaggaaagcactcatctctcatacacaacacaaaagaaggaacacagggtgagcgagcgcgaactccaagggccaaattgattcacccagaaagtggatttgattccatttaacaggcattcgtacaaaactgttctgtcttctcaaggtagtctggctagacttttgtatatgggaagtaattcccatatag

SEQ ID NO: 633 - DNA, 518 bp, Rattus norvegicus
  Genbank Accession No. AI012114
caaatgacaaccagcaggttatagctctttattgtctcagtctacacctggcccaggaatgctcccatgagcagcctctggttcaggggagagcttggtggtagtctctggacagtctgtgatggggatatcaccagaggccacaggagctgcagggctgtgtgaatagcagcactggtctcctagttgacaggtaccctctttgaatcgtttgcaggggaatgtcttgaggcgagcggcgcgctgggctgggtcctcagctggctccttccgcttattctgcagcagcctccgcctctctgccagaccttcactcgctgccttgccccctggccgggcacggggccggggaccccagttggcttctggattggcctggaagcgcttaagtcctcgctggcgggagctggggttggcatcttcccggatgttgaagttggccttcagcctgggctccacagcaagaattcggaatgctggactgctttcagatagccgctcccgtttcactggacact

SEQ ID NO: 634 - DNA, 418 bp, Rattus norvegicus
  Genbank Accession No. AI012145
ggtacccatgtagacacagccaatggcggcggtcccgtagctgtgagttcgtgctcccagtgtcaggcctcccgcacaacctccaatgaagtagttcagggggtcatctggcttctctcggacctgggcactgacacaggtggtaaggccaaacatagctccaatagcagctggaattaccgcggctgctggcaccagacttgccctccaatggatcctcgttaaaggatttaaagtggactcattccaattacagggcctcgaaagagtcctgtattgttatttttcgtcactacctccccgggtcgggagtgggtaatttgcgcgcctgctgccttccttggatgtggtagccgtttctcaagctccctctccggaatcgaaccctgattccccgtcacccgtggtcaccatggta

SEQ ID NO: 635 - DNA, 398 bp, Rattus norvegicus
  Genbank Accession No. AI012177
gctcaagcacaggacttgaggtgtgcctggaccttcagcgtgcattaaagaggctgaggggatggggacagggatgacctggatgaggaaactgagaggaggggaggaaaggggaagtactggtaggagctgtctagaggcgatcactgtgataccgggggatgttaccgggaataccatctcaggagagcaaggcaagagaggtaatggacacaacagtggttttcccatgcccctagcaccttcatggagaccgcaggcttggaaaacaaccacagagggaagggatgggaaaaatggctgcccaggagtcttctccaccctggcttatcagaccccatccctatcacacagccccttcaaccacttgaaaatggagcaaacagagggagcaaaat

SEQ ID NO: 636 - DNA, 523 bp, Rattus norvegicus
  Genbank Accession No. AI012216
acagaactcaaagggtctatttattaggaaggaaatgtcagtgctttatcaaagatgaagaggtcagacagagatggtgggatggaggaccctcagctgggacacttcttggccacaatgaggacagcagaaggcacgagtcccagttcctgcagaggccgttccatgtcagcctctgagaaagcccgtctggggaagccactgagcaactgcaccgggtcctggtcctgtccaggttcctcccctcggtgaagctccacatagagcctcacagctgccagctgctcccgggcccggaaggtttgggtcagtgaagtcccatcaggcagcctaacctgtatgcgacactggtcatactccctcttcgtagggggctcctggcggggagaagaaggaacaggaccaacttgctctgagggcgtgggttctcgtcccaggatatggctgagaggagtctctagaggctcgtccacatcggggtcgtcttcatgctccataagccagtccatcgcagcctcgtgcc

SEQ ID NO: 637 - DNA, 574 bp, Rattus norvegicus
  Genbank Accession No. AI012221
actgaaatacgttgtcttacccaacccacccaaaaataaaaatcttacccttgtcctctaatctttcccttatccccagtcccatccccggccctgcacaagtgccccggatttcctgcccattggctatatcggagtgtgtccattatgtagcaacgtggaagcctctgtggagagcacagagtgggtgaaggacccttaaaaaggtgctcatttgagagccctggccacttgctcataggccagctctatctcttcatcgtcaggacaggtggaggcgaattcttcccgagcgtaagcgttgctcaagtaccgatgcactccacggaacgcctccgggatggtgaatcctctgtactttttgcacaccacctggactatgtgaagctttggcagcaggttgcagtcagccagggtgagctcattgccatccagaaacttcctctgagagatgccctcatcctcggcgctggtttcatccacttcttccgggaggggggatgtcaagtaattgtctagaaccttcagggctttcaggagtcccttctctaggttgtcattgagggccgggttt

SEQ ID NO: 638 - DNA, 636 bp, Rattus norvegicus
  Genbank Accession No. AI012235
caaggacagtgccaaccatcacaccagtcacagtacgacaaaggaaaggaccaagtacacatttacatatttttttcaaaggcagaataatggaaaacagactcaaagagatgaatagattttttttccaacattttctttggtgagcaaaagcaatttattttaaaaatctatccagattattgtcactgataaaacagataaagccagatgtacaggaaatacacatctttagccctttagactgcctcagtgggaagccagtgtgattaactcaggaaacagtagtgttctcttactcgtttctacagcgtagaaatgtttgcagggcacctcatgaatgctaaatctttttaaatgtacaagcaagatgatatgtggaatcttcttcctagatgttcatgtgcctcgtgttatttggggaaagggatgttatttccatgaaaaattccttgagtaatgtttttctacactagatgcttctgaatccaaccagcgggcgggcgggattccagtaacaatgtgtccattgtaaccatagacgataactcggagtgtgcacacacagagacacatgactcttcgagataaatattttcatagccaagcagaatactttagaggtatccgacctcc

SEQ ID NO: 639 - DNA, 508 bp, Rattus norvegicus
  Genbank Accession No. AI012308
tatttttgtaaggatacattgaaacattcgatggaaacagctaatgacaaatatggaaatgaggtgtgggcatctagaagcactcctacagtaatatatgagtgtattttcattacatctttactttgatattggctcgttatacatgtggtataatggagagtacgatcagggaggcaatcctgcatttcagaggaggaggaaacccagccctgcctgtaaagggtgagggctaccctgacagccccagagatctaactcaactctgcagggaaagttctctaggaatcacaaggaaagggactctgcactcttcctgaacgcagacaaagagcagacaatggttatgctacaaggacttcaccttgtcactactttgaaacgtattcttgttgatgacagccctgtgcctgctcagctgccactctagagcttttgtcacttatacaggatcaatcgcaaaactgcaggaacgtttgaggaggctcatatattgtcatgcaagttt

SEQ ID NO: 640 - DNA, 544 bp, Rattus norvegicus
  Genbank Accession No. AI012337
  misc_feature (1)..(544): n = a or c or g or t
gatggtgaaaaacaaccctgttcagacaaagataaaaatacaaaatcagatgtagcacaatataatagaaactggctgaaaacagtacacgctaacagacatgatacacaaactcagggagggaggagataggagagggcagaggccacggcctacaccaggagccgctcaatagactgctgaatggattggatctgctgctttagttgagagccttctttgatggttacagaacaggcgatgaccggcctggagactccacaggcccgtcctaaagcctgcttggagcgtacaaatacataggggacattcttgtcttcacacagcagagggaggtgcaggatgatctccaagggctcagcgtctgctgccatcacaatgaactcagagatgcctctgttgagggttttggtggcttcattggctcctttccgaagctgcttgtagttacacgactgctgaacaaggtccagcagcttcttggtgaggtgggcatctgcgaggggataggcctttgggttcacatcagcctncgcctcgtgcc

SEQ ID NO: 641 - DNA, 636 bp, Rattus norvegicus
  Genbank Accession No. AI012356
ggatgttaaagtagttacagcaatatacaaaaacaaacaacaacataaaacaacccacaataatataaatttttacactagaaagtatacattggaatttgagtgcagtgaccaggacagaataaaagccactgtactgggaggccaagcaaactgcaggcatggctgggtgaggttggggacaagtggggccaaggggaggggaagtgggccgttccaagggctcactatgggtgattaacccagatacagacttcccagaacccctgaggtacaacacctgccccagagaagccctcaccttgttcctgggtccccaggattggaagccatcaacatgcccacgccttgccttcctaaataccctttcagtttatgagttcagcttattgtgtaactaaagaacctggccagggaagggagagcaatgactgcctcgaagcagaaggctggggtggtcaaggcaagcagtttgtcttggagacaatgtcctcactgcccttaattcagacactggttaactggagaaaaacaattccacagacagatcagctgagtaaggtggctttgagtcactgaatctagccatgcccctgtatcaagggaggcttgccttgaaccactcagtgttcaagt

SEQ ID NO: 642 - DNA, 561 bp, Rattus norvegicus
  Genbank Accession No. AI012379
aatggcaggtcaacaaatatcctgaaacatacatagattctgatagtcttctaaccccagttgaattcaaacttgaaagtaacacacgcgagctaagggaagtcaatgttgttccaaggcacttactgaatctccatgactagacgaaaacaagaaccattagggtgaacaattagacagtatataatataaaaataactttttgcttacaatttacaaaaggtattattattacactctttgatctctgataacctgcaatgctggctacacgaatccagcaagtttaaaattcagaaacagttttctaaaatttcagggcaaataatttacaagtaagatacacaaagacttaaaccatgcagaaattcttacatcttctgttaataatattttaggacttcaactttatcaaattatatacctacttgccctgtacatatacaaaataatgcatacatgataaaacagcaaaagagtagtcctttaactcagtttatcataaaagtattactatattaacaggtctacaagcagcttgtaacagggttaagagacatt

SEQ ID NO: 643 - DNA, 556 bp, Rattus norvegicus
  Genbank Accession No. AI012438
acaattgatgaagcaaaggaagcgcataaagagctattggcgatatgacaggataatgttttcctggagcccccaggaccccatgctggggccacacgtggcagtggactggtgtgcatgcctgcagtgcactgagcacacacctgatggcagagaaggccccacacagacagccctggctacagaggtcaagctcacgtgagaaccacccgctactaatgatgcactaggaacctggaatactgtgtaaaatgtgggtgagcctcctctgacatcctaccctgacagggtctgatcattatgtcagaccaagggcaagcaaaagcctaaaaaacaaaacccacttaattaacagtggctatttacataaggtttggggtcttcaaaaattcagggcagttttaattctgagctcaaggagactctctgaataggtagcagggtacgtgggagtgcctgagagatcactactgagactcctgaaggagagaacagttgggtttccccaggcaagcatgaacgcacacaccaactgacatgaatgaaaaaccaaaac

SEQ ID NO: 644 - DNA, 539 bp, Rattus norvegicus
  Genbank Accession No. AI012464
aacagtatacaagagtttatttaatgatatgaatttagctccatcacgtagggccacgttacaagttccgtctgggcccattacaactctaacaacaaaaaaaccttaaaaaaaaaagaaaatccacaactttctccatgtcattaaatatattcatatataataaccataatatattagtacgcattggaaagggacactggcccaaacagtatgtcatggtcacaactaaacatttacaattctgtgtgagcagaatcggcgacacaggagggaggctggcttagtttttggctggggcagggccccacaaagagaattttgatacccctggggtatggcatggctctggtccacaggaatgtctgtctgtgaaccacagcccattcgtgagcctaacttgcccactctctaggtttcctggatagagcccttcagtgttgagaccctaaaggaaccatctcccaggtcagtcccaaagggtcttcatttcagtcctgttccagctcggggcaattctaagagagcctgaatgtaac

SEQ ID NO: 645 - DNA, 599 bp, Rattus norvegicus
  Genbank Accession No. AI012471
gaaggcaaagatcatttgctcattttatttaaaagtaaacagttgtaagatagaagggcagatgttttctttattgtagagacagcagttacaaaagagaagtaataaatatgacattaagaatttttgtttttgtttttgttaaaaaatacaaccccctggtatttgtgagaagtcccaagaaactcacaagataaaaaaaaaatctgtcccatgggtgagaatacatttctttcagttctttggagctgatgtcagacaccggaagatggccatgacttcaaaagaccttggatgtcacttgagaatttcacaggtccaccctgatttgcatggggtcggatgacagctatccttctactcactaatattaattacttctgacgattctttcattcttaacagtaaaggacttaaaatgactggattgtgaaatgaagaatgagagggaacgagaacatagacattgttaagtgccaggagacaggcaaagacagcatcaagttagtcccgtttcggagtggggtggggatagagggtctaattcacaagtcttcctttaaatcccgccatcatactaaggtggaagacggtgaaaa

SEQ ID NO: 646 - DNA, 559 bp, Rattus norvegicus
  Genbank Accession No. AI012485
gaaagatcaacaaacctgattttattatgacaccatatttttgtcatcggttctgcacaaaattatatacaaagaaatatatacaaaaatgttcaagtattaaatttcaattcaaggcttctgtttcaaaagctacatttaacatacttcagaaaaagcacaaattagtcatttgaaataaatttccaactacttttggtttatatatatatgtatatatatataattcagtaggcactaaaatccatgcagctgcattgtaggggcttgttcctacccttgtagaagcaggtccgtcactccaagttgtgagtttggctactacccattcatgctcaagtgcagtagataattttacaaaatgtgatatactgaaaccagagactaatgtaggtctcaaaatcatattatctagcaacaaaacatttacagttagttgtgcaagaacaagattccatttccataaccaaataacaaattaaaacatcttatgtgtaagataacttacatctttggactgctggaaaatacttaattatgaacattttaaaaattaaag

SEQ ID NO: 647 - DNA, 631 bp, Rattus norvegicus
  Genbank Accession No. AI012589
ctgccttacaaactttattagtctgggaaaagggggacaaggagttcctgtcccttcgtccactactgtttaccattgccgttgatgggacggttcaaatggtcaggggaggacagaaaggccttgatcttggggcgggcactgaggcgagccacataggcagagagcagggggaagttgtccaggcagccaggggccaggacttggtggaccagcagcaggtccagcaagttgtaatctgcaaaggaaatctggttacccacaatgaaagctttgcctccctggttctgggacagcagggtctcaaaaggtttcagatgcccaggcagggccttcacatagtcatccttaccattctcatagttagtgtagatgagggtaccatatttgcatcgaaggtcctccaccccatcattcaccatatccaccaaggcagcctccttctggtctttcccataaagccctaaagagcgacccaggtgcctcaagatggcattagattggtaaagggtgaggtctccatcttcaaacttggggagctgcccatacagacaagtggacttgagcgagccttgaagccagacatctatggtaaccacctcctccttccagctctggccctggtcagcca

SEQ ID NO: 648 - DNA, 651 bp, Rattus norvegicus
  Genbank Accession No. AI012590
tttccacatttcaacatgggaaatttgtaaattggttttatggcaagactgttttttattgtgaaaccactagctactgtttacaatgaccaatgtcccaaggaaaggtatggggatttacaacttgatatcccgttaactaagggaacatacaaactatctcaggattccgcagaaaaaatatagacaataagaagtggttttaaacaagtgacttaaaactaaattttcaaatgcttacttttggcatctggcattaatactttttaaagttttacaataaaatatcaccgtttgggaaagttaccacatttcctaatgaccgactaatgacgttacctgaattaacactgatggaaagtacacaagcaatcaataacttaccaacagcatctcaacttcagaaacacaagagttaaatttagcatcttcagtgtttggcttcttgggccaacaaactacttctaaacaatgtatgtgcacacttattcagataagagggctcctttggcacctgagttgagtataatacaaaaggaaagaatatctaacataaagctgtttaaaggctatatcttatctatctatacatatatacacatacctgtacacatatatgcacacacatatacaagaagcatacattttttc

SEQ ID NO: 649 - DNA, 552 bp, Rattus norvegicus
  Genbank Accession No. AI012613
ggcacattagggtgaactttattttcacattacaactcacttgggagcttcaaaaaatacaaatccacaacttcactgttgtccctggaaagccctttgtgatgttaccagctgcctcccctaaggtatcccatctgtcaccagttccacagacaaccagattaactcaggtaactagtgaaggccctaagtgtatcctgacagtggtaaacagaagtgtatactcagggcctctgcctcttcttatctcccctctcctcagtcaaggaccacagtgcctcaatgccatagctgagtaacaggcaacgagggacacagtacactagtagtttatgctttccaagcaggcccaggcacatcctatgaagacgtccctatctgtaaaacaacacagggtcatcaccctgacacgataacctttagagttaggaacgcagagaaagactgtgtatgcttagaagcctgatccccgagaacccacccactaccctcagcttgtctctaggacacatggaaggcagcatgggagcagcccagagctggctagccatg

SEQ ID NO: 650 - DNA, 534 bp, Rattus norvegicus
  Genbank Accession No. AI012619
atactaaaagaataaagatttttattaagcattgtaagttgcattcaatagcctctggatacgccacaccacaatccatcaacagtcaatcagacccaacagcagttcattcttcacaatccatgagttagggcggaagtcccttcaacttacagtaagatcctacttagctctcgcgggcaggggttggggagttacacctcatttctgatcactaatgtgatgaagagcatcggaagtatatgaaacgtaagaagtgattctgattcaaagtacattgtttgggaacagtaacaaaacatcaaaatgatagaagtatacctgcttctactaaattcctgatgggaacttctcaagaacaagcaatttgtttcctgctacagaaggggaggggtgtttggtttttaagatcatagggggttcttctttacagaatttcatatttggctaatatgaatatgaaggcataaacagcaacagagaacaatcctgcaacagcagtgagtacaccacgggtaatgttgatactccaaa

SEQ ID NO: 651 - DNA, 625 bp, Rattus norvegicus
  Genbank Accession No. AI012637
aaaacacatcagaattttattgcttgaagaatacagcatatgaaatcacaagaacatcaaaattaaaagtcactaggcttccaacatataatacattatcagatgcagcaaaatattaattaacctgaagtctgcatcggaaaaaaaaaggtatggaaaattatccaaattgtttacttgagaaacgtatacttaaaacaaaacaaaagactgttacagtacaaattagaaaagccaaaagcgactagctcatttccaaagactaaaccaccggcctttggtgctcaacctttctgaaggaaacggttccttctatgttttccaaacacaccatgggcagacccatgaaatgccttgaaataacttcaacataaaacattcagcaaaattactaccctttttgctaccctttttgttatagggggaagaatatctgataaatgcataataatatgcatataaatttcccttctaaaactgaaaaatatgaatattaagaaatctaatacttataaacatttcttagctctcgaaattgaaatcctagcagctagaatctcctctggggcttggtgaatacagatatttaaatggcttggcaactgacatgggaacttaatgactt

SEQ ID NO: 652 - DNA, 422 bp, Rattus norvegicus
  Genbank Accession No. AI012638
aggttatacccaatgcagaatgtttaatgacgcaactgagtcacagctctgaagtcatagaccagcattataactcaaagtcaaatatgtactcgttggccaaatatatccgtcggaagatgagagctgccagtgccaaagtcaggatgatgatcagcatggctgacccgccgtgctccgtgtggttggctcttggtggctggccttggagtacatcgggggaagcagacgaccttctctgactctgttgctgggctctacgttgccgagggctcatggaggtattcttaggaactggctgggtaggtaaatcgtcttgtgaatcatttagtgagaaagactgggttaagtctgattcagcgatagtctttccaaatgaattgacttcggccttaaaactaatttgtctaaccagttctttg

SEQ ID NO: 653 - DNA, 491 bp, Rattus norvegicus
  Genbank Accession No. AI012647
aacaattaagtcaatttatttaaacagttgacttaggcatctgcaatggtgacttcaacctccactccaggctcaatactgatggaagtaatctgcttaacaatctctgaaggactgtgtaagtcaatgagtcgcttgtggattctcatctggaaacgatcccacgtcttggaaccttcaccgcaaggggtttttctggtagtgattctcagtgtcttggtaggcatgcgcactggtcctttcactttcagattcttctcctttgcgcctctgatcaagtccgcacaaaccttttccagcgacttcacgttgcggctggtgagcgtgattcgaatccggtgaatcgccacttcgggctccacgggagtcttcccggtatctttaaatgccatggctgaggcgtagcttcctgaccgacttgttcctcagcaggagcgaacagcggtgagtcaggacagagcagacttgacaaggctccacagcacgcacca

SEQ ID NO: 654 - DNA, 516 bp, Rattus norvegicus
  Genbank Accession No. AI012958
cagaattgggaacattttatttggaaagatttttttaaacatgatttatcttcatttttccattaaggcaacaataatatccttacttcgtggaggcagatgggcaaacatcatctgaggctacatgatgttcagactaaagtcacagccaaacactttgcattcggatgcagcgggaatactggttgggagctggaaagagccatctattggtttcctgagcccactgtcaggggatgaagttgagatcctgcatttccactgctttggaagacaacgaagttccattagtgggagtaagactttcactaatgcaaagggagtctacctttggttcacaatgctctgtggagttttagcttttggtaagttttcgtggaaattgcttatctagtgggagctattcaaattcatgctgtcccttttcggttttgaattccaggcagttcctagtcaacatggtactcttggcatccagctacatatgcgtatgtgcccgtgcaagcatttgggtga

SEQ ID NO: 655 - DNA, 615 bp, Rattus norvegicus
  Genbank Accession No. AI013011
gattttaggacgtttattgttacatttatttaatttttttgcagtaatagatgaggcacaaatacctcctgcctctccaacactgcaacaaaaaggacaatagtcaagggtaacagtgaaattaaaattaaaagtaaaccaaagcctaaggcctgggagaaaacctggctacaatctagtgtagaaacttgtaaaggactccagcctcgtcttccgactgcaccacttcacagatcacagggtagggtcacagagtagggcgtcctgacaggacacagccaggctcagctcgccaggatgggggcctctgcccatccacctgtgttctgctcagctagctcaaggtcacatcttgctactcacatgctgccggctttcaaagctacatcatctggtcaggctgtcagagggacagcgctctccctggcaaccccacactctcctcggtcacagtggcccccagcagcagctgggaacaggttgtgtgtttggcgtctcagcactgacagatacatggggcacctggcaagggatgctcactgtgtgtggacctgaaacccccaaggaaccctgaaaggttgctggtccctggtactaacctggcctcatcccctc

SEQ ID NO: 656 - DNA, 368 bp, Rattus norvegicus
  Genbank Accession No. AI013260
ggcattccaatacactttaatcgaaaagactttggcatggcggcgggagagctgccctaggctgccagggctacccttgtgggctgggcctcagcggcggctgccactcacacggtggtgatggcgcagctcatctccatcctcttcctcatcgtcattgtcctcaaccatggtcagtgagcgcaccagcttgcacatggccacttcttctccagtggcgttgctgagagccgtgcgaaggctgcgcccacagccccaagtgttctgtgccttccacaccaagtcagtaagggggctatgggtgaccccatctcctgaatcccagatcgtcaccacctgcccggcctttagggtgaacttcggtggga

SEQ ID NO: 657 - DNA, 469 bp, Rattus norvegicus
  Genbank Accession No. AI013273
acaaaatacaaaaaaaaaaaaaagccaatccaaagagtacagaccagtagtgacaggcacgtggctcgacagcaaattgtgtccagcgagacgttagttttccaactttattttagtgaacacatgcagtatataaaacagcgatagcaacagcaacggaaacaacacacgaagaggctacggctttcgggtggaagtgagagaaaaggaattaaaaaggcaaatgatactgttttccataaaaacataaaaactactataaaatgtctttttcccccctcctatcacactgattaaacctctcccggaacgtcacacatatacacaagaacggaacaaaaatgctgaacccgacagacagcaaatactcgagagggttgttaacctaggtaactgatcagtagtttaaagaaatcttctagacgtcctgaaacccgcctcttcgttcttccgtacagcatcccagcca

SEQ ID NO: 658 - DNA, 476 bp, Rattus norvegicus
  Genbank Accession No. AI013387
cacagccaaagaaatttattttaaaatagaaacaaacatacattaagctttaaacaatcaaattttaaacaaaagggaaaaagagccatttgatcccagagttggtacagaatgacttttgtgtgtgtgaaatccacgtaaggagcacgtggacaagctgacatggaaatccatcatgcgtgctcaggtgtccactggctgccatcagacactcatacactaagagctacccttgactgactgcccactggcaccattcccaagacccaagttcatgtggggtatatggtcaagtgctacggttccttctgaacacgagaagagagggtgctcaacagggtcttctttccccgctgattccgccaagcccgttcccttggctgtggtttcgctggatagtaggtagggacagtgggaatctcgttcatccattcatgcgcgtcactaattagatgacgaggcatttgcctcgtgcc

SEQ ID NO: 659 - DNA, 445 bp, Rattus norvegicus
  Genbank Accession No. AI013437
gcaggtaaaaattatacttttatttgagtcaccaggataaagattcactttgtggttcaagtcaatgttcaaaaatcataacaggccagaaagaattgatcccaagcacaaggccaggagggaggggaccaaacagaccaaagaaagatgacaatccgatataaaagatgagtggtggcttcacacgcgcacacacacacacacacacacacacacacacacacacacacacacacggatgaaatgttagacagaggtggacttcacagggtcacttctgtttctgtttaaatacaggctctgtggggtggttctttttgtcttgtgtccagctattaggaaatgaaatgttccctggagggacatgatgaggggacaggaagcagcatgggaagaactcatgctcctcaccacggcgcttcttgcgctacaggattggtccaca

SEQ ID NO: 660 - DNA, 693 bp, Rattus norvegicus
  Genbank Accession No. AI013508
ggagagcaggagaaatgtttttatttgaagagcagtgtggacatgaaagacagaaagcaaggaaggggttccaagggaccagcacctttctcagcaacccctccagggggctgcctagagatgggctggcaggcccaggcccaggcccaaacaaggcctggcaatcccttgggagagggtgcctgggaaggagggaggcaggaggcctggggttcccacggagagaatgcaagaagccgcctggtctcaccgatccatgctgtcatccgtagggctggagaaacaggtctgtaacagcttttcacagaactccagctcctcctggtactcctcatgctgctgcagcagctggcagcgatgacggagcagttcctccaggcccagctcaggctcccggcattctcgaacaccctgagggaagtctgtcacaaggctgcacagggctccaagcacatgctcatggaaaggactgtgttctgtcctcacaagggccaccagctgctggaccatccccatggagcaaagggttcctttgtgctcagggtggcccaccagcaggttctgcagcaggaatgctgacttgaccttgagcttctgcacttgctgctgcatggcccgcatcagcactgagaatccatccaggcggaggaactgcagcaatccagcctcctgctctcggacaagacaggagat

SEQ ID NO: 661 - DNA, 507 bp, Rattus norvegicus
  Genbank Accession No. AI013568
gacatatcataaaatgtatttaatagaagtcacacagtaagaatatggaagcagttcagatataggtttgtatcttagaaaacaataggcagaagaaataggaattccacccctgaatgaagacagtagtacccagcagtgcatgtttgacagtggcggatgaattaatactccaccaccatctcccccacatgttcttaggccacaatatggtgtttacctaattctttattagaaaaacgacatttttgaatactcagttcataatacccataggcacagttgaattctgttagctcaaatgaccggccactgccagctctgtgaaatttctatgtgtccaaaactgcacgtggtcccagacctacagtgattcactttccacgggctcaactttacaatcgggtgcaaaaatggcatgtattcagtagagactgcttttgaactgggagcttttcctgggttcacaatgtgtgacaccatcctttggagacacgggacagtggc

SEQ ID NO: 662 - DNA, 569 bp, Rattus norvegicus
  Genbank Accession No. AI013647
aaaagtaacaaactatttactgttttataatgttaagtgattcaccacgacaagctgcagtcaaattaaagtgagttatggaaaatgaaatacataaagatgtatttatacaagtgcagactaaatattttccatacaggtatgtaaataaggagatatacagtaagtgcacactcgatatgactatgcaggcaacacatagttagttccagatactcttggacagtccatgcaccatcttcccaaagtacaggtttagtcattcttttaagggctttggaggggtgattaaaaagggactgagttccttgcaagaatatcagtatgaactagatgagggtgagggtggtcagttatatatattacttactgtaatttgtgattgtcgaggaagaggtgtggctgttggtgtgatagtaatactgctggtgactttattggttgttttgtttagtgccccattagttaagccttgagttctgttatcctgcagtgaagggctggcaggtctcacggggccagccacagcttgcatgtaaggacttcctaagtgaaagtggattttatta

SEQ ID NO: 663 - DNA, 366 bp, Rattus norvegicus
  Genbank Accession No. AI013676
gcggccgcatatgatttttttttttttgcagtaactgttagtttttaagtctcgtagcaggttcactagaacataacactacgagacttaaaaactaacagttactgcaaaaaataaaagctacttcaaagcaagcaaagtcagtaccatgtacagatattaaaaaagaaaaaaaaaagggaggaacaagcaaggctagggtttgataacgccatcttgtgatccattcgtgtgcattcttcactgcgtgagtcactccccaaatccatttgtatggttactcctcgaccaaaaaggaccagaacaaaaagtttacttcgactgttcccataggaaactcagcttggatagtgtgtcaggcaattt

SEQ ID NO: 664 - DNA, 386 bp, Rattus norvegicus
  Genbank Accession No. AI013715
acagggacttctgcttggttttccttcagcacagacgtaagcgcccaccctggttatgcccttcctcctgctgcagccgaaggaggtgcttgtaattacccctcaaaggttccgagcgccagggaccaacatggccaacggattctttcttggaagacatttttcctgctagtcgtttccagaggcagtgtgtaggatctcaagcggaatgtgccggaatgaaagtgtgctgcttatcaaccacggtgtgctcaggtttctaatgccttgcacgcttccagctggggaggtgaggggaaggctcaggagaggtgcttggtctgttggctcctcgccaaggtgggcagtgagagacctaggtggtgagacattggggatctggaaaa

SEQ ID NO: 665 - DNA, 443 bp, Rattus norvegicus
  Genbank Accession No. AI013730
  misc_feature (1)..(443): n = a or c or g or t
actaaaacacaacaggtttattgcacccttttgctatttcccaaacaagagaataacaccttttcaaccgtaagcctctctgcccatgctaaaaccatttgttaagtgttcaggatcgttacgacatattattcttttgtatacactgtgcaaatgcagggaaagaaatcagccgcccacccccccaaccagaagcacaaacgttgtgctacaatacaaaagagcagataccactgtaggagagtcttccagaaattagctgagtgccaagaagcccctggacttgggtttaataaagcagttgccaagggacactctcagcagagaaaatgctcagtgccccggaagctaagctcccaaccgtcacagtgttgtaggctggccagcacttctggatcgcatgtancagtcggtacagtttagaagaccgttgcgaatcctga

SEQ ID NO: 666 - DNA, 446 bp, Rattus norvegicus
  Genbank Accession No. AI013738
cagtctgcaggagaccatatcccacccatacatacccatgcacacaataatggcattcacccaactctacctgacaaacatcttttgaatcacagggacaaagtcatacttggtcattcccacactgctggtgacaccagttacatttggtctttttcagaaataagacagttgatgtcccaagaaagctaagcccttaactagagaggttaagaaccctggaaccagcaggcacaacttgaaatatttgccaactccttcattaaaaggttattcttaagactatcttcccatgggttgagctaaaaccactgaagatggtctttctgtactttgcagaggacagaggcacactcctttatggaggcggtgtgtaagctcatgagtgtagacccattgagcctggctgattctgccgtcctctatcacagagaaggaaggcagaa

SEQ ID NO: 667 - DNA, 539 bp, Rattus norvegicus
  Genbank Accession No. AI013740
taagcctgcggccgcatgtgtttttttttttttttttttagactttgacaatactttttattgtttatttagcccttcacagctcaccccacacagagaaaggttcttatttgtagtgggtagctcattttgtagcttatgtggggaatatggttcaagcagaactcatgtctggctgctggtactgcagagcaaaggggaatctaggcacacccataaagtgggttgattggcaggctggaagacaaagctcccaaaaaaggcactttaacagggatgtagctcagtagagagtgcttgcccaggaggcacacagctctaggttcaatctcttgtaccataagcagtttccatggggtcagagaatggctggagagttgtggaaaccagaggaggtattgttttggagacaggacctcactgtgtagccctggcctcaaactcagagatccacctgcctctgcctcctgagtgcttggattaaaggcatgcaccaccaccgccgcctgacaggaggaagtttctgatggaggagctat

SEQ ID NO: 668 - DNA, 498 bp, Rattus norvegicus
  Genbank Accession No. AI013765
ccctatgctcaaaaacgaagatatggccttgctggtccctcccctgaaatctcatcttcaaggattgggaggcagaagtggtgactgggggtgggttggtatgaggccaaacatgggtgtcctttctactccttttctctacattcactccttgctttcagtgttcccttcccaaaactttaggtgtgtacacagcttgccaccctagggagcagggctggggtggcagagctgaagtcaaaagattaatgcccactttcaacgagtgatgggtccagtgtgtatctcgggtggacggacggggaaggaggaaaggctgggaccctcctacccgcaagggcattgggacctcagtcctgcccacccctacctctcccagcccctcttcctaacagaactggtcatcacagtcgtcatccttcatccccttcagcctaagcctcgcaaagtcctcaaacacgatgtcgtcgtctgtggcatagttggtatcgaattcaa

SEQ ID NO: 669 - DNA, 555 bp, Rattus norvegicus
  Genbank Accession No. AI013804
ccaacacaaaattgtaatttattcttgtcattattaggaggtcaaaaaaaatgtacagttacgaggatcgttttttcccaaacagaggttaaatatgagctgaaagtgtaaaaaggaagaggaatgtcactttacaaattattaaattaaaccaaccaaccaacgaaaccaaagaaccaaccccgccatgctgagttctctccttgtacaactctgtgaaatgagaacagaaaatgagatagaccgtggaggtggggaccctgggtagaggcaggacctggggccagggacagtgagggtggggactgctgggatgtcatggaccctggtcctcccacttagacctggttgtacctggtggccctatcaaggctggggaaaaggaggctcctgctggcctgcgtattcagcctctccactgggagacagagacactttacaggacatggggacaaccaccggtggccaggctggtgcccgccccgagagccagcctccactcttttgcgtctgaatttgcccccacatggaccctgcatctctttctgtctttcc

SEQ ID NO: 670 - DNA, 395 bp, Rattus norvegicus
  Genbank Accession No. AI013829
gcctgagtactgagcagagaggtggaagccagtccaagaagctctagagaacacaatcctgtcccctctgtccctgtagtctcctcccacagtctctccagcctccttggctgagcccaggcatctgcaggtgaatctcttctgcagtcaacgttgggactggaaggaactggattcacagctggagagtttgtgaagtcaaacccgggggctcgtaatcccaagagggcgaggagaggccaaaggctcaggatactgcagaggccacacccaaccggttcctcctctctgcagcacacagggaaacacatccacatcgaggggccttcaggcctgcctgtccttccaggaaggcttcagttctggagttcatgcctgaatcaggtccggggcca

SEQ ID NO: 671 - DNA, 568 bp, Rattus norvegicus
  Genbank Accession No. AI013861
  misc_feature (1)..(568): n = a or c or g or t
atcaggatagaaatttatttaaatccaaaataatatgactatagttagaataatataataattatctaaaggaaatatcatcattggctctgaaacagtctaacggtgtcatttttctggagtcaaaaacatgtagtaaaaggatatacaggaagcaaaaatacagaagcaagccggctgagtgaggaagctgtaacaggagggtacactaagatactgtaacaatcgagacaggaagacaagtatagcaagctgtcttacctatcaacccctgcacagtaagtcagtaacccagaatgaaggaataatagcacgtggttaacaggacaaatttccctctaatttgtctttgtaactgatttctttccttttttaccatgggttccatctggttaacaaaacatttggttttatttgtaaagcagagtaaataaaatatcctgatcagagtgctcaattttgtttaaggtgctcaaggttcanacttaaaaaggtcaactgggctagtcagtgggaaccattgggtgtgtttgctaaacagatgaaagcagcagcatttaaaatggat

SEQ ID NO: 672 - DNA, 492 bp, Rattus norvegicus
  Genbank Accession No. AI013875
catgtgttttttttttttttttttcatacgtcggaagcgggagagatcagactaaagatgggtgggtatacctggtatttggatgagatgctctgtgggaggctcgcaggggattcgagggtggcttttataaaatggttttattttctagctgtatttaaaggggtgtttaacattacctacttcattaaaaaacaaaaacgcccctcaggaaatttagatacaattgcgctagtcatggttggcatctatgagagagagcaactgcattctgaatgagtaaaacggacgtgtgcattgtaatttacttttcctatgtccccttcgagaggggcaaagtaaaacaaagaaagcagtgcagttggctgaggagactgagcttgcaaagcaataggtctttctgtccaggcagctcctaccccttcagttccattccattttcccttgggactaaaagctctgctctgtctcatttaaagtcttgtcttccgg

SEQ ID NO: 673 - DNA, 652 bp, Rattus norvegicus
  Genbank Accession No. AI013882
aaataaacctgttcaggggaacagctactagatgaatttaagggttttatgcaccttatagaacttatagcaaaaatagttttagttgatttcattataaataacgttttcaagaacctgtgcaaaactgtcaataatttcctaaagcacaattgatcagaaaaatccatgattgttcagccttcacacccttcttcatgtaagaactcccttcggtacatctcacagttacttattgggtggaaaggtatatggagaatggtcattagacgtctccacagtcacctgctgctggccacttgcttcctcaacgggaaccgtcgcagtctgcatgtgtgtgtactgtggtaagtaggctccttgcatggctgacgttgcaggcatgtatgttccggtgctgcctagtgacaggtgactcatctgctgggccagagggctgatcatagaagcaggttgtagtgacatggtgtgttccatggagggagttaacacggcaccaggatgctgcagaatgtatggttgaggctgcatccaggaaggactctgcaccttgagagcagggccccgatactttttctctctggtttcctttgccacctggtaggcagatacaggagatgcaatataaggtgtaagagaagtttgagtgatc

SEQ ID NO: 674 - DNA, 484 bp, Rattus norvegicus
  Genbank Accession No. AI013886
tttttatttttttattttttttttttcttataaggacatttaattggggctggcttacaggttcagagtttcagtccattatcatcaaggcaggagcatgacagtgtctaggcaggcatggtgcaggagctgagagctctacatcttcatctgaaggccaccaagtaaaagactggctcccaagcccatgcccacagtgacatactactccaactctgtcaaggccatacctactccaacaaggccacacctcctaatagtgccactccctaggccaggtgtattcaaaccaccacagggtacctagagaacaaccctagaactgcactctgagagggttccaggcttttcagactaggagctctacagaggactgaaggcgcagaactgactgggcttgggggaagaacatggagtcaccattttaaaacttgtatgaaagaaaagaggtgagcaatatggtcctcgtgccgaattcttggcc

SEQ ID NO: 675 - DNA, 694 bp, Rattus norvegicus
  Genbank Accession No. AI013911
ataatcaggacagtgatctttaataaaaaacatctctagtaatcatgatcttgatgtagattgttcataggtacattcagaaatcactttctggccatgagaaaacatcatttacaaatttttaatgtcccaaaatacacattaatttaaaaaacttgatttatcctggccacttttttctcttggccagcaacaataatcctgagtgcctcaacaaaaattctgataaaaggaaaaatattgggaccgttaacaaatgtcttaaaatttgtctttaaaagggggaaaagtgtttaaagaacacatggagctttcttaaagttctttaacaaactaccttgggagctcaattcaaaaatagaacttgatgtactaaaacagacgtttcagcgcagctccaaaaatctttataaatacagcaatttgcaaggacgatcctggatcagaagtgttattccttgtgtatattgtgtgcatgccccatctcagttgtcataattgtctctgtaatttcctcctgagtagcggtcatagccaccctggcttctgccactgtagtctctagaccgcccatacccatatccatagcctccaggtcggctgtcgtatcttccacttccatatccctggtctccaccacctctagagtagctgcgaccacgcccatgggccccaaaagcaccccctctgggtt

SEQ ID NO: 676 - DNA, 455 bp, Rattus norvegicus
  Genbank Accession No. AI013971
ggagatgtttgatcagatgtaataacactgattccaggccaggacagagggtattgcccctgaagcaaccagtattctgtggcccaaggtgcccctccgttcccagacctgagttccccgtcggttagttaaatagagggagatcttcccagggagtcttgggaggagggtccgagtcctgtacccgcctcgtccacgcagaggtgtctgagcacaagctatttacagtattcacatccactgtaccccaccaaaccaaggcaaatactacaagtggtccttccccgtggggggaggccagagaggctatgagtgtatgtgtgtacggggaaggtgggtgtccgagcgtgtgagcacatgaacgtgctgagggacaggacctgctttcagccaaagacatcatcagtctgtaaggtgcagattgaaaacaaagaggagctctgcctccgggagcc

SEQ ID NO: 677 - DNA, 433 bp, Rattus norvegicus
  Genbank Accession No. AI014023
cttagtccatcctttgttaaaacacaagatcacagccccgcagcaagtgtggcagctgcccagtgtgcatcacttagagggccgtgtgatgatgcgtgtggagaagtcaaacaggtcccggttgatcttgcgcaggctacgaacttcctcttccagctcaaacacacgcacgggcagcatctggctgcctagcatgttcttctccagatagccagacaatgcggcctgcagctgctccaggcgctccaggtagctaggttctttgccctgcaggtggagccccagctgcaggcgcaggcccccaccctgagcttcgtctccgtgctcagcacccagcaggtgcttgttgaagtggggcaggggcaggctgggcctgaactcaggggtcagcatgctgggcggggccagtgtgatggctgcattggtcactggg

SEQ ID NO: 678 - DNA, 410 bp, Rattus norvegicus
  Genbank Accession No. AI014135
agaacaacaaatcaaaatgtaaacttaaaatataaccaaaagagggacagctctttaggaaaaggaaaaaaccttaaatagtgaataaacaactacaaccacttaaccattgtaggcttaaaagcagccatcaataaagaaagcgttcaagctcaacatacatacttacacacactaattccacaaacctcaataaattcctatattacaaattgggctaatctatagacccatagatgaaatactgttaatatgagtaacaagaaccaattctcctagcacaagtgtatgacaacccggataaccattgtcaattatcgaatcataggtactaacccaacaataaaattacctatccctaactcgttagcccaacacaggcgtgctttaaggaaagattaacaaaaaaa

SEQ ID NO: 679 - DNA, 542 bp, Rattus norvegicus
  Genbank Accession No. AI014140
caaatgcagcatattttaatttgtttcaaataaagcaatatatgtttatatatatatttatataatatttcagaaaaacaccagatgttaaattctacaaaagcacatgtgtcttcagcagatcacgtttgtctgatcaagaatttcttgtttcaacattaactctctaaagacaaccaatgggtcgacatcacagctacaacgtaggttgctaactgagcctctgatcttcagccacatctcgattttcctaacaatgggtaaatactggctggctaacatgatgcaaagtcttgatgaggagaagcgacaacagatcaagcaaagccatgggagttatgaagcaagctagagcagagtactaggattagtaaaaatgattgcgagagaacgacacaaacatacaggtttgtatattctgattgactctcttttggcagcgaattgggtcagcaccttgggcagggaaccaaaaccaggcaaaacctgctctcttccttcccagctcaggccaccagcgtcacagctgggactgagagaac

SEQ ID NO: 680 - DNA, 508 bp, Rattus norvegicus
  Genbank Accession No. AI014169
gccattaaaaaactttattttgatttttttttttttacaaaggatagccccactttggggtgaaaatatatttggttaagtacaaaatatagtttttaatcatacaaaaagatacacaaaatacaaaaacaacaaagacgacacctccatcagctcacactttctggctgcacagttctcgggtggagtgcttagagtggagcttggagctctgacacaggacacggaacaaagtgctaaggcggagtaagttttggagtgctagaggccacggcgagagcagaactttctcctaacactggacaggaaatgggtctgggagcttccatggaaacctgcagttctcactgtgcctccatcactgttagggcatctcaatgtaagagtgtcaccagggtccagctgtcagcagcaacccttcatatgagtagtgtcagaatcacagaagtctgtgtgttgggggaaagcctccaaaagtaataaccaagctgggcctttaacctcagca

SEQ ID NO: 681 - DNA, 294 bp, Rattus norvegicus
  Genbank Accession No. AI028831
tttttttttttttttttagcaagtgttctgtttaataatccttggtcgtatgtagtgtcctttgggtgcctccctaattagttccacccattggggttcgtcctgggccctgcagtttgctcctaagttctgggacgggtgcgtcaaaagctgcttgtgtctcctctgttcatccatccatgtctgtgtcccttgatgtcatcactcagcatcccggggtccacaggtgaccgacgtggctcctgctcgctgtgccaagatggctctccaaattctgcataccatccctccccc

SEQ ID NO: 682 - DNA, 505 bp, Rattus norvegicus
  Genbank Accession No. AI028856
  misc_feature (1)..(505): n = a or c or g or t
tttttttttttttttttacagcggctacgtatttgaaaatttaagtagtcaagtcaataactgtccttcctagttatatttaaagactaactaaaatagaatctttgtgcttatatttcaaaggcttggttagtatattagaaatctaccaaaacttaaagatcaaagtttttgcttaaacactgcgccctgtctgatcacctcctcctatgactgaccgcgtacagttcctcagattccactgaagagcatctttcctctctgaagtgatccttttctacagtgataaatgaaacttcctcccaagccttttaacatggccctcagcattccacaatcaaggaactccaggcacttacactggactaaaattatatatagtttttctgtgaatttctgagaatgaaataagcagttgacgacttaggattaaaatgaataatatttgaactactctatcanaatgtatcacaataaatatatttgttctagaaaagtctgcttc

SEQ ID NO: 683 - DNA, 425 bp, Rattus norvegicus
  Genbank Accession No. AI028953
tttttttttttttttttgatatcacaaaagtttatttagcaaaaagtttcatatgaaaatgtacatgacctagttctacatcacaatcaagcacgctttggggagggatgtggacacactgctgaacactggttagactctttccaaggcttctaacatgatgatgctgtttcctcggatgaccaccatcccgatgttgttctgttgcccactggtcgccatctccacacactcatcaatcacgaggttcataaaggggtcaaagccccgcagtattccttgtacatgcctgccgccatttaacttcaatgataacttcttgtccataaactttttcagttcgggagggtgggctttgctcatggcgactcttcagtgagctcagcacaacggcgaaggagtgagcggccctcgtgccgaattct

SEQ ID NO: 684 - DNA, 478 bp, Rattus norvegicus
  Genbank Accession No. AI029015
tttttttttttttttttgcattctttttttcctaagattttttttttttaatttgagtttctgtagttttatctttttttggtatcgaagtcaggtttttctgggcagaaaaaaataaagaggaggaataaagaagcgaagataagtgtgaggaaaaagcaaccgaaataaaaataataagattaataattaagtactactaccacaggggaggaaatggagagaaagtgtctgtgggcttaacagctacccagaagtccattctactccagcaggaagaggtgatggtaaaccaaggtatacacggcaacgccatttctcaggagggaattgctgctgttggaaacagagcactcacactcgtacttagagaatacgaagaaattctgggacacagtttgttttttaaatggggagtctatagcattgacctgatctgaaatcctgaggagctgagtttctaaaggccacactcatt

SEQ ID NO: 685 - DNA, 329 bp, Rattus norvegicus
  Genbank Accession No. AI029058
tttttttttttttttttgggattttaccaattttatttctagatttttttgtcttttttttttttcctggaccatgctggtcacatgtctgtgctgggaagcgccatggtgtgtcaaccagaatacacaaaacaagacagaacactagaacctaacagattaaatgatgcaccagagactcagaacaaatctctccgggtccagcagcatggtggcatgcacaacaggccgctacaagtaacaatattgataactaacagaacacagttgccctgactgctgtgatgctatgtcccagatcaaatgaaggcccagcatgacaggatgat

SEQ ID NO: 686 - DNA, 377 bp, Rattus norvegicus
  Genbank Accession No. AI029126
  misc_feature (1)..(377): n = a or c or g or t
tttttttttttttttttaatgaggctgttttctgtgcttcaagcaattggtgggttatcaactggtgtgcaaaggtcccttgtctgtacacatagcaggattttcatacagcttccccaaggcctcgaggtatgcttggattgatggaagtattcgtgtctgtctgctcaccccaaccccatatacctcttgtctgcctttctactccatggagtcagcagtgctggttggagtctttggctggttggttggtttcatanatggtggtggttgctgcctcgtcagagatgagctgtgcgtgcctttgagctgcatggatccctggcccttctgcactgagacagctcctccagaggtctgggagtgacagcataaag

SEQ ID NO: 687 - DNA, 308 bp, Rattus norvegicus
  Genbank Accession No. AI029156
tttttttttttttttttagggacatcttttatttcattggttatttcaaagctgtctttaaaacgaagcacacagaggaagaaagcctggaagcggactggctgtgtgttcacaaggattcaaacaccacacggcatgtgctagtagggctgctctgagacagttaccaagaattggaatcacaaaatcaagtggttatcttaggaagttctagaaaaatagattttttttatattcaaatgcaagtttaaatattttcccttccacagggctctcctataccctatcaaatcatggtcaataataaa

SEQ ID NO: 688 - DNA, 229 bp, Rattus norvegicus
  Genbank Accession No. AI029185
ttttttttttaagattcaaaagttttatttggaaaaatcagcacagaacaaagatatcctcagtaacttttctcagaatatatgaatagtgagactctatgaaatgtgagcaacaactctaactttacacagggtctatggtttatacaatctcagcccccatgcctcccacccactgatacactacagcattgaccccttagtgacatcagctgtcactaacagtctg

SEQ ID NO: 689 - DNA, 454 bp, Rattus norvegicus
  Genbank Accession No. AI029264
tttttttttttttttttcggtagcacgggagtttattatcaagttgctgcctgagaagggatgcagggtggtgaaggcagaggagaactgagcaagtgctcttgtgagctgctgtggtgttgggtggggccaggccacagcgatggccctggtagtggggtagggtcttcttcctgcctgacgcttctttcaggcttcagaagggggactcccagagcaagaggaaagttggggctagatcacaactgcacccagcagtttcttctctgtttccgcctttgtgaagaatctcttccagaggtagacacatacagggatgagagaagccaggagcagcagcacccagacacccaagagcattgcctggaggcttatgagcagggtctttagcatgcttgtgtagtatttgcacagtcctatcctattagcttcttcgggaactggggtgatgctg

SEQ ID NO: 690 - DNA, 444 bp, Rattus norvegicus
  Genbank Accession No. AI029292
tttttttttttttttttgaagtaatggtctttattctgtgtggaaaagtacagtagttgtgcagaaacaaactacataaccaaagagtaagacgttcacaaatattaaagaaaacaataaataagccgtatagttaaagcggaactcagagagagcttagaacaacgacctagctttttgtacaaagcatacaacacacaggaacagacacactgaatgacgctgcaaggttcctttccatacaaaaccttaatgatgttcagaggagcatcgtggatactcatgtctaaaacattctgcaaatatagaacttccttctccccgatctagaaaatacatttcacatctcgacatataaaatactgcccccccacctctctcaaaccagcatttgaacatcttccaaataacaccattttcatataaaaatacctcaaaccaagg

SEQ ID NO: 691 - DNA, 457 bp, Rattus norvegicus
  Genbank Accession No. AI029428
tttttttttttttttttaaaaaacacaactgcagtttattccagccatgtttcccaggagcagagaaaagctacgctccccggggatagcctgtcggttgtatctactattttgcaagcctgaccttgcatttcgaacacctcaaacctcttgttctgtgcactaaggagaaaaagtatcaaatctatcccatatgtacaactctacagtcaccataacatcactgtcatcgagtaacacttgcccttcagggcaactaaaggtcggtcagctcatgttcctcacactcctcccccatttcctttaggaagtgaaaggctactacaggaaagcaaacattcaaaccatcaaaattcagacaagttatttcaagataataaaaaggggaaaacgtgactgttaggcctgcagagcacagaactgctggaacacagccaggatgtgaggatctaactct

SEQ ID NO: 692 - DNA, 459 bp, Rattus norvegicus
  Genbank Accession No. AI029437
tttttttttttttttttatggtcaaagccaggccatctttactggagtgagtgcaggagacaaatagcttacaacaacctctagcattgtcttaaccatttgataaaaacttcactataatatttattgtataatgaagaaaagacaacacattcagggaaaaattgagattaacttagttttcttaaaaggttcatctcaaggatggcaacaaagtccagcttgtgccgccaaacggttttacatgatcaaaccgtgtacagcttctttgtgtgaactgttgactacaaacatttaccaaatacataaatctctttttaaaaaagccattttaaatatagcaaagcagtgtcttcttgcacagcaaagtgaagaaagtttctacagagaaaataaaagttttacatctgtaaagttcttttcacattctaatcatctagcttttatgatccgatgcag

SEQ ID NO: 693 - DNA, 464 bp, Rattus norvegicus
  Genbank Accession No. AI029466
tttttttttttttttttaaaaatgacgtctttattaatccttcgggaacttcatacaacgtattttgatcttattcataaaacgaccccaagattttttttcctatacattggcctggttcaatgaatgcaactgagttggcgaggggagggtaaacgaaaggggaaaaaaaaattctcgcgtttcttttaacgatgttcattagcaagttaatattaggatgggttggtagttaatagcaagtaataataaagtgagcacggattaactagtcctacccgcctgcccactcagctacggcaatgcctggcaagtacctgtcattccgcaattccatctcatctgtgtgcgtcttgaggagggaattcacacgataattagtattattaattactaattaataattaattttacaaataagtcttttctagtaacggctggaacttcgatcctagaccttttgg

SEQ ID NO: 694 - DNA, 389 bp, Rattus norvegicus
  Genbank Accession No. AI029608
tttttttttttttttttcagttaccacagaattctttattaaaatgtgtcatcaataatgttagcatacatacaatatacacacatacatatgtacattctttgacacacctcacagattgccaacatcagtttagccaataaattaaaactaaaaacaagaggatgggggagggatactagaggcaaatttcattttttatctggtaagaaattgcaaatttctcagaactcccctgggggaaccctgaccagagaatctttgaaacaaaatacataaatccccaccctcccccaaaaaagattccaaaagatgcagttacaacagtgtgcttctcagagcaggggccttcactccacttcatactcttctggcttcaagacagtctg

SEQ ID NO: 695 - DNA, 212 bp, Rattus norvegicus
  Genbank Accession No. AI029793
  misc_feature (1)..(212): n = a or c or g or t
tttttttttttttttttacagatcaagaaaaataacagagagtcattttattggctgtccacaggaagttcatcacacaggaggcgaggactgccccatggtggcacaatacgacacccatctaagcattgacagaaggttaaaatgtctgtccggggcacgctggacctcacgtgccctctgtggcanggaatgcccatccaaatacagtt

SEQ ID NO: 696 - DNA, 323 bp, Rattus norvegicus
  Genbank Accession No. AI029829
tttttttttttttttttgttctcctaatagccagattcttttatttgatgatccatacattttaattcaaatagacaccacaaaacttaggcacagattaagcattttacaagcaatgcattatgccaattttctttgcaattgccaaagagtacaataagtgaactccttaaatgatatacttctgtacataaaatatccatgtattaatacaagtgtatggagcagagtttaaaggtaatcaaaccctaggattgaaataaataggatgtgtccatacagagcagcatatcccagaacactgtgcttggaagtggtcacgg

SEQ ID NO: 697 - DNA, 537 bp, Rattus norvegicus
  Genbank Accession No. AI029969
tttttttttttttttttccttttaaagatttttaataggtacttaaaaatggacagttcatatcacagttacggaactgtgatcctgttagctatgaggagtatgcatttttttccagtaaaacagtttcatgcttataaaagtcaccgaaggtcaagttgtggcaagagcacgtacaataggaccaatccaagtagcaaagagggggaggcagagaggttagaaagcagtcacaccgttgacacgaaaagaacaacgaatacacatttctgtattttgaaggcaattcacaatcatttccaggaattctgtgagaatttaaggccatttgttctaaagaaatgtagacatgacttcacaaaactgtagtttgtataaaaactgtacattgaaaactatttagaattgattgtgagcaggcagatcagggcggaggggtgggctatttcacacacaggcaggtcgggccacaggggtgagtttatttcacaaatgtgttgtgcgctgagtcacggggtcgtgtacgtggaactgagg

SEQ ID NO: 698 - DNA, 444 bp, Rattus norvegicus
  Genbank Accession No. AI030023
tttttttttttttttttacagtaaaagtaatgatttttaatgtaataaaaaaataaagaagacgtcccaggccggcctggactcaacgagacactgtctcaaagcaagcgaataaattgacgaactcgtttacatatagaatttaattttacagtgatccctttcttgggcccttcaacctcaattctatgcaaggtcaaggctctggctaccatgcagtgtccaccaggctccagaggtagtcgctgatgaacttctgtgagagctgcgcactgtccaagtggataggctgggccacgctggggccgtggtgaatgcccttgaccatcccgggctcgcactcataatcccactctattttactaatttggtggtagagctgcgccacatacactgcagaggggatggtgacagtgttgtcttcatccacgtctctctcctgtc

SEQ ID NO: 699 - DNA, 394 bp, Rattus norvegicus
  Genbank Accession No. AI030024
  misc_feature (1)..(394): n = a or c or g or t
tttttttttttttttttcaataaacaaaactttattttcctttaatacaaaaattaaatagcaagttttttaatacagtgataaattagaaatttacagtacagacatcaatgtagacacacttttgtacatccttaaaaagggggatatatttccttggaaattcagcaatttgttcagggcatggatagcaggggtttgccaggtacctctacactaagcatccgaatggccccaggttgcctccagggttctgcagttactgaaaggcatgaggatccacgtaaaaggcanagagcaactgggtaaactgctgcacaaaagacttctaactgtattttatcggcttgcagactgggattattattttagttcatccttcttatgaagagcc

SEQ ID NO: 700 - DNA, 322 bp, Rattus norvegicus
  Genbank Accession No. AI030091
tttttttttttttttttaagcttttttttttattaaaatactgtcatacccagtggaatgcttcggcaatcctggtacagagtggcgtgacaaaacagccatgtttgcaccttaaatattcatgataacttaaacacacagacacacgtcatggtctttggcagaaaacgttcacagcacaaaaaaaaaaaaaaaaaaaataccaaatattaatccaaaatatattaagttgttttttttctttcacgatattttttgtttttccctcctttttttttgttttttttttaaacttttatctttgtaaacaacgcacatgaac

SEQ ID NO: 701 - DNA, 489 bp, Rattus norvegicus
  Genbank Accession No. AI030134
tttttttttttttttttcgcttttctcttttggcagccaaagccagccttcgactttcttcccttaacttctccaggtctagctcctccagcagtatgctggcattcttatttgcttcagcagcctgcctgtctttggcttgtactattgattccatacaaagatgacacttcttcagcatctccttgtcagtgatggttgctatatacctcatgcattcagaatctgatggaaactgattgacctctttgactaagtagcgtaccaccttcacatgaccctttctaaatgcagccatgagcggagttatcttgcggttatctgctgcgtctacatctgcacctgcttgcaccaggagctgaaccacatctaggtgtccaccatttgctgctagccataacggagtgttcccctttttgttacgcacatcaatatgagctcccctgccaatgagaagttcacagaatttataatgccctttatctgcgg

SEQ ID NO: 702 - DNA, 420 bp, Rattus norvegicus
  Genbank Accession No. AI030163
tttttttttttttttttagagaaactctggagatttattgaacaatcacagtcacaactgaacatggtaagtcatcttttacagagctcactcttccaggagaggtgggtggtcttgggcttcccccacagaaccctgtctcagtgcccagcttccctgcctgcagccccccccaccccaggggaccccagccttcccgtcagagcagagtggaacctgttaagatctcgaaacagctattactctcacccagcagggccctgattcagcatcaaaaccttaaaccaaaatatgactaggatttgtcgtagaaagcaccagcagcaagtgttgaccggatgcagggtggaactgcactccttgtccctttcccactgcctgtcttcagttaaacacgccaccacttcttggctacacgca

SEQ ID NO: 703 - DNA, 351 bp, Rattus norvegicus
  Genbank Accession No. AI030179
tttttttttttttttttgcatcaccatgatttattagacaggaatcagcttttcaacacatcatgctcaccatgccccaccccacagaaaggcttcaggagtcaggggaggaagggatgggttgcccacacaggtcccaaccgaagatctgagcaaccagcacacctaatgcccaggaatctgagcttgagtgtattctgccactccccaaacgatccctacaggggaagaccaaacaaatagtcgatagataatcaaggctggctttccttcccctgggaactcggacagcctcggactagacaacatggattgtgccttaggtagccctggcgactcaggcaagaatgg

SEQ ID NO: 704 - DNA, 394 bp, Rattus norvegicus
  Genbank Accession No. AI030449
tttttttttttttttttacaataaaaataaatctttaaatgttttccagcttatttccctgttcctccgccttccccatgaggtactacttactatgcaagtcagtcaggtctgaaattctgaaattaaagttcaacatggtaaagacaaggaaggcgctctaccctcttgacctccagagactccacagagatagcaacagtaaaggcagcagagactgcctgggtcagactgtaagcagggagaagttgggaggaacagaaaggcagtaagaatgataggaaagaccactgatagactgcaccctgacttcttggagaggtcatggcctcacagttccaccagactgggaggcctggaacggcgagctcatctttttccagtcactagaaga

SEQ ID NO: 705 - DNA, 255 bp, Rattus norvegicus
  Genbank Accession No. AI030472
tttttttttttttttttaacttacaaataagtgtttattagcccaagttgccttcctttttgttggattcataggcatcacagacgacctaaggcatgacacactacatgtttgttgttttgtcaagaggccctgccaactgtcagtgctgggctacatgaaggaccctggtcaagtggcaagattctaatcacgtggtttttttttttttttcaagtacctgccaagttgctgtgcaacccaagatcacaaagt

SEQ ID NO: 706 - DNA, 447 bp, Rattus norvegicus
  Genbank Accession No. AI030668
tttttttttttttttttaagactgtgtcatatttttattttaagctataaaaacaaaattaggcaaacaaaacaacagaaaaactcaaaataggttcaaatgatgtatattcatcttttccaggaaagcagaaggtaggccctaccacaaagaaaagatgtcattaatggaggttaactttcaacgtacattaaatactatcaattaacgtctgaagagaacctagggtttgttcaccttgctataagcatgagttgacttttgttatgtcattgaaaacataaaaatgccttaaaaatctcagctattaagtatgatcttactggaaattcttaaccacaattttccttcctggaatgatgtcgtgcctgtgcatccctctaaacataacggaaagcacagctaatgcaggcgggcttcaacctgttctaccagctgaaacagctt

SEQ ID NO: 707 - DNA, 315 bp, Rattus norvegicus
  Genbank Accession No. AI030704
tttttttttttttttttacaaactggggactgtttatttattttagtgagacgcccatatacaaagaaggcacaggatggaggaagcttttatagtaccatggggtggaggggacagagctggggagtgggcctgcctgtgggcagggatggggagaggtcctgagagattggcctccactgctggaatggggatgcatttcttgccaactctctctgtagccacaattttagagagccactcataaaacccattccggggacctgttttctagttcactgctcttgggtctgagcacacaggtcataagaacat

SEQ ID NO: 708 - DNA, 424 bp, Rattus norvegicus
  Genbank Accession No. AI030743
tttttttttttttttttcggagctgggttcagggggaaattttggaggtgcagtccttaatgccccttccagaggtaaacttctgaacgaagtgtgaggcagccccagcagagaacgaacatgcacacaccatacttcaacgtcctgccagcccacaggagtctggctgtcactcagcaccatttatgacctgtcagtggttgtgacagtttgacccagtgatggtcacggcttcagcttgggaagcacaattacaaaggacagtgctgtcactgctacaccacttgtagctgtgactaggggaagccctcagaaggggcctgtagcctcccacaccatgcaactatagtacagggtctactacccatagctctcaggggcccttcaccgggactccaatgttgtccgcatggattggctgtgc

SEQ ID NO: 709 - DNA, 461 bp, Rattus norvegicus
  Genbank Accession No. AI030773
tttttttttttttttgtaaatgaaaccgtgacttttctatatgatttttttttaaaccataattaaaattgagaccaaggtggacatggatgtatttgtagtgctgactcttgaggaggcggaggcaggagactgacttaagcgcaggagctcaaggccaaccggaataacagcaagatcagatctcaagaataaattaagaataaaaataatggctccctttgtgtgtccatgaggtttatgcatatactaacttgaacttgttctgtaattctgcatacctaggcttcaataaatccactgatttcatgcccaaggacaggtttctcctgaatctgactcactgatgtacttctccccatgtgaagaagaacctgaaactcttctgagaagctccccgagccatgtgcaggaacccatgttggggacttggatgcagaaagaatagaaaatccatgtcc

SEQ ID NO: 710 - DNA, 431 bp, Rattus norvegicus
  Genbank Accession No. AI030806
tttttttttttttttttaagaaggaagtgtttattttgtgcatgattccagagagataacattctacaatgggaagcatagtagcaagcatcaggcatgatggattgaacagaaaactgagagcttacatcttcaaacacaagtaggaagtagaaagggtggaaaagatatttgatgatgctatgcattgccgaagacagctcacagtgatacattccttccagcaaggctgtacctcttaagcccgccaaacaacaccaactggtgatcaagtgttcaaacatatctagggacagataaccacaatgttatctcacctgagaaagtaggcttcccactcttagcagaggctggatccaagcatactgctgtatccttgccaagaaaatttacccagtattgtacacaaaattcataattacctttcctga

SEQ ID NO: 711 - DNA, 451 bp, Rattus norvegicus
  Genbank Accession No. AI030932
tttttttttttttttgtattcaaactagctgcttttctaatctaatcaggttaatttcaatacaaaaaaataaaaaataaaaaataaaaggtgccacctggtcagcaacatcatacactggtgacaagagcaggtttactgagttgtgagctcagactgctggaccttcaggctggccttgtccacctcggtagactgaggataaaagggacctaccagccagttgagaggcgtgttgttaacaaggtaatccataacttcatctaaggactccttcattttctgcagctgccccttgctagaagtgaggacgccatcagacacttccttgaaggaggtaacattgcggaacgccgagtagatgtcacctgccatcacccccaagtgtttggcctggtcttgaatgttctgtggtaacccttggacgttgaacaggaacgtctggcatgta

SEQ ID NO: 712 - DNA, 299 bp, Rattus norvegicus
  Genbank Accession No. AI030991
tttttttttttttttttggcattaagaacaagattttatttttaattgtttcttttttggggagggagggtatattatggtaagtataatgcccatggaagtcagcagaactggcgttatgggcagttgtgagccattaacatgactgcgacaaactgaactttggtcctctgcaacgacacacgcacgcccactggacactgcagtccaaccaccacaagagagaagaattacagaatttctttttactcgttgttaccatctaaaccatttctctctttaaaacatacctcgtgccg

SEQ ID NO: 713 - DNA, 516 bp, Rattus norvegicus
  Genbank Accession No. AI031004
tttttttttttttttttaacagtcacaacaaattttattttgattagtttctctgactctaaaaatgtggggattaaaggcaaattttgtggggaaagggataaagacatttggaagaaaacacaaacgaaaacagatatatctgaaaagctcttttggcagatttcaagatgacaaaaaaaacccagaatttttgaacagccttattaaagtatacagaattaaaaacatttacagtattatttttagaaaccaatattttggaatgtacatagcaagttcattctgtgagaatttttttcgtaggagaacaacgatatcacatctgaacaccccactgtttgtatttacggtttcttaaattttgtaagaaaatagaaagtttacaattaactatacacttctaattgtgtaatatttactgttgatctttaaattactttgataaaaccaatgtgatagagatttttttaaaaaagattccaggatttttttaagatcgtgacaaaatttctt

SEQ ID NO: 714 - DNA, 488 bp, Rattus norvegicus
  Genbank Accession No. AI031012
tttttttttttttttttgggacaaagaccacaaagatttaatttaaaatcacagtgtctcaggcaggctgccctgctgtgagggcaacctcaaaccacatctcctccaggggttttctagcccagcagaggaagtgtagcagtcctcagtctggtctccacactcctggagaggaggtcaagtccttaggtgcctgctggggcaggagggtccgctggtgctgtggtggtctccttctgtaccagttctggctcatcctccccatcctgaggcgggtggaccaagaccttgtccaagatgccaaactcttgggcctccatggggctcatgtaacggtccctctccatggctgactctgcaggctctgcttggtgtgcttggcatagatgttgtacagctgccttttcagcttcatgatctcctctgcctggatagcgatgtctgtggcttgggccctggctcctccagagggctggtggatcatgatt

SEQ ID NO: 715 - DNA, 295 bp, Rattus norvegicus
  Genbank Accession No. AI043611
tttttttttttttttgtcattaaatgagatttattgccaaattccaagaaagatggatcataagcagaaggcactggatgcctcccccatgagggcagggaagcaatcctgtgcggtccccaccctactctaccccaccagcatgggaaccaacagcattggccagtaaggcagcaaccccagaagtacttgcccgactgtcacttgacagcacagacagaatctaattcctggaagcaggtgacctggcagaggtacagcatcctggttgctgtagaggacgatcctcgtgccg

SEQ ID NO: 716 - DNA, 191 bp, Rattus norvegicus
  Genbank Accession No. AI043654
tttttttttttttttttcctacgatatgaggactttaatctgtagacatatccaagggcccacccccacgccacaagctctgttactccttgtggctgtcattatgagctgacatgcccacccttatcaccatcacaacgaattcttccaagttaagtgcgttgctcactatctgacgtccaattctttgt

SEQ ID NO: 717 - DNA, 368 bp, Rattus norvegicus
  Genbank Accession No. AI043678
tttttttttttttttttgcttttccgtgggtgttgtccttgtgcctttataatgaacacattgcccctacagtagccctctgggatggactagccctgctcaggaatggagagaagtgggtgggtgaaagatggactgtggtgttcccagggtgagggggccacaagccagaggccctggagctggcacgaaggggttctgctgcccgtgttcctcagcggaggctccagaggcgacttcaggtcccatgagtctctgggacactcaggatgtcatctcctttccatgagtcaagcttgacacagggtggggagtggtgactaaactgtcactgacacaactcagagatcctccaggagcacgggcca

SEQ ID NO: 718 - DNA, 481 bp, Rattus norvegicus
  Genbank Accession No. AI043694
tttttttttttttttttaactttttaaaagtactatttttagttactgcatgagtttcctgacctccaatcattacagtgttttggttaaggcttttgagaaacaagggattatagtatctaagtcacaggtttagaagggggttctaaaacaatgtaagaaatagcgtcaaattcatatacagacactagttacaagaatacaccgtttggagaacagttttacctttaccgtacaagagaaatacatctaacatctttcattacttatttgaaaaatatttattggccttgggatgcagggctttcgttttataaagtgttcagaagtgcagaagagcacacagttcaacagtgcaagccactgccacgacccaacccgaagggagagtcagtgcccagtaccaagaaccgattcatttttaattaaaaatttcagagtttatataagtttagctgtaaatctataatcaaaaagtttt

SEQ ID NO: 719 - DNA, 481 bp, Rattus norvegicus
  Genbank Accession No. AI043695
tttttttttttttttttcacgtttattacatatatttgttgcaaaaaaacaaaaaaccacacaggcacatacaaaacaaaaagtaggcttacattagtttaggacgttaactgtcttcaaacacatttttcatcttcttttcagcatatagtactctagttatatacatttaaagcagataaaataaggcttgaaactggtaaaatgttaatttaatccatattcagaaacttgtaaaataaaaggtaacaatgaagaaataattaagaaagttgtacaaacgaccatggttattatttccctttataaaagtattccaataaaacaaaataaaaactgtggaacacaaaagtcaaattagagattttggttgtagtaccttccctgagtttctttgtaaaacatcaaatttaaataaggccatttaaaaactgacctaacggccttacccctccacgccgccattacacacaatgcatgt

SEQ ID NO: 720 - DNA, 370 bp, Rattus norvegicus
  Genbank Accession No. AI043724
tttttttttttttttttaagttttcaaaaaggaatttaatccatcacagcaagacattctcagcctataaaaacatccgaacaagggtttcaaagcagttcccacccccaaagcaacacacacaggacaggcctgagatcagttcattcaaataatctttgtacgcagagcatcccagagtatcaccccagcctaacctggagaaacgtcaccgacaagtgcagcagtcagggtcagcaaaataaatagagttaatatatatgtgtgctatccttgaatatacagtgaagaccgggcccggtgccatagcacagagctccttacaagtgtcctagtggctggacagtgggcaccccaggaacccaagcaa

SEQ ID NO: 721 - DNA, 389 bp, Rattus norvegicus
  Genbank Accession No. AI043768
tttttttttttttttttggggctgtgtggttcatttattggggccatgtccagccatgccgcagccacctgagcaggagcccagtgcccccaaaaggcaggtgggggaagggaggaagtgcagaaggctcagtgccccagggttccaccccagtcctgtcttggtccttgaagagaggcggttctcaggtgagcgaggtgtcgtcatcgctgccctctcctgctccacccgcccgctcctcccggctctctgtcacggcgctctcgtcgatgttctccagtgagtctgcgtgttgcaccgacagctctgacagcgccaggctgggtaacgggctctgctccgggtgcagccatggcttgaaatgtggctggtgtttctgcttccactca

SEQ ID NO: 722 - DNA, 498 bp, Rattus norvegicus
  Genbank Accession No. AI043805
  misc_feature (1)..(498): n = a or c or g or t
tttttttttttttttttaattttagtatttattgccatcaaaattagcgatttagggcttacacagaaaaatctgccaccatacaatctttcaaaggaaagctgtcttctctatgtgtgagaaagctttaacttattcctgttctaacataaaccatgtttaacaaacagatgcttgaacatgtgccggaatttagattaggcaaggaagttcactccacctagcaagcaagtctgaaatatcatctttgttttttaaaagtttgacctgaattactgaaatctaatggattctcatggtcagtcatatgaatacgttataatcagtaagaagtcagtattgcacattaagcttggaccaactcaagtttcttttttatgagttctttgccatatgtgttttgtgaaaagcctttttcatctagacagtattgcaaagatgtcatagtttatttgtctccacagttttatctacaggagcattgcacgttgcccgtan

SEQ ID NO: 723 - DNA, 451 bp, Rattus norvegicus
  Genbank Accession No. AI043849
tttttttttttttttttaaaggtcagaaaataggcttatgtttattcaaaagcttatcaccttgcacattactattttgtcttgttttaaacacacacaactcttttaagtgtggactttgcatccctgatatctagcaaaaatcatatctaatgacaaacacaagatttcaaggaaaattgatttgaagcatagacactggatctccaatctctaaaaaattgcttctattaacaaagattggggtgggaagtcagggagaggaccagaaaaaaagcagcttcaaattcagggaagcaaagtaaaatggagaggaacagaagtaactcaagtttactaatcctgaaacgtccaacaaagtgtcatcgtttagagtccagagcaactcatctggaattttaaataaataagcttaagtttattcacatcttctgcttcaagcatagcccta

SEQ ID NO: 724 - DNA, 465 bp, Rattus norvegicus
  Genbank Accession No. AI043904
tttttttttttttttttctaaataaacctcaactttattcagctgacatgttctgaaagcaaggggtgaaaatattgccaatcaaagctatttaaactcaacagggcaagctggcttttgagaaaaagcctgaaacgaaacctgtaacacctactgtttacttggtccttagatttagcattccttcaagtggccgtacatgaaatatacatctatctacttggagtccttctggcaccctacctgcttcaaaccctttcacttatctacctgctaggctgcagtttctgacaagctccaagtaagtacacagccctctccactagagggcactccaatcaggctaggtgcccttccctctggagatgtaaggacagttgtacccaatcagatcagagtgatctcacaaggcactgaatggaaattcgagggagagcaacctaggcaaccagctcaatgcccctt

SEQ ID NO: 725 - DNA, 488 bp, Rattus norvegicus
  Genbank Accession No. AI043914
  misc_feature (1)..(488): n = a or c or g or t
tttttttttttttttttgtcagtgaatgggcgtttatggggcagcagctacaagaacgtgctcctttggcaggctctcacaccagccacaagtacagtctcacctggcattgctcagtgggctgagctttctccaggcgcagcagcagcatggagtgaggaggcaagcggacagctatgaggtaggtggtagggggctgcgccaccacgacaaagggctctaggtgttgggacaccaaggcctccaggccctgtggcccaagtggacaccacacacgactttctacaccctttggcaggcaggagttccagagctcatcaaagaaacacaactcagagcccttggggagctgggggaaaggcangaagaggtcagcaaagttcacagacaggggtggtaggtgggcatggcacgtgaggccggccggtgtggtgtaaagggcagcacagcccagtcatcagtcctgagggccacacctcgtgccgaat

SEQ ID NO: 726 - DNA, 431 bp, Rattus norvegicus
  Genbank Accession No. AI043990
tttttttttttttttttagtttttgaaaccagtttatagatggaaaagaaatgacgatggtcatatgtgttgatacattctccaatcccctcatggggaagaaagggacccagagccattactatggtaagtgtacaggacccattccagggtgggaacacccttggacttgacagctcagcctcaaactgggaatagcacgctctaacaataccacactctgcagtcagcttacagtaaggggggaatagattcttccccacgtgtacacaggcaaacctggcacagtgatagagatgtgctttagagagagaaaagtacatcgcaggtgttaataacattgacaaaagttgtagccaagcacatccaaacgcctgtccagcttgaaaatgcctctcagccgtctccaaacagactccggcaagcagact

SEQ ID NO: 727 - DNA, 259 bp, Rattus norvegicus
  Genbank Accession No. AI044018
cggtcgcatgtgtttttattcatatatatattggtcagtcacacacacagtgggtttattttttcctttggcgttgtttacaatgtctcacagaaaagaagggctcccattggcattgagggtgttgaaattcattgtttcagtggaaaaagtaactttctgatcagaaagacactgcgccattagcaacagcttgcccgtttcctgggctccaagacgcagactgggagaaaaaaggaggccattaaatgacatggct

SEQ ID NO: 728 - DNA, 302 bp, Rattus norvegicus
  Genbank Accession No. AI044170
ctgccgcagaagttttttatttcaaatgactcatggcagcccagagccctcaagatgatgcacagagtaacagctgatcatcaccgggaccaatggctgaccagcagttccttagcacaggagcacgttccgcccaatggactttgcaaatgcttttaatgccatcacctgttgtacatgctcctctaccctggcactgtcatctcagccgctcacttacactgtgcactgcagcagatcctgttcactgctgcacttttcaaggacttaacacctacttctgttctagacctcgtggggaa

SEQ ID NO: 729 - DNA, 312 bp, Rattus norvegicus
  Genbank Accession No. AI044177
cggccgcaatgttcatatttttatttttttttcacaccgacagttgatttaattactgaatctgttgagcatggccccatctgttggtcctgattaaacagatctaggagaatggcatggtaacacctgagtcctgtcttgactccctttccgtttccatgcagtcgacgaattgctgcagacctgtagcattacttcatacataatgacgtggagtttcactactgacgattactctacgttcttacgcttgctttgttctatatcaactgaactgctccataggcatgaagaggtgcaatggctttgtat

SEQ ID NO: 730 - DNA, 457 bp, Rattus norvegicus
  Genbank Accession No. AI044237
cggccgcgggtggggagtcgacgcaggcgcttacgctttcgctcgggaacgggtgcaggaaggtcccggcagccgccatctcgccgtcgtcgcgcggggtccccggggcgttgttcaggccgcccacggcgccgggggagttcttcggcagcccgtccatatcgcccgagcccagggatccgttcacgtggtgcggctccatcgtgctcattgaggccattgggccctccgggctggggccgagcgggaactgcgggcacagggcagcgtggggctcgggccggccgccccccgcgaggtccccatcgggtgaggcgcaccggcccccactcacgttagccctgccagcgcccggcccgatgggattcatgatggtgtacatgttctcgctggagttggtggagtctccagggctgggcatgatgggtgttccgggggggccacctcctcctgtcgg

SEQ ID NO: 731 - DNA, 471 bp, Rattus norvegicus
  Genbank Accession No. AI044247
  misc_feature (1)..(471): n = a or c or g or t
tttttttttttttttttcaaaatcacccagagctgtcggtttagtgctttccaaaaatccacagctccgcctagaaacttctggacgggctatctctagacaaatggaccaacctcttgaggatccagccttcaggaaggtcctaccttccaccccattccaggcagctggtgaggctgaaagcatgggaaccaggcaacacctgctttgggtggagaatcagcacacaggctgggcagagagctttattggagggatggagggcacgatgttctgaacatgagttgagcagagtattggtagggagggcttaggtagccaggaagcccccatccactggcaaagcggaaccagtagtcatgctacttcggttgctcagcangaagaggatggtgtctaccacgttctccacctcagcaaacttgccaagtgggatacgatccagcatgaccttagctttgtgcgggtcac

SEQ ID NO: 732 - DNA, 474 bp, Rattus norvegicus
  Genbank Accession No. AI044253
  misc_feature (1)..(474): n = a or c or g or t
tttttttttttttttgtacacagatgcttttatttggatgttaatagatttcaacattgtctgcaagattctcttacaatgcaaagtttttttttatatattaaaaaactcaatttagtcagtgtaattgctgtattaatgtgaaaaccttacaacagaatgcagtattggtatgtgtgaagtcagtttccatgcacggatggctgctacctgtatgcttggcatcttcagaaaactgaagaatataagtgaacagtaaaaaaagatgacttaagatgcctaacatgtttatgattacaaatcttgcaaaaagcaacaaagcagttaactggaggattcaaccaataccaacccaaatatgtcctatgtcccataagcccaggcttatggacaatgtattaacatttgtgctaacttaatgctcaagaaaaattatgttttaaaatatgtancgtgtctgagatattttacttt

SEQ ID NO: 733 - DNA, 407 bp, Rattus norvegicus
  Genbank Accession No. AI044338
tttttttttttttttttcttgccaaacatagaactttattatatttctagttgcgtccctttgtattagattcagaatcaagtactggacagaatagctctgaactatgtccttgggctaataaggtttctactccacctgataaactggcttctatccccaccatggtgccagttggaggcacttggattacagagaaacagcagctggcttgaagaggggttttagtctaaaatctcccagtaggaacacagaacagattgaacttgtgttggggaggaaggttgctacataccagagtacgtttcagtttctcaaaccagaggggcacccaaggcactttccctgtccccactcatcccacaatccaccttacttgctgacctccacctctgtgtgtcaaagca

SEQ ID NO: 734 - DNA, 283 bp, Rattus norvegicus
  Genbank Accession No. AI044345
tttttttttttttttttacctaatggaagcctttattttagccaaactgacagctctgagccaaagctccaagtccacctcctggcccactggtacccagaaaagatacacaggctaaggttgtcccctaaggggaagggctgaagtatatggcctgtgggctgaagctggctctgttctgggcaatccagtgtcccagagagacagggccatcagatgtctttttccatccagaatatagggcaccccttcagatctcgatatcgtgtctctaacgggcttt

SEQ ID NO: 735 - DNA, 519 bp, Rattus norvegicus
  Genbank Accession No. AI044347
tttttttttttttttttccaggggaagaaaggcccaataagcctttcagactttattggttagccctcaaatacaatccaaattcttcatgttacagctcaaaaaaagaatttaacattttaggcaaaataaatactttattgttttaatggggtttttgttttttagagaatagcctttgtgtgatagttcaaatatttataaactttttaggtattctttcaaagaatgctaattatttccaagcacttttgactaaaaattttcacacaaagtaacataatcggagttgaaaattacaaatactaaaagactaatttctaataacatttggttgctactttatacatttatttgacatatatagtatcagataggaacctttgtttttttgtttttgttttaagaaaaccatgagctttcaatggttaaaactgaattaaaatcatttatgcatgagaaaaacaaatctaaatctcatttggaaaaacaaaacccagcttattcatttctattcta

SEQ ID NO: 736 - DNA, 311 bp, Rattus norvegicus
  Genbank Accession No. AI044369
tttttttttttttttttatttgttccagtagctgtatcatactttaataagggattattcacaagtaagtctctacaacgcctgggagcaaaacctggggtaaaactgactgctgcatcaccgtggatccgctcaaaaggccgtgttgcaatgtgctcaattaatcaaaatgtccatccggacctccaaaaactccaacaattgtcggacaaaaacgatgcacgtggctcagtcatcgtgcacaagcacccacttcaagactgcctacaggttggaaacgttcacaacatgatctcgtttccaataatcat

SEQ ID NO: 737 - DNA, 435 bp, Rattus norvegicus
  Genbank Accession No. AI044396
tttttttttttttttttgataggtgacacaatctgggcagtctgcccggggaactctgacatgaagctgctggctgaggagggttagacctttgctcccggcatctgaatggtcagtctcaccaccagcacagctgagcgacgccacggctcggcccggctcatttaaattccccactttctatggagcaaaacaaaagctttacaaactcagacacacttagttttcagcagtgcaaacattctgaaacagcgcagagtcctccagctattcagaggataaagtcagttcatgtagtgcttgaaggagaatcccagatactctggaatggagatggcccagttgtgactttgtccttaaaggcaatggttatcatcagggactgaagattatttcccatctgaagtcacgagcattttagctttacttcgcagt

SEQ ID NO: 738 - DNA, 313 bp, Rattus norvegicus
  Genbank Accession No. AI044425
tttttttttttttttttccagaaataaaagcgctttaatatctggaccacccagatgaaatgtcatggcaaatctcataaaaacccagagggagcagaaactgatactaggggaaggaagggaaaccaaaaggcactgagcatgcttggcggggcaggaaaggacactgtcactccagagacaacgaataacaaagggacaggagccatccgggccagctcggggggcttcagaagcgggagacaagtctgagtccacaaaccaagttctctgcggcttttcaagaaagaggatttgcttgcaagatgcatga

SEQ ID NO: 739 - DNA, 467 bp, Rattus norvegicus
  Genbank Accession No. AI044525
tttttttttttttttatgatctgacagatgagatgcccttgttggtgcaaaaggcttgaagtcactatatttgattggctctgtagcatgcaaataaaccttgccattatggctaatacatcatccattattatctcttgttcatttttgcaatttctgtacccgattgagtacaaggtgcctttggtggttttccaaggatcttgaggttacatgaaattgatgatgacgtctgttgaaagtgctgtatgaaactttgtatgaaggcctaaggtagagttgacctgagagcagtgtctttaaaagagagactgctggaaagctagctggagcttctggctacttgagaaagccactgtctgaagcacagaccataaagtgtggttcgctttctagttaaactgaatatgcttttcagttatttagtgtatggagatttcctacgattttgtgttaggactggagat

SEQ ID NO: 740 - DNA, 449 bp, Rattus norvegicus
  Genbank Accession No. AI044588
tttttttttttttttttgaagttggaaatggcaggggtatttttctttgttttagagaaaatgcaaagtacaaaggaattgacactaagaaaatataattagagaaaaagttaggatgcaataaacatgccattttaacaacagtcacacgtggctctctgttcactaaatcacccgagtggcccagctcttcacatctgcacatttgacttcagcctgtccaattataattgtgcctcctgataacattcggtagccaaatgaaacacctaaccagaaaactggttatctttaaaataaagtgttggtaaaatagttcatattatttgtttaaaaagacttagtttcaaactatgaaggaagtaaaagactgcatagaaaacaatgtcctatcttatctcaatattttttcaaggcataaatggtgtatgtgggtttacatgcatatc

SEQ ID NO: 741 - DNA, 453 bp, Rattus norvegicus
  Genbank Accession No. AI044688
tttttttttttttttttcgtggctgaccaaggcggttttattagagtggtacatacatggatctgtacatttgtcacaacacacaacacaagctagaaaagctaatttcccgaaaacaatcagtaacagtgaagtaattttaataacaatgtcccttccttctgagagccttgggtgacatggagaggttgaagccaaattgcctttcctcatagtcagaatcgtcaactttcagttatctttctgcccaaaagatcaccatctaagaaaaaaaggcccgagggcacagccagaaaataaagtctgaaagctgaagtcgctcatctgcatcttgtacagctggggcctgaaggtctgccaggtgacgacgaaaggctttcgtactctgacaaaatgtcctccaaagccaactaagggtggagggtttgctccggctctcaggttgaggctgca

SEQ ID NO: 742 - DNA, 372 bp, Rattus norvegicus
  Genbank Accession No. AI044794
  misc_feature (1)..(372): n = a or c or g or t
tttttttttttttttatgtgctcataggctgtttattatcaagaggaaggagagagaggaggagagagcccagacagccctcagggcccaagggagagtgaacagaaaggctcctcttcctcctcttgccactgacccagaagactccatctgcagagatctcagggtggcttaggggcctccaggaggcgtggcagctctgctgttgactggagatgggatggatccccacagggtcaggtcccagcctcggaatggcttctgtgtacacaaaatatctctcttcgaaaggcactggtggaggtgagcagtangaaggctgccccatcacaagccagactcactgtcccaggtctgagttctgcttcctca

SEQ ID NO: 743 - DNA, 478 bp, Rattus norvegicus
  Genbank Accession No. AI044836
tttttttttttttttttaaatgtagaaaacaaaatgacatttatttttttcttaaactcaaaattaccaagtagggtaagaaattaaatataaacacaaagtccatcctagccctgtttatccaaggcagcataaccaaatagactcatggagaccacctggtcaacagaggatttattaagtatctcatcggcgtcttcggtctggactcctgcttcgtcttcggccacctcttcaagtatcccgtgcgcctgtccaaattcaggtggatattttttatttccccatattcagcgaacttgtcatggatatcttcttcagtggcttcttcgtggactccagtgacaaagagaatccaaccttcaacagagcgctgtggtccaggttcatcgccatcctgctccacactgtcataatcttcccgcatccgcgctcgggacccctcttcagaaccaaaaccgcggcccttccgtttctt

SEQ ID NO: 744 - DNA, 392 bp, Rattus norvegicus
  Genbank Accession No. AI044864
  misc_feature (1)..(392): n = a or c or g or t
tttttttttttttttttcaatcacaaaaatgggactttaattagggccttggacatcagtaacaactaaagtaacaggcaatataattttagattaaatagagagaaaatacaaataaatagtagaaaaaagatatgaccctttaagaggaaataatatcgtgcacaatgtaacacagtagcttacaggtaaggtaaaatttcatttttcaaagtgtaattatacatattaatatacagccaaactcattctactcacaataagctcatagaaaaagataaaaataattaactgtctataaaggatccataacagctgtatcgagaccttcagttattanacactgtgtatggcatctcactttgtcaaaaggaacctcctggctcctctga

SEQ ID NO: 745 - DNA, 398 bp, Rattus norvegicus
  Genbank Accession No. AI044869
tttttttttttttttttcacagaaagatcttttattaagcagggaagaaaagttgaagtggctgctttctgactcagacagaaaaacatcagcaaaggaccttgcaggcataattcataagaagggggaaggggggaggtctgtgttagaatgggctgggggcaatggtgtgttttgactgggcatattaggtgaaccaaagcgggcttttgattgctagactttaatactttgacagctggaccttggtagtcagcctcaggaggaggaaggaattggctaaataagggaagagactgtgggaactagctttagaaatgcagtctagtggttttaggcaaggccgaaagaatgagagagaagggcacggcctgctacagccatgtctgtcaggtcca

SEQ ID NO: 746 - DNA, 462 bp, Rattus norvegicus
  Genbank Accession No. AI044883
tttttttttttttttttcacatcaaattcattttaattctaaatgggtctgcactttaacgctggtgtgcgatccgcatgtgtccacagaaagggtcctagaaaatgcacatcttactgttcaagtaaaaaacatattccattgtacaaatattttggaaaaacggcttaaatgtacataagaattaaaaatacaactttagtacagtctgcacgtgggagccctgagctcaggctctcaggaggtcctggcacttagcagatggccccgaggctcccgccgccttcgccttcggggctgcttgcaggagagccggatgctcccatcgtctgctcagtggctggccgaccctgcctggccgtcagcaggctcctcaccctcgctctccttgtcccagtccttcatgctggcgcccatcatgaagtcatctcgcagaatcttccaccccggaccctcctctga

SEQ ID NO: 747 - DNA, 432 bp, Rattus norvegicus
  Genbank Accession No. AI044947
tttttttttttttttttaaacagcaccagcaggggtttatttagtgacagtaaggttaatgattccctcaaacaatataggacaggccacctggtttattcaaactgaatctaaaccttagatctgactcaacagtaacataaaaacctttaatgacaaacccgtgttaaaccaaagacagtttaggtgagtcttaaagctctactactgatgggctggcatctacacgacaagtgttcagttcggttacaaaagcacatttgagtttcttagggatatacaagtaatactccatgtagcctgctaggtcctcaatggtcacatcatccacatagacacgagcttgctcggaacaggatcgaggagagccagacagagttctggtgtgcagtgactgagagtagtcctcaagtgatcttcgttctggggcca

SEQ ID NO: 748 - DNA, 407 bp, Rattus norvegicus
  Genbank Accession No. AI044976
  misc_feature (1)..(407): n = a or c or g or t
tttttttttttttttttaatattctggacagtttatataattgggatcagatctcacatacaacaagattttagctggaaaaaaaagaaaccaatctgtacgctatgagacagactatgtgttgaaacttgccctgaattacggcaagtgggaagggcaaaggtctanggcagataaatagtcctcaccccggagtggtagctctgacatttgccagattttccatgaagtcacttcgaaccatccctccccaggctgcagcctgtcaccagtgaagccgggaaggatgccctcgtagctcggaacctacaaacttgaatggaagtgaacccgacaataacgaaagtatttaagtcctatctaatctcatctggtaaatatttccccnctcncgctcgaccttcgtg

SEQ ID NO: 749 - DNA, 387 bp, Rattus norvegicus
  Genbank Accession No. AI045056
tttttttttttttttttatcgcttcaggcgcttttattaggttccacagcagggctggggtccacacccagccaacacacacttgtgagcccaaagcagagccgaagcgggagcacccatgtcccaggagccggctgcggctagtcagagcaaggccagggctagaccccatctctgagcctgatgaggaccataacagccactgggttcgtgtgggtgtatgcacacaggcgcctctttttgcgctgtagggcctgatggcaggagggattagaggtgggaccagggccacctccatgtaggaggaggtagctgagctgcccaggtctgaacctagtgtagggctcactcccaagccagtagctttagccctcgtgccgaattctt

SEQ ID NO: 750 - DNA, 495 bp, Rattus norvegicus
  Genbank Accession No. AI045074
tttttttttttttttttgcattcaaattttattcatcagaaagacatgattatttcaagtcagaataagggacattattcaagttttgttccaactcggcacaccagctgtgtattcctatggtatccactctcttcagccttcctggtggccacgagggtgggtggtcaggcaaggcagggctgcagtcaccagcaggatacacacattccacaattctgtaccataagggtggtccacgtagcaagagtagggttgtgtgcccagaggatcagtcgtcgcaggcgggtcagccctgagtcttgaccagactggactggaaaatggccactgaggtcagccaataaccggagtgtcaacaaactctactgttcatagctctagggtcccattactgcagggtgacgactccagttctagcactgtgatgttgtttggggctgaagtggtcaggatgttccttggcacaaacaaggtcatttgtgggccctttgt

SEQ ID NO: 751 - DNA, 395 bp, Rattus norvegicus
  Genbank Accession No. AI045075
tttttttttttttttttgattagacaaaatcaaagtcatttattactaaagtttggttttttttttctttgctccaaagcaagagaattgctgtaatggcggagtgttcttgcttttgcattttgtggttgttgctgttgttgttgtagctagaaacaggtctcattcatggaaaactatggtccttcaaggagtagctgcttctgatcctggatgaggatgaagttcaggctgatgttcccaggcagggcagccctcgctgggctctgagtcgctgagagattttgtagagctccattgtggccctggcatcttctacagagcagtggccccgccagttgttctggatgctcttgtgcagcaggcgcttgcacagcagcctcagggacacacgg

SEQ ID NO: 752 - DNA, 461 bp, Rattus norvegicus
  Genbank Accession No. AI045151
tttttttttttttttttccagaaaatgaatgattgcatttaatataagaagcattgacctgaatttaaatgggacagatgcggaaggggcggagccatgcttcaaaccctgacgaggcttgttgtggttccaatcaattttccagccacatccgggtcagtccccctatgagcccacagcggtcacttttgaggtagatgctgatggcttaaagagaggtaggtaaagtccgaacttgttttcaatgcccgcaaatgttgcaactgccagtttatagccccctacgtggtcaggattgggagcgggcagagtaatccgagatttaggaaccagctcagatcccacgggcttcacgcctccaaaatcgacgtagaaccatcgctgcagcagttcgtaagtaagcaaggtgacaccaaactgcggtgaggagcggaagactcgagcaccagctcctttccaca

SEQ ID NO: 753 - DNA, 493 bp, Rattus norvegicus
  Genbank Accession No. AI045153
  misc_feature (1)..(493): n = a or c or g or t
tttttttttttttttttgcttacaaagttttattttcggtatatcacctgtccagtgtctatctggggcgcacacacttcggggaactggtgggactgtcagtttaaggagctcacgtgagggttgatgatgaaggtccaaggcagtttgtatctcaccatgacagcatgggaagagagtcaggctggggcaggaccggagaacaagctgactcctacagtgcggtgacacgaaggccctggtccctggctctcccagcactgtcatcccaggcagcactgcctgaaaaggcatgcaggtcactcagaagggcctcagcactgctgcctgagcccacaggaccctgagagctgaggcccaggcccccctcactatctgtgtcatgtacatctggggtctgctgtgcctcacagcgctgctcctcttccttggcatcagctccctcggggccaccatccatcatgaaatcttctgcgtcncctcgtgccgaatt

SEQ ID NO: 754 - DNA, 248 bp, Rattus norvegicus
  Genbank Accession No. AI045161
tttttttttttttttgtggtcatgcaactgcttcgcttttagtcactgaacagggcaagaactcaattctaactcaacagacaattttacacatttttcccatggtggggatcaagcccagggccttatacacgctaggcaagcatatatgttccgccaagcatagccttaacctttatacgtttcttacgaacatatcttaaagatatatacgtaagatatttctagatgagtactgcctcgtgccg

SEQ ID NO: 755 - DNA, 408 bp, Rattus norvegicus
  Genbank Accession No. AI045223
tttttttttttttttttagtctttaaaaagctttttaatttttcttaaatgacagttacaattccaaatgtcaccaactattagagtaagaatatttcataacattttcataattttgccacagttgatcatttgcaaaaggaagaaaagaacaagagttccgactttccaaatgtcaatatggctcctcttattaatattaaaacacatttgctataaaaatcactggaagttaataaagaatagagaaagtacatcttttaataacttccaataaaaagagtaaaatataatgaaaagtatacacttacttgatactaatgacatagtatttcattatccttcgagcagcaaaatgtgtaacttgagccagatgttcaaatggctagactttctctaagagcgagt

SEQ ID NO: 756 - DNA, 494 bp, Rattus norvegicus
  Genbank Accession No. AI045477
  misc_feature (1)..(494): n = a or c or g or t
tttttttttttttttttatacacatttttaatgagcatatattagtctagtaagcagaaaaatacaaataacaaatcatgattagtaaaatgtttctcataattactttaaaatttcttagaatgatgttatcactgatttatccaatcttattcatacaaggtatgaagtaacccataagtttgctaacagcataattgagagtttttgcttggtcataacttcctttctaagttgctacttggcatgaaaccccatggattggaaccaaacaatggagccaggcacagaatagatggaatcaacaggaggaaagacaccttccccttcaatgggattgtctaccccgtagaccaatgacccttgagtctgattttctgacttccattttgccatctgaagaatagcaatggaaccaaggtgctcaccagggaagaagggggagcaagtanagtgggggtgggtggagaacagagtctctactggttctatca

SEQ ID NO: 757 - DNA, 384 bp, Rattus norvegicus
  Genbank Accession No. AI045502
tttttttttttttacttgtacagttctttattttactagcactaaacaaatctacataaaatacattactaaggtacagctgtaacattagaaattagaaatggcataggctctatttcatactgacctactttaaaagacagctataaactttaaggtgctcaaagttcttccttttaccatatttaaatttgtgatgggttgaacattatggtgacctgagctttaggacctgactgggcaccatttcaggggtacaggagcacagggccggaagaggggcgctgcctccttcactgtggacagacacgctgtctcgcttctagcagcttttctactacttcttcctgactggtgagaaacatgtacaatgccttctgtcat

SEQ ID NO: 758 - DNA, 368 bp, Rattus norvegicus
  Genbank Accession No. AI045537
tttttttttttttttttccatgaataaatgaatttatttgctagtacatgagtggcttgttatgtaggtggctttggtggctgggtaggaacgaagggagatagtatataagcaaaagccagggcctgcccgtggcagcagatggctggaggaggccacatcgcctccagcatctgggtgctatagtaatggcctggcagtgaggtgcatgtatggcagaggcctgaagaagaggtaatgcagagtgggcagctctgcccacctctaattattgcttgagtctttatggctgagacagctgcctaccccccggggagctgtgtcttggccatcacagtgtgaactccagttggggctgcctcgtgccg

SEQ ID NO: 759 - DNA, 262 bp, Rattus norvegicus
  Genbank Accession No. AI045594
tttttttttttttttttgacagttacaaagactggaaaaaccaagcaagtttattaacacatgcagtgcacactgtacagtagaaccccaacagaagagaactccaaacagtggcttagtcaggtttacacagcatcttcaacaaagaacagtagcattttacaacatgacaagacagatttgccttttgacttccacagatggggaattatggagaatatatttacaggaataaattaatgaagaaagacgtgtccattcc

SEQ ID NO: 760 - DNA, 487 bp, Rattus norvegicus
  Genbank Accession No. AI045600
ttttttttttttttttaggtggtccctaaactatttgaaggcaggtagctgagtctaagctaaagtatttctcagtcagagtaatcaatcacctcagagtaatcaatcaccctcccctcagacgcccctcacaatgcaggaacagtgcaacagcaaaatcaaagagcaaactgtattttcaagaacagaagagtcgccagtgctgaaggacagagtagaaagcagattctttgggggacatcagtcagtcagtttccggcccattaggaagacttctctttcctgctccgaggagagtcggctccattcgacgtgaccgtgccgttcacaccattctctgttccttttctggaagacctgcctttggtcacagccggtttccttttcacgggaggggcctggaaggcagaatgttccctccacctccgaagctggaagttaatgaacttccacatcatgaaggcttgagtgatgcaaatggacgcta

SEQ ID NO: 761 - DNA, 400 bp, Rattus norvegicus
  Genbank Accession No. AI045608
  misc_feature (1)..(400): n = a or c or g or t
tttttttttttttttttgaaaatccaaaatgttttattttattttttttccttaaatagagataaccagtaaacaattttctgaacttggaagtttaaaaacgtgcatataaaaatgggcattatgtatttcttattgaatgtggattgactgccgtctgctaagaaaagtgggtgtgggggctgaagagaaaggaagttgtctttttttgttttttgtttttttttgttttttgtttttttttttttttaaggcttgcttgtgaaaggaacagttgtaaaaacaaaattgcttgaagcagggtcagcttagtgcttcacagtttgactgcttctctaagaggagcccttcctgcacacgtgcatcagaaaccacagaanacacanagacagacacctaa

SEQ ID NO: 762 - DNA, 422 bp, Rattus norvegicus
  Genbank Accession No. AI045624
cggccgcttgggggcgctctttcagtctttaggctccgtggagccgctctgtgcagggggacagccggaaagcgactcaccggagcgccatggtccacctcacaacctttttctgcaaagcctaccacggcggccacctaaccatacgccttgctttgggtggctgcaccaaccggcctttttaccgcattgtggctgctcacaacaagtgtcccagggatggccgatttgtggagcagttgggctcctatgatccactacctaacagtcatggagaaaagctagttgctctcaacctggaccggatccggcactggattggctgtggggctcagctctctaagcccatggagaaacttttaggtctgtctggctttttcccgctgcatccgatgatgatcaccaatgctgagagactacga

SEQ ID NO: 763 - DNA, 317 bp, Rattus norvegicus
  Genbank Accession No. AI045632
tttttttttttttttttagtttttgttcaggaccttgtgtgtactaatcaaatgttctacccttgcgttatataaccaattccttccccactcttttgactccaccactcactttgaggaaatggtccgaagggctgagttgtcttgggaactgacgggagagcagtcaccattaatgtgcccttggtgccatgtgtcctcaccccgggcacaccattgcctcttcttcgttttcttcttcatctatgtctctgttcactcaaagttaacaataattgtaatccataaatgagtttatatttatactctaacatgtc

SEQ ID NO: 764 - DNA, 492 bp, Rattus norvegicus
  Genbank Accession No. AI045669
tttttttttttttttttgaagaaaaaaaaagaacttttatttttttctattgcataaataatggtaaattagactctttttttttaaataagattatatatttacagacaagtttagttacagaaaacatcgggtacatatatggcaaccattttccctttatacagtaagataacatgttaataatatcgcttcattgggtcacttaagttgcatgccaagttcatgtaggttaatatttacacttgatataaagatatttttctttatttcactaacctgctgtctcaccacttaatagcagaaaatcaccaactaacgctaaatgaggtacaatgggaaattgagatgcatgattgacatccgactggaacattctggaagaaagaggcaagaagctcctgattagaacagtctttacctgtgcttcagagtcaccctgtgcgtagggtttaaatcccagacatttacatctgtgctttgagaataagt

SEQ ID NO: 765 - DNA, 388 bp, Rattus norvegicus
  Genbank Accession No. AI045789
ttttttttttttggtttcaaatacaggtttattcaaagacagagccccgctagggcgcggtccaaccaagacgggtgtgccgggtggtgcaccctcctgccgagttctgctgacccctggcggcggagcaggccaaggaaccgataaggtctggccttccccagtccacagtcatcctggcaggagcatgctcgtgggcagctctgacgcttacggactttgtagagcagggaaccagaagctggcctcttaggtcgaatgtccaggaaagagatccaagagaacatgagagttatcagggggtgcccaagtgtatgttcttgcaggtgattagatgagtgggtagagcttgggtgtcgtgaaagataacaaagattttgggctggtg

SEQ ID NO: 766 - DNA, 447 bp, Rattus norvegicus
  Genbank Accession No. AI045862
tttttttttttttttttaaaggtaaacaaaaaaggcatttatttctaagatatggctgaagtacagtgtttattaagccagttttggaattaaaaaatttgcagcacagacaaagcaaaagaatagtcagggcactcctcagatatttcaacctatagagcttttttcttcagttgcttttgatgtttgcagtgtcgttttggattggtctgcatgacagacaggtcagaccttggggaagattggcgacccacatcgtctgctgttatgggcttgataatatggcctggcttggtcacaaccttgggagcagtcagcttttggaatgctcgctgggtgatccatgtggaccctatgggattctggatggtcctttcaaattgctgatggtgggtgaatggatacggaagcacccgcacctggtgagctgccctcgtgccgaattct

SEQ ID NO: 767 - DNA, 467 bp, Rattus norvegicus
  Genbank Accession No. AI045866
tttttttttttttttttgaagattgctttgtactttatttacaatagaatgtaagaaaaagtaagttattaacaataataaataacaaggggggggcgggcatcgacgacagaacagccgtaaaaggacacagagggttgtgtgtgtgagggtcacttccgttcgagttgcttgcactctgcgttccaacacttggtccttcagtggtggcagtggtattttgactaagttaacccgatcaagatctcagctcgaaaacggaaatgctgaaatgacactggcaaggacatataacatcaactcaaaagaacctcttatctcctcagggacactgggaaacggggagggagacttgaaattccacagatacagtttgaactcggaaagcaagaaagtgggaaggcttatcctaagcatttattaaaatggagttacagtaaaggggcgtcgtctgttaagttctccac

SEQ ID NO: 768 - DNA, 466 bp, Rattus norvegicus
  Genbank Accession No. AI045882
tttttttttttttttttagtggatataaacgtcttttattcaattttaggttcagagcttggtttactgtccagctgcacacaaatgtcccttttctcatattgttattggttgtgtatattttctttttgcataagaaatatgtctgtttagtccagtggctcctgttttatccggatgacggagggtactcggggtgtccgtctcagttcccgtcggaggacgtattcactgaactgggatgagtccacgcctcctccacaggaacccacaatttcaaatcctctttgctgcaaccgctcgaggacctgaactgagttgaggtggcagtagccgtttagtggaaacctgatgacatgcgtcgagtcgtgattccaacctgcattgacggagttgcacatcacgtcgccgatctcgggaaacacttcttctatcaaggacttgtccccactgagcgtgatccttt

SEQ ID NO: 769 - DNA, 314 bp, Rattus norvegicus
  Genbank Accession No. AI045970
tttttttttttttttttaacttggagattaccaaagatttatttggaatgacacagcactgagaacacaactgttacagatggtttgtggtacagcatacatcacctcgttcattttagaatgatctgtgaagatgagttgcataaatagaatgtgaaagtatataggagcttttgtaaataggttctttagccccctcatacagccaatcatataaaggcagaaatgatgactgcatagttgctggtccatggatttactggactgagcaactgggcaactatacaaccaagccctgctctctccaaaggggc

SEQ ID NO: 770 - DNA, 468 bp, Rattus norvegicus
  Genbank Accession No. AI058285
tttttttttttttttttacgtctttagttagatttatcacccaaatatttacaaaatgcatagaatttaagaactaaatcctgagtttaacaaaagcagtaacatagtctactacttcactaaaggcttttagagtaattctggtaagaaaggaaaattaacattcatgtatccattctctaacaacaaagtgtcacaagaaaaggaattaggttctaaggcaaggtcagtgtcctgcagtttcctgcggtgggtggggcgcattgtctgtaaccctggtatttccctagacaccccctcttgtcatgattacatttgtctccctcattactgaaggtgtctgtgtagtcctagcttctctgctccaggctgtgttagatgtggaagtggagggccaggagaaatgtagactcagcagtacacaatgcccggcttccaacgcgtcacacttttgcctcgtgccgaatt

SEQ ID NO: 771 - DNA, 438 bp, Rattus norvegicus
  Genbank Accession No. AI058304
tttttttttttttttttaacattaagtattatttatttttcaagtttaaaagttttctaaatacatatgtacaagataaataaaacaaactattcttaaagaatcgctgcatggcagaattcgtaaacatacgaggtcttttgtaaggatacaaacatttgtcatcaaacacaaagaaaaacattgaaaagaagcaagcaaggagaccaccttgacacagactgccagtaactaagagggaccaggacagactctctgaacatcaggagaaaacctcttttgcattcctcctagtggcctggccttccttttctgtgtggagtggctttcctcagagtcaccaacctccgatgagatgcctacctcctcttcaccagccttttgtttctgtcttgcatgagtctctgtccactgtcttgctttcttgacaaaagcgat

SEQ ID NO: 772 - DNA, 371 bp, Rattus norvegicus
  Genbank Accession No. AI058341
  misc_feature (1)..(371): n = a or c or g or t
tttttttttttttttttgattttcttcaaatttctttattatagttattttatacatggcaaactggtataattttaatttaactttatttacacatatcacttatatggaaaaattctgctaacatgtangtatgattctggaccaccatattctgaacaatatgtactttttatctttctccttgatcagagctcagttggaattctttaaaatggtgtcactttggcaaccgcatctttctttacctctcttgagcttttcctcttattttctacatcttggatggagtcaggcagaggctgattcctcgtctcaggaagaagaaggacaacaaggctactaaggatgggaagaaccccatagatgat

SEQ ID NO: 773 - DNA, 431 bp, Rattus norvegicus
  Genbank Accession No. AI058359
  misc_feature (1)..(431): n = a or c or g or t
tttttttttttttttttgctcagccaacagcagcagcacgttttattgcaaccagaatcccctggtcatgtgaggaagggacagaacaggacacaagacaggagatagcatgctttatggaccagcacacacagaccggtgggaagcatacccaatgatgctgacatggagggtagttggagaggaggcgggctccattttagcagagtcttccccacaagggacctgagggaaagggggcagttgacagtgcgggtcaaatgaccaaagagactcagcagtctctagggcaacttctgcatgggtcncctgtggatgttgttagatgaaaacaaagatatactctgtccattgagagtanggaaaacaaaggctcaaaatgacagtcactggccagcacccataggtgtgacctgagaccctgactccta

SEQ ID NO: 774 - DNA, 376 bp, Rattus norvegicus
  Genbank Accession No. AI058603
tttttttttttttttttgctttgttcaactttatttttctttcaagacagattggactagtaagtcgagtgatagttggtgaaaattctagaaagcaacaagaggatcaggaaggagatggagcatcgagacatggacggtgaagaataggatcatgggtattcgttagctttcttctttctctgttgacaaggcagctccagttacatgttattagggagcctgactttgtagcagaatgggaaagaagggacttaagagtgagtccagggttaagcatgtgctatggaaggattgtttgattcagccataggcccatgaaggagagacactgcctgccaccccatcccagcccaagttcctttacagctactca

SEQ ID NO: 775 - DNA, 308 bp, Rattus norvegicus
  Genbank Accession No. AI058730
tttttttttttttttttgctaggtgaggattttattaagtccgatgataggaaagactgagaacactcaagacagttagtaaaacagtgctctgtcctagagggttaaggcacaagtggaaatccagagtttgtgcttccacacacacatctgtgcctttcacataatgacctaaagccatcaacagcagtcaaaatgaccagaaggtggccgagagtgggctggtagctcagggaacacacgtgactccaaaagggttaactacaagtggcaggtgacatcatcttacagacattgcaacaggatag

SEQ ID NO: 776 - DNA, 346 bp, Rattus norvegicus
  Genbank Accession No. AI058746
tttttttttttttttttacattattgactcagtgtaatggcttaaaaaacaaggttcctcaaggactgccaggggcccaggcatagtcacatcctttgtgaagagcggaaggaaaaggaggtgaccgaaaattaagttaggggagatgaaaacttcctgggaagagaagaggaagggtaaagtgctgtgttaggagccaagcgacaggagaccctgaggccagtgatgtcatcccagaaacaacatggtgacagaagtttaaaatctttaagccacgactttgaaggactagtgcagcagagcgagcacctatgctgagcatgacagcctttgctaccccagcaca

SEQ ID NO: 777 - DNA, 342 bp, Rattus norvegicus
  Genbank Accession No. AI058759
tttttttttttttttttgaaccatctgcaactttattctggagcagaaataagtcattttctaacaataaatataaaaaaaaataataataagttaaggttccaaaaacaaaaacaaaaaccacccaataacacagatctgtaacactgacagcgacagttgtccaaaggggctaaaaacggggtggctgggtggtaagtctcctacaagtcggccaggcctcagcccgggaatgtctgttgcagggtatcctctgtccccagccctggcaaggtccctgccacacactcattctttccacaagtataaaatatatatttaaaaaaaacctcaacacagcca

SEQ ID NO: 778 - DNA, 340 bp, Rattus norvegicus
  Genbank Accession No. AI058762
tttttttttttttttttaagctaaagaacagattttattgttttcccaaaacactaaaatagcccatggcatagtaatttaggacacaatataaatgacatatacagtcaggttcccaccccccccccatggctatttttaactgtcttggggaggaggctttaaaatgtccactcattcagtgacctttattaaagttatcaacaaaccacaaagggagagttacttgggcggaggggggggggggtcttaatgtaaaagaaatcacaagtcctgggtctgggtaaaggaaaatacttcatttgcgatctatgttctgtccgcagaaaaatctcaaact

SEQ ID NO: 779 - DNA, 155 bp, Rattus norvegicus
  Genbank Accession No. AI058837
tttttttttttttttttacaaactcaaaaagtaatttatttaaattactaaaatagcttcttaagttatttacacattaactgctacagttgtttatcctgaaagataaaagcaacgtatcacttaaaatttattcaagccagttggaatactcc

SEQ ID NO: 780 - DNA, 458 bp, Rattus norvegicus
  Genbank Accession No. AI058889
tttttttttttttttttacttatgcaaagataagtttattaagattaaaaaaataacatccaggacagaaataaccatggaatctgctgggtgtagcctctcctttataatctcagcacttggcctgagtgagttccaggcagccttggctccatagagaattccagcctagcatttgctaaaaactaaaacccaagccaattaaacaaaagccatcagctacaaacaaaatgacaaccattttctggagtaacaaggttaattaccatcatttagtgtggttccaaattattggccaaatgcaccacctgaaccaacatcaagaagcaccatactttaattatagttagtgccaaaagaatgtttgagttttcctaataccaggggtcatttataaccattttaacttttttttttttttttttttgcaagcacacacgtattggtacccatgtcac

SEQ ID NO: 781 - DNA, 316 bp, Rattus norvegicus
  Genbank Accession No. AI059061
tttttttttttttttttaacaagaagcctgtatttctcatcatacgaggaatttaagttaatggtacttttggacttttaacatttgtgtttgtgagacagggtttatacactgcagcccagggtgtcctgggtctcattcgtgtttcttaatcctctcctgtgctgggattataggcatatgtctggcttgatttaaaatactttaatccaatctgtaatgtctgttagcggtttcccgggtccttctggtttgtaattaaataactcaaaatgagaaaatctggggctatattaaagggaagaaaaaacaaaac

SEQ ID NO: 782 - DNA, 340 bp, Rattus norvegicus
  Genbank Accession No. AI059147
tttttttttttttttttccttcccagttcaggtttacctctctcagtcttcctttggccctctcaggaaaacctggcccaagttctccatagcctacacagcatacatcagggttcatcttcaatgtatctttcttagaaagacctgccttgactacctccaagatggcatcttcctaccagtttctgtacatttgattatttaatgtcccatgcatatagcagatactctgtgtgttgatgactgcatttgcaatcaaggagtggcacacacactatcctaacccttgtgagacggagacaggaggattgcctggaatggctggccagcctggactaca

SEQ ID NO: 783 - DNA, 433 bp, Rattus norvegicus
  Genbank Accession No. AI059154
tttttttttttttttttcaaaatataagttatttatttggccacaagcctagggtctgggcctgcacagctgacactcggaaaaggagccaggggccagaggcgtggctttcccactgctgttagcaccagacaggaagtgtccatggcttagctctatgttgtaatgtcctgactgtcacacactggagacctgttctgggcaggtctccttggttactggcagagtgggcagagcctgagtccggagaggggtcaggaagctgtagattcatcttctccatatccggaggcacttgtctttcccaccgcttgctactctctggccatctggactccagtcaacagcatatacctaaacagaggaaggggtcagacagtgaccatgaccttgaagagtacggcacagcacaccgtcatgagccctccagact

SEQ ID NO: 784 - DNA, 402 bp, Rattus norvegicus
  Genbank Accession No. AI059290
tttttttttttttttctccatttatttttattcctcagagaattacagaagcttgttttacagcctctgtgttgacacagagtcaaggcacagtgttcactcagctacatgcaccatcagcactgtgccactaggagaccagactggtaacaagcttgagcatcgctcgcctgcctggagtgccagggcccctctgctcagatggctctgtaggagtgcttcaaagctggtcttacaaccagaggcaccgcacctccggagatccctgtttgcaatctacaaagtataggcatgtgatataaacctgttccccagaagcttcctgggtgacttacatgaacaacgggactctcaacaactgatgtggagcactgccatttcctgatggagctgcatgtctga

SEQ ID NO: 785 - DNA, 243 bp, Rattus norvegicus
  Genbank Accession No. AI059386
  misc_feature (1)..(243): n = a or c or g or t
tttttttttttttttttacaggtgaaataaatttttattgatcagtataaaatatttcaacacacaatgtcttacatttgatattgtcttcagtctggtgactgtttccttgcaatagttgggatagaatctgaggcctcagacatgacaggcaggtcctccactactaaactatgccccagacccgaggggttctangcaagtgctctcctattgaaacatggccacagctcctcagtggta

SEQ ID NO: 786 - DNA, 493 bp, Rattus norvegicus
  Genbank Accession No. AI059444
tttttttttttttttttccaaaagtacacatttaatgaggctttgtactttaaatgggcctggaaaaagatcctaaaccaggcacatttccttcccccttaattgggtctcagtatgtaattcaggctgccctggaagtctgtgtggtcttcatggccaagggactttaggcccactcagctgcccaaatcccagggtataggagtgtctctcttgccagcctgtttcctgattactcaaagaggttttgttttggcagtgctggggatacaacccaggcttttttatttggttaaaaaaaaccctaaaaactatcactacaaaaacaaaacaaaacaaaaacaaaacaaaaaaaccctaatatattaaaagctacttctttctgtgaaagagaaaatttgaaattaaatttgttgtcacaagatgaatctttgtcttaagctgttttctcacagaaagtgtatgtttagaaaacgttattattccaagtgat

SEQ ID NO: 787 - DNA, 472 bp, Rattus norvegicus
  Genbank Accession No. AI059519
tttttttttttttttttcctggtgaccttcaatgatcaattttattataaagaacagtatcaaaatatacaaatctgcttatgaaccaccaagaaatgcagctttttaaagggccaagtgagtatcagctttttcagagtaggcagcttctccctctgaggtcttcctggagaaatggggttgatgtccatgggccacattttctatatatcctctcaataacttaaagggtgagtctggcttctgaatccagatgtctatcacaaatcctcatgggagagtggctgtgtggggttttcctctgtgacttcgctttgtgctgtctgcacacaagcgtcttctgtctcctcaaagccatccggacacacgcacacaaagctccctggaacattgtagcagttttcgtttcttctcttacaggctttttcttctagtgagcattcatctatgtctgcacactgtccactctgct

SEQ ID NO: 788 - DNA, 230 bp, Rattus norvegicus
  Genbank Accession No. AI059675
tttttttttttttttttccattttgacccaacatttattatccttttacaacatgtcgttttttatttttttttggtttagaaactggttatgattaggcttccaacagtaactcaaaatcatgtaaaataaaaatcaacctactttccatataaacacccagcaaactgaggccccttgtccacctacccaggctggctaaaggtaatggagggcttggacagcattga

SEQ ID NO: 789 - DNA, 214 bp, Rattus norvegicus
  Genbank Accession No. AI059947
  misc_feature (1)..(214): n = a or c or g or t
tttttttttttttttttaagtgtaattaatatattctaataaaaaacactagtaaaaaaatagagccatcctgggcaacttagtgagatccagcctctaaataaaaggtcaatgcagctcattggcagggcacacgctcagcacgtcaaaggtttagggctcagccttccacatgcaggtttcttcaaagcctccaaagcagtgtntgtgcctt

SEQ ID NO: 790 - DNA, 411 bp, Rattus norvegicus
  Genbank Accession No. AI059968
tttttttttttttttttgggtttgaaagttaattttattaaatgaagataatatatgaaatacattcatcatgactagaaaggtgtggccagatcatgtctcaggtctgtagcaaataatcttgactcatataaaagtaacttcaaaattccagtttctttaaatagttatgcacaaaacatacagatacacacatacacgtacagttcctaccactgtgggtcagaggtgccctctcccttcactgagctgccccccccccttcactgctcaaagacctgtgcaacggggttcgaccagatctgtctcctaaggatccgcctcgggctagcttagacttgcctgaggcttcagctccctagtcacacagggcgagtcccaaacactaggagaaatgttcgctcttcctta

SEQ ID NO: 791 - DNA, 337 bp, Rattus norvegicus
  Genbank Accession No. AI059971
tttttttttttttttttaaaggatctccatcttgtctttatttgcatgtggttacaattcataaatacacttgtactctttctcccgttcccaaactgtcctccacatgtggtaatgctactgaagcccccctgcccttctcactgtcctctctcccccaggagcaagggaggggtgctcctccatgcgacatcatgttcacccagggtctatcttggtccacgcagtacaagccctcaaggcctctgaaggttggggatgagcaccacaaagccttgcaaggtccccggatgtccttgaaagtgaccctgggcccagctccctcctctgccatgtt

SEQ ID NO: 792 - DNA, 372 bp, Rattus norvegicus
  Genbank Accession No. AI059974
tttttttttttttttttacaatgtttccaatggccataatttattatctcaccacaaggcacaatacacagagctttgaaggtccaatgcagtcgtcgtggcagaacgctccgcagccttggcacatgatcatggctttcaggctgcatgcacactggagagagatgctttctactgcactgctgtcagtgaacatctgtagggacagtgatgcagtgtggcctgtaccaaagctggctttgtggctcagctgcaccacaccaccagcgaggcctctgggaaaggcggccgagctggaggagtaattaaagctgctgggactcagctgcagtttggaaaacttcccgtacaaagcctgcttgatgctgagtt

SEQ ID NO: 793 - DNA, 430 bp, Rattus norvegicus
  Genbank Accession No. AI060053
tttttttttttttttttacagtaaacttttcggctacaaacctcagacatacacaaaagatcttccaaggacaagcatagcagggctagggaaacccaaactgactaatgtgttctcacagtataagctggcataaaaataaataagactctattagcacagcagcgacgataatgtacacataataatgcttggtggatgaatggtaactattctaattctagttctaaaagaaaagtttagtttaaaagtctatcttcaagagtcaatgctttgttttcccatagtgctcctgctgatttcagctttcaagtgtaaagtgaccatcttgagtgaatagctcaaatcgtattggctttgggaaaaaaataaatccttgctttattttggtatgacataaaaagactcactaagttcacatgttaactca

SEQ ID NO: 794 - DNA, 361 bp, Rattus norvegicus
  Genbank Accession No. AI060176
tttttttttttttttttaaactgtgaatatgggttttattatcaatactcaagtgtttacttaatttgcttacggtaataatatttggagtctttatattttaatattatctcagcaaccatgagctgactctgagatgataattatattgtaaataaaagctcaaatcttgattacttttatgggaatactgagatggaaaacaaagatgatggaacatccttagatttatgtttaatcaatgtgtgacttatacattacaaacaagacataaatgtaactcatttgattagtcttaaaaaccttgatttaaagtatcaattaaggaaataagcaagaagaggaaactacttctactatg

SEQ ID NO: 795 - DNA, 471 bp, Rattus norvegicus
  Genbank Accession No. AI060236
tttttttttttttttttcacattttattatgattttattatatatctctttccctggagttttgcaagtaaaaggttgcataagaaccaactcttcatctgtcctcaagttctatcccacaaaagtggatcatctcataactgcacgatgtacaatagccaatgactcaataaatactttacaaaaataaggcagttttttcttaaaacataaaaaattaggatttcctagacttcagctcccatgacccccttttatatttatttactgggaataatatttattggcagagaaaagttgctctattaagataaaatagacaaagcgaggcacgtattatttttcaacttgttttgctttttctttggaaagtgccactcctggctttacggctgaacttccttcagtcttctgagcctgttaagacagaacagaaatgctactgctggggctcttcagtacagttatgct

SEQ ID NO: 796 - DNA, 442 bp, Rattus norvegicus
  Genbank Accession No. AI060279
tttttttttttttttttgtgtttaactttatcctttataaagccatacatggatggtgagagtaagcagctgtacagaggggacagcatcagtgtacatacattcatgtccagaacacttagcatacatcagggtttatacaaggtggcagaggctataggcacaatgatacaaaatataaagtatatttccatctataaatacacagccgggggcaggggcagggcatggactccggatatgggtttcccagcagagggcctgggaggcagagttgggatgatcaggatgtgagggacgtcttacatttgattcgggtgacagaagggaagagactggggagatacctcatgcgcaccccaacgtgctcacacacatacgagccaaatgtgggtcctcatggagggctggactgtgaacactgacacacactgggtgtgtc

SEQ ID NO: 797 - DNA, 321 bp, Rattus norvegicus
  Genbank Accession No. AI069939
tttttttttttttttttagtgaaacgtcttagtctttattgagaacatctcagtcctttgtctacatgtgacagcatttcatgctcagttccggctgggctcggtgtgaggaagctcatgcaggctgtaacatgtggtatatacataaatatacatacagagaacactgaggattgtatcttagcaacacgtttcttggctgaattacattcatgtaaagtgtccaaactctaaaatcaaattaaaagtacataacccaaagcctggaaaagctaacagcttttaggggcttattccgtgaacattcctcatactgtgctt

SEQ ID NO: 798 - DNA, 490 bp, Rattus norvegicus
  Genbank Accession No. AI070067
tttttttttttttttttgcaggtttaactgattttaattgaacatgttggacacatggtgttgcattgccattaatcttagcatttgggacacagatcttaaagagttatacaataaacatttataaacattcacaaacaaaaacagtttgcaactttttgaggaattgtagaaacaagcaactaataacagccatgtggtagctggaacttgagattagtactttggtcttttcacttcaaccccgtcagcttccatcttcttcctcttctcgatgatcgcacttattttcttccactgtcgatcaagctctgccttatcattggtttctttgaagcgcctggttttccgtccttcagacatcttgatgccatactggaatgcagccttgggcaaagcctccttgttgttcatatactcgctgtactcctcctgagtatcaaaatcccagcggcctaaggggcccttcttgtcctcgtgccgaattctt

SEQ ID NO: 799 - DNA, 504 bp, Rattus norvegicus
  Genbank Accession No. AI070068
  misc_feature (1)..(504): n = a or c or g or t
tttttttttttttttttaaggcttaaccagtttattggaatgtctctgtagtagaaatttttaaaaaatatgcaagcgatctgtcttgctcagcacaatactaaagtagatgtgccttagctgcgaagtcccgggctcgagtcccggctcccgcgtcgagggtcgccgccctccgctgagttacgcacagttcactgtccagcggggtgggggacgcctcgccccacccctgcggcggtgtccagaccgtctgctgctgcgtgcagaggctggctgcatgattgccaggccttggctctaaagtctctgtctcctccagcctgaggtcccctccttcctgtcttggcgaccacctgtggtgctggctcctggctccatagcccaaggggcgggcgggcgcacactcccctctcctcgtctcagtctcggtgactccgcccctcccggaaggtatcacgggtagggtagcttttgagggattgttctggggaatganggggcgct

SEQ ID NO: 800 - DNA, 477 bp, Rattus norvegicus
  Genbank Accession No. AI070087
tttttttttttttttttatttggagtctgtttactggaagctttctgtccctgaggatctggacaacagcagcaggcagcagatgtcttattaattcgttgaaggcttggcccactcgacattgaggataagatggtcgtagccaaagccagacacccctgcaatggcacgcgcagcatcctcccggcggtgaaagctgataaaggcaaaacccttggactgcccagtggtcttgtccttggccaagtagattcgggagatggagccaaaaggccggaagagttcctgtaagtcagtctcacgagtgtcctcagacagattagtgacacggatggtggcattgtcatcagctctgcggtttggctgcatagactccccacggcggcttgccccatcccggagactaggaggcacatacttccctgtcttgttctgggcggcctgcacaggctccagttctcctggcaatttctcctt

SEQ ID NO: 801 - DNA, 512 bp, Rattus norvegicus
  Genbank Accession No. AI070122
tttttttttttttttttagtaaaaataagttttattgattacatataatttttaactatcctaacatatattataaacttttaagattagtattaaatgactttatatattttcccaagaatcatctaagttgtggtaccatgtttgttgaaaactaaaaattcaatttctccccagtcattcattacacacctattcgtagggagacagaaagatctctccaagctcacaccccagacctggacttcattacgcagaacacatcttccttcccagcaggcgtccccctttgttatacagaccctctccagtcatctgtcacgtactaaatctaccttcttatccagcgctgcctctggtcttccctgtggaaccagaaaggcatacacatcagtgaacagctgttctggactctgtattttgggttattcttttcattttggctggaaaccccaattgacaacaaaaataccaggcacccaggccaatgtttaacacaggatggaaagtgg

SEQ ID NO: 802 - DNA, 496 bp, Rattus norvegicus
  Genbank Accession No. AI070179
tttttttttttttttttaacattcctgaaattttaatctttatttagctcttggatgttcatatcctatcagtctgagtcttcagaagtaaagattccaaatccctggctcaaacgtcaacgaaagaaagctaacttttccttaagccaggtctcggtgaggtcgtctgtggtgcggatttcaaacacctttgtaagctccgcgatctgcaccagcctgtttttacttcccgcgtacatcatctgttgttcaggcttgcagcccacggggctggagaagatgaaacacaaagggtaggacaccctgccgtcgtcatgcacgtacttatagctatagaccacgaacctgggctgtctctctggcaactccaacttaagttcctctggggaaacattctggaattcgtcttctagcaccaccatctgccggtctttgtccactttcactggggagggatagaacacaggttacagaccctccccatcccaagggatac

SEQ ID NO: 803 - DNA, 402 bp, Rattus norvegicus
  Genbank Accession No. AI070195
tttttttttttttttttgctgcagcaaggcctgcgctttattgtgggtgatctaaaggaacacggttgcccagcaggagctgggccttgctcttggtcctggccacacagccctcaaccaccatacataaatagggacagactctgcataggtggccccttcagccacagagcaggagcccactggtaaggggcctcgtgcccagcctggcactgactccgtcccagcggtgctggccatggacattccacgctggccaggcagcttcagtccagttcgatggggctgctgtcatcctggctctcttccccttcttcctgctctgaggagcccatgaggctgctcagcaggttccctagcaagcctccataggaggatgtctgctttggcggcacaccgaag

SEQ ID NO: 804 - DNA, 417 bp, Rattus norvegicus
  Genbank Accession No. AI070314
tttttttttttttttttctcattttggtttcgtttttaatgcattttgtcagttttcttcatttttaagtcacaaacagcaggcactgaacagcagttccccccgctgctgccggcagtcaggccccgaggttacttgaggttctaggcagatgcaacagctagggaggccccagccacaggcagcttaggagaagtgtgctgcagatggaaggtgttccgggaatccaaggacgggggcgccggggacaagcacagcttgctcccacccccaaaccaggcgcctcctaaacttccctgtctggactcttggagcagccctcactgtggccagccggcatgcagggtagtcctccagccacccttgggagcccaagttcttttccaagaccccctacttgtccctttgcctgctcca

SEQ ID NO: 805 - DNA, 506 bp, Rattus norvegicus
  Genbank Accession No. AI070330
tttttttttttttttttcaatcaataaccacaagaatttaattatttaatacaactactaatctaatgtcaccaataaaatctaagcaatcacatcacaaaacaaagagttatattcagcaaacatgcattagtaatctatacaacttaacgttaccccagaaaaggaactggatataaaagtttgtataatttttggtggttttcaaatcttatggcacagattacccaaaaaattgtaaaaacagatttcaaacattttcaataaaatggtaaaaaattgagtaagcctttaagttttcatagttggctcaagataaaagcatcaagctggccccaatctgtctaaatggacagagaaatagctaaaatgactgacaccttagttacaatggtattggaagtctctcccttctatcaaaacccctttgggttaaatttccaatgcaaacgtgtcgttgtaaatactgtgagaatgtaaacttggagacatcctcgtgccgaatt

SEQ ID NO: 806 - DNA, 477 bp, Rattus norvegicus
  Genbank Accession No. AI070336
tttttttttttttttttagggaatcagaatttgtttttatatccctagagttataaacatttgtatcaaaatatttacaattatagtatatgaaatatcctattaatgaagaagccaaatacagtactagaataacccaccaatgcaatgcaaattacatgagacataaatgtcacagaaaagaagtaaaagacaagggaatgcatggttctttctctccagtcataaatcaactttttaacaaaatgtgactatctttttctgttaattttcttatgaacataagacagcctagaacaaatgtatggtggtcaaattataatttaagaattattatagctttcctgaccagtatctctaccatcagctcagcaattaagtaacctacttgaacattcccttaaacataatacactagagaaatatacttagtaatgatccctttacataaataccagcaagtatagcataacaact

SEQ ID NO: 807 - DNA, 329 bp, Rattus norvegicus
  Genbank Accession No. AI070410
  misc_feature (1)..(329): n = a or c or g or t
tttttttttttttttttccattgacgactttttgttacttagcttccttttttttttggtggggtgggggggtgggggtctggagctcaacatctcttcagaccagcctttacgtttcagatctgtccatttgattttagtcctacacacaatggtcaaaccttcggtttatggcaggatgactccctccaggagcatcgaaggtataaacatagcttggaagatacaaaggtgataggtggtagaaaacagttgtgtctaatactgtgttgggtcatcacctangcaaagagtggcttgaagggtatgcagaacctgcttatgattaa

SEQ ID NO: 808 - DNA, 253 bp, Rattus norvegicus
  Genbank Accession No. AI070419
tttttttttttttttttgagagtaccccgctactttttattagcaaacactagtggcacagtcgggctaaaaagcacgaattcccacatcataaagacagaaacatcttttgcttcttgctgatgtgaatggtaccattaccagaactccccagtgttgttgctccccaaagcagcttcctgatgaggtgggtattcttattgctgtgtgtaacatgttgcttctgcctggttgaccagcttaacattaatgg

SEQ ID NO: 809 - DNA, 332 bp, Rattus norvegicus
  Genbank Accession No. AI070421
tttttttttttttttttaacgtttcctaatgtctgctttctttgcaactgtgagtggcgatggtcgccagctcagaccaaggcgactgtgcaaacctctgaacgaggttttcctttctgacagaagttggtctatcggggttctttctcaacagacatgatttctagaaacacagcagccatcttgtgactacgaagcaaggagcaatgagattactgagaggaggccccgccctcactgagcattgatacggcactccgttagatataatactgtgttagtcacctgctccaaggttcaggctatgcggataacaagccctcgtgccgaat

SEQ ID NO: 810 - DNA, 352 bp, Rattus norvegicus
  Genbank Accession No. AI070497
tttttttttttttttttaaatactttagttcatatttcattgatttgaccttttgactcaggatcagagaatgaatccagcatgaaaacaagatgaaatgaaataaaacaacaaaaatccccagaaaacagaaacaaactatttaccattgaaatggcatttccctgtcggctaacttccattagtttttattgcatcatttttgaaatgccaagagagtggctttggacgtagtgtttgctgttcaactaaaccatagtgttcaattgcttgcgaccattagctaaacaccattttctgatgaactccctcaagagagaatgtataccttctaaaatgtgtctagcacata

SEQ ID NO: 811 - DNA, 523 bp, Rattus norvegicus
  Genbank Accession No. AI070523
tttttttttttttttttatatgtgactttttaataaaagtttctgccatcatattattcacatccaggtttccacaggtctggactcttcttcctacagatggagatgagactacttcattgaaaaaccagaacgagacaaaacctgagcacagtcaggttgtcttaggcttaagagtttctgggtttcgtccttggaggagttgaggatcttcccaaggcctcggaccacgaatattcttccagttttcaaaagtggagtcctttattttctcatactctgactctaaagttattttattcactttcaattttttctccaattcaggatcaatcttaattgtcacagcatcatatcggatttgtgaaaattcgcgaagaccaaaagaaccaccaacaaccagcaacaacatgggaactccatagcgaagggtcttgttcttacgcagagcgcgcaacacagcgggcgcaaccatggcagaaactgcggccgatttagccgcctccgcagagaccccaacgcc

SEQ ID NO: 812 - DNA, 286 bp, Rattus norvegicus
  Genbank Accession No. AI070611
tttttttttttttttttagttttgaagattaactttatttaggagtaaagcgctgatacagagacagataatgtgtgggtttttttttaaccttttgtttttaatttttaaatcagtgtggacaatatcatgctgttcattgatacaatacagccctgtcctgggtatacaagtctgtgacatcattcactacatgaatttacttcatgagacggcatagcagaataagactaactaaagatatatattcttagtaagaaaatgcctgaaataaacaaagtcacaa

SEQ ID NO: 813 - DNA, 303 bp, Rattus norvegicus
  Genbank Accession No. AI070621
tttttttttttttttctgaggtccttttatttttttcaaaggacccttttaaaaatttataactacaaaacagtcgccatacattctgccataaataaaaacaaacagtaaggcaggactacataagcaaactgagaacaaatgtttttcagaaagtgtgaaaatgttttacaatcataaagccatccagtttttaaaataaaactgtggaaaacgttcaagtggcacatacaagtcaccctggaaaaggaacaagatgtggcattgttgttttgtactgttatttaaaacctaatcttgctt

SEQ ID NO: 814 - DNA, 302 bp, Rattus norvegicus
  Genbank Accession No. AI070673
  misc_feature (1)..(302): n = a or c or g or t
tttttttttttttttttacataaaattatctcactccattttatttaagattttttatccagttagtaaaagaaagatgtgtctctctttatacatatgtacaagttcagttataaaaatagacagcacatttaagagaaaaaaggcttggcattttctgattccctctaaagagcatctgtacacaggagtcagggtttgggtangggaatttttatgatttaaattaaatgattcncctacacctactccccccccccaaaaaaaaagtgtttaaaaaatcaatctatctaaactcaatt

SEQ ID NO: 815 - DNA, 178 bp, Rattus norvegicus
  Genbank Accession No. AI070715
ttttttttttttttattactgccattgcctttattgatggactcagagacgggatttaaattgactttttccaccccaataacttaacaaagctgatttgatcaaatctttgacatataatgctcatgttagcatcttggcttctttgtgtcagttgagatggtgaaaagccgtttca

SEQ ID NO: 816 - DNA, 329 bp, Rattus norvegicus
  Genbank Accession No. AI070784
ttttttttttttttcttaggaaggacatttaattggggggaggggaggtatacagattcacaggttcagtctattatcaaggtggaaggaatgtcagtgtccaagcagacatgatgctggagagagttctatatcttgatcagaaggcagccagaagactcttctgccctgggcagagtttaagcatggggtctcaaagcccatcccccctccacagtgacatacttcctcaaaggccacatctactccaaaaaggccatacctcctaacactgccacttgccatgggccaagtatatttaaaccaccgtacctttgaagatcacagta

SEQ ID NO: 817 - DNA, 457 bp, Rattus norvegicus
  Genbank Accession No. AI070824
tttttttttttttttttaacaatcaaaagaattaaatttatttttcacacaacacagttcgtagttcatggttcatggtgtggagtggtggctgggtgtagggcatttaggaccctggaaggccctttacttcttcttctttctgcggccccagcgctgctggccagctttcccccttcctccatcctctcttcggctcttccaggtaggcatgggagcctccagctcgcttgggcgccccccacggtctggcacatcacccataagcaccttgttgattgcacagctggtccctcgtcgggcagccacactggtagctgggaccaggcgagaaaggtcagctcgggcagccagaacatgtgcggtagagacatcagactctggagtcagaagccctcggattgggcagagcactgccttcatgacctcactgtgggcctctgcctcgtgccgaatt

SEQ ID NO: 818 - DNA, 330 bp, Rattus norvegicus
  Genbank Accession No. AI070839
tttttttttttttttttagatccattacccatgatttatttaaaacacactaaattcttgctagattaatagtccatgtgtgatgtcaacaggactttaagcaatgaaaacaatttcagtttatgcagaattagctcctcttttcttctgattcttgcaaaattttcaccttttcttttaattccttctgatctctggaatactgttcaaatattggttgataaatatacattcctccagcaactccaagggcggcagcaaaaagcagttgtggacgcgtcaatctccggagcattgctacggcgagtggcgcacagctgagcgtgacta

SEQ ID NO: 819 - DNA, 286 bp, Rattus norvegicus
  Genbank Accession No. AI070868
tttttttttttttttttgcaagagaaaggagcaggacgcacgggtccctcttttacttcacaacaggaaatgtcacagacaccatcaaaatgggagggggcggggggagaggagagcaccagttctgtccagcctaaggaggcggcaggaatggcaaagtggaggcagggagtaggtggggctccaaagcccccagcccactccgtccgaggtgagcttcctgagtaatgaagggtctgggggcctggcaagcctcattggggggtccggtttcttttctgcactc

SEQ ID NO: 820 - DNA, 386 bp, Rattus norvegicus
  Genbank Accession No. AI070911
tttttttttttttttttcactctacaatcgactttttattaagattataaatttaaacaaataacccgaacagttttacccggtgagatacaattcagtatgcacaaaaccacaggaggaaaaagggccgggaaggcaaggttggcaacttgttttggagtccctggggtgttgatggcagagacccagaggggggcactaggcaaacctcaccttctcacaacaaaaggcttttaaattaaacaaaatctatcgagctgaggacgcagacagggttctcacaggctggaacaatgctggtttcatgagatgggaccaaaggctgaagcacgacaaggtaacttagaagcgcgcacaaacacgacagctgaccaggagctaagcga

SEQ ID NO: 821 - DNA, 452 bp, Rattus norvegicus
  Genbank Accession No. AI071024
tttttttttttttttttgatgcatttgaatctttattctacaacacgagcgacataaatacattatcttttaaaatattttctctttagaatttattttttacttcagataaaatatacacaaaatacacttgcaagcttgctgacagagaccccaagaaaacagtgaaccgacaggttatatcaaaccagttatgctagcacgtttgaaggagaatggtttttaggactttgtaaatgtggctaaatgagccaaaacaaaagtgatgcttccttgatgagccttttggagtaaacaaaaataattcaaggctcctggtgaattggttgcaaggatgaaccttccatcttctaggtaaaatggtaagtctactcattcattatggctatacttagcttcatttatttatactttttaatgaaaataaattcattctttggtataatacaaga

SEQ ID NO: 822 - DNA, 354 bp, Rattus norvegicus
  Genbank Accession No. AI071098
tttttttttttttttttatggagggactggttctttattcaaaatgtcacttgtcactattcagtatcaaaacagttgcactacagggttctctttctccggttggaggagtacaaacaagccaggaatctgcagggcgcccacctaacaggctgagaagaaaccacctgaacatggcaattgggtggggacacttgaaagatcagcacaccactagcccatagactgcaaagaattctcacagccagtgggttggccaaggtaacctaaccccccaaaaacaattttatattattttgaaatttaaaaagttcttttttttttttaaacataagctattcaagcctcgtgccg

SEQ ID NO: 823 - DNA, 375 bp, Rattus norvegicus
  Genbank Accession No. AI071137
  misc_feature (1)..(375): n = a or c or g or t
tttttttttttttttttcaacttgctcagtgctttattgaaccaaggccccaacagaggatgcattgggggccttccagcatgaccttttcatatgtagattctgaacccaaaagttgcttaccaaaatacttcactcgatttgtgtgcatacatgtgtacaaggcactgtgcatccatgaccatccaacaaagggcctagactctgtcactagtacagcaacacggaaaaaccatgcatactctggaccagatatggaaagaaggacagagagggacagggagggacagagaaggaccaaaaagtgaagctcagtgactggttcattgcccagcaacaagtgctgaccagcgaggctctanggttcacagcagt

SEQ ID NO: 824 - DNA, 377 bp, Rattus norvegicus
  Genbank Accession No. AI071139
tttttttttttttttttgaaaaataatgaaataagggatatttctgaataaatggaaatgtagaataatttaaccttaaaaacaatccattcccagcagcacatgaacaaactgtgacatcacaaccagagcacgcacaggaagacttgtgccctggagaagatctacaactccacagtgttgtaaacgagacgagacgagagctgttctcagtctgcacacggtggtgagtctaatgaatgtactggtacctgtgagggagggcacgctgcacacacaaagctgctttctcgcctccatccagacacacgatacatcatcttacagcatctgtacacagagaattcaaacctgcacaacattctcaacgtaatcac

SEQ ID NO: 825 - DNA, 560 bp, Rattus norvegicus
  Genbank Accession No. AI071173
tttttttttttttttttgcctttagggacacttttacttggaaaattacaacactagtacaagtcaagtcttacacatttaacatttgcttgttgaaagcaattcataatatcaaaattaatcatgttttactttttcttcacaagaacacaaaaatgaaggggaacttaaaacagaaaatttaaaaaggtaacacaacttctcttattagtccttgatagttatgacagagactttccatcttgtgtttctctgcatggagaccttgatccaaagtcttatttgtttctagtatctgcttctgcctccccctctatcagatcggctccctccacggccacctcctcttggtgctccacggcttgaactgctgtaggaatcacgtggaggagggtaccccctttccatagacgggggaagccctcgttcttgtctgccgacgcgatcacggccacttgagtagagatcacttctgctgcttgagtaactgtctcgacttccaccatatccatcacgtgagctgctgtaatcatcatagcggctgcttcctccataagatg

SEQ ID NO: 826 - DNA, 555 bp, Rattus norvegicus
  Genbank Accession No. AI071185
  misc_feature (1)..(555): n = a or c or g or t
tttttttttttttttttgttttaatttggactttattgaaacagcaaaaacataactaatgttttgtggattgttttttaaacaaaattgaaatgaaaaacatcacaaataaatgtcattaacatttctggtgagaaatccagtgacaggaaaacataaacaatactgagcaaagtcttctcccacctagactattcaagatactgcctggtcctgggttgggtttagccatgttttctaacaaaggcttctattctgtaaagagaagattggacagcttgtgtagaacattcatggttactattactatatgttctgtggccacatgcacttaacagccacacatgtgcacaaagtcatcattcctattaggcttagctaacaacaagaaaaaagaatacctttccaccttgttctgcaatgtgacaagcgttaagaagagggaaccaatgtatgtgttcagccattccatatagtcattcctttatggcactttccaggagttaattaaaggagcgccaagatctgcangaattcaagccttacctaaaaata

SEQ ID NO: 827 - DNA, 292 bp, Rattus norvegicus
  Genbank Accession No. AI071410
tttttttttttttttttacttttgaggtaattttattatctagttccaaggctagacttattaagaggctttgattcattagattttcctcaatatagtttctctgtaaacaatctgagctacagcaatcattcccatggcaccaccttgattctgacaaaagagaatcacaaaccctataacgtggttacagtagggcaagcatcttgaactgggctttttaaagatgaagttcttgagcattttctactgggaccaggcatgcgagtgcctatctggaaccccagagctc

SEQ ID NO: 828 - DNA, 474 bp, Rattus norvegicus
  Genbank Accession No. AI071490
tttttttttttttttttagttataaaataaaacatttttaatggacaaagtaatcatatatatatgtgtgtgtgtatgtgtgtgagacttagcaaacaaaggaagaatgtgaagcagtttgtttttttactatttacaaaatgccatttggagtggaggtggccatcttcagtaacttgggaaatgtctttcacatgaagtggtcactgaagtgtggctcctgggattggctcagaaaggccacacactgtcctgggaggaagcatccccctctagggagcaccagaaaggctcagtcttctgtctcctcataggtagtctcgtcaaagggcctgtccagcagaggcagcggccggtggcgggagtacttcagttgcagcagatccccaacttcatctatctccttcaaagccgtgtcaagtatttctttggtatgagccgctgacaggcaaaatctggctctggactcaatga

SEQ ID NO: 829 - DNA, 515 bp, Rattus norvegicus
  Genbank Accession No. AI071509
tttttttttttttttttgtgagcacaagggtaaaagcaaagaccaacaatgaatttgcagcatgtggagttcacaatgcttaatgaacaggaacaacttggctcttcagaatgaatcaattaggtgaatgggtaaaaggtaagtaaaacatatggaagtttccctatgcctggtctttcttgaaccagtcatatttacaaattgaaatgtttatgaaacaaggcaactccccatgtggcatgggagacaatgcaggagatagagctcctgctacaacttcctctagtaattaggaagctatgtgtctctgttagaaggatgttaacaagctcctgcagtttccactctagcaagaaatcaaagagacccaaagcagacagctcgcttcagtaaaaggattatgaagtctggttattaaggcacagacagaatgcttgaccacagttctctttctgaagagactttctaaaacaattagcttctagggccagcaggatttgctaactgaagagcaa

SEQ ID NO: 830 - DNA, 543 bp, Rattus norvegicus
  Genbank Accession No. AI071536
tttttttttttttttttcagtttttatcaatttttattgtgtccttgaaaataaactttaaaagcatttccaacttgattcaaaataaaaatagcaacaaaaacgaagccaaaatttataattctcacctggtacctgccacctttttgagtttgggcaggctgaaaaaagttaaaaaaaaaacaaaccaaaaaaccaaaaacccccacaaatgaccttcattttaccgttcccttcatttatgtgtaatcttactacattaaaaaaaaaaaaatggtcaaaggcttaacactgtttccagatttcagaatttgacatagttttaaatatgtggcaaaaatacaacaagaaatccgaatgtgatggaattaatgttaggataaacaagcttcatatcctaataaggaactaaagaatccaaaaacatttgtgacactataaagttatttattaactatacacagaatatgtcccctataaaatgtacaagtagatcactaaaaagtcttatccggtaaacactttctttaatacagaatatac

SEQ ID NO: 831 - DNA, 456 bp, Rattus norvegicus
  Genbank Accession No. AI071566
tttttttttttttttttaagaaaagaaggcttatctttattatttttaattacatataggtatgtgtatctgtgtatgagtgcattgcctacagaggtcagaggtgtcaaaaaacctacagctgaagttatagatagtgtgagtcttctgacatgggcactgggtctcctggaagagcagcaaaagttcttaactactgagccatcttgtcccagccgtccctgggacaaaagtcttcaaacccattccagcctggctattctgcggtgttctctacacagcctttccagcgcagggacagggcctcaatcgtgtcccgcagcatctgtgtccagtcatctcctctccgcattggggtacagcgtgtctccttgtgctccagggccaagatctctgcgggggtctcaggagtcagcccagccgcctggactgcttctgggaatttgactgctgaag

SEQ ID NO: 832 - DNA, 345 bp, Rattus norvegicus
  Genbank Accession No. AI071568
tttttttttttttttttcagacttctcagctgttttattattaatattatcttctcctttaagcatccctttaagggtgaaatgaaattcaaccatttacagagaaaatgatttcagaatgtacatattgattttcctttacaaaaaaaataatactattattattattggtgtccttaaattacacatttcccagggccctaccttctgcttgggtgagtcctgccttcccaccctgaatctcacctttgttcccgaagcttcgtcaagcttgtcccttataaccactgtgacccctgggtgaacgaggccagctggatgcctgtagaggcttccttgggtcta

SEQ ID NO: 833 - DNA, 498 bp, Rattus norvegicus
  Genbank Accession No. AI071578
tttttttttttttttttaccctaaagcttgcatatttattgaacaaatacgactaaaatagctaaaatacattgggtacttatggaaggaccacatgttacaaaagcctgcgttttcagcagcgtacaactgcaactctacgtaaatgccacaaatgcacaataccgtttccttgctctatttacatagctgatatatctaccctaacagaggtgggggtagggaggatgcacaagaaactcaggccagaggggaagcaagagagaatgagagggacagtgcatgcgtcattggtgtctaacagtcagaagcgcaaacagttcagaacaaggcctgccctgtcaaaggaagagctaaagacgttatataaaaattaaggtgggctttcagtccggctaacacaacaacattccgtgaagagacggcattgtcagattttatttttgtttatccatttcattgggagcaaggacaaaaatgtaaaatctataccttgct

SEQ ID NO: 834 - DNA, 533 bp, Rattus norvegicus
  Genbank Accession No. AI071581
  misc_feature (1)..(533): n = a or c or g or t
tttttttttttttttttaggattctagggtttattggcattaattccttgacatctgtcactcattcacaccttcaacactgaatcagatctgttgggacagatctcatcccaaggatgagagacaagatcaaaccaccatagccaagcaatagtatcttcagagaacattcttcagagatgtggaaagatttgtcagtaccagaaccaagtcacagtggcatgatgttgcttgtctgcaattccagtacttgggaagctgaaacagaaaggctgacaactgcaggacagcctggccctcatgagtaagggccaaaagtaaagcagagaagttaaagagaaatggtttttatacattttatacctgacacattttccaaccttggntcatacttttattgtttatatttgcttcagaacaaggcatatttcagaaattctcactccaagtcacagctgcttctgttacacatatgctgtgttctgacacacatctttttgtgccagagaattttcttacaagtaagaagtcat

SEQ ID NO: 835 - DNA, 372 bp, Rattus norvegicus
  Genbank Accession No. AI071646
tttttttttttttttttcagaccaaatgatcaattttattcaagcacaaaaatgacagttttcgtttttcttcatctctttgatgaagaaacaccattataagtccaaattggttttggaagcagaggtgcttcttagagaaccccaaagaatacattgctcacagtttttgattttaggattcagctttctttcccacgttattgacactgagggatacctgatgctgttttaatagtgaaagaaggcactaaagaacggggagaggctgagggcaaatgggaggggcaacggatggtgcaaagacccatgacaggtaaaaggagaagcctggagtcctgtatgtgagcacgaaaatgagccctgaagttc

SEQ ID NO: 836 - DNA, 191 bp, Rattus norvegicus
  Genbank Accession No. AI071690
tttttttttttttttttaatgatttaattaatccaccattatgtacaaagattacatccgttagtaagatcacaattttcaaaaactggtccaaaatccgtctctggttataaactctgacaatggttcacactcgagacaggatttccgcatcgttccctcataaacagctgcatgcgttcaaagcattc

SEQ ID NO: 837 - DNA, 416 bp, Rattus norvegicus
  Genbank Accession No. AI072008
tttttttttttttttttggaaaaaaaaaatctttaatggaatctgctctcaaataatacgttacaacaaaaatatacagaatgtacacaatacaaaaatatttataaaccagcgttgtggctagtgtttcgttcttcaattagtcctgggaggggcagctcacggacgggcactgtttttaaggcagaggagagtcaacagtttgcagccagccctgggaagcacacagcactgggtaatcctcattatctgcaaactgaattggacactagaggaagatctgggttcggtgagcgatgcctccactaatgctctaggcaagaatggttcgcttggaaatggagagccaaaagagcccccattagggagcttctcctaattaaaaaaaatcaagtgatgaatgatgtcattaaaga

SEQ ID NO: 838 - DNA, 454 bp, Rattus norvegicus
  Genbank Accession No. AI072050
tttttttttttttttttcattttttaaaaagttctattttgtctttaggaattacatcagaaacttacatctgtaagtacagaactcaaagttaatttgtagtcgagtttaaaaagataaatagtagagtcagaaatatttaagcaagtacatcaaaccatttattaaacagggctttgtgtagcctcctgtcaagagataacctctagtgcttcagagtggagaacaagagtggctgttgttctgaagtgggtattgctgtgttgctgagtgtgatataaaactccaggctcaaatgatccacgcacttccccttctaaagtgctgaggctaaatggctcagttaattttgggacagtcaccaaggagggaatacagatatccacagaaatagtcatcagaatgatacattatccaggctttgaatacgtttctactatgaatccattttcca

SEQ ID NO: 839 - DNA, 340 bp, Rattus norvegicus
  Genbank Accession No. AI072213
tttttttttttttttttcatactccctacatctttattgagcaagcatatatccaaggttactcctgtgcatctacggccagtttggtactaggagacggccacatagttattatctgtattgttcacaaattacaaaacttaaagatgaaatgtccacaaggattgtcaagacagcaggtgcttctgtgtccaagatgccagtgtctaccggcatcaagatagttgtacaatctagtgtagacatactgctcacaaggatccaagctgctgttttggctttaactggcagcctcgtctgatcaccagaattagctgtttctatcctttaccaggagcca

SEQ ID NO: 840 - DNA, 496 bp, Rattus norvegicus
  Genbank Accession No. AI072405
tttttttttttttttttgggatttacagaggtttaatgaatgagccttttccagcagcatttaacacatcactcaaaagaacaagtcttaactgagaaatacaggctgcctcattttcacagtgaagtccaggtagtgaaaacagtaagacaccttccacaaaggaaggagaagcaggatgagtccagagtttgaaaggtgcccaaaccgtcacatccagcctgatcgtccactgacttcgtttgagtctttgggagtggtcattccttcttgttactcagttggttgttgtgcagccacggaaggaagaagctgaacatgaggatcatcagcagtacgcctagagaaggagcaacccaatatactacgaaaaacttatagaacgattcgtcaaagcacgggaagtgcagcgaaagtgccagtgctgggttaaacagcgctcctgtgaggctccctcctgcataggccaaaaaggtgatgagtgcagccagcacgt

SEQ ID NO: 841 - DNA, 475 bp, Rattus norvegicus
  Genbank Accession No. AI072425
tttttttttttttttttcaggtaacaggctccttccttgatttactcacagatgaaaagattaaaacatcagcagatcaaataaaactcagggcaattcataaggcactttgggcagcagcaatgggctgaaatgggagagatgagcacacactcaacccggcctaggagtgccttcgccgacagggctgtatcgcaacactagggtgtcgtgaacaggcttccagacatggtactcagtacacgacctagctggtcacgtgagtactgggtcctcgatgccgtggtcggggttgcaggtgaaagcgatggtgatggcgtagcgggtgccccagaggactttctccactcggtgcaggttctcagaacctgaagtaaagaatgagactcgaccagctctgggctccactgtcttgttggacccttcctccatgaacacaaagcgccctccaccgaagtcctctaagtaatccgat

SEQ ID NO: 842 - DNA, 501 bp, Rattus norvegicus
  Genbank Accession No. AI072439
tttttttttttttttttccattctgtattttattactgaaatacgttgtcttacccaacccacccaaaaataaaaatcttacccttgtcctctaatctttcccttatccccagtcccatccccggccctgcacaagtgccccggatttcctgcccattggctatatcggagtgtgtccattatgtagcaacgtggaagcctctgtggagagcacagagtgggtgaaggacccttaaaaaggtgctcatttgagagccctggccacttgctcataggcagaaaacttggcaaatatgtccagccccgaggtgttggattcggggttcagagcagccaactttgggtacctgggagggcacagcacggcctccaggaactcctcgattttgttggtatctgtgtgcacttcggtgccgtagagcaagaacgggagctgcccaccggggcaaagcttctgtaccgtctctgtccgtctcttggtgtccacggtggtaacgttga

SEQ ID NO: 843 - DNA, 284 bp, Rattus norvegicus
  Genbank Accession No. AI072521
tttttttttttttttttaggacatttttagggttttattttatacattacacattcccatttatacatatgtattgaatacttgctatacatccagcagtgttctaagaattgtaaggatggacagacattaaagtgcagttagtaaagcttctcttgtaatgtgagggagataggaagtcagtggtcacgaagtcctcaagaaaaggaaagtatactaaagacctccacacagatgacatttaaggcctcagacaatttgagcaacaggaggctagtgtggtt

SEQ ID NO: 844 - DNA, 469 bp, Rattus norvegicus
  Genbank Accession No. AI072550
tttttttttttttttttgccagttattgcatttattattcatcagaaaaattaagtgactaacaccattgtgctcattggtctttcccaagaaaagaagggaattttatcccaatttctagaccacagttgtaggccgtggggaaagacaacggcagcagttatagctaacggttgatgcatagacgtgcaaggatttttctgcacactgtcttagcaatgagcgtgttctccctcaagtggctcattaaaacatgttacgtggttttcaccatgaatttactcagtgtattggcgagaggacagcttcgccattcttactgaactaatgagcacagtattgctgttttagcccagaacaattcgttactcttttgaaaagcaccttaggtttattttttcttccttccaaattgctcatagcaaacctttaacatttccccttctttttttggaatgaaagccttttt

SEQ ID NO: 845 - DNA, 144 bp, Rattus norvegicus
  Genbank Accession No. AI072559
tttttttttttttttgaagtggcataatatagaagtctgcacataacatttacgttcaggatggcagtagcactccaatatagattacgctagaaaactttggacttcaactgccgctgcgtgtctgggctcttccttaactgg

SEQ ID NO: 846 - DNA, 333 bp, Rattus norvegicus
  Genbank Accession No. AI072634
tttttttttttttttttggagtctaaacttttattggtccctcagtccccaaggggttcccttcttctgagccttagtgcctcagaactctggtatcattggtctcggacaccactttgccatccacgaccttacgggtagttgtcctctggacagtttgcatggagttgctggagtccagggcgtcgttgagactgaaatcgtccccatcctccaacaagcggcggtaggtggcaatctccgcctcaagcttgaccttgatgttcaacagggcttcgtattcctgggtctggcgctgtccttctgcccgagtttgtgccagctctgattcca

SEQ ID NO: 847 - DNA, 468 bp, Rattus norvegicus
  Genbank Accession No. AI072658
  misc_feature (1)..(468): n = a or c or g or t
tttttttttttttttttgaagcttttaaacccttttattttttattttttttaaataaatgacaaaacttttgattgattcctaaccgcccagctccctcatcagacatttgggggctggagtttggcactgcaggagtgtaggaaggaatggagccctagcagtatagcctgggattagtcctctccctcagagcataaggtggcctgtgtcaggaaagactggactaatgtttatgtgccacacaccaaggcaaacctcctggccaataatgtgtccaagctggatgcccaccttacggatgagggagggtggccggcttccaggagctttgggcctggacccatagacccattgccaacaagagtcatgtgcaggattagaacccagagctttatangggtagctacgtcncggaccccagagactatacacagggctttttagtgttgggtttctgttctctct

SEQ ID NO: 848 - DNA, 304 bp, Rattus norvegicus
  Genbank Accession No. AI072695
tttttttttttttttttggagtctgaatatgagtttattgcacgtgtagtcctagacaggcagcaaggggaggaccaatacaggtcccacctaggtaagcctctcactggcttgtgtcctggggcatgatcctggaactttctggaggcagagagggttctgttggaggctgcctctgctggtgcttctgctgaatcctggctctgttggccctggccctggcccgagtgtcattgtagatggctgtgatgatccgatccttttcgtccatgaagctgcgatgcacctgctccagcttcctgaa

SEQ ID NO: 849 - DNA, 326 bp, Rattus norvegicus
  Genbank Accession No. AI072755
tttttttttttttttttggattgatcatacacattctttattgtccccatcccattaaacccggacattgcccgttcctccaacaaccccccccactacagagttgatctcctagccagtaccaatccttgagtcacctaccccgtcacctaccctgtgagagaaagcctattgttctcagttgtacatttctctagaagcagtgacatgggaccctgttgtcctcttccagtgttttctgtgaccagcagagctggcactggagctgagggagggtgtgctcctgcccgagtgtcctcagaggagcccttctaaagtctagagat

SEQ ID NO: 850 - DNA, 350 bp, Rattus norvegicus
  Genbank Accession No. AI072841
  misc_feature (1)..(350): n = a or c or g or t
tttttttttttttttttggtgtgagctctatggaagcccagaacgtatctttaatctttaatgtgggccccgggccctgcctccccaccccagcccagatgacatatttacaggatgcggagggacccaggtccaggccaggtgaatgcagccccctcctctcttctttcctgggtgctgccaggtcaggccctgctanggtanggcaggaggatgcaggaagttggggcccccgtggggactggtcacaggaagtgttgtgttcttcaccaaggacacatgtggtcatgtccttgtatgcagaggccttcacagtggtacagaggtgtggattcacatgtctgcgccca

SEQ ID NO: 851 - DNA, 387 bp, Rattus norvegicus
  Genbank Accession No. AI072842
tttttttttttttttttgacatttcttaaatttattgaataattcttggctgggagaggaaagatcacaggcttgaacaagagtaaagacaaaagaacaattaattgcaaatgattacaaaagtaatttctgaaacagtttgaaccactgctaaacaaaactttagtgcactttgaagttccgagtttgataaatgaacattaaattactcaagagcagaaagagagattactactacgcacagtatacgaccttagtgtgctaaatgagcaaacccaaataagtggccacagttactcaaagttacttctactaaatattcattaagtgaacaagaatgcagattacttgaaacacagcacaagtaactgaaggcagcaaatcccc

SEQ ID NO: 852 - DNA, 455 bp, Rattus norvegicus
  Genbank Accession No. AI073021
tttttttttttttttttgaagaaaagtcatttattaaatagagtccggttaggatctccttcccgttcatggtgcatggcctccttccagggatgggagtcgggtgcactggaaccccacaggaaactttgaagtatccagttctagggaattatagccaatattctgagagagcaagtctgagatgagagccgagaattgcaagtgttggacaagcagtcaaggaaactcctcacctttggcgaaacctaggcaggatggcaggagcagctattctgcaatggccgctcacctgggacataccactctccttgggcaggatgtgaccccatgttgtcccccagactcctctcctccttgcttctcttcctttcctgtcaagtctcacctccctttctacatctcagttctgtttggtgttgacagaagtttgaatgtcacaatactgcatgtgt

SEQ ID NO: 853 - DNA, 195 bp, Rattus norvegicus
  Genbank Accession No. AI073223
tttttttttttttttttaatcacaacacatttatttttagagaacatgaaggacgacacaaaccaggaagtactgaaacagtaagtattactaactagaacacaagataatttaagttagaagtttttatttatatagagatgtcttactgtgttaatctagctggcctagaattagctatgtagatgatttagg

SEQ ID NO: 854 - DNA, 516 bp, Rattus norvegicus
  Genbank Accession No. AI100768
atgactccttcatattgtattttgatgttctaagctattgtagatcaaaacactttattatcaagaaatacactagtgagcatattttctaatacagaaaggaaataaatgacttggctctggagacgtgtttttcttatctcatattgataatatgatacagtcacattaataagtctgaaaactactttcattctttctacacataagcaacaggcagtatgtgcaaaagtatgaattccagaagctgtggtgtgtgcatgcacactgattttctttatagtgaacagccacttctaatatctcataacagcatgtatacagacaatggtcacagatctccatcaaagccgcagtaactgaagataatgcaggcttgaaggttaacaggaagctgccgctcaagagtttccactcctcatcaaaggactctgtgggaccaacgtcttcttccctgatgcaaatgggcttgtttcaagtttctctggctactgaaatgctgctcggatgactctg

SEQ ID NO: 855 - DNA, 476 bp, Rattus norvegicus
  Genbank Accession No. AI100835
acctttatttggactggacacacaagtcagacagtaataaccacagcaatatggcttgtgagcaaaaccagcactgcctcgcacccgctgctctttgtttctgtaaggagagccagtggaacaaacagcgacactcactggacagtcagttaccctcacacatgggaaggacaaatggatgtactgtggagcccagtggtgcaagatgccagagtagggacagacgtgtggaagagcggttcatggagttagcgccagaataactcagagaccaggtgatctgttcaagatagaaatggaggtgccttccttccactgtgacccatttctggcttggactcatgtgggccggagaccatgttaaaggtgctaaagagacaagacactgctcccatttgttggctatcaaggtccagttgaggacttaggtgcgtgcactctaagtcagaagctatccggcttctcagctgtcggtt

SEQ ID NO: 856 - DNA, 499 bp, Rattus norvegicus
  Genbank Accession No. AI100842
acgttaacaaggaaaaatgtttaataatgaacatttctgacaattctgaactctagtatatatcagaaaacaatgaacaaattattggggacaattagaccttaaccctgtgcaatctcacatcccaggcccctggacaccatactctgctggcaaacacacagtggcagaggggaggggtggccaaggtgctgtcaagtctgtactttccttcctgcctggctaagtcctcacattgtcccccaccagtatctgaggccatagtgtcccatacaggggctgggctagagagtacctcccctcagcaggtaatgattgcagccccagcacacttagggcttccaggaaccccatggtcctctctgattctcacaacaaccctgtgaggaaggtgggaggaggaggtgaccctgtggtgccatggaaactgaggctctaggaggtgctatgactgagctgggagggagtgtatccgccatgcagcaagggggcccaggtg

SEQ ID NO: 857 - DNA, 498 bp, Rattus norvegicus
  Genbank Accession No. AI101006
ttgctgaccagacccagcgctgggtcctcacagggcatcccctcacacacctcacaacagccctgtgaggtagggttcttcttgtacagtccaacctcagacccctgagacctgcccctagctctcgcagttagtataagcagaacaagggactccaactcttgctttcattgttctagaaaatacaaaagctttggtcccaatttacactaatcttaaattttggggggttttcaaacgcccattccccattgtcttttttttttttttaagtcatcatcctttggttttttgagacagggtctcactctgtaggccaggtttgcccaggactatacactctaggctggcctcaaacttacagcaatcctcctgcctaactgtcctgactgctgggattacaggtgtatgccacacccgattccacaattttctcttaaatttgggactgaccactgctgcaaggcctggggtcagcccttactcgagtgtgcatcc

SEQ ID NO: 858 - DNA, 289 bp, Rattus norvegicus
  Genbank Accession No. AI101099
  misc_feature (1)..(289): n = a or c or g or t
acaccattgtgaggacgcccccacttcaggcgcagcagctgcacttgtccgaagcctctttgcagatgcagccctgggagcacttcgcacagcccacggggcagcaggaacagcagcctgggggaaaaaagttgagcgtgagcgagaaaccgagttagaggcaccctggacgctctgggaaggtgcggcgggctagggaccgcaggggcgcgaagggaaagggtagagaaaataaatccaactcacttttcttgcaggaggtgcatntgcattgtttgcatttgcagga

SEQ ID NO: 859 - DNA, 416 bp, Rattus norvegicus
  Genbank Accession No. AI101157
acgtgaaccagtcccgtcaccttttattggacactagttcttggttggggtgtgaaggttaagcagatcggagcgggccaggcggttacactcggccatgcagtgttctccacagtgacccctcttcagtggtacttgcgtcgccgttcgtgtttgagttccttgtaagaaatgcagtagctgaaaaccacgtaggctgccagcaccatgttaatccctgagatgctgcctttccgaacgttgatgtacttgttgtaataccggtcatagcctctccgaaaggctcctgcaataccactgggggtgaaatcccgcatcaatatccagcttggcagctctctaagtttaacctccatgagcttcttctccttcaatggcacgatagacgccatcttgaacctggtgcccctcgtgcc

SEQ ID NO: 860 - DNA, 533 bp, Rattus norvegicus
  Genbank Accession No. AI101160
aaagaataactttgttttattatcatgatttcagaaaaaacaaacaaagaaacgaacaaacaaagaacaggacagacagttcaagaaaggacacagtcagtgtcccgttttaagttccaaatttcttctttttgatgggtggtgggagctgagcaatgatgtcatccagaggtcgttctactgccacaagtgtcctttcatccaaaagatccataaagagtaagggcttatatatcttagacattttaaatccatgggtcgtgcgcctcaggaagacatctgattcgtttttcggaggaagcggattatagagcacagttttgtcatttggaagtggcaaggacttgtcaatgatgcagaacatgtaggcgtcatggaggaggatgtgcatgggtctcttgggatggatgctgatgtgtgtgatgggagtatccctttggagccacagctggtgaaatccttgcttttggacagagcggttccactctgtatactgcttgtctgggatgctgaactcaaatacctgctggtca

SEQ ID NO: 861 - DNA, 374 bp, Rattus norvegicus
  Genbank Accession No. AI101256
aacaatcacataaggaagcatttatttgaggttgaacatgaagtcacacaaataaaaatttgtataaacacaaatccacattgagtcataacacagggaaggaacaaaggacagattaacaaaggaactaattggcagctatgtacagtgggacacaattgtgtcatgtacactacaaagtctttacaaaataatcatcttaggtcaacagaagatcaagcaaccttcaatgtcgtcctgtaagatggtttctttacacctcctgctctcccagcgtcctcctttagtagggctggtaattgttctggtgattgccaccccctcgggatgccttgccataagtgctctgctgaccgctgtagtctcctcgtgcc

SEQ ID NO: 862 - DNA, 426 bp, Rattus norvegicus
  Genbank Accession No. AI101270
ctcagtcacacacacagtggttttattttttcctttggtgttgtttacagtgtctcccacaagagaagagctcccattggcagagagggtgatgagattcattgaaccagtggcaagaataagtttctgaacagaaggccacggagccatgagcaacagcttgcccgtttcctggcctccaggactcaaactgggagaagagaggaggccactaaatgagatggagaacttcagaactctggccttgctctgctctggggagacagtctgagggaacatgccgggttaaagcctgggttttaagggaacactctgagagatggggtaagataaaacatatcagtgatgaggggtgtgtgtgtgtgtgtgtgtgtgtgtctctgtaggttacctctgcctgtctctcaactctgacttctgagtact

SEQ ID NO: 863 - DNA, 564 bp, Rattus norvegicus
  Genbank Accession No. AI101323
ctgtttttttccccaaaacaatcaccaaaagcaagatgatccccaccccccaatcaaagcgaaacaaaatactgtcatgttaatcatctctctaaacaagccttctgcgctcagctgtgtgactgggaggagggggactcggtttaacttatggtgacctctgggctggaaggcccaagaggagcagcggtctgagaaccatggagtgagtaacagctctctctctcctggcctccccggtttcagaatgagctacaagagttttgcaaatttcaagcctcaatggtctgagcctccccaacccagccttatcaacttccctatgggtgtgcagtttctttccaaagaattgtgcaagtctaagcctcctgggtgaaggcatttagtagtccatgatcaacgtagattgtcataactcggtcccctctcatgggcgctaacctgaacacgctgctatactgctctgcacagactggccacggtggcaaggaggatccacttctgcatcttcccaggaacggattcagaatcaccagccatgtggtgggtttctgtctccccttg

SEQ ID NO: 864 - DNA, 453 bp, Rattus norvegicus
  Genbank Accession No. AI101608
agaatttagtatatgtttatttgtttaataggaacattcaggtatataaataaggtaaatactttccaatatacaatatatcacattcttatactgcgttgaaaggaatctacgggtgtggtgaacaccaatcctaagtgcagagagaaaggtcggacgtggtggcaacactgactggtgaagcccaggctggacagaacacacatgcacatgcctgtctggggagaccagaggactgccacatggatttcacacagccagggactgagtgccactgcccaggtctgagggcaggaaagccaccaggcactgtgcattaagtgaagtaagtattccctccacacaatggaagaggctgagaaacagcctgtggtgtgtgtcctgtctgccactgtgatccctgctgctgtttggaaagtgtttaaacgtcaacagagatttgggttcacagac

SEQ ID NO: 865 - DNA, 595 bp, Rattus norvegicus
  Genbank Accession No. AI101901
  misc_feature (1)..(595): n = a or c or g or t
aagccatagaagaatatttattgatatgggaaaatgttaacaatatacttctatatgaaatatgtaggatacaaaacagtatatacgatttaataccatttttacggaaagaaaaatagccatatatacaaaatcatgcataataaaaaataaaaactgtatacaccattcatggtcatctctttagtggactggatgtgattacaattcactggagtgattacagcatccatcactcgcctgccctgtaaacagtgtctgcttcatctgtcctgtgattagtgcttccaacagtctgtctctgacagacgccttcccaagcagcttctccgatttgctcttatatactggcatgtagagaacatttcaactgatataatatagagattgccacagcagatgcctggctttagaaagttatttggagaactagaaaattctctacataggattttctctaatagagaaaaatatgcattgatggtatgtgaatacgtaatttcaggagttagaactgaagaatttaggatctncccttccacctgcagtgaaagaaggttaaggatctcaaccccataaaacgtgattagtaatc

SEQ ID NO: 866 - DNA, 551 bp, Rattus norvegicus
  Genbank Accession No. AI102009
ataagaacagctttttattccatggtttcaaatacatagcaaaccgaccatgttccctgaaatttagcaatgacattcatcacaagcctcaacgctctagtctaaaagggctcttcagaatccacttcacaaagctttgcacagaacagtttaagcaccagtaagactgttgttagcagtgctcttatcccttcactgttacagtcaaacatgcaggttcaacctatgtgtctgaccctgtaaaatggatgccacactcagccttgtggtacaaagtttataaacacaatataccaatacaaagttgaagccattaaaaagagcttaataacaactaccaggagacgattaaatctgggaagttgagggaatccgaagaggatttggaaaggacacgcagacgtacattacggtaaatgttttactgggaagaggtgcgagggaaacttctttgcgctttggaaagactcacttgctccgagcctactttctttctgctattatctttagatactgcagggcattgtgagcggcgtcactctgggcattgc

SEQ ID NO: 867 - DNA, 544 bp, Rattus norvegicus
  Genbank Accession No. AI102023
cagtacataattattcaaataaattttaatgatttcaattcaatacaactgaaaatgtagtgtcattaaataacattttctgctataattcaaagtacagtttggaggccatttccgggcagaagcatcacatcctaagttttcagcttaagtgaggtgactgacggggtcatggcaggggcggggcaacaatgatcagctcatagaatttggcttggtgggcaggggccccgcctcctcgtgctcttcagtctgagacctgacaaccacgagggaaggagctggatatctgctcagcttttgttcattcataaactccaagtcaccatagatactcagcttctcagggggcacgtattgctccacggttgtagccacagctgcacagcaaatccagagcaacaccattaccgagagcaccagagtcgtagttaaaatccacccagagttaagagacagacatcttaaaaagccatcgctttcttcatcttccaagtatttcctgtgtgcttgggagtttcttaatctgtaaataggacatttg

SEQ ID NO: 868 - DNA, 549 bp, Rattus norvegicus
  Genbank Accession No. AI102044
attgtggggttagtacctatgattcgataattgacaatggttatccgggttgtcatacacttgggctaggaaaattggttcttgttactcatattaacagtttttcatctatgggtctataaattaccccaatttgtaatataggaatttattgaggtttggggaattagtgtgtgtaagtatgtatgttgagcttgaaccctttctttattgatggctgcttttaaccctacaatggttaaggggttgtagttgtttattcactatttaagggtttttccttttcctaaaaagctggccctcttttggttatattttaagtttacattttgatttgttgttctgatggtaagcttaaagttgaactgaaattcttttttgggcaaccagctttcaccaagctcgataggcttttcacctttacctaaaaatcttcccactattttgctacataaacgggttgattcatgaaattgtttttaggtagctcgtttggtttcggggttcttagcttaaattctttttgttaaggattttctagttaattca

SEQ ID NO: 869 - DNA, 611 bp, Rattus norvegicus
  Genbank Accession No. AI102055
ggaaaaacaccccaaaacactttaatttttaagacaagtgcaagcaccccaaacaaaggattattgttacaacacttgttagcttttcacaatctaattattgcaaaggcaaatggataaatgttaatggacaaagtcaagaaaaaacgaggcaccttaatgaataaaaattttttaaaaaagacattcaatccactgacttctaaaagaggttaaatacacctcctatgagacactctaaaatagtattgcctactaatgtctgcgtcctggattctacagttaattttaaggaaatgcataaactaaaactgtatgcgctctgcaaaggggaaatgaccttctcattcatgggcggtaatgaaaaggcaaggggagccgcagtagcaagtaaagctgccggtggaatgaacatgatcacggctacctgtaagctgtgaggcgtgttctgtccactgcgctgcaaactgtagaaacacaccttgtgttttaaacaaacactgatcatgcttttccgaaaatatattatttttttcattccacacactgaacatatttctcttgtccaatttaaacaacgcatttaacttacagtgctgggaagaggcaac

SEQ ID NO: 870 - DNA, 582 bp, Rattus norvegicus
  Genbank Accession No. AI102064
caccatgccaaccgtgtttacattaccttgaaagattataaaaatagacagcgtataaaactcatgtgagccacatgaaggagaagaaatgtccttgcttgtcaaatgctgcagcaggagacgtccagtcagtcctttgaacctggggaggaaggactaagaagaggcccttttctgttcagaaaacggagactcgtagacctccatgggtgggcaggtgcagacgaggtgctgatctccgtagatgtcgtcgatccgagcaatggttggccagaatttgttctctggtttcacaaagggcagaggaaatgctgccacctctctggaatatgggcgatcccagcgggaggatgtgacacaggtcaaggagtgtggagacatcttcagggggttgacccgtgggtcgatgcggccctcctctatgtccgcgatttcctgccggatgctgatcatagcatcacagaatctgtccaactcggccttgtcttccgactcggtgggctcaatcatgagggtccctgccacgggccaggacatggtacgggcatggaatccgtaatcctggagcctcttggtaacatc

SEQ ID NO: 871 - DNA, 502 bp, Rattus norvegicus
  Genbank Accession No. AI102248
ggtgcataagatttgtttttgtttttttttaatatataaaagattttttttcttaaaaaaaaaacaaacaaaaaacaaaaaagtggtgctctttagaaacacttgcaggaagatcaagtagtccagctacagctcgcaccttcaccttcctcctttcgtggggaccaggagctcccagcctgaccccctctccaccattctgtgggcaatgggcactgcccatgctgccactggccgatgggacagcaaacagctgaccctgcttggaactgttggtggccagggccccctctggatgagggacatagacaactgcttggtggctgaagcagaaatccctctgccaggtggatgaggtagtgttctgggatatggccgcctctcccaacatgtgccaagccgcctgaaacagagtgagcgggcaggcacggctgggctgtcctggttggcagggaaagtcttatcagggactggcagcgatcgatagtcaaggccttcatcc

SEQ ID NO: 872 - DNA, 458 bp, Rattus norvegicus
  Genbank Accession No. AI102318
aggagatttagttatattttattttacacagatcaatttgtagggcagacacaattcttcggttcagtggggctttcacatgattacagtcacaaaattggcacgctctattaaaaaacaaaaccaaacagagacggacagaatatgaagctttatgccaacttagacccagtgtgcactgcccttggtacgagatcttggaagtgtctgctgggagcttaccaaaatagaaccagaggttggaggtcaaaaacggtggcttggaaaataaaaccttttttccaagagctacgtgttttatagaaaaatattgcaaataaaattagtgctagttgaggtgtttattcaaaatcacatgtggcgcagggcttcatgccaacctcttggcacgcagtgcctggtggagggaggctgcatggctggctaggtgcacggtggccacccttccgcctcgtgcc

SEQ ID NO: 873 - DNA, 536 bp, Rattus norvegicus
  Genbank Accession No. AI102505
gagcaaggtttaaatagactttattgttacaaagggggaccccatcaagcagaaccaatatatgtggtcccagttgtcaccatggagacatcgagaggtcatgattgcagaagaggtgactggaattgaataacatgatcccagggtaagccagccaggaatgcaggaaacatgatcaaggtgggctggcaagagtggtctagtcaaaggatgagggaagacgctcccttcactcccgcttcttgtagctttccaggtgtgacaggacccagcccgcaggtagaagacaacacacgaagcaggaagtgagcccaatggtgatatccaggaccccgagctgctcccgcggcggcttcgagtggacctgagcccgcggcaccataagccgccgggccgggccggtcaggctcctcagcagcagcggcgtcagggaagacatgacggcgcggagtgaccaaggacaaggaccagccgaagcccaaggtcaggaagtcaacctagtgccgaattcttggcctcgagggccaaattcccta

SEQ ID NO: 874 - DNA, 631 bp, Rattus norvegicus
  Genbank Accession No. AI102519
gctccgtcttttatttggggacagaaacggtacaaggtcagatatctcccagagggcactctgtggatatttattccagcgggagtcctgatcccagggagggtttgttgagtaagcgtctggaatgagtggatccgggcatcaggttgttggtgggcatagggtgggttcatctgtaatactgcctctgtgtgttgaggtcactgtatacttctggcctctgaccctgaagctcctgataaggtgactcagtctcagccatgtgctgtttccgggtcccgtctgcagtccctcggcctcgagagaccaggcggcccagagagtacaccgccagggcgatgagcagagtcagcaccaagtcgcccagcacaatcccagccagtacacccgggctcacagaggaacattcgcatcctgggtaattgtctcagaaggatgaagagggagacacaggttaacaatcagggctcggcgttagcagagagagagagctagaaggaaaaggggtagcctgaggaaatcttgagaggaagagagaaagaccaggggtgttatggcttaccactctgggcctgtacgggacttaatcctcccacagtcaggaggacaggaaggaacagaaagccccagg

SEQ ID NO: 875 - DNA, 599 bp, Rattus norvegicus
  Genbank Accession No. AI102520
aaggtaagcaattattttatttccctggcctgacagcaattgacttcaaagtcccagaacctgatgccgacaaagcgaacatacagatagctcccaacagggaggacgctcttcatttgtagagatgaattgaaatgtcatgtgtgaatgcgattcctgatgtcttcaccttgcgtctcctccatggttgggagccctccctctggttccccaagtcccacacgcacccctcccctacccccaagtccaggtgctcccatctgctgggcttctgcctcatttcccatagacactttcatcactgtaggccacatacagaaaatagtcttcctcgtggttgtcctcatacagctgtcccatggtagcactggtgggagggatagtgttgttgacaaagaagaataaggcgtcctcaggtctcaggtggatcctcttccggattaagaagtagaactccactttaacgccatccaaactgctggcaatcataaccacattccgaacagccctattttccaagaggactccatctaaatgtccgtgcgaatgtctactgccacaactggggcggtgctatgacacctgggcggaggaaaagg

SEQ ID NO: 876 - DNA, 625 bp, Rattus norvegicus
  Genbank Accession No. AI102560
atgtttaacatagtgttatatttggaaaagcagatttaaaaaacacttgaaaatacaagataaggtaatggttacttacgtaagttttaaccttatattgcttggccatttttttttacatataaattattgcttcctactttgataaatacacagcacagtcatatacacagaggcagagaacatgaactatgagaaaaaaaaatcaaacactgtcaatggcagtctggtaagtcaacgaatgtttcatatttaccagctcttataatggtggaaaactacgaggtgtagtccctgagaagttaggtagatgcccggcctgtgggctttctatcttctaattgttatcccaagctgacagcatcatggcagtcctaagcaatgagacgtccaaaggcaagagtccttgcttctggtcattgatttcatcctggtgtttaataacagcgtaatacgaatacaaataaataggctatgcaaataaatattcctctgctaaaaatgcttacttagtatatacagctttgctttatacagtagtacatttcttccgactttttggcaattttcaaaatgggttttccctagagcaaaacgggcccactcagtaatgagtgggctgaaa

SEQ ID NO: 877 - DNA, 405 bp, Rattus norvegicus
  Genbank Accession No. AI102562
ggcttttattattcacatgctcggtagaaaacggggtttagtaaactgggtggaggtgtacggcaagactctgagttggtccggaaattatttacacctgagggcagcagcactgttcgtcacttcaggcacagcacgtgcacttgtccgaggcacctttgcaaacacagccctgggcacatttggagcagcccacggggcagcaggagcagcagctcttcttgcaggaggtgcatttgcagtttttgcagccgcaggagctggaccaggtgcaggagccgccggtggagcaggaccagttggggtccattccgagatctggtgaatctggagcaacggggtaagctacaagaaggcagtccctcgtgccgaattcttggcctctagggccaaattccctatagg

SEQ ID NO: 878 - DNA, 487 bp, Rattus norvegicus
  Genbank Accession No. AI102570
ttttaaacatttatttattatgtatatgtcatacagctttcggcctgcatgtatgcacctgcaggccagaagagggcaccagacctgattatatatggttgtgagccaccatgtggttgctgggaattgaactcaggacctctggaagagcagacagtgcttttaacctctgagccatctctccagcccccgacaatttctttaatctcagaaagaaggcacctcagtgggccactaggactcttcttcaaagtaaggactgtcttcaataatgtagacctcgtcttcaattctggcctgctccaccaccttattttgggaagctccgatcttagagactgggaaggcaacaaacctcagagaaccagaattctttctcattaccatgtacctggtgatagccacggtgctcgcaagcagcagcagcagcagggctgcaaaggacatgccaacatagaagcccttagtcgggtttctctgcagcttc

SEQ ID NO: 879 - DNA, 478 bp, Rattus norvegicus
  Genbank Accession No. AI102578
gaaatgttttatatcaagctatatatatatatctggattctgtcctgagtacatgcatacaaaatcaacactataaaaataattcacaatattaatgtcatcgacaagttaacatctacaagcatacaaaggctgtgtgcattgcttgccctggccagctcggtaaagcaagtacctgggaaaggggacagaggagagacttcagatcccagcctcgaaccatgaggaagcaagcctgggtcagggctgagcagggctttcatggctggagggaatgggataagtgaggctttgcccctggccctagggagctggatggggctactcaggccgttaaaaggcagactacagtgtaggaaggcaaaggtcgctctacccaagacaaataatcactggcaagaaatctctcacatgctcacacgtcaactccctttagtggggtctggaccccactggaccaacatctgtccaatcatgg

SEQ ID NO: 880 - DNA, 531 bp, Rattus norvegicus
  Genbank Accession No. AI102618
gggggggaaaaggtttattttttcctcagaagaaacagactggggaacatttacaacccacattaacttgcagttggtcctaaccctttcgggaacaggtgttaaaatgttaggtgctctacggaatgaaggtgttcaccccagacagaatgtacatggacgatgcttgaagactgcatgttttttccctgagagacgtgtaagacaaacagaatttgctgagagccatctttccaaacagcccctccctcttcacactttggaggatgtgcctcaactattcatctagtcagcactcagaccacatgctgctttccttctaaatcaatccctttcccaaccatttgaactctccaagtcttcatagccctggaccgaaaatacctactaagatcctatctgtacttcagctttcacaccttgtgagctgggaagtcaggctcctagtaaacaaaacttccataactggattatgaggccaaccttttagttaccttaacctatagggtttattcaactacataaagtgct

SEQ ID NO: 881 - DNA, 522 bp, Rattus norvegicus
  Genbank Accession No. AI102620
aaacaccaaaataggtacaaatactataaaattggttcaaaggggtaaaaattttaattaaaatatctcgatatatttaaaataacaaaggatacatttaagccaaattttcttaacccagagtttttttttgtagcatttgcttacatagtaaggtgctaataggagttagcccttaagccctggaagtcttaggaatcatagtcacacagcacatagaatttcattgtgagagtgaactttggtagaagaaaaatctataggacacctgaggtagtagaaactggaataaacagcagtagacgttatttacaacttgagtaccaaataacattaaaaacacaaaaataattacacaatacaattttcagtccagctttgatccaaagaaaacaagaatatcacatcacatttgcatcgaaaacaaaacagcacaattaccagcaagccgaggggactgcaaacaaactcaaacacggtgggtcctgacatctggggacagtctgagtttgaaatgtggca

SEQ ID NO: 882 - DNA, 575 bp, Rattus norvegicus
  Genbank Accession No. AI102727
ctaaaaactgtaggctttttattcagttaagaggtagacagatgaacatggaaggctgtcccattgaatttgcccaaagttcccattccacttcattcacccatcccacactgccagaaatctcaaaagaataaccacaaccaccaggctttgtcttcctacttcttagcaacacgtccacgaactgtttgcaaagaagttactacaaacttaaattttcactgtgccaaagattctcggccctctaagaagttgtcacatgtcaacagaacctgccactagtgacagggagcagagtgccgtgactatttctatgagagactacaagggaagcttcagttacatgtttgttaaatccctgtgcacgctggggaagaagctggtgaggccaacaaagcagtatatgccatcaaatggctctgcttggctgtttaaaaagaatccacattaagttatctcacagacgacattaaaacataatggaattgatgcctgatacaaaagttgagaaatatgtacaggaagtcatagcccaagagaaaagggaccttagaatgaatcaatggaaacctggc

SEQ ID NO: 883 - DNA, 503 bp, Rattus norvegicus
  Genbank Accession No. AI102741
cttcttctcttagacacagtgtacacacgacagcctacacatggcacatgatttagcaaaataaaacattcacgatatgattgaaataacaaagtgtctcagctacataaatgactttaaattatacagtaagtgaacaggagaaagaaacaaagctatagcttattgaaagcgcaaaaacggctctccaatgatgtgactttacgaaagaccttccttgcccaggacttctcgccaagacctcaacagccacctggggccgtggttctgccaatggttttatcttcaggttaacttcaggtgcctcatacttaggcctcacctcaagtctgtccgggtaggagggaggctgatcacacagggactgagaatggccagagacttcttgggaaagaggctggggtgtacatacgggagagcattgagcagggtagatcaggagcgccatattaggagactctgaggttgaaagagacaacttccaacagtaagtcagaggttta

SEQ ID NO: 884 - DNA, 691 bp, Rattus norvegicus
  Genbank Accession No. AI102745
  misc_feature (1)..(691): n = a or c or g or t
gagagttgaaaagagctccattttattacggaaagttacaaaaaacgaaacaaaccaggcagctgaccaaggagcaatggggagaagcgaggcgcctcctgagcgccccccacactgcaattcaattcaatgtgaaccacgtggaggaacagaattaaataattttcatggggttcaggattaggatccccagcctgccctcttgggggaaaccgaggcacagtaatactgagcaaagctgaagaaggttacacaccttcccaagtcactcacaatgaaacaaagggaaggtggaggatcccacaggggctccgcgggtaggcatggcttgtaaacctgggactctgcaggtgggattgggagctagtgggtatgtaaaccaggctgtgatcaagagggaagctgtaaacaaaggggtagtgacctagaaaagggggtgttcgtggatggagcgggatccccggagagtggctgagctttaaggaaggctgtgaggctggaggtgctccatctcaattccagataaattctgaattccaacccaggacttgatgctcactcttagctcaccgaggatgctccgcccaccgggaactttgggttaggggtcaatttaggctagcggctccgncccaggaacangatgggaaaagcaagtccgaattcgctcgcttgtcgcccttccctgcca

SEQ ID NO: 885 - DNA, 700 bp, Rattus norvegicus
  Genbank Accession No. AI102753
tgtttatttccatctttaatactagtccaaaacagactgatacccatgagcatagtttaaatgtaacaaagaaaagagttaaactatatacattaaggaaaaaggaaagaaaacctttttttataccaaccttttcctattaatgcagtttctgattagaactaaacatgtctctttctcaatttaatttaggatgaagtaatagaacttttatgatcaacttcataaactgtctttaaggagaaaacgaatttttaagtgggtgtcaccatatttaccagtgaactggctgcatggttgccttgtctccttgaagtctggctatcattagaactaacaagatcaagtccatgaggccctcggggaactcaatggctgtgacatccaaggggagggcacataccatacatcacaatgatgaaagttaatgctcttaccctctgagtccatgtaaaaaaacttattactctcattcaaactaactgaagtcaaacagttaaaaagtcagaatgaagaataaaactattttcttttcacagagaggagggacactccttcagctccatttaaagtgaattctgtgctgagtccctgctccttcagaacagtaaactgaaagtcagttattgctagcaaagctccagtggtctctttcctacctcaaagatgttccacacaaaaaggctattggtttgacttg

SEQ ID NO: 886 - DNA, 496 bp, Rattus norvegicus
  Genbank Accession No. AI102849
gaaaggcatggatggattttatttattaccctatatctacaatctgaggtaaaatataaggaacacataaaatgcctatttctgctaccgtgtgatataatttcccatggtgaacatcgtggtgacgctactgagagcggtgccctcacaccctctaactgctgagagctgctgccttatacagtggcatcgtctgcgagctcccacgtggagccccacagagggcgaggacaccaaggtaccccactccccaccctggcaccgaggccagacaggtggttagagacaaccaaccaggcagacacaaggccagcctgactccacccagagcaccccaggtcactgcaggtcctggtggttagggagggttgagtcatccagctgctcaagcatgcacacctgaccactggcctctgaccttctggatacgcccagaaatttacttgctgcaaagtaacctcgagagagactccgaggtcagcctctccagttgcac

SEQ ID NO: 887 - DNA, 489 bp, Rattus norvegicus
  Genbank Accession No. AI102868
agatgactcaggactttaatgttcttcatatcgtcaatcgaaaacactaacacatgaacaaccagaaaagacctcagcaaagatctggaatgtacagattgccctggttaaactacaaaaacagccatgcgatcacagtttgggggtgggggtgtaactgagttttgtttaacggtctaaccgaaaagcaaagaaacaaccatttcttctacttgtggcaagaaaagttaatcatggaactcctagatccttctcatgaagcagctttaaaagaaatcgcttctccagagcttcatcccctttgctgttaccaatgcgaaacggaatgttcatcctgcttctattctggcgctccaccggacacacataaaatccttgagaattatcaataatctcataaatcatttgggatttgacggagctgagcttctccatggctgcggacccaccattgttactgatccattccaggatcatgcccatgacgta

SEQ ID NO: 888 - DNA, 472 bp, Rattus norvegicus
  Genbank Accession No. AI102877
agatacacagaacagtctctattgtctgaacatagatacaaaataagttatacttgctttgttttctatcacagtaggagtgcagcagacagctactgtgtcagtggccatggaccaagccaggaggaagatggagggcactgagcacaaggagaatttttgccaacgacaccagtgtctctggaacactgtagagaacaaggttccagtcctctcaagatggccttctgtgaattagcatggagtcctgctttgtaaaagcctgtggctgaattcgagctgggatgttttaggttactaaatgggaggctgagcaggaataggcacagacaacatctagcaggccagcccactctcctcatggcttggttgtacttctgtgatgttgtgaacatgaggagcaggccagaaggcacagtttccttctacaaggtaacagatggccagattgatggcccacccaaggctggtg

SEQ ID NO: 889 - DNA, 566 bp, Rattus norvegicus
  Genbank Accession No. AI102977
aaacttaacaactaagtcaatttatttaatagaaaacaaaatacaaaataactcttttcagaaaacagaaatatttaatcctttagcagacatcagaacttgctttgtccttagagcatggtcgatatttttgagtgtgcactcatgattcatcccgttcactatcaacactgcagtgaggtggaagcaggtcattgagggagaaaaatgaccaacgagcacaaaaagttatctttaaatccagcatttcttgtctatcttgtgacttattcaaaattactctttatcataatttgttgatggtgtagggctggaaccctaggtgactggcgcagcgctgaggctcaccctctgcccaccacagtgcttctccccagggtataaaggctgacaaaagtgcagccaatggaagaaccacctttgccgccatcactgcaggagcccatgctcagtcgctacctgcctgcctgcccacagaagcacagcatatggttatggtgcccctttctcctgatacactgggccaccagagtctaaattccctgaacctcaaaattccaagtttt

SEQ ID NO: 890 - DNA, 441 bp, Rattus norvegicus
  Genbank Accession No. AI103018
tttttttattcaccggggctgcacctcctcatactcctaactccagcccagccctggaagtcccaagtgagcagcagaaatttgtgaactaatgacacgtggctgacaaagttgtgggaagagagagtcgtgttctttgtgatctttttcacagggcacctcgagcactcagactgtccaccagtgcccgaagcttctctgacaatgcgacctggtatacagcagggttctgcagctgcttatgagctggtcggaggcggctcagggactgctgggcaaaggctctggactcttccagagatggaagtggttcatacggctgtccctgttgcaggtacagtcgcagcaatggctccacctgggctggcttcacagtgcagggctcctgggccccctgaagccataccctgagttcctgcccaaccttgggtgggggctctt

SEQ ID NO: 891 - DNA, 461 bp, Rattus norvegicus
  Genbank Accession No. AI103059
aacactgcatatattccttatcgttctgttgatacaacatggagaactttgtaaggagaaaaaccaaaaggtgctaagagaaaaagaggtgcagaaaccaggtaagaagccaggaagaggctaagataaaccagagacaagaaaggtgggtaggtaagcatggcgatgcacacctttaatgccggaaacatttgggaagcagctagtaaatcctaggccagtctgagctacataatgaaacattctcaaaatatcaaagtaagtaaacagaaaagtgtgggtggagagaagccccctcatctgctgcaacatttaacccttgcagtcccagaagcctagacagaaagctgctgggacaccccattctggcttctcagtacaagtgagaggtcaccgataagacagatccatcaggaaaaggaatacacatgtaggagctgagacagcagccagccttgctg

SEQ ID NO: 892 - DNA, 432 bp, Rattus norvegicus
  Genbank Accession No. AI103097
gacaacaggacttcaagatggcgtctatcgtgccattgaaggagaagaagctcatggaggttaaacttacagagctgccaagctggatattgatgcgggatttcacccccagtggtattgcaggagcctttcggagaggctatgaccggtattacaacaagtacatcaacgttcggaaaggcagcatctcagggattaacatggtgctggcagcctacgtggttttcagctactgcatttcttacaaggaactcaaacacgaacggtgacgcaggtaccactgaagaggggtcactgtggagaacactgcatggccgagtgtaaccgcctggcccgctccgatctgcttaaccttcacaccccaaccaagaactagggtccaataaaaggtgacgggactggttcacgtgaaaaataagaaaaaaaaccttt

SEQ ID NO: 893 - DNA, 540 bp, Rattus norvegicus
  Genbank Accession No. AI103106
aatagtaaaacagccttttatttgttaatgttgataagaaatttaagcatgttacactatcttaaaaacctcaactagcgcacgtgaagagaaagtctcccccaccctagcccgcctgccccattcccctcaggaatcaagactctaagagaaggagttgactgaacgacggctctgcgaaacgtccatccagagtgcttacatgatggctggcgcaatactgccttcctacaaaacgtttcttctcttttctatttaaaaaaaaggtaaccttgatcacttattacaaaaaaattccatacaaaagttcatatattgaaaaacgcctttcccccctcccacacagcaccattttatatatagcagagaaggatcaagagcagatcgcctatctagggagagcgatcttcaattatgcctggacacgcagtggttttcttaccctccctgttccctcttaaaagaacttaaaaaaaaaaaaaattacatacacacattcaaaaaagaaaaaaaaaatgccaaaaacttgagggccccttt

SEQ ID NO: 894 - DNA, 531 bp, Rattus norvegicus
  Genbank Accession No. AI103143
tggccctgggcggcctgcctcccggtggcggctcacacccgcagcactacggtcgcctgcccgggaccatctggagctacactcaggtgcggcgcacgggaggcggcggcgtggaaacggtgcagggccccggcgtgtcctgggtgcacccggacggcgtaggcgtgcagattgacaccatcacgccagagatccgcgctctctacaacgtgctggccaaggtgaagcgcgagcgtgacgagtacaaacggaggtgggaggaagagctggccaaatgtatgaaccttcagaccatggtggacacgctgcaggaggcagcacaagaagccgaggccatccaggaggagatgaacgagaagatcgaacggctcaaggccgagctggtggtgttcaaaggtctcatgagtgaccccatgacagacctggacacaaagatccaagaaaaggctatgaaggtggacatggacatctgccgccggatcgatatcacggctaagctgtgcgatgtcgcacagcaccggaactcggaag

SEQ ID NO: 895 - DNA, 588 bp, Rattus norvegicus
  Genbank Accession No. AI103150
caacgtgcatttatttaatatacattgtatgggttcaagcagacttaatttaaaaaaacaaataaaacaaaacagcacagctcagaaaccacggagaaaggacagacatctaagaaaagagacgacacaagagaaagctggagagctggcgtcagggctcttggttggagacctgctttgaatatgtttcttgcaggtacttcttaaatgctgtggggtttttccagagctctgcagcatgtgtgttcaaagggctctcgatgttgggttctcctagcaggctctggatggagagcaagatggtcctgacatcatacagtgcagaccacttgtccttgaggatgtccaggcagatgttgccctgggtgtccacgttggggtggtagcacggtgtgaggaacttcactgtgggtgcgttgtaagggtagccactggggaactctagggagagtttatacctcaggtcttcatatacagtgccggcggctccatggatggttcctacccatttgaacaggttgtctgattcggggaaggcggaaattcctttgtcaccagacatcatgagggtcatcagctcctgctgta

SEQ ID NO: 896 - DNA, 447 bp, Rattus norvegicus
  Genbank Accession No. AI103245
ccgaagccacggcccaactttatttacactcattgcaaagcatgactgagggtaaaggacaggtaccaggggatggggggctgggggtcatggaaactgtgcgggtgcacggtagggttgcaggaaaaaaggaaggcggtggtgaggatggacagcccctttttcagtgtcccccaggctcccaggcgtccgggggcaaaaagcaggtgaggctgccttcaggatttggacttggacacagccagtccaatgagtccatctttcttcatggccttgtcaatcaggcgttccagctccttgagccggtagttgcccacggccaggtagaagacataatcccgctgctcctctttgctacctttgggcaacagctcctccagcagcacgatgcctttacggatgtcgtcattgaatttgcttcaaaccaggcaccaggcgtatttaaac

SEQ ID NO: 897 - DNA, 567 bp, Rattus norvegicus
  Genbank Accession No. AI103284
ccgcagcacccggagcacctggtcgcgcagcagtacatacagcgcctccaccttgctctgccgccacaccagctcctcgtcgctctacccaagacaaataatcactggcaagaaatctctcacatgctcacacgtcaactccctttagtggggtctggaccccactggaccaacatctgtccaatcatggcttccagatcttgttccagagccagggctgggcagaagcagcagcagaatgtgggagcctggtgatgggtcacggagctggggccattaagcatccccagctggagtggtgcctgatgttccctgggtctcattagcattatcagacctttggaaaagctaagcaacttttataagtgagaacaggggcctggatagctcctgcactcctgtgttgatgtccagtatgttccggatgctcctgacttcactgcttggtagattgcccttgatggccaggatggcgttcaggtggcctttgctgaagtcggggtaccaagtggcatatgtggccacctcgatcttgatggcactgggatcttgcaggcgattaatctc

SEQ ID NO: 898 - DNA, 567 bp, Rattus norvegicus
  Genbank Accession No. AI103314
cagactactttatattttcataacattttaacatttaatagaaactatatacaataacttcactatatcttacatgaaggagccaccacagaaatttacataaattaaaagcaagaataattaaggagaacccagacctgtgaactgcttttctcagtcggttcactaggaaagggggtttatattgcccaatgatgtggagcagaggaaaggcttaaatacagctttagatacggctacagagactaagagccaacacctgaagagcaccgttcttcaccacagccaaccccgcctagacatccacgtggatctcagcccatggctcagaagtcccagtataaatgtctccaataggcactgcatctcaaaggcagggagcacctcacgctcttcctcgcaaaaaatcccaaaacttaaatactaacttgtcatcacagagacttgggttatgtttgtctacagcactctcaagccccgaaggaaacaacgtggtctgagctgtccctgttcagtgagagatgatcaaagatacacttgtctgaaaaatggagagttcaaatccaa

SEQ ID NO: 899 - DNA, 489 bp, Rattus norvegicus
  Genbank Accession No. AI103320
gagataggatttctgtgtagccctggctatcctgtactctatagacaaggctggcccaactccgagatccgcctgtctctgtctgctgagcactgggattaaaggtgtgcactgctgctaccacccgcaacagttcaggatcataaggcactttggaaaggagatggggacagtgaaatctctgagttccagcacagtcttcagttccctctgggctggagtccccatcttgatgtgacagtgttagtgtgctggccccaggaaaggtgtcagacagtggtctgagaggtgccttgcttgcttgctgtgactcttcgcctgctgaggccctggactgtcctgagctcagaccttggctacaggcctctggggtggctgtttctggagcaaggccagggtgtctctcttttgaatggagcgcaactgcttcttctttgctttcttgagcttggcagggttccggatcacttggacaatctcagctttgcg

SEQ ID NO: 900 - DNA, 502 bp, Rattus norvegicus
  Genbank Accession No. AI103327
aggtgaagcagtttattctttatttggaaatcaaaggcaaagctccgaagagccagtcacaaatacctagttggtggcaggattagctagccttggcatgagcgaaaccttggggctgtgctctgggtcgtccagggtgcgttagccgatgccgttcaagaacattagggttagggtgggtgctcagtacaggggacttgcctggtatgctggcctcagcaaaataagaagacatttagcaccccttcttaatgccttcagggatggttcctgtgattgatgctctaactgtaggatcctggtgtttgtggaaacggggctttactccttgttacttaacttggaggctgcagctctttttcctgtcacttcagccatagtgctctccagccttgagtcaggcttctctagcagtggacctctccctgtggtcattccccactggatatcagagccgttttctccaaacgcagcttcttcctgggctccatcaggactgaaa

SEQ ID NO: 901 - DNA, 512 bp, Rattus norvegicus
  Genbank Accession No. AI103410
cttgtacaaaacactttattatagagaagagttggcttatgggctcaaacatctagatctgggtgtctattctctttcctgttttgtctccagcactgggagctagggtccctcctcatctataagttatctctgtgaacagagggggtcttccccaacaccctgcagttccagaataagtctacaggctgaagtggtctgaccatacaagaaaagctctttacaaaaggttctgtggggcagaaaattccagaggccatcctgccagcagaactgggctgccagctcagtggtgggcagggctcactggcaggtcaaccatgtgtcacccaaagtctagccatagcagaatgaaagccgagctgtaccgatcactgggaacagtggggtgacaaagttgtcagtcacaaggtgcctttctgggtcatggcaaatgtgggtttggacttctggtccttaggccacaagagagccactgggcggtaagccaagcctggtgtgggggaaaggcc

SEQ ID NO: 902 - DNA, 490 bp, Rattus norvegicus
  Genbank Accession No. AI103472
caggtttttaaaaagggcttctttaattaaatacatgggtgagaggccaggcggaatgtcggagaggtgccccctacagaaagaacaaacaaatcccttaggacccttgtcctgcctgccctgcagacatcacccttcaatggttagacccaagtcccagttatcaatcagaacctgaagttaggggggagggaaaggacaccaggacaaaactctggttgcttatggagttaactgccaaagaccagacctttcccggttacaggagggacagaccagcaggagctgggatgaagcaagatacatccaaaagacacaaaaagaatggggccccagcccccgacccaccccgcaaactaaggcatctcatttttgtggggccaatggaagttcctgggagggggagctggcccaggacccttcgagcccagctccagaagggtgacctccctccaccaggctcaggtaaaggtagcaatacccaaagcct

SEQ ID NO: 903 - DNA, 483 bp, Rattus norvegicus
  Genbank Accession No. AI103552
cgttttaaaatggctttattaaaggctagagtataaaataggaccaagttacaagctgtcagtaagaatttacgatttcgaaagtatgtatcaaaggagagggcagggtgaggaatggaaggccacccccacactggcatgtggggtgcacctggccgaggggcagattctgctgctcctgacaggaccggaaccaacccagagggcagaccagacgcacagagcctgggttcctgagggcttctgttggacacagccaccaagagcaagacacggagccctggagctgcctcccaggtgccgagcgtgggcgtgtggtagaacccagcatcatacactggcttcagccaaagagtgtgcttcagagcagagtaacgagtgtatgtcatcgtgatgtacaggggaagggaaagtgggaattacagttccggtttcctggccactgccgcatgttccctgggggaggccaagacgccagcgtaa

SEQ ID NO: 904 - DNA, 499 bp, Rattus norvegicus
  Genbank Accession No. AI103572
gagacagacatggttacttttttatttgaagcaaaaaaaaaaaaaacccataagttttaataaatactgtggaaaacactgaccaaacaaacatacaaagtgacttcaacattaaaaaaaaaaagcaaaaaaagttctgctttataaccgttataacttattttctttttacaatatttaaatacagaaagcacttgccagcgattttgtaatactgcccaaagcatgacgctgtaccagtcagagcatatttgttggtaatgtctgagtttcatgggaaatgactgaaatggcattttcttgcagagacaaaacaaaatacttgtgaagacacagaactgggtgtcggaactaccttaatctccccttctgccccagtttaatggggacacagcttcaacacttcaaaaatgaagcgtcatcattgggggaaagaaaagcttgttttcaacaagcacggactataaaagatcaaaactgatttcttctctgaaaagaa

SEQ ID NO: 905 - DNA, 408 bp, Rattus norvegicus
  Genbank Accession No. AI103631
cagggaggcgtctcatgtgagtgtcaatactttattttggtgtaaagagggaagctggaaaatacactgtatttaaaattttcttggttccctcactttgtggaaagcccctccccccgccccaagctaatcaatctgttcaaactcaaacacttaaaaattacagcagcagcaaaccaaagcacagaagaaacccgatggagaaggcgcctgggcagtagtcacttggtgtggacgaccgaggtgctgaacagcagcttctgcttctgcctcttcctcttcctccctcctctgtcttcagagagggggtctgaagtagctggtgtgtccaatttcatgaaggcggtttcgatagcttggctgaaggaattttggaaactgggcacaggaacacggtcagaattgtca

SEQ ID NO: 906 - DNA, 575 bp, Rattus norvegicus
  Genbank Accession No. AI103641
aacggtttcgtaaaattttattaacttgacctttttccggcacagtgtgtggtgtgtgaatctatgaagattcagagcccacccaggacaattgtgcccacatctcccttctgctgacttctttgggtttaagacacccaactccatactgcaatggcctccttctctcctagactacaaggcacataaggctacacggtgatctttgtttggggagctacagcagcccgatttctcagtcagggcgtgagacagaggaagaaggttgggtctacagaaaagtgatggctgttcaccccaggaaggagaggcagggtgcccctgatatgaggacatatgtggatggttacacagggtgggagaagaggccactctatctcacaaagcagaactggagcagcccctcactagagcttgatcaggaagctatgcatctgtgacagaaataaaaagtccttggaaacatacactgcagctggtgggtggaaaaggggaaggcttcattgctcaggtcagcatcaagcacatcctggagaatgtcacggctggctgggccctggatactgagcatgccc

SEQ ID NO: 907 - DNA, 575 bp, Rattus norvegicus
  Genbank Accession No. AI103708
accaaaagataagtagaaatttatttcaaaatttaatacaaagaatacaaacctcatggttcctcaaagacatcaaattactcttctataattttctcctaacttttgagctggcaggtagagaccatagaagaaaatgttacacagaccgaatcccaagcgttgcgtatttaagcatcactaactgtactgtattttcccaaaccatctggggagtttcgatgggattgttccagcgtgcactgaacagtagtgaattatcatttccatcctaaacccagtaagccgtctccggctgtatttcacccagctgaaagcacataagccataggacatgaaaggaactgtcactagggccagagggcctgataccttggtcagccaccaaacactcttgttgctacagcaaccagtttgcaaacagaaacgatacaggataaaccaaggctctgtgataacatcagggctaagtatccctttcaaagggtgtaatagtagcaaggtaacttagaaattctatccattggtatggatgaattttacctgagatgaggacagtgatggacattaaatgc

SEQ ID NO: 908 - DNA, 522 bp, Rattus norvegicus
  Genbank Accession No. AI103719
caaaattagtaaactttatttcaatttcaaaaaataacaaaggcagcttaagctttgttcttccagatcagatgtgacccaaagcaggaactagccttccaaagttaaaatacctgtaattccaatcaagtcacaggcaagcaagaccttcatggtggagtcaggcagggagctggcagggcacccaaccctgcagctggatcagtgagtccgagacagcacaaggggtaggagcacaaggcaaaaggcccatcaaaaatggggtccaaaacttccagagggtttcatcataaggagttatgtacaaagggacccaggctagggtcacagcctgtgagggaagtgacccacaggccacggaggctgtctgaccctaaccagctgctgctgtgtcctgctcactctcagttctcctcatcgctgtcttctgggctgatggctggactggtgaggctgtaggtggggctgcattcccaagcaacccgactcccggaagacccgggcccggcgcgccgggggccg

SEQ ID NO: 909 - DNA, 377 bp, Rattus norvegicus
  Genbank Accession No. AI103738
ccagtagaaaggatttatttatagtcaaaaggtgacacaagccttcctttaaattccattttttttacagtaaataacgcatatttccctccttcccatgcaagatagaggtgtattaatctacaattcttatttaattgtgaaaaaataaagtgtctccctttataatcagattggtagcgtggatattatctgtggtaacggggttgcttactcaaggactggttatttggttaagtcctaaaacgttaagttgaaaaatccctcacccagtaaaaataaatactgcaacatgaaggacgtgaaaacctacggcaccctttaaaaaacctctgcagagcagcagcacggagctcaagggaccagcagggctgcag

SEQ ID NO: 910 - DNA, 457 bp, Rattus norvegicus
  Genbank Accession No. AI103828
gagcttcaatctcaaacctttattttgctgtaaaggggagaaaaatgattagtggggggtttgtacacaacactttcatacaaagaaatgggtgccgcaggcctgatgtccagctttcttcacatttccccattccaatgtgaccagcaagcatgttgctgttccaatgacagtgaccatgccctggtcacaccatttttaagcactcataaaacgaatacacaaacagggttttcagagccaatttttagagaacattatctagtaagcggttcacgcccagccccctgcccttgcccagttttcacttttatttccttaatgttttgactgacagtttcccctctgctcggggtttaaagcaccattcaagcccagcccacaatgtattcagcagtgcagccttagccaagtacatgagtgaggttttctaccaaacatcacaatgacctcatag

SEQ ID NO: 911 - DNA, 568 bp, Rattus norvegicus
  Genbank Accession No. AI103841
  misc_feature (1)..(568): n = a or c or g or t
actgtcaaaagttttattttatttaccctgttaagcaggccctgcatcgtgagaggccctgaccctggggctgagctcagggatccagagtccgacgccctcacacctggcacccctggctgctgtactcctgcagaaagtcattgagctggccacaggctgcccgctgacgggtgctcctgcacaggcgctcagatggcatctcctcgatccaagtatttgagtccaggtagtgggaagcagtcagggtaggggccaaatagatcatggtttgttctgcacagcctctagggagcctcaggagggaggccactccgcctggggacaaggcgccttcggagcccaaagtctccaagggttcggaggctgtaaccctgacgaagctgctgaaatctccatcaggaatgacgttggggtctgagctgccagggatttccaaactccgaccaaggttatttanggggtcgaggttgtanactatctcttctctgtggatggccccttccttctcaatttggagaatcttagacacagcatcccctatagtaaaagacccccgagccaccac

SEQ ID NO: 912 - DNA, 576 bp, Rattus norvegicus
  Genbank Accession No. AI103911
ttgtgaaaagtttaatatcaaagcagaaaaatattacttatcaaaaatgatttccccatccattttgaagtagaaaatgatgtccccaccttttctcaagtccaagatatgaaaagaaatttagataatgacaactccaattatagatttcacaactatcttgtacaacaatctgtaatgttttattagaattcactatcaaagacattgcacctttccagtctgtgactgaatttaatgatgttcaacagtggttttattatgctaatgcttgataatatttaacagtgaattcaattacttcacattaatgtttgccaatagttattaacaattcttaaatattttaaatcaaccaacctagaagtacacaaggcttactctcaactcttctgaggggacatgaagaccgaaagaaacctaggccctgagtccaagtgtctaacccacaacaactacatcatcactggtgaactcataggtaggtacttccaggttgagaggtgcagggcccttcctgatcctgccagaagcatcatagtgtgacccatggcaagggcaatagtagccaccaaa

SEQ ID NO: 913 - DNA, 585 bp, Rattus norvegicus
  Genbank Accession No. AI103939
agaacaaaatagatagactttattaaatatatgttatgtgggttttaatatcaaagtagagtgtgcgtgaacggactcctcatccatttaacaaaaatatcaattgttgctaaccatgaaatgattaaatgccacgacatacacaattgttttttaagtgagaaagaaaagaatcacagcttgaataaatagagtgttctcagctggtccaatcaaggcataaggcacacattgaaatgagggattagtgaatcagaaagcagatactcaggcacacacacagtctctgaacatggcggctcccacaatccaacactcattctccctggaggagagagctgtgcgtgctgcgagtctttccctccagggtcaagtgtcttcaggcacccatgcttcttgtgcacaggcttctccatgcaggagaaatactgctactaatacttttttgggtaaacaaaacctttatgatgtaacaaaaataacatttttaactaatgccctttccctccaatccaaaatcgagtaaaacagaaaatagatggtaaaacctggacttcagcatccacggaaaacaaatgatggctg

SEQ ID NO: 914 - DNA, 568 bp, Rattus norvegicus
  Genbank Accession No. AI103947
aagtacagtaacgacaaacattttaattggtatccaaaagacatttctatgtaaacaaggtttccttgagcaaaggtagggagagttgctacacaagaatgtcatttgttcttaaattgggattgttgttcacctcacaggagccttctggttcaggcagcctgttaaagcacttacaatctgctgcaggtggtaacaaatggcagaggcagaggcaggaggttctctccaagtttcaggtcaatcagggtcaccgactgccacaggaactgtaacaatcctctgtgtgcagctctggtctgattagatttgaaggaactgggctacaatgtggggaaagcaggttcaacaaggccctaaggcccacggatcttacagaatgcttacgtttatttttctctgataaattcatttcaatgaattttccatggacactgcttgaaggcaagagctacatctgtcgctgtttatgcttggggttggtcttacagaggacaaaccagcgcccacgcctcttcaccatgttgcagtctctacagcgcctcttgatgacacccttggtcttgaa

SEQ ID NO: 915 - DNA, 315 bp, Rattus norvegicus
  Genbank Accession No. AI104035
tttccagtgggtttttattagtagttgcatcatgattcagggtcccagggtagggaccatcatatactgagggcccccttttctaacggggagaagggcaaagagcagaggaaaggtgggcggagccaggtcagatcttcccaggaaatgtgccttcggctatgcgggcatcccaggctgagacccatgagacggggcaaagggacttgtacactcgccgggaccactcccaccctcgtgccgaattcttggcctcgagggccaaattccctatagggagtcgtattaaattcggaatcatgtcaaagctgtttc

SEQ ID NO: 916 - DNA, 509 bp, Rattus norvegicus
  Genbank Accession No. AI104099
aattttaataatacctgttatgtttaaagagtcaacaacacatgaggaaatgtcttctatgaatgtttacatgggtgaacacatgctttaaatatgcagtggaggagaggtgcattcagttaacaaagtttaaaagaaaatccctcattatcaattacacaaagcatataaaaatatttctctgaatgcatagattaagactcggaactcccctaagagcaaccatgcagtttcatcccactgccagagacactgaccccagaggactgtggcaaaggacaggacactgggcagagccatgggggacatgacctttggtcactctgaagtgctcgattgctcttgtgtcatccacctcccagccaaatcccactgcttctcagaatctctaatcaactagggtggctgaaggagtctgaaccccagtaatttagacatgaattaatactgagtttatttcttccaagatagaatcacagttaactgaattactaaagtttttcaaagcc

SEQ ID NO: 917 - DNA, 588 bp, Rattus norvegicus
  Genbank Accession No. AI104251
caagacaaaaaggcttttctttattgtgcctgtgaaatggaatacaaaagtcctggttaggtttgatcccctgtcccccaatcacagccagggactgtcaccctggaagaggagagtgaggaggtctagactcttcgaggtgggtcctgggaagtgagtccattcaaggcaaatggtcaagaaaggcaaggagggcaaggtggaaggcttctggcttgtggaggtagcaggcatgacctgcattgtgcagcttcaccacggagtggttgggcaggtggcggagctgctgaagtgactctcgcgccaaggtgtggtccagttccccatacaggataagagttggggtcttcacagcctggaattgttcctgtgcgtaattccgggtggaggtgggtgcgatgggcacgaatccacatagctggtggtggctttgcatcaagaagggtatggcatagctgccactcagtgaggggctcaccaacacagtattctgcagctgtaggtcccggagcacgccctccagcaactccactcggcctgactctgtgctcacctcctttgaaggggctgagttcccaaaacctggaa

SEQ ID NO: 918 - DNA, 615 bp, Rattus norvegicus
  Genbank Accession No. AI104258
gtaggttgactgtttattcaatgttaatgttacagagttcgtacactgtcggaaccatgcctgagaacccaaagaaagaaatggtgcaatggacagcctcatccacccagacagtgtattaaaacttgattcatatgcattttgatttcacaatcttaaaaaattataacaagacttggaatttacatctgctgcaggtcttcagcgttccagtacagtatgccattaaacaaacctcgtcatacgtctctgttcacttcttaaaccagaaccccgaacagaatttgtctatgtgtgtgaagctggggtaaagcatacattaagggaagattgtgactcaaggtgtgagattacttgttaaggttttctggtgcccaaattaagccttcagtataactaagaatctcaagcttctaatcacccaccctcctcctggctggctcagatcatgccaacactgttgcccagaagtggcatacagtctggtcaggagacactggtctgcacctcctgcttcccacactgctgcactaatccactaatctgcaagacatgctctcaagctgggaaaacttcactcattccggttctactactgtcagtagtgagcgagtc

SEQ ID NO: 919 - DNA, 580 bp, Rattus norvegicus
  Genbank Accession No. AI104279
ggtgggaggcagtcctttaatggggtggggcacaagatagcagaacttccatccaagagccacaggaactgaagccagcgtgacgcggcaggcttttcggtaacaatagttgagatggcacaggtgaagggttgggcaaacaattcagctctggtgagctctgccacgccccactgacagcatctggtacagactaactcaggcgtggaaaacgagccaaagtccagaggcaggagcccacacgacagcacggaaggtgactcatgtgaggctgtcaatgagggagtcccgcatgctggtggcaatggtgctaggtttggcttcattcagcttgaagacactctccaccactgacagctctgtgctggtcgtgtccaggccacagaaagcacaccaatcattcactaccatcccggcagcaatcacctcgctccctcggttcacagtgcctgccacaaggggaacctgaagaagggaggacagctcatcctgatcctcgatcgaagttttagggtgcaccagacctccttgattactgaagacacagtagcttccaactaacacctggtcagcaaccgtc

SEQ ID NO: 920 - DNA, 560 bp, Rattus norvegicus
  Genbank Accession No. AI104296
gcagagtaagctctcctcacgcagtctttaactcagcactgaccggacccacaccagtgcttttttttttttttggttctttttttcggagctggggaccgaacccagggccttgcgctcacaccagtgcttttaacagttccatccctcattccagagaggaggggaagttcttctgtggactctgctggcatggtgagcaatcacaagcacttcttagagaaggcacagatactcaggtctagagtacagtcaggtccagcagatcgtcaggaccgggtgtcccgagccctccttcggggtctgggaccacagctggaactaggtatggagcccaggccaggaggtgcacctgggggttggtagccacattcactggggtccaaggggtcccgactaagcagtacccacactgcaggcacatggcgtcggactgtgagggggtccaggcccgtgtccggtgaagttgggacccagctgtcctcagtttgcaggaagcgaagcttggtgagctggggtaggcccggaaaccgccgtttgacaatctctgcacagctgac

SEQ ID NO: 921 - DNA, 472 bp, Rattus norvegicus
  Genbank Accession No. AI104340
cacaaagacagccgcatcatcaaagccaacccagcatgggtgacagctcacaaagctggaacttgcaacacactgcacagcctgcaggcatcaccacaaattgaagagtgtccctttcaggtgactcagctggtctgagctgcttccaggcagctcatctggtctttgttttctctaagtagttcagctgtggctatctgtttcttctaggcagcagtctatttcctttgggaaggaggggcctagtgcatatggtcagtttcaggggcttcgagaagctattttgagtgtactgcatctcttagtgagcatcatcacagcattttcctccctgtgttggttcatttccctaaaacattctgtcttaagaaatttcacacaaaaatgggaggttgtaatcttaagaactgccacacactggtacaggctggcacacaccctattgtgtgccatcatgaaatcaggtgactaa

SEQ ID NO: 922 - DNA, 596 bp, Rattus norvegicus
  Genbank Accession No. AI104342
acgggttttttttggggggtttttttttaaacaggtaccaatttcagtctatttaaatatagtattaatacatgtaatatttcaatgctttgatatctgaaatttattgatttttgttcaatgacatgaaactacactgtgatgccatttacagaagcttgataaaatatactgaaaaatacttattataccacagtaagctttaaaaaaataaaattaagccattacagttaagttacaaaaaaggtgaaaacacaaaacatggctaacagtggtgatctaactgggtaaacaagacaaagaaaataatttcaacatttactcatttccttaacatggtagtctaaattaaattcctaagagtgggaggaggccagcttcatgggtagtttgctctgctgtgcaaactgaggtccacactacagtttcaagataaactacttagtcacatctgagcagggaactaaaggaactgagccatcatgatggagttaatttcaacatctccttacagctttcctttgtctttgtttttgagacaagctatcactatgtaactctggctacctgaattctagactaaactggccttatac

SEQ ID NO: 923 - DNA, 569 bp, Rattus norvegicus
  Genbank Accession No. AI104357
tttctctttacacaatgacgtgttgctggggcctaatgttctcactgaacagtagaaaaccaaaatttgtcatttcttaaagaattgagtacaaaaaccttacataaattaaaaggatgaatacatttacaggtgtcgatgcaaacgttcccaactcaaggcaagtaacaacccatggaggtcaggagggaaaaaaccagaacagaaactgggtcctaaggctcggactttcccaccctgttagactggcaagaaaagaagtggtaactagttcaggaacccttgccagcctcgggaaatcctggaagtctgctgttggttaataccctgcacagatcactacatggtgctcacagagatccactaggctggggactgactgacttttccacagatctccccagccaccaagtgaccgagccacatgaactaaggactaaatcaagatatgcacagggtattaaacatataccaagggaacagttaacttgaatacaaggtcaaaaatcagcaacaagttctacgatccagtgctgatatcagatacaagcttcaaggacaaatttctt

SEQ ID NO: 924 - DNA, 598 bp, Rattus norvegicus
  Genbank Accession No. AI104373
gagggagaattctttattgcgtgaggcgcgttggagggcagcccagcagggcacgacctcagccagctggcggtcagggctgggccggacgccatgggcctcttttcccgtcttcctctggtccctggggagccaccctcactcggcagattcggcatcaaacctgagttcctgcagaacctcactgatggcctccatggttttaattacctttatcttcagctggtgcaacttttcagggtcctgttctgacactcctggtgtccccatcacctgcagcagcgccaccgtggctaggcgcgtctgttctagctcttgaaggttgcgcacgtggcgggcgagcaccggttgcgctcgaggccctgccagctccgcttccactgccagtacctcgcacgaggcagcggcgaaggcctgggtcacctcatgcacgacactccggtaactcgggaagtcatggtgcagatcactgagcaggtactgacggtgagcttggtctagacggcggaaggcctgtgcacgttcattctgcagctgctggatcctctgcaccagcgtagcgatcggggcatctctccaggcccacgtgggctccgca

SEQ ID NO: 925 - DNA, 532 bp, Rattus norvegicus
  Genbank Accession No. AI104520
cagttcaagttatttatttaagccatctcctcttacgagcaaagggatggaggagcaaagtaatggtcaccatctgataaaggaaagatgagctgagcatccaatgggctttcgtggtccacacacaagagtcagggtccaaatcagtgctgtggtcccttgtcgcctgggcgaagagccaggttctctttactcatcttcatagccagtcggaagcgggttcatgtgaggattgtggaagagggtatggttaccatctccccaggggaagggcttagtcctgatgcggagatgggggtaggcgacgaactcgggtctctcgtgctcttcgtgtcgcgacttcaggaaaacgttgagcatgctcactcccaccccgggcagcgccacgaagtaggtgagggccttccaaatacgagctgaaccctcctcgccgtgggcgccactcgacatgggccgccccacccgtgggagggcccggcccagcagcccagagactcgagacgcactcagcaccgccgacgcccctcgggcc

SEQ ID NO: 926 - DNA, 596 bp, Rattus norvegicus
  Genbank Accession No. AI104528
aggacaggaataagttttattaattacttttctaggaaatagattcagtaaatacagcacttttggaacatacatgtgctgttacacaagttttttaaatttttaagagctcttcaatgatgtttatcaggaaaatctctcattggtggaattacttctccagtctccagaattgtatcacctggaaatattctgggcttcgtgccaacaatggcatatggtttagtagccacatgatatttgacgtaatagtggacgaaccagagaggtatgatcacatgggaaacagtgaagagactggtgcggtacgccttgaagatcatgtacttccacagggcccggtcccgcaaaaagttattccagaatcgctccaggggccacatcctgcgcgggggcaacacgggctcccgggggctcagctcttggtccttcagccatcgccttctcagctcccgcagctgctgcagccgcagcttctcatcgggcgtgtaccccgacatgtcgccggcgagcttaccagagagtgacagcgcgcacccgaacctggggccggtcacttacgcgcgatcccgctccgcaaagcgaccccttgtgcc

SEQ ID NO: 927 - DNA, 616 bp, Rattus norvegicus
  Genbank Accession No. AI104605
gtacagcagacaagtcatcagtggcactttattcagtcagtccttacatcaggtctttagaaaacatcatgcagcctgttagccccacagacccctgggttagcctagagtctaagaagtccttccttgtcagcttctacaaaacagggctgtatcacaggatgagggctttctcagataggtcccacaagtcaagagcctggaaccaaggcctgagcccccaagtgtgagctgacactcacctaggggccaaggggagagtcaagccccactaaaatctccgcacacctggtggtcagagcacactcattagagcttaaggtggtctgagtttccattcaatttcttgagtagattgctcagggttcagaagtatcactttgggctgttacacgaacatggaagatgtctacacattatttaggtgaggctctgggacccctggaagacagaagagggtacagaacttgctccttactgtggtcctaggacgcaagaccttgagaatggcttttaagaactagatggtgcccttcacatttaagatgttaatagtccaaagaagcctggtatttaggtgctagcttcccagatcctgtgcgggaaggtggtgttg

SEQ ID NO: 928 - DNA, 449 bp, Rattus norvegicus
  Genbank Accession No. AI104658
  misc_feature (1)..(449): n = a or c or g or t
ggcccttcagttatttttactagatttttaaatgctttaaatttttttttgtcctttttatcttttaaatacaaagtctgtactgtcccagtgcccaaagtcttcctttgcactagggtccagtagagtctgtatcttcaatcagaacctctgtggtagcaccgagtatatccgagttcatgaccagcccttcagtgcccccactgctgccacttcccacaaagatcttcccgtcagccataaggctcacccgttctgtcccactgcagtatgactttgacaacccttcagcttctaggagtaggcactctccagatgttgagtttcccaagggcttcangaagaaaaaggaagcccctgactatctgcaggttgtgtcaggggttctgggttagtgcccaggatatctgtgctggtgatgagggcacccgcattggctgccagagctt

SEQ ID NO: 929 - DNA, 473 bp, Rattus norvegicus
  Genbank Accession No. AI104685
atttaggacgcagactcagttccaaatagtgcttatacatggatatctgacatcttacaaaaatatcagaggttaaagtgtcacaagaatatcataaagcatttcacaaaatgtaaaagtcatacaaaatgtcattcaacaaacagaaaaaagaaatcaagcataatgaacttcctcagcaattagattataggttaattatatgctattataacatacacaaaatcagactgcctgctggaaaggaggaggcagatgcatggtccacctcgggatgtgcatcttccttgtcaggatgcctgtatttgaacatggtgtctgtaacagctggtggcatctgctggcaccctgcagataaggcttgacaagctggtctctaagactgcctgcatctcctttgctgaattacattgtatcagaacaatcctgcttgcctgtgaaaccctggcaaataaccttcggatttttatcaa

SEQ ID NO: 930 - DNA, 312 bp, Rattus norvegicus
  Genbank Accession No. AI104821
ttttttttttttttttttttttttttcgtttttaaaatgttttttttttctagcagtacattctttaaaagaagttaacaacttcagttccaaatataaggattaagtaatgcaaatgaaaagctgttgttttcggtgaagctaccgcctaatgaccctgggaaaagtagtcttaagaactgaaccggtgcaaaagtcccttagaaaagcttcatttgttgcctgtaaagagtcttcttaaggtcactttacgtctagaccatcgcctcgtccccaaaggaggagctttgcttggtaatggcttgtggttcc

SEQ ID NO: 931 - DNA, 422 bp, Rattus norvegicus
  Genbank Accession No. AI104897
aaaaacaccaccaaagtaaacctattagcttccatgagctggtcacacctggacagttggtagagctcccgtgtggtcttgagcaaagagcttgagccatcctgcagactgcagcctgagcgctgtgtgcctgcagactgcagcctaaggaccgtgcctgcagactgcagcctgagcgctgtgtgcctgcaaactgcagcctgagcgctgtgtgcctgcagactgcagcctaaggaccgtgcctgcatactgcagcctgagcgctgtgtgcctgcagactgcagcctgagcgctgtgtgcctgcagactgcagcctgagcgctgtgagcctgcaaactgcagcctgagcgctgtgaacctgctggtacccaaggttaagtgatcagctccaaaccatgcaagaaaaaccagcgacacccaca

SEQ ID NO: 932 - DNA, 350 bp, Rattus norvegicus
  Genbank Accession No. AI104953
ggttcctggtatttaatgcagataggctgggccagctgactgtccgggtggctttgaggggcaatcaaggccagctctccacttgccggacattggcaccatcaaagaacacctgcgtcggggaggcgaaggtgaaggacatctgtccaggcccagcggcgggggcaggtgaggcggcggcctgggcgtacgtacgcgcctggagcaccagacggcgcagacctgggtgacgaagcaatgcggcgggcagcatggtggcggaaacgtcagtggactttagcttagcggacagcagacacacagggatagcgagcctcgtgccgaattcttggcctcgagggccaaattcc

SEQ ID NO: 933 - DNA, 503 bp, Rattus norvegicus
  Genbank Accession No. AI104979
atctttcttccataggtttaatttattaaaataatttcctacaaaaatcaggacgaacactgagtgtgctgtgcatccttctcctggttctttacacaggacagtgctgttcagcgggttttgcttttcagtttctgtctggtacgttttccgggtctcttgtttgcccctttcttcccaggccttctggggcccttgccatgagccaccttgccccggaagctggagacatcgtcgtagctctcccgtgtgttccatttggagcctttcttctttccgccaaaaccaaacttctgatttttgtatcttcgtttggcattgggccctttacttatctgctggcctttagctcctcctgcctttgcacctcgttccacaggcttctgatcgccctcaaggaaatccagcttatcagagaagcctttctggtacttcttgatggcattcatcatatgcgctttctcctgctgcctcttgtgaaggacctcagtttgcaccttctt

SEQ ID NO: 934 - DNA, 668 bp, Rattus norvegicus
  Genbank Accession No. AI105080
atcaatctgcaatttttattgtatcacttaacacattttttttaaaatgtcatgacactctttgaatcttaagttgtctattcaggttttgaggtttaaaatgttctaagaacctccttgtcttaaagtaacagactggaatgataagcaagtgcatgtgaagacatatccataccaacaataggaacgtttttcaactgtgcactctaacatagacatatgtactctcatgggccttggaccttctaagatgggttcttcttaccaacactggcagaggatgctttcaaccctgtggccatccagaaaaagcagtcctacatagagtgtactatggaggaagagcttatcttcctttcacatcatgtacaggtcaactgtggctatacttgaagagtgagttccagtgacaaccatcacctaagacgtgcataaattcctataattagtgccagaaggacaatatgtttcactgtatagacaccagctgtccagtctagcttcaggacacctaggctttcagacatctgatacaaagggtgcttctggagtgatggcccctggcaactgtctatattgtggccacttctgaggaagcatcgctgataaacacaagctactgtgtttactctgtcacacaaagcctgctaactgactactccgatctg

SEQ ID NO: 935 - DNA, 504 bp, Rattus norvegicus
  Genbank Accession No. AI105243
atggtgagaatatttattgagaatggctcattacaaacaaaatatatttatgtataaaaccccctgctatgtaaaagatccctttcatcctcctgtggctagagtgatcagaaccatctagagtttccacgtgacctaagggcctacactgggtcgcacaggaaaacgagaagtctgagcgtcacacgctgtggtaagtatctgatggcaaggcttccttctgtggaggccacttcccatgagcactcacgccggtgtgtcacgcctcatcccatccactcgctgtgaagccttcacctcttcctgtcgcttggtctcagttataccagaccctcctcggaggacacccatatccatagcttctgtgtggtactcctgagcttaaatccagagctctgtggggccctgaccacccagcattaaggcaatgggaatgagaccagactgaaaccaatactactctccgaaacccagagtagctgcctagctgacagcactgccctt

SEQ ID NO: 936 - DNA, 492 bp, Rattus norvegicus
  Genbank Accession No. AI105272
tttgagataatttatacatataaaagggtttaaatacaatcacaccatcattgatttaataaagctcctctttccaagatcgagaccgaagaggcacttgctgtttgcagacaggtaaggcgctgtgcagtagaccatttctctggggacacagttcactgtgactggcatttgtcagacttcctcctcttcaaactccactaaaggtgcatgtctgttggcttgggctccttcactgaaaaacaccttttttatcctgccgtcctttggggcttttatggtgtgctccatcttcatggcgatcataaccatcagagcgtctccagcctttactctgtctccagccttcacgaacaccttttcaatggttccagtcatgggagcgatggtgcctccctgagttccttctgcactcactggagacaagtacttgggtactggaatgccaacttcaatactgccttccatagaaaacaggtagatccttgtgcc

SEQ ID NO: 937 - DNA, 409 bp, Rattus norvegicus
  Genbank Accession No. AI105301
ccagtctaagatctttattaagtaattcatcaggcgtgccaaagcatgttatcaatctgcacagagaatgagcgatgcatggggcacatgaatgctaaccacacattccactctgtgcatgaacacacagtgtatgagaatctgttttatcagaaatcagcgacccgtgctcccccaaccccactcccctgttctgatctggtcatgggaggacagagcaaaggaagcacagtgcgttgaagtgcacctgccttctgggtaaacaaattcaagtcggtggagaaaacattgttatgctttaccaggcttggaaagagtaatattctaatttagacaagtaattcctgctacaaaatccaaattatctctgcctgtctttgtctgtctcccatgtcccatcccaccatgg

SEQ ID NO: 938 - DNA, 428 bp, Rattus norvegicus
  Genbank Accession No. AI105383
ggaaaagtctctttatttgaatttggttctcaggacagggctccaagagcaactgtatgcaactggcccagccagtgggactctgaccccagtctcattctaactagagggtaaagtctttccaaaacatagccccaccttccagctttctctacaggggtccccaccacctccatatgagctttagaaataacctcccataccaggagatggatgagagggagggtcccatctcagtgtagacatagtagacaaaggcacagagtcatattggttcttctggaggtggcctccgctgggagtcccggccggacggggagtcactgctaccagagaccatccaaaggtagtttgggtgcacttggccctgcacagcttcacacaccatcagctccccgtccacagaaaacactcccctctggttcctg

SEQ ID NO: 939 - DNA, 453 bp, Rattus norvegicus
  Genbank Accession No. AI105398
gtgtggctcttgatgatttattgaaaagctccggtaagaaacacagcaagctgagtgatgcatattgaagaattcaaacggtacagcccatggatacagaagagcacttagtgctttgcccactcacagttttgtcaggtgcaaacacaatctgtatgattctccttagttggctgattcttttgattccttcagccgtgcatgttttctttgtgtgtgtgcgtgcagtcgggttttctgacagtgcgaccgatctgttcccttctgggcacctgcttccttcagctgattaaaatttcactcgtttcttacagaagcagcatgattgtttaagcgggcatgttcctgggacgtgttcgatcctttcatttctgcctcggctactattgcgcaggacatgttggtctgagtgctcgcacctgggcgccatgctttcctccgtaccctcgtgcc

SEQ ID NO: 940 - DNA, 649 bp, Rattus norvegicus
  Genbank Accession No. AI105417
accttatagcttgcatatttattgaacaaatacgactaaaatagctaaaatacattgggtacttatggaaggaccacatgttacaaaagcctgcgttttcagcagcgtacaactgcaactctacgtaaatgccacaaatgcacaataccgtttccttgctctatttacatagctgatatatctagtcaaacaaaaagattccaaagaaataacctcgaaacgcctggaaaaaaattattgcttttctttttctaagtcaggcgggtgaggctgcagaaaggaagagttctggtaggtcaattacagttttgtgattgctcccgctaccgtgactgcacatccacccagggccagtcacgagaggacagcctctcacactcttggtagcatccgctcagcctacaacactgaagaagaaagccacactcaagacacaaggaaaacaagtcagtccagtctagagaagaacattccgggaaacagagtaccaacaccttcttagaacatggaaattaaaaacaactccgtcagagctacctcgccaaggagcatgttgaaagtccaaaattgcaccattcatcagtgtctcaagccctgtggcagcgtctcagtcacttaccacaaggaaacaatgagtttcaaactactt

SEQ ID NO: 941 - DNA, 595 bp, Rattus norvegicus
  Genbank Accession No. AI105435
aaggcacaggctctttattttcctcttttatctgcttagtgttgaacacagaaggtactgctcctgggatagaggcaggaaggctcactgtgaagtccactacaccttctcacacaaggtctgctccgtctcagtggcttctgtgtcactcccctttgtctcttccagttccaaaaaacttaaaacagggtagatggagtttgatttcatccacagttaaaaagcactgagggccaagagccacactgagaattaatttcttcttctttctatagagcatatctgaatgaagaaagacatttcctaagtctcaaatcagtgtctcactttcaaccataaaagctgggtccatccattacttcttgagcaaagtatttctctgttgaagtgggttcatttttcaaccgtgaatgcctgaatcccagtaattgctctccccaggatcagagcatggatgtcatgtgtaccttcgtaagtgttcactgcctctaaattcatagcatgccggatcacatggtactcatcagaaatcccatttcctcccaggatgtctcgtgcctggcgggcgatgtccagggctttcccacagttgttt

SEQ ID NO: 942 - DNA, 657 bp, Rattus norvegicus
  Genbank Accession No. AI105465
ataatcattatataatattttatttaaaaattttgcttttccagagtacactttctcattgacaactcccacggtgggaagacagtttattacttagtcttactttttttggacagctcattcctgcacaagtgagagacatttgaagagtaagtctgtttgcgatctgtcatatttgaacccttctacaaaggagagctccctaaattgaacttcccgaaatctaactttcctcaatttccttcctaagacttaaaaacatcagtaattgagggcatctcctgattaaaagtcccctagaaacagagccaccaacagctggggccacctgaacaagagtggaaggttccaaacagaatactgttcaatttcatgcaaactctgactcacgaatgaacagttctccctcccagtctgaggagagaagtctactcttatcctgacagcaattagctggctctccttaagaaacagtgatcaaaggcaacatgagcttatgaaatgttcagttacaccatgagtcacatgagctggcgaccagactcagtgacaatggaactcagactcacgaatgagtgaacctaattcctcaacaaattaattctgaaaatagccatgtaattaccagacattctgcccaccaacggatttattctt

SEQ ID NO: 943 - DNA, 414 bp, Rattus norvegicus
  Genbank Accession No. AI111492
tttttttttttttttttaggaaagtcagagcaagtttattcacgggcaggtttcatgaagagagcgctaagacttccttctcagcttctggtgcaatcatctcagagaggcttgaataaaaccctctgtggaagtagctaccatgtcgcacagagccctagtgttaatcagctttaaaaatacgttctacagaagccaacaagaaatttaaatacatagacacatttttataagttatacatagtcataaaagagaaaaatattgaggagttaatattaaattttaaatcttattatagtttaagattagggtaaaccttataaggctttcatggaatttcatataattatttggggatggattcttaagaaatgggacttagcatcagaatgatgtagggagacatccacact

SEQ ID NO: 944 - DNA, 312 bp, Rattus norvegicus
  Genbank Accession No. AI111599
tttttttttttttttttgctacaataatgcacttttaatggtaaaattcttgacagcacaatgtctatttggcaaatcttctgttcaagcatccatccagtcacctctggaaaaggtgcacccactgcactgtccacttgtcagaggagcccttgaaattcagaaatgaaggaccttgtgtggagcttgccatgccttcagttaaagggacccacatgtggtacctgcaggaatatgctgtttagaaacatgtatttataacgtgttatttacccatgttcttaaatactgtttcagcttaacaatcaatct

SEQ ID NO: 945 - DNA, 471 bp, Rattus norvegicus
  Genbank Accession No. AI111853
tttttttttttttttatagaattttatctccttttagttaaaaaaaataatcgtaccaccgaatgaagcttttttcattttttgggggagtggggtcgggggagaggtgttgagaggggggaaccaaaaataaaatgcaaacagccaaaagtaaagggaatttatattcctctgtataaacatatccactaaggcaaacaagccagggccacggctgctgagctgggctgggcttggcccctccgattctcacaggttctaagaccgaaaaaataaaacctttgcaagtcctgcaggggtcccgggggctcttgaggcattgtagtaaaacaaagagtcatcgagtttcacgagcagtgacacgaggaacattgcataacggtggccccggtggccgttcacttagactggggtgacgtcacagttccacaacacagcaagggacacgcacgtacacacacgtaaagcgtg

SEQ ID NO: 946 - DNA, 496 bp, Rattus norvegicus
  Genbank Accession No. AI111960
tttttttttttttttttactttttaaaaaatttatttaaggaacacaaaatgcatctaagtaattttttttttttttgttttgttttgagatagggtctcccaagtcatgggatcaaaggtgtgtgtcgccattactcgcagagtctaagtgattttttaaaaaccaaaatttcaatgtcatctgcttacccaccactctctccaggctcagggtgtgaagacatcttctgatttccgtactaagtgtctgaatgactgagtcaagagcatgcacaatccagtgggctgggcactttgccacttctggctcggaaccctgaccaccctcccgtcccacaccagtctcctaggcccacagtatacacttggagacagctggtgagggtcgcccaagttagaacaagttttcctgtaaaaacctaactagttaggctcaaattccagcacagcctccctggcctgcaattctggtcaatacaactgccgacactgcac

SEQ ID NO: 947 - DNA, 393 bp, Rattus norvegicus
  Genbank Accession No. AI111990
tttttttttttttttttccttctttctccctttattgtccttcacatcatagtccctttaaacagaacagtcatccttcagcccccagggcttcttaagctatgggaggggggaaggggccccccaacatgacccttccctgagggtcttcttcagaaggtataggctcccacaaagacggtgagtctcagtacagagctggcccggtaactcataagggagttcatggtgaccatctcgaggtccaggacgtactcccggggtcctgtcaccggtctggcaaggaccagcatggcgctgacattgttgatttgcctaatgtagaagtccccctgtgtgttcccagcacggatctgaaaggcattgtaggcgccagggtagaccctcgtgccg

SEQ ID NO: 948 - DNA, 504 bp, Rattus norvegicus
  Genbank Accession No. AI112012
tttttttttttttttttaatagactgtctttttaatgagtatcttatgtacacacacacaccatacaacaagcttggttccattataattccatcaggtgctcaggtatgttcaatgagctgagatagagttgatgaagcatggcctttaggtcaggactagctgggttcaggcacatcttgtgtagaaatctaaggagcctggggcatcctctcccagttaacctaggaccttaagtagcagtgacctccccctcccccttcagacacaatgtgcccaccctattaacagtataaaaaccacaatacagatgtgaagaaatactgtcttcccatcccttcactaaaatgccaattaactacgctccctaaaccatgatatacattttacaataatccgtagaaaacaacagctaccagtcatgtacttctgcacagctcacatacatgcacagaagagtgggttcccagtcagaagtgagagtgaagacttagagcatccatg

SEQ ID NO: 949 - DNA, 379 bp, Rattus norvegicus
  Genbank Accession No. AI112043
tttttttttttttttttatatatacatatataatttattaaaaacacattagaatctcactatttcaacagcctaaattctagcaacatatacaaatatcaagtgactacagtacatgccgaggtaagaaaaatacattctgggagaatatcactgacactcgagctattttcacttctgtatttcaatacattttattttcaccattcccagtgccaaaaatgagagagactacacacaaattggtctaattgagattggtgccacagttaacctagataccctataaccatccaactccctagatttttgcagttcgaggactttcaagttcaacccaacagaattaacgacttctttttacagagccctgtcagtt

SEQ ID NO: 950 - DNA, 348 bp, Rattus norvegicus
  Genbank Accession No. AI112161
tttttttttttttttgtagagaaacatctttatttgggtaatatgtcccaaaacaggtcagttagtaaaatagattctacagagtacagccctatgcacagccctccctccccaaaaataatcctgggggtggggggaatctgtctccccaccccgggctcctcagatataaagttttggcaggttattgttattatctaggtttggcccaccatgtccactttctgtagtggctggtatcagtacctacttttctcattccagaccagttcagcaaacatttctgccccaccccaaattgtggggcctaaataaagagcaaataggtctcctccactcctcgtgccg

SEQ ID NO: 951 - DNA, 300 bp, Rattus norvegicus
  Genbank Accession No. AI112462
tttttttttttttttttagttgtttatgattttaatatctgtctcactcacaggatgcgtttgcttagagcttatagtcgctaagcatcggaaactatgttggtttatttcttctcctccttcgtgccagtcacgggcttgacctagcagggccctcagtgtgtggactctaaggggggggggagtaaagttgcagttctcttgtgctcagtgtccccaagcttctccaggtacatgtgtctcgatattcttcctcctcactctcctatcctgggcatttccacaagaagatgtgtctgt

SEQ ID NO: 952 - DNA, 476 bp, Rattus norvegicus
  Genbank Accession No. AI112571
tttttttttttttttttattcttttgactttaataactcatcttatatatatttatatatttatatttcttcttatcttcatttcctcagcaaaaggggaaataaaaatattgatctataaaataagcagatgataacacgatgccaaaaatagcttatgttaagtgcacggggtgaagcttgaatgcaagctaaattgcaacaatgtattgattcgacatttaaatacaggacttgcaataaaataatcattgagatatatgcttctacctcttaccgacattttagaaactaccctctacacgtagatccagttgtaacacttgacagtagcattatggagcatggtataactttggtacacactgcagatatggatagtgatttccgtaaatgacagtccttcaccagatgaagctctacacagaccagccacctgatcccacattgttccccaacactgtttgtccccgagt

SEQ ID NO: 953 - DNA, 312 bp, Rattus norvegicus
  Genbank Accession No. AI112636
tttttttttttttttttgcattatgaaaaaatagatttattgcccaggagttgcagaaacgtctcccgagcagaaaggcacgggtctcaggccctccctaggcgcttcttgatgaaatggcccaccagccgctgcggcctttgctggtattccacaagcacattatggggagtgttgatctgatccccttgcagacggtccagaagagtgacacacaccacagccgctttcaggccacaggcactgcacatggtggcaaacactgaagattccatctcgatatttcggacacccgcggcatgggctgcacgc

SEQ ID NO: 954 - DNA, 372 bp, Rattus norvegicus
  Genbank Accession No. AI112926
  misc_feature (1)..(372): n = a or c or g or t
ttttggttcttttttttccggagctggggaccaagcccagggccttgcgcttcctaggcaagcgctctaccactgagctaaatccccaaccctgagggtcacagttttaattccactgtcttcatctgcttaagattcctctgtgagagcaaaaaagagtgaagagccaaagaatttgacggctagaagttaggaattctggtggctggttcatagatcacaaagtgctgggagaaagacactatttcctatcagcaaactgtgaggtgttgactcgacacagacatatgaactcacttcaaatgctttcgtctgtgtggaccattataccaatgtggtatgacanacacacacacacctaatangagctaa

SEQ ID NO: 955 - DNA, 543 bp, Rattus norvegicus
  Genbank Accession No. AI112986
tttttttttttttttttgtgttaagggttcttttttaatgtataaaattatttattgtcaataaatttttatttaagtggttggtttgatttctttgctgtccatccaggcactctgaaaatagccctttcctcaagggcatccagttgtgctttttatttttagccctcttttatctgtcttttccaacagtcattggcaacttctaagttcttagccagaagatttgtggatttcttcaatttactttaatttagggacccttcttcaattagctttaaaaaccattttaaggtaggtttcccttgtgacgcccaacatctctgtagagtctttcatgtccattcctaacactcagaatcctaatctttatgaaggaaatgccagtgcttctagaaacaaaaccaaaattgcacatcagttttgtactttgttagctgtcttgtagttccttcccacagacctaacaaacagtcctgcgagtcaagcaaaaccacaagttactatatgaggcgtttccaacgatgtgtggctactaacgaa

SEQ ID NO: 956 - DNA, 461 bp, Rattus norvegicus
  Genbank Accession No. AI113008
tttttttttttttttctcatttcaacattctttattaataaaatgtatttcaatgtcaaaaggtatcactgttttcttcatttcatttcattcttctttgccagtcaggttaaggacagttgtaccagactctggagagggtctgccctgagcgcgtggtgattgctcttgctgttctagtaggcacatcgatgttatagtattgatctttggaaaaggcgtagtaatcatagccgtcaggttttctaatgttgggcagtgttatcgcggaagtaacgacatttgggaaccctctccacagtgtgctcaccttgtcttcattgtggaggaagcctttgtcttgataagaggctttgatgggcaccgagtaatggatcctgaaggtgtgtgtctggaaaggtccaacagcacgctcaaagcggcgcctcctgacctgtgctgcctgccccatacactgagta

SEQ ID NO: 957 - DNA, 451 bp, Rattus norvegicus
  Genbank Accession No. AI136295
cggccgcagcagaggctaccgaaccgaggggttgtcgttggtggagtccccagacttcggagggaaaggggcgtgacccggaagcggaagcccatccttctctcggctccgctaggtctgacggctgtcttagacctgctggtggagtcctaccaccatggacctgttgtttgggcgccggaagacgccagaggaactacttcggcaaaaccagagggccctgaaccgagccatgagagaactggacagggaacgacaaaaactagaaacccaggaaaagaaaatcattgcagacatcaaaaagatggcaaagcaaggccagatggatgctgttcgaatcatggcaaaagacctggtgcgtacccggcgatatgtgcgcaagtttgtgttgatgcgggccaatatccaggctgtgtccctcaagatacaaactctaaaatccaacaactca

SEQ ID NO: 958 - DNA, 400 bp, Rattus norvegicus
  Genbank Accession No. AI136327
  misc_feature (1)..(400): n = a or c or g or t
tttttttttttttttttccaactgctaagggattattttaattatttgaggtggggaaactgagccccggagagagcaaagactctgcccgatgtcacacaggatgccagtgatagagcccaggactcctgcttctagttcacagtatctttccccagggcaggtgaatgagaggtgagatggggtgagttcgtctgtcttgctgtttggactgagggcaagatactaggtaaggagtanagctgaagaaagaggaagaccctggcacgtaccaaggctgagattaaaaaaaatacaaacccagcgattccccctccccccaaccccatcctgccccaaccctgaagtccggctagggtcaggtccaagttcaagtctaagtgagtccgcatttgctcca

SEQ ID NO: 959 - DNA, 347 bp, Rattus norvegicus
  Genbank Accession No. AI136372
tttttttttttttttttcagagtgaaaaagacaactgtattggatttacaatcaagatttacaaaaaagggtgggtggccctgggggaaatgctgctccagcacccccagatccaggcagggcctccaggacagcctgtttaacagctgagacggggacctcagtttactgggtccctctggcacccaggcaggtcctgttggctgtcttctggctgctgggagactcccaccttagacaggataagggtggctccatcccggacattgtagtgcatcaaggtgttgatccgtttccaccggccttcccgctgggaggtaaggtccaagtcagacagaatctgggcc

SEQ ID NO: 960 - DNA, 561 bp, Rattus norvegicus
  Genbank Accession No. AI136460
tttttttttttttttttcatataaatgtactttattgttttaaacagaacgaaagaagaggcagaaaacatttgcatgtaagtcctagcttataaatgtagtttttagtggtggcatctctaacacgtcgttcagggactgtttccttttgcctccttgtactgtgagcactgacacttgagaaaagcacatctggcggacatatgtctccagaactggaagaacttggagagcaaacatttttcttaattcctctaagtaatctttagtaaaacaaaagatgatctttggcatagattcatactttaaaggcattgatatgcatttatatcaggtaagcaactatacagatctgctgagagctttcaaaagaatctgttatcagctgaaaggaaataggggaagcctgagtattcagggtcaacttaagatttgcaagttcagtgttggggtcaacatactagatgtgggaagaacatccaggaaggtcttagtcctgtattcacctggttcttgatttctggaagaagcatccatgcgctaggaaatgcttatacagcc

SEQ ID NO: 961 - DNA, 341 bp, Rattus norvegicus
  Genbank Accession No. AI136493
  misc_feature (1)..(341): n = a or c or g or t
tttttttttttttttttcacagttttaaaaagtttatatatatatttatatatatttatctttatatataattaaaaagttgactccatttaaaggtgtatgatacaggggcaggctacagtaaactgtacaggtaacctttcggatcctcctggtggaggcgccgggcgggccgtgccgggcgtgggcgcggatttcagcaccattggggatttctgtagtgtaagggtctgagctggggggcccacggggtatggtgatgctcctgngctgccctcccctgccttgttccccaagtccaggctgtcctgaaagggtggaggccgggcatgcagatgccc

SEQ ID NO: 962 - DNA, 434 bp, Rattus norvegicus
  Genbank Accession No. AI136665
tttttttttttttttttcacgttacatttcttacccgtttatttagatgaattgaaacatttctctctcttacacatccatgtgcatacacaaagtttcatttttatatgcaaatgaagccacttctgctgattggttgcctgatcgggttcgtagaaaaaaaatcaccaacttttgaaggaacaaggctagcagaacctgattctgagtcctgagtgaaagtctagagataagtaataattaactataaccagtgggcaacccaacattgaaatattggtagtgactcattttatttggcctgccccatccagaggacccaaagatgaccccgggattaaccttcagtctaatggaattgagattatgtggcacctaattgtctccactgagttggatgttgtgcttggttggttggttaaaaacttgggcaa

SEQ ID NO: 963 - DNA, 449 bp, Rattus norvegicus
  Genbank Accession No. AI136891
ttttttttttttttcttgaaaaaacggggtttattgatttttaaactgcaaatagtcgttacaaaaagtttttttttcttttaaataaattcacacaaagaaagagaaatagaaagcgacggtagtgaccagcaagaggaataataattacattcatctttatgtgtgtgccagttgtttacatcaacatcggaaaactccaacctggagtccagaacctcaaatctgcaagcggaatgtcttgagatgggcacatggaattcaaagggtttttctctctctctcttttttttttttttgttttcccttttagaagctatacataaatggtggttttccttctgtactgtcacagaacttatacattctcagtcctacctgtgaaaggcctaaggagaaaaaaaaacctttgcggccgctccaacatcagaacctcgtgccgaattctt

SEQ ID NO: 964 - DNA, 387 bp, Rattus norvegicus
  Genbank Accession No. AI137062
tttttttttttttttttaacattgttaaaaatatttattttgatagtctatcgtaagtcagtacagactccactctgcctcagatgtgttgaaatgacgtctcctttctcatccagccggagcacacacctcccatgttgcactgcgtccagatccagatgaccgaacagtcctttatccccaaagtaggcttaaaactgatggttcaggcattccaggatctgcaccccttgtgaatcccaggtaaatcacgagaggaataaagccccagcggatggcaaactggccgcccttgaagagctgctgcagcctctgtttggcttccttgctcagcttcaccatgacgacgacggaccagccgaacgatgcctcgtgccgaattcttgg

SEQ ID NO: 965 - DNA, 446 bp, Rattus norvegicus
  Genbank Accession No. AI137211
  misc_feature (1)..(446): n = a or c or g or t
tttttttttttttttttactgataaaatagaatctttattaatgaatagtgtttagtcatagtttcaacaactattctctttcaacccggaaatgacggcaacttctgtcccaacaccccaagaacgtcgtcggcttttccttcctaagtctcatacatgagtgggatgaagatataggaactgtgccttggggaggggtcactgtgtgagggctggtgcanaagttgctgggaggggactcctggcattctgtccacccagagaaagacagatttgctcacgctcactgcaggcgatgctggccctgccgagcaactagcacacatagacataaggtctaagctggccaaggccagtgagagaatggatactggttcaggagggcagctgaacagcaagagccacagagagagagattattcctgaggtangaacactgtatgca

SEQ ID NO: 966 - DNA, 563 bp, Rattus norvegicus
  Genbank Accession No. AI137224
  misc_feature (1)..(563): n = a or c or g or t
ttttttttttttttcttcgcnaaaaactttatataagtcacacgcattcaataagccatctacaacggagcagaagacctcaccgaactaattcgtaagtctctcccagaagtgggttgaagggtttcccagtgcgctcccactgagaagcaacggcagacacagcaaatgcagccacacactgcatcctttccacaggatcagagaatgagctggctttgtggatgaggtaagtgtgctccatgtactcagtcagccgctgcagaaagctcagaggctcattaaagatgactggcattgtgatcttggacagttccatcccaatgcatttcctgaggatgctccagatgctgaagtcatttctggagaacatgtgatggcaggcttgttctgtgctttttaatgccgttggagagcgcatctcctccgccacagtccttcncttcggacattctgtgcttcncgctgttcgcaggcacttcgttctcttcanaggcgcgtgctgtcacagcttccagacaagtcagcgacccctcggactncggacctgacagtgcatcata

SEQ ID NO: 967 - DNA, 348 bp, Rattus norvegicus
  Genbank Accession No. AI137302
tttttttttttttttttgaggatagaatactttattcactcataagggccaaggaaatgtagctggggactatgcatggttctagggatccccggtgggacattccctatcgcccagtcccagagcaccccgacccaggtgcaggcatggaaggaacaattcaggtgcaagtcccaagtgcccctcgcttccccgccgtggctcagctgccctcgcactccgggcagcgctcggtgggcgtggcggctgtggcactggcgggtagcttgaagtctcggccgcagcccgcgcagatgtagagacagcgccgcatgtgcgcgcgacggtggcggatgaagtgtgagctga

SEQ ID NO: 968 - DNA, 504 bp, Rattus norvegicus
  Genbank Accession No. AI137303
tttttttttttttttatctgcttaatctcacttttattacactgaaagcaagaagaaagaagcaggcaacaaaaaaacaagatgaggctagaattgcatccttaccttggactggttttttagataaagcagactttgaaagacctatatataagacgttgtgcatacatgaaaactggctaaggggcagagtgttatttttaggctgaactgatggacacactgattaaggataagtgggaaaagtgcctaattgatatttcctttcttggatgatggaaatactaagaggtttgcagtctttctagctcttttgtagtttgctactttgaataactcacctgaactctcacctctaacttagcaactatgaagatgtgtacaaacctgacaaagagaaaagacaattaaacaatgtaaaaagagctttgtaactagaaagtaacatccaactattcatgatttcacactgttactgtatccacttggcttgacagaagagca

SEQ ID NO: 969 - DNA, 540 bp, Rattus norvegicus
  Genbank Accession No. AI137406
  misc_feature (1)..(540): n = a or c or g or t
tttttttttttttttttaaataagaaattttaatatttaattattaattaactgcttccaatattaattaatcttacaactgtgacatttctatggttctttcttccctatcataccagtgtcccttcccaagttggacacacctggatacattaaatgttttattttggtgacagacaattccttttattttagttagatgttttgaatgcctacagtaaatctgcccattccgggaggtcgcagacctcctggcctccccccaagtctatgatctcattttcacagataaacacccacttctcagaccagctacccaaagcatgcatgttctcgagtcctttgcaaaccggttattttgtctacataacctcctcatatcccttcctcacattcttcgtaggcagatgctggagctgttgctctaacctcctgagatatggtggcccgctgggggagtctgtttggcttcatttgaccttcncataccagctcncaccagtccagccctttctctgaggaacctggagaaaaattagc

SEQ ID NO: 970 - DNA, 418 bp, Rattus norvegicus
  Genbank Accession No. AI137516
  misc_feature (1)..(418): n = a or c or g or t
tttttttttttttttttggtttcagccactttattgtcaaggaaattaacagcctgaaggggttccccaggcccaagcgctccccccaggggccctggggaagcaggcaacaagcgacctggtttcactaccccgtcctggggagaagggacgggagaggagaagggttcacagcanaagggcttggggcgccccgctcccgcccactgagctcagtctgggggcagccgaggtacctgtcccaggggccttanacccttgcacctggctgcgcatctggccggggcaggggcggggcgcatgctcactcgcccgtgtgggtccgcaggtggtacttgagggactgtttgtagcggaagcacttancacagtgcgtgcaagggtanggccgctcgcccgtgtgcgctcgctggtgctc

SEQ ID NO: 971 - DNA, 475 bp, Rattus norvegicus
  Genbank Accession No. AI137579
  misc_feature (1)..(475): n = a or c or g or t
tttttttttttttttttggggaaattattctttattgaaaaataccaataatactgacagattccaaaagcagttactgtcccagagtacaaagcgcttagctcatttaccccaaacctgtttgcatctcaaggttagcatttctgtaaatcaagatacaaatccgataacttcaataaaacattttccagctttattctttaaggagctgtataccttcaaagtcagggtcacgaggtcagcaggagcacggggcagaatgcacccggcactccctgggcgtcagtttgcagcaacactggaaaccacattgttggtgctggaaacaaaaatcccgcacaagatagctgccctccaggatgagagggatgttggaaacagcatgtcganagatagcttgtttttcttataattaacacactattattttaagattgctctttggaggaaatcttaagaatgcactgtaatttcc

SEQ ID NO: 972 - DNA, 415 bp, Rattus norvegicus
  Genbank Accession No. AI137586
  misc_feature (1)..(415): n = a or c or g or t
tttttttttttttttttaaaagggtaaacgtttatttggagttagtcttctggcaggtggtattaaggcccttcaggcagagttcaggagctcctgtatggctgcctgctgctccggactgagttgagctatgcattcagtccacaatcctccagaagtctgtacttggcgaactacattggccaggcgtttggcacaggggtcttcatgtttgatggcctcatgcatttctccttctgcaattatactgaatattttcggtagattggtattatttgggccaagaacaattggatgattactttcaatcaggtcacacaggtaactgaaggtctggacagcttcttctttatcttcatgtanggggagccacgacagccagtgtggtaagacctcctccacattcacgcagtca

SEQ ID NO: 973 - DNA, 490 bp, Rattus norvegicus
  Genbank Accession No. AI137752
  misc_feature (1)..(490): n = a or c or g or t
tttttttttttttttttaaattttaaaaatcagcttttacgatatagaaaaaacccttgctttaaactctgagcaactagaaatggaagacttggctcagctcatccaggggctcttacacagcagacaagcaccaccaacactgcagtgctccccaacttagtaagatccaggactcatttctccaagactgcaatgcatttttggtcacctcatttcccaatgccctacaacagttaccactgatatcccaaggccccatgaagtcagggttataggcaagcccaagggaagcatgtgttaggaatgtggactcatgtgggttttaaggaaaggcaagacgggaatccttaagccaagggcgaagtttagggggcgtttcctgngtatgggaagtttaaaaacaatagtctttcatatcattggnttttgttggtctttaatattttctctgtgtgtagccctgggtatcctggaactctgtagaaca

SEQ ID NO: 974 - DNA, 442 bp, Rattus norvegicus
  Genbank Accession No. AI137932
  misc_feature (1)..(442): n = a or c or g or t
tttttttttttcttgttacagtgctgtttattgattccaatatctgaggggaaaaaaaaaaacaccctgccatctttcatgaggagtggctgaggtccaccatagtaaaatcatgagcttggatttcggcaaagaacaaatagctatggtagcctcttactcctgacagtggccactccccaaaaggtagaggctgaaatgtccaacagcaccttgggacaagatctgctcaggcctccacctcatcacagatgagacaatatggacagatgtcagcctgtcccacaggcaattcccacctgttcttcattggcgtgagattcagatctggccctaaaggcaggggattcctgagtcatgggtccattanaaagcgagcgattgaccgcactgccgggcaggcctcgggggtggacagtgaaggagttgctgccggtctttt

SEQ ID NO: 975 - DNA, 477 bp, Rattus norvegicus
  Genbank Accession No. AI138024
  misc_feature (1)..(477): n = a or c or g or t
tttttttttttttttttgaaaggaaagcagggacactcattgtgtgtctttatttcatctctctattcactgtcacctctgactctctggggcctgccctaaggagaggcagagccttgggcactggagagctggccacacactggccacagccatgtccttagtgcgcttgtcagactggcacacaccagtgacctcaaggaccactgaggacactgaggacacagccagcagtcagggtcacctgagctcagacaatcagcctgggactggggaaactcacttggtaacttcatcctagtggttttgattctggtcaacctgattgcaggggagggttccatgtgaggtctctggaggcccacagcacatgattgccaggggctgtttgctgcctctagccttggcctgngtggctcctctgttccgaggggtanaactgctggagcaactgcttcttgttcaccctcgtgccga

SEQ ID NO: 976 - DNA, 401 bp, Rattus norvegicus
  Genbank Accession No. AI138034
tttttttttttttttttgattgtattcaaatttttattctctcaacaaaaaaacttaagacaatgattttaaataataaaacatgatatattctagacacttaattgttttctttttaaaaagacagtttattataaatttggactcctacagttctggtgtggcgcctcgacatttacagtatttcttaccattttatcttcactccaaacttgctaaacaaagagttcctctccgcaccctcgaggcttcgctttaaggaaatacttcacgaccacacgaaacccacacacacagaacatttgtttttttttttttaaaaatatttacagaagtctgtccagccatttggattttgtttctttgcccatactgagatcaacaaaaaagccctcgtgccg

SEQ ID NO: 977 - DNA, 388 bp, Rattus norvegicus
  Genbank Accession No. AI138105
tttttttttttttttttaaagtgttgctgttgggtttcgtttggctggttgtgtgtacacagtgtatacaaggtgagttgtacagcgccgagtaagaagagcaggaggtcaaggagaggagggaagagggcaggagggagcagggccggggcagagagaggcattaaaaaatagaaccacattgagaagacaaagggaagcacggcggagggccggggagacagatcgctgtagaaaaggaacaggaggggcaggacaaggggagtcttctccttctccgcaggtcgaggtggggatggcttctctggggcagggggctcgggtacagcagactcaggtgttggctctggaggccgctctaacatcattttctccctcgtgccgaatt

SEQ ID NO: 978 - DNA, 481 bp, Rattus norvegicus
  Genbank Accession No. AI144801
tttttttttttttttatgaattaatgtattctttaatataagatttctgttgtgatttagaacaataaataccacacagtgaaaaacttattatcaactaacacagcagcaaaagaaagaaaaatgcatgtacacatcaccatgggcaaggtcttcataataaattatagtacagtcccaacacagtatacttctacacaaagtcactactgtgagcacttaaagaaatttgtcttttatgtcttaaatctggatctaataaagtttatacaatatcaaataatatcaaaagtctaaaaaacacaatgagttttgatatgtttataaattattgttttatatactttacaaaacataaggtgaaaagtgcagcttaaaaaaagttgaagttgctcttcttgacactgggtagaaaaatgcactgtctcaagcgggagctatgtaaaggctcacacagtttctcggagaatttctttaagct

SEQ ID NO: 979 - DNA, 549 bp, Rattus norvegicus
  Genbank Accession No. AI144919
  misc_feature (1)..(549): n = a or c or g or t
tttttttttttttttttcaaaatatattagatttggtttttattgtagagcacacacatattagggcaaagtgctgcacacacaactacaaatcatttttgggaaaagaacagtaaaaaacaaaagaccaaaacaaaacaaaacaacaaaaacaaaaccaaaaaacaaacaaacaaaaaaaaaatccccaaaaaaacaaaaaaaaaacaaaaccaaaaaaaaccaaaccacagaagacctgtaattgctttagttatgtagtctcaatctgagggctccacactggcaaaggatttgaccccaaagagagacttcctgatggttggctgttcccatatctctgcagccactgaggcctgagggacagacctctgcatttccagaatggtggtagcagcatggctgctcagaaggcctctgctttctgcaggctctgttctggcctggctgccaaagccattcctaatgaacctggatcagcanaaccccacagccctccaggatctaagcagacacaaactgttaaagacttcacccttttttttccct

SEQ ID NO: 980 - DNA, 525 bp, Rattus norvegicus
  Genbank Accession No. AI144958
  misc_feature (1)..(525): n = a or c or g or t
tttttttttttttttgtccgtcaccaacgttttaataagagatgagcgcacaacgcacatttggctcccttgcgaggtgtccatcaagcaaagcggccagtttcctctggcctttgattggggcctggccatctccttcctccccctgcgtgcttctttcctgaatctcagaggggcggctcgtgcgttccggaatccgggagtacacgtggactgccttcagacctaccttcctcctgaggccaagacaacagcctcctgtctccctctgagatgggctttcctgatcctcgagccgggacatcctcccgggacccgcctctgtaggaccagccctgcccttgacagaggagcaggagagaaagcagaggcagagccggaaggggcaacaggttctccgtcccaagacttaatgggccggcacttggtgctttgccatggagatccctaagctcatgccgccacctacacacagacgagtctggaagcctgaggaaaccgggactcgctatgtantggggctga

SEQ ID NO: 981 - DNA, 500 bp, Rattus norvegicus
  Genbank Accession No. AI145010
  misc_feature (1)..(500): n = a or c or g or t
tttttttttttttttataagaaaagataactttatttccagtctgagaatgtattacaaacagatttttgaaacgcagtagagcaacacgattggccgcaatgcaggtacagatcgaggcttttacaggtgggttggcctgccagtcggaactgtaggtggcaatggagggacgcctaaggggtgggcacagccacactgcccctctgacgtggggaagtggagcacctctgttctgtgcaagggagcacgcagcctggggaggtagacagcccaagcacagagccagggtgacctgtgggcagggccagagccctccttatttcttccacctggtcctggccaccagcttcctggtcccagcaaggaggcacacagggaacgcttttggaaggctctgcaagaggccctccagcaaactgatctcaggaccctgggcaaactcagcttctgggggccaggcacacccctgtcaggcagcccacttctcanagccctcca

SEQ ID NO: 982 - DNA, 443 bp, Rattus norvegicus
  Genbank Accession No. AI145095
tttttttttttttttttatttgcagctgaatgtttattgcagcactcccaagtgatcactgttggatgaataaggaaacaattcataaccaataaaaatgttgaactgccttttttacagtaattgtacactcattgtgcttagtctgtaaagttgtatcctcagctcacccataaccttcccagaatagaacactctgtcatacattaacatagagccttcaaaaggtatacacaaggctcaactctgcaggccataccagatgctgtcccatccactagacagtttaagagggacacagcaagggccatgcagaccccatctcaaacatcccagtactaatactctgtatttgcttcttgtgtctgctttttctgaacatcaccacatccagttttccttcgcaagaagtctcctctcactggccatgcatttctgctcca

SEQ ID NO: 983 - DNA, 491 bp, Rattus norvegicus
  Genbank Accession No. AI145202
tttttttttttttttttcggaaagaaacaaggtttatttgatgaatataaataagacaatcggcacaaagtactcctcatacacacaataacaaagttatgagctgtacataccttgcacatggttatttctactaaacatgaggttacgatgactggctgatacatgcccgttggtagtttcgagggttccttaattttatttatttatttatttttatttttttcatatcgatgtccataatcacatggatcaaaatcacaacccacatgccactcacttgaagaaatattacaagaagcactatcaaacaagggtctcggggaagtagatacacggacccttggcagcattcaaacggcgctctacacaaagacagtgcagctagagtttatgtcaatacacttgagggctcatcataaacactgtttaaaaaataaaacccacttccaaatgaaagttgacacgctgttaacgtgcatacttaatac

SEQ ID NO: 984 - DNA, 451 bp, Rattus norvegicus
  Genbank Accession No. AI145384
tttttttttttttttttcaaggggaacacaaccggctttaatgaactgtcagtcagtgtgggggtcagaagtgatgtcagtggggaacagcttctggaaccggccataggcggcctgggtgatgacgactgtcacgtgggccgcaccgccctccggaagctcctgcacctgctgcaccacggcctcattgtagagccacctgcacgacacaggagaaccatcgccagacatgctggaaagcggtgcgggcgcgggtcggccccccacgcatgactcacccaagctggggtcccccgaggcgcacgcgtatcgtgagcagctgcctgccggtggcgcgcagcactgacgcctccagggccgccttcagctcgtccagcccacgccctgagactgcagataccgccagggctccagagcatggcatggtgtgcctgccgcctcgtgccgaatt

SEQ ID NO: 985 - DNA, 556 bp, Rattus norvegicus
  Genbank Accession No. AI145385
tttttttttttttttttaactcttcaaaaagaacacaaaactttattaagatcttacactgtcatcagatacagccaaagaaaagggtttataaaagacggagaatccccttctcatgtgctcctgccatctgagactcgatggcaacgaatgctgtgtataaacaactccattgagtaacccagtgttccctttctgtacagagaagaactgaattcacactgttaaaagccttttctggcacaactgagaagcagggctcatctttaggagtaactcctaacagctagtaaagcaatgtgggactttacgttacttcacatcctgtccatttcagagtgggaattcaggaaggccctcctaccttcccagtcactgtcctctccagacttctcagaccgtacgtgagccacacaccatgaagctactcatgacagtggcagcagacaacattctctgaactgacaatcatgatggctggatcatcctagactttgttgatgctaaaggatttcttagagaaaaccctgattcagaatgctgtgagcagctgtca

SEQ ID NO: 986 - DNA, 604 bp, Rattus norvegicus
  Genbank Accession No. AI145387
tttttttttttttttttcagtagtaactatctttattctcaaattgataaaaccatttaacatatattttacagtataaacaaattaaatgctatgcattttgcttataaagtgacttaaagtattcaagcatgtaattcaatttgtacaaaaagttaagttttcaaataaagctttggttagtaaaactgactatataccatcaaatccatttttcaatgttgttcagaaaagttaaaaaaaataacccagaacctaaactagcacaagtatttcctatacagccagagctccctactattcagtaagggtaaaatgttctcagagttgcctttgacgtggaactctgggccggtcttttccttctcaactgccgtgcctgaaagaacgccatcacttctgaagtttaagctgtgtagaaagccacactctcttttgttcttagttaggtcatctgtctttaggactgttagcttccatagcctcacgctttataaaagccccactgaaacatgctgctggggtgaaccacttctaacttctctcagagcaggcgtctgttagcactagtgcccagaacccaagctcatacagtacctaaaaa

SEQ ID NO: 987 - DNA, 394 bp, Rattus norvegicus
  Genbank Accession No. AI145722
tttttttttttttttttgctagaaaaaccaactgtatgaggtttatggaacaggggtgggggagaatttggtacatttaccattacgtcacaatgggcacaatctgatatacaattttagactagcagtatataaaaatactttttaaacaatacttttggtaggcataggtagcacttttaaaacaaacagctatgtagttttcaggtctttggaaggcctagaaacaattctatttaccgcctttggctagctcgacgaggacctggaaagcaagctctcttgcacgttatgtacaccccccccccccaattctacaggctgcagcttctgcctacacaatgaccactgcaagaggtttccttctgtcttacagtgggtgtaaaatgaggag

SEQ ID NO: 988 - DNA, 565 bp, Rattus norvegicus
  Genbank Accession No. AI145761
  misc_feature (1)..(565): n = a or c or g or t
tttttttttttttttttgaatcttcaacgactgatatttcagtgaatagtgtatttgttctttcaacttttctgtatgtttggggttttctttaataaaagaaattgtggggaaatggctgtctattgagttgccagttattggagggtgtgtgtaggagccctgcccagtggaattcgacttgggagggtgagggaggggtgagcaatctgtctggggtgaggggggttcactantgatctctccttggagagtacaatgctgatgtttgggttactccatcctgaagtagtttggaagaaggccaaaggatcatgagacagacattaccgagaagggatctaagacctgaagttgcactgagaaagtggcacggtgggggtgacaacctgctgcttcccctgccctgcttccttcattttttccaaccctaagacctaagagtagagaagatggtactacagttgactgggacncacaangggtaaagtgtctagagaccggccaccctgaagtgtctgctatgtttctggtgttgcgcgccctctcgtgggcttctggggaa

SEQ ID NO: 989 - DNA, 475 bp, Rattus norvegicus
  Genbank Accession No. AI146005
  misc_feature (1)..(475): n = a or c or g or t
tttttttttttttttttcactaagcaaaacatattttaataggaaaaaaatcacttcttttttaaaaaagtgtcctttcatgccaaggtgtatacacacaatgcatgggctaaaataggcagctgattcccggggtgagaatttaatatcctgaggttatgaagccaggccacatccacaagctggccccagattcttggctccccaggcccgggtgacaggcaggtgcggagattccagcctcagcactcacagcagggcagcatctacggttcagtcagtgtctccatccccttcactgccctccagggagctggggaccttggcacctgtgtcatccgctccaagtgcagtgccactgaagttgtggatcggcaaagtgttaagccactgggccatggaccgctcatcccgctcagtgctgacaatggtanggtagatgtattgctccttgaaagcagtcaccttcccttcc

SEQ ID NO: 990 - DNA, 483 bp, Rattus norvegicus
  Genbank Accession No. AI146033
ttttttttttttattttcacttattttacttttagtaataaattttttctatctcatacatgattggacacatattttgcttttaaaattaacagtcacaaagaaaagaacagtggtttatttttgcaatcatggtgaccacgcagacgaatcttaaggcctcaacaacactgcatcttaccatttctactgcacagaaaggccttctgttttgactctttctggtgaacagtgattttttctccggtggtttccgttggccaggtagtcatgacagatgatgtaccacggcgcttgctgtgtcaggggattctccaccagacgaatccttgttctgactgtgacagctgctggcaatctctcagtgcaagtccgtgcctccggcctctaccgtggttggcctaagaggcctgctttggctgccagggcttcattctcttcaggtttcacctctcttgttgtgaagtctttaacacagtccaa

SEQ ID NO: 991 - DNA, 632 bp, Rattus norvegicus
  Genbank Accession No. AI168942
gagggcgatgccattttgctttattgaacacaacaccaccggatatttgtagtcatgaaacaatcgtaagatcaccgcccatgtgccctctaaagtgttaccctcatgcactagatccaggaatccactttacacagccatgataagtaattcgcagctcgtcagccagtatccgccatagttcatctcacaaaaccacgtgtgagaagaaagaagtacaaggaaatataaaaagagttcagaaaaatatttccatatctggtcatgatcttcctggttttctcagtcgtcagtagttgatcatcttgcgaagggcatcatagcacttccatttgtctgggatataaaagggctcaaaaatgtgaggaaacggggtgtcatatccacacactctagatattggagcctctaggttcaagaaacattcttcctggaccgtggagctgatctcagaggcaaagccgcctgtcaagggcgcctcgtggctgatcaacagtcgccccgttttgatcacagacttacaaactgtatccacatcccaaggcacaatggtccgcagatcgatgacttcacaagacactccaagcttttcttgggccatggaagccacctcccggatgacatgaacctga

SEQ ID NO: 992 - DNA, 534 bp, Rattus norvegicus
  Genbank Accession No. AI168975
caaaggttcattgtcacatttattagtagtagctgcagctggactggggcttctatggggactgttgggacaaactttgaggggcaacaacaggagggaacaccattgatggtcagcaagggtcttaaaatgggatacagagcacagtgacggtcaccatggtgctgtcacagcacaaggagctactgggtgctcatttccttcctgaacattccctgagcctcagtccacgatggtcaacgcctcccacaaacctggagcttttggactctggctacttcctggaggtgaagtcacacaggccacgccctgccacccccaatcatggccagtcaattgtcttcagtaggcctcagtactgaacactcgtaactgcctgacacagctgaccctaccctacctagtgacagctggaggcattgtctccattcttgcctgtctgcctgtgacctgagaaagaaatggggaaaagaaacttccactttcccaagaaagctggaaaaaagagagggcagattgtttctgggcaggaac

SEQ ID NO: 993 - DNA, 577 bp, Rattus norvegicus
  Genbank Accession No. AI169020
aaaacaagtgtttactaaaattctggcaatagctttatgtaacaagatacagcataccaggcctgccactcaacttgtttgtggtaagtctcagcttcaatatgaagccgttaaaaacaaaaaccaaaagtcctgctttttacatgctaaatatcttgaaagtgtgccattaaacatagttatgaacttaagacagcaagagttagttaaaagctaaacactgcagcctaaacaaagtttatacaaaacatgaagtgtctatcactggctacgtaaaaatctcctgactggttaaaacttgtgtaacacatgcgctttacaactgtcagctgtcaagctcagaaagtaccagtgtctactaaaccatccctttccaaagccaaagtgtagtcaaaatgaattcaaatgacgcaacacaacgtaaccctaaaaacattcagttattattgatgtggaggtaattccagagctttgggggctttctcatgctgcaaagggccgggtacctctggttcattccaagcagcttacgacaaagtctaaggatgtcattaacctcagtcagggcaggactgac

SEQ ID NO: 994 - DNA, 609 bp, Rattus norvegicus
  Genbank Accession No. AI169115
cacgcaatggccaactttattcagagcatcagatggtttttgcaatcacaagggcaagcttcaagtgacaggctacgtgtgacagagacatgtgtctcagtagaggcatagaaaccaagaacaatcaccagttgtaacaagtaatctgaagtaaactcactcctaaccactacacctgagagggacagaaaaacagattccaagaacaattctgttaagaaactgaggtcacaaaactcttggcttcttggagttttctccgagcattcagaaatcccctcacacaactccattcttggaccatgttccgacaatggcagaacgatacccttgaaccgtaagccagaagagatctcttcttaagtagctttgtcaggtgttttttctcagcaacaaggcaagtaactcatgcgacccacctcccaggacatctgactggggtggggcctggaccatggcgcctttccctaacagttactggatgcatagaggtccacatcaaaccagagagttaggtggtcagtcagatcaggatttcagagagctgttgaatctttctaccagctttttatctcaagagattcttccttctaacttacgtttcttagg

SEQ ID NO: 995 - DNA, 631 bp, Rattus norvegicus
  Genbank Accession No. AI169144
aagaacactctcaggactgagcggatgatgttattttcagaaaatgaattttcagatattcaaatgatgcaaccaattgaaggaaaaaccatcagttcacagggctcttccttaaattcagatggacagagaggaatcctgccagtcaggtaagcatggaatccagggctgatgtgtcacaggctcacttcttcacgccgaggtcagtggctgatgtagatcacacccatgaggccatccacaggatagttgcccactgaggaggttggtaactctgcaccggatccagccacctgggctcagcccccgctgttctggatgtgggttctgagagcgtcctcagcacttaactaaccctttgttggttgaaggagctgggactgtttctccacacatgaactgatctttgtcataaatcacttttataatgagtgagcagctaggacacgttgccacatcttctccattttccaaatcttccttggtgatggagaagttatccccacaggggcaggggtagaaatacgtctctgtgtcctcgtcatattgaaagtcctcgatctccacctcgtcatgaaacaccgccatggtcacccggtccggaccgcatcagtttgcctagctgcgccca

SEQ ID NO: 996 - DNA, 703 bp, Rattus norvegicus
  Genbank Accession No. AI169156
ctcttttgcagctggctgccatttattctctcttttcaatcaccttcactctttgctcaccatccaattacatcccccggcccacccgacatcatcttgtgtttgagtccagcttcacataggtacacatatccactggttccaggcacagggcatggggagatgctgcagtgagtaactcattttttgcataacagtattgcttttgtcagtgtgagaataaacaggaaagccacgtttcttcataatctggtcttgtgaatagataacaaaggagacaagaccttgggcccggtactgaggcacggtgcctcccattcgcatctctccagtttggtccattagagtccaagatgcaggggttccctcaggccccaagacacaggaacttgggaagttctttatgcagcgttcgatgaatctctgactcctctcgttgccaccaaaaagccagaatttattcaccaatgcagcatgggtaacatccaaagatgaaagtttaaacatctcttgattgatagccttgggcttgccacttcctggtgataaattctttgtatccagcagggaaaggaacagtttcctaactgtctctgataccacatagaggatgttttctgagtgtttgacttggaaagaatggatgcttgcaagattttgtattgctttattcaagtgggactgggaactttgaatctgcaaa

SEQ ID NO: 997 - DNA, 702 bp, Rattus norvegicus
  Genbank Accession No. AI169176
ggtccaaatattcatttattataaacgagggtgcggagtttgaatgctcagaaacaccaattaacacaaaactaaaacagccagtgaaacaggaaccaacagggaatatggaggcattcacatctggtccagagctaccatccaggctctccacccccacccttggtccagataacccctggccctggtgtccctgctactggaacaaactggactgtagtacaggagtcaggtattctatgaagctggtgtcaagggaaacggactgtcagaggtcaggtttcctgttctccaggaaccaaggatttcaacctcaccaattatcacacatctggatacaaaaaacaggcaatatgtttggctaatcgtaaaaagacactgtagggagaaaccagagtgtgtagtagacagaggcccctggcctggaagccactggagcctgaatagtgaatacatgtggccctctacatagtcccaggaaagacagtgggaccgtccagacagacagctgatggagacggacggggctctctgcctagtgtgctctgacatcagtcactgacccactgccactgaggccccttgttctctgtccagctaaatgcagccaagccctgggaataaacccatagcagcagctagctggctactccccaaagcaggacatggacccacaaaaagcttgctctcctatgtgtggca

SEQ ID NO: 998 - DNA, 637 bp, Rattus norvegicus
  Genbank Accession No. AI169177
aataatgacaggcaatcaagtttattcgtgttcacagaacatactaggcgaccccagacagccgccctctgacaatccatggacccaagacttccagtcaggaagacatcaaaggccacagaccgtattcccaagggtctgccaaagtcttacaacagagtcgaagtgctggaaaatggagtgttacccctaaacctatgccccccgaccaagactaaactaatcctcccacaactctgtctcacggaccctataaatcgtaataaatatctgtgtcacagcaagggggcatatctcgcacccctgcataagttagaataaatattacatacacccctccttcacctaggaggatatacataaatacataaatattaattagacaccgagaagacctccgtccgtcaccagtgagcctagccaggacccacggtgcctcgggctcgccccaagaaccggcatcttggcggtagtgttctgagttagcgttgccttataagtcccagtttgggatacgttcttgcgcaccaggtacccctggtgcctctttgggttttttttccggactgtgacccatcgcgtttagaatgccgccgggtgttgctggagaaaagctttgagatccagagcatagtcc

SEQ ID NO: 999 - DNA, 351 bp, Rattus norvegicus
  Genbank Accession No. AI169211
gacaaaggcaaaagaatctttatgagttttaggtagtctggtttacatagtgagttctaggccagtagagatacacagtgagacccccagctccccaaaaaagaaagaaaaataaacagatgttactcacacttgatcttggctgagccagtagagatagctgtggaacgggcaaagagcttgacaggtattgtagttttgacacggcgaaccaaagggactgtaacacggggtcgcttcacgggaactgcccggggcacaggcactggagaaagtcggcctcgataatcaaacagcctgtatatggcagttgctgctctctttagccccttgggtctattaggcttgggc

SEQ ID NO: 1000 - DNA, 561 bp, Rattus norvegicus
  Genbank Accession No. AI169265
aaatcctgatactttatttcttatatcctagctatcaaatcccatatgaattttcagcattaaatagtgacacatatcaagtttcagagatttattcatcagtgtaataaactcaaaaaaaaatcaacatgatttcatgcattcggagacatagttcctgcttaagtggaaaattgtgcggatggcttctgaaagaccttcattgtaagcagctttgcagtgaacttcacagtttagaagtctgggccttcttttttcagtttgctgtagtccacgttcacagaatagaacttatattgttcattgggacccagtttgttccaaggctctgggttattcttcctgtcccagctgacatctggattgaacaatgccaagcgcatcacatacagtgctgctccagtaccccctgctccaataaacacgaagagagggatcaagctgggatgtttcttggcttgcccgaggatctggcggagcatgtttgcggcacaggcctacctacaccgagagagaagattaggacacacactaaaccgcttctgcaacctgcctcgtgcc

SEQ ID NO: 1001 - DNA, 657 bp, Rattus norvegicus
  Genbank Accession No. AI169278
cagtttccaaatggttattttatcagatcgttcaacattaaattttcgtcatttgcaattcaaaatagttacctgaagtttgcgttttgagtgtgtatttacttttattgtacatctgttttctaaactctttggcacagttttctgggggcattctgactgccacaatacaagtcaggagagagcttgtttgtgatgccaatttcaagtatttaaatttagtttgggttgtggctttttctctttgaagtctgcgttttatttgtaacaactgtacttttaattttctatatcctctaactccagagttttcttttttgccccctccccccatagctacattcacagctgaaccatattatcaggaaaggcgccttgatgaaaagatcaggacaggaactctgaccattcgtcagtgttttccctagaataattaaaatgaaaccaaaccaaacataaacagcgtctttcctcgttttgtgagacagcctcttgtgctgcatcagtagccagaacttcagttagtttatgaaatgcaacatgaaacccctttgtcttctgggaaaaagaaactgcaatgacttgaagttgagaatgtgggtaccgccttactcacacacactcattctcagactgtgaaatcccccacgcgccttt

SEQ ID NO: 1002 - DNA, 652 bp, Rattus norvegicus
  Genbank Accession No. AI169279
ccatttggctctttttattagagaaatcgagaagacagcgagtagggaaatccccatagtgaatggaaccatcacatagatgcctttctggaaccccaaccttctatgatccccaaaagtgtgcttgtgatttcagcaacttacaaaggggagaggaaatactgagaaaggccactatttaataatgaaggagtgaaggtgtacaggttcctaaccagcctagggccaaaaataagaaacaaaaggtgtgcgcagagcaagctagcctcagactgctgagagtaaggcattcaggtgccagcctggcgagttcccggaggcaccacaaggtcaagtgcacatggaggctgttggtagtgagctgcgcagacacacagggcacacgcatgcccacacacgcatacccagaaggaaagttatcagactacacggtggtggtgattctgttccctaagagtttgtgctatgttgaaccagagtctccctgctttgggaagaggaatgactagacccaaagacctctacttctgtaggtgtcatgaggaagcatttcatgctcctgtcccaaagtacgtgaccagagagtatgtctggcttctgatatgtgctgtttcccacaaacctaggtgagcttcctttcggatggacattg

SEQ ID NO: 1003 - DNA, 634 bp, Rattus norvegicus
  Genbank Accession No. AI169284
tttttttttttttttttttttttttccaactgttttttttttttaatttttccccttttaccacaaaacaaagtagaagaaatgattaaaactgccaaagtagttaactagtagaacatgtattagtctcacacacacatatacatgtacacaggaaggaaggcaggcttatttacaagaaaacatgtaaaatcaaagtgggtgtcaggaaacattgaaaaacaaacacatacatgctacaagaggcaccactgagtacagtgctagggaggggagtgaacagaggcagacagacaggttcagtcttcacagcatcagtgcaatggatccacaaaccatgttacagctagttcatgggttaaggagctgttcccaaatgtgtcctatttggccctcagaggttgagttctgcagattccgactgctctaaaagcctacctactgagagggcacatgatcacagtaagcttaaggagttgcaaaagctatgcagaccaaagtcaccgatcagcagtctgctctcagctgcagccctgcatttttctgagaaatatcaaggggaaagtcaaacaccagtaaacactgtctctgaagtgcaaagctggagtgactgaaattcagccaatacttcgaa

SEQ ID NO: 1004 - DNA, 662 bp, Rattus norvegicus
  Genbank Accession No. AI169289
  misc_feature (1)..(662): n = a or c or g or t
atagtttaatgtattttaatagcaaacttacaggaacagcacagaagacagacaacattaaaaacatgtacttgcatgtaggacaactccgttagaaaagtatagtgaatggatggaatctactgtatgataaaatgctacaaacaccatttagttgctgtcaataagaaatttacttattttaaaaaaatccaaatgctggcattgtccagaaaattttaacaggtttatttataattgttataaagttgaactgttgaaatgtgttcactgaaacattttgcttgcattaatgctttacatcttgcatttatattaaaaattcacacacaaatgaacgtggagaaactgccaatacctgattctgtcccctatgtttccactcgcaatcatatacttaggtacctttgacccccatggaaaaaatatctaacattcagaactactgataacaggaagaagaggaaaaaaaaattttttttttgagaatgaaatgtttcccctcatagtggactcttaagcacgttctccgcgtatgcggcgtgctagctggatgtcttttggcataattgttacacgtttggcatggatagcacacaggttggtatcttcaaaaaggccaaccagataggccttacttgcctnctgcaaagcaccaatcg

SEQ ID NO: 1005 - DNA, 561 bp, Rattus norvegicus
  Genbank Accession No. AI169311
tacacaaaacgagttcaacattcgctttagccaacccccagttgtacaaaaaaccatctattctgggtgtgaatctggttcgaagtctcctaatgctggccaatcagacccataggggaaattgccctacagagggatgaaaagaaatgacaagaaaggagcaataaatttcactgctaataaacgattgctttcctgctaaacaaccaccaatggccttccttctagccattccctcattgtcatggattcaatgcagggttcttcgccttccttcaggccgctgttttcttgaacatggtccctgaagtcttgaagcctcaattaacccattgtgaaaataggaatggtcatagccctcaccttgtaaagatggggtgagggttaaacaaagggtacaggagggctctttggacctgctgtttggaaggcatggcgttactgttagatgttaacacggacacctcactccctagggaaagaattggcggccaggagatgaagatcttaatccatgttcccatgcctcaccctgagtgtcctgctggcgtccttccacca

SEQ ID NO: 1006 - DNA, 573 bp, Rattus norvegicus
  Genbank Accession No. AI169324
ctattgaacggtatttatttttctacaacatgttaatagcattttttttcaacatcagctgtgcaaagacagttgagagcatcatgttgtgatcatagtcttagagcttgtttctgggcacagtgctgctgccatggtcctcgggcagcatctgccttccacagctgtgcttccaactggagtgctggtcattgttggcacatctgtgccggggccacagaagtcagccatgcccatgtagtcctgtgtagccagccagtggtctgtgagtgggtgggaaggctggtgtgtggactgtcatacggtagctgaggaaggagtgccgcccaccaggccctgcaggctcaacacagcctgtctctctgtgcatgtgctggtgtgtacccagcacacagttgccattcctggagccacagtgcttgatcctaaggacccagccagctgcagaaaggacttggtggccccatgccttaccagacctcactggtggtctctgacctcaaaggacaatttctatcttctgtaaaagaacgactgttggggttgattccgggttctattctgcctcgtgcc

SEQ ID NO: 1007 - DNA, 625 bp, Rattus norvegicus
  Genbank Accession No. AI169337
catgttacacaggtaaaaccctctttttattatatacagaacacattgaaatagagcatctcctctgaacacaagacagaaggccctggctttctgtaagctcccaaaagaacatgaatcatggcctcgaaagagttccttctcaaggtggtggtgcatgcctttaatcccagcacctgggaggcagaggctggtgggtatctgtgagttcaaggccaacctggtctacagagagccttctaggacagataaggctattagagagatgatctcaaaaaacaaaacggagttccttctccagaagaaaggaggagtgcaggggaggaggcagagacagtgtacatgtaaaacctgattccacaggactttcccagcatcatctgaaactatacatcccttgccttacagccggggggtggtttctttggtccagtagacctaggactggggtgtgcaccactcagtctacctccatcttcttattctgcaaagaagccacaaagacttgccactccgttgggtaaaagcgcttatagacattgatcttattccggatctgttttggggtgtcttgatagtaattcttctcatcccgggccatggccttatagtcctatccatgatt

SEQ ID NO: 1008 - DNA, 514 bp, Rattus norvegicus
  Genbank Accession No. AI169365
ccgagcggaatgggcagttttacagaaaagaatttgcaggcgagtaaaggtgacccttcaatgtcaaaaacttttttttttattttagcccttggtgctggctctgctctgtctgatgtgggtcacagtcctccctgcctgggccagcagtacacagcagctgcgacatgaacaaaggacacctggtccggtgaccagagaggaggtgcctggaggaggcatcttcactgaagaggtagacatgccccagaagcggggagggttgtggtatgttctcactgagcaccagctggatctccttccctccaaagagacccctaaccttctcagaacagatctaagttgtgtggacctggctggggaaggtagcaacaccctccgtatggctccctccatgttgactgaaaacagagtgtagtaagatctgcagatgggggtggctttgacaccaccccatcttctgccccatgctatgttcccaacttacaagacagcaagctgggactgtgagccc

SEQ ID NO: 1009 - DNA, 651 bp, Rattus norvegicus
  Genbank Accession No. AI169372
ctaggcaagcgctctaccactgagctaaatccccaacccctggatatgttttaaaggaggaaaggaccagtctttgtggcagcacaaatgcttagtgataatactatgtcagtctgtctgcgatggatcagcccagggtggaggctgcttttgctttggaggacagggcttgcctgaagcgcctcttcaggtcctgcatgttgggggatcggggccgggggatgatggatgctctcctccgctccccgctaaggctgtgcagcttgctcacttctttgcagagatgttgaaacacatcgcagacgtcttcgtagttttcactagtagaaatttcaaggaagagactacccagctcattggcgagctgaagaccttcgtgtgtctgcacctgccgggcatgcaaaaggtcccctttgtttcccacgatgacgacgggggcttttccatcagggtgagaatttattttgtgaatgtggcacaaatcatgtaaatgtttttaagtgtgaacaggaaaatgaacgtaggccattacattaatttctctattgaaacaatgacagaaaacaattctatttccaaagctacagaagagcacacagtgctacttgtaagtggcgtctgatgaaggtcttgcatatctggtgtcagttg

SEQ ID NO: 1010 - DNA, 476 bp, Rattus norvegicus
  Genbank Accession No. AI169494
  misc_feature (1)..(476): n = a or c or g or t
cagagctgagggagagggctgcaaagctgctttcccaataccccaagaatacatattctctatttttcccacaggtcatggttctgggaatgacctaaggacaggaaaggaagctgtccccagggttctcaggttagggagggacataaaagtcacacagtttcttagacatgtcagtggctgtaaacatagggctggggggcctctttgctctagaggggatcttggtccattcttgatcaggggaaaggtgcctaactctttttagacctatgagcagtcccgagggggtcatggaagctgggcaaccaatcccagggcaatgtgctacacctcaccaagtcagacaagtgagccagaggcttcaccacagcacacagacacacacagtgcacttgggaaccttaagtcggaactctagaagatggggatatagttgtcnatcttggcgcgatggcgctgggcaatgcactcac

SEQ ID NO: 1011 - DNA, 450 bp, Rattus norvegicus
  Genbank Accession No. AI169517
taaccctcactaaagggaatatagcttgcggccgccaaactttttttttttttttttttttttttatataaaaatactattttatttctcatcaataaaccccagctacccgctgggatgtcgcatgtcattacccaacttgctgaagaggatgaaacagtatgatctcaagtgcaacgccactctcaggtatacaaaaagctgctagcttctaaaatgaaataggagcccctagaataaatatgctgtaggggacagggggtgacattaagcagccagatcatccaagaatagcagttgtctgtcggagagcatgtatcctatcgtgaagctgagtttcctcctgatgcttttatagggcctgaagccctgactgctgcagaaaggcatgggcagcctctggctgatacaagaacagcagttgcagcagctccaaactgtggcctacca

SEQ ID NO: 1012 - DNA, 556 bp, Rattus norvegicus
  Genbank Accession No. AI169648
  misc_feature (1)..(556): n = a or c or g or t
actangnataggaagactaagtcttttattgatatttgttcagcagctggcaatcccagccttcatcccatgtcctttaaatagatgagcaagctggtctttccattgcagggagttccatcattcatggtaccagtgtaattcgtctccagtcagatgccaccagtccatcccagataaccttgcttagacctaagtattggctttcaaagcagctttgtacttccctgtcatctccttgggtaagggcaccaggccagggcagggcacctgaccttccacttcgcacatgcactcccgcaggcagtacttccgggggccaaagttgcctggatgaaagcgctgctgcttctccagctcctcctccctgagggtctcctctttcttgcccaagattttctttatgtgctccacgatctccgtattactcttcgtctccacgtctacaaggacctgctccccagattctaggtataaccgcaggaagggcgatggcgtcatgttcttaaacagcatgatctgcacccaaggattcttatactggatctgagggatg

SEQ ID NO: 1013 - DNA, 649 bp, Rattus norvegicus
  Genbank Accession No. AI169655
cggaccataaaatatttattaaggtatactcttaaggaatatagtgaatataaaatgtaggatcacaatgtgaagcaatttgaatctgctcaaaagccagcacagccctcctaagctgcagatggagaccactaggaggaattactgcgggccagaggaggaggacagagcggcttttcaggaacggttactactggagcttcggacacctctgtcattgcaagaccacaccacattacactaacgcagcaacaatgcattcatattgttctcattagtcattagtagtcaatttgcataaaacaccagaaaacaatcaccatggagatcacaagtgagttagaaatggacctgttcttgcaaagcacgcactgtgatgggatagacatggaaaggagtgtgcacattacaggagctgcacgcgtcccaacaagcccctctgccttctttcctggaaaagcgaagtacaaggaacaggcacaactaatacttgggaggcagtgtgtagctaaaatctcatttaactaataagtcaatgatttttaaaatccccgtaaatcttttctgtcctgaggtagttgcaaaataaatcataaactgggtaatcaactacagtggaggctgcaactcttcattcatgaaaattagt

SEQ ID NO: 1014 - DNA, 547 bp, Rattus norvegicus
  Genbank Accession No. AI169668
gatccaggagggtatttaatttacatagcagccacgtggggcctgtcaagctgggcagtggggtacttctaaccccagatggcatcccctatccttttccttcaggactgtcttcacaggcccttggataggtcgccccacattgtgcagaggatgctccagttgaaaggaagagagaaatctgggaaataaggctgtccccaagcggggaaagtcctaaacctggagttggttgcctacatggtagctcaggggtcttgcaaaaaccagtccacgtcctaggcacagttcttactcagctgggccttcagaggaagccctcccggcggaactgttcttggaggagggctcggtactggtcaaatcctccctcgacccgagtgacactgcctttctcgcacacccacagctccttgcacaccagtcggatgaagcgctcgtcatgagataccagaaccacaccacccctgaagttgttgagagcatggcccagagcttcaattgtctccatgtccaggtggtttgtgggttcatccagaatataaaa

SEQ ID NO: 1015 - DNA, 652 bp, Rattus norvegicus
  Genbank Accession No. AI169728
aattggaggatgaggaagaagacgatgaagacagtgaagaagaagaagacgatgaagacgacgaaatcgtggatgaggaagtgaatattgaatttgaagcttattccatctcagataatgattatggaggaattaagaagttactgcaacagcttttcctaaaagcccctgtgaacactgcagagctggccaatctcctgattcagcagaaccacatcgggagtgtgattaagcaaacagatgtttcagaagacagtgatggtgaagtggatgaagatgagatctttggcttcatcagccttttaaatttaagtgaaagaaaggggactcaatgtgctgaacaaattaaagagttggttctaagctcctgtgagaagagctgtgagcagagcatggttgaacagctggacaagcttttgaatgacaccagcaagcctgtgggccttctgctgagtgaaagattcattaacgttcctccacagattgctctgcctatgcaccagcagcttcagaaagaactggctgaggcacgaagaaccaacaagccatgtggcaagtgctgcttctacctgctgattagtaagacatttgtggaggcaggaaagtctacttccagaaagaggccggatggccttccacaggaagcactgat

SEQ ID NO: 1016 - DNA, 623 bp, Rattus norvegicus
  Genbank Accession No. AI169756
aacggtgtcataaataagtaatataactttattaaaatgaaaagacaatattcaaaataatgcaacaaaatgaacaaatcctttgtccaatactgtacacacagtgcggagatcagtgcattttctaaagcatgttttaaccttcatttagttcatactaaaaataagctttaaatagctcaaataatgtcattcagcagtttaaactgaacagcttgttgggacatggcagcggtgtccctctgttagcaagcaccttctctttgtgcttatctatacaagataaacaatcagaggatgtaaaaattgaacacaagctacacgtctcactgactctcagggcagtgaggcagccagctgtgagttttctaagcaggaagatgctgaagtgacctctggcattaagacgttctgtgctattggtcagaagtgtttcacttaaaaagcaaacaatccccaggaaatactgaataggaaccaacaacacaagaccagcttgtgttgtaatttaaagtctcaaaaacaaaacaacatcccatacaccccacgataactctcaatcatggctaatcactgggctggtctataaaacttatacccaacactgacggccagcaccactc

SEQ ID NO: 1017 - DNA, 202 bp, Rattus norvegicus
  Genbank Accession No. AI169883
caaaaagctttatttttacttggcccaagacttgggaaaggctccagggcggttacaaagctgcctagtggctttaaaggttcattcgggtggaggtgctgaggcggtcggtgcaaaccaaaggagggagccccttggaaggcacaaaggcctaatcgtgcttcaaagtgaggcgctcaaagagatacccgcccaaaaatgc

SEQ ID NO: 1018 - DNA, 557 bp, Rattus norvegicus
  Genbank Accession No. AI169947
ccatttattgtatagttagagtttcaatatcttttcatttgggaaaccaaaagataagagaataaatgtacattcctactaaacttgcctttgaaactttaccaatttaaatgatactatattacaagattcgtaaggattgacacaagaaaggactgaaggatgtaagacatggcccatggctggcaaaaccggaaaggcaatggatatatttcagcacttcctatgtcctcaatcaccttttagaaaatccatcataagccagaatgtacatggtagatgctcctcagaaccacctcaagtgacgccacataactaccgcttaggttgcttcgaactaggttcaacctctgtggaaccccaagtgcctggtttgagaaggtggctaaacttaatgtaatttatagcaaaaatatacatcataattgtacctgcaacttttagagacaaaagtgattaacctggcactgacatccctctatcaaatgccggttaattgaaaaattagaaaatatcacagcaatataacaggttggggatcttaataggaaaagaac

SEQ ID NO: 1019 - DNA, 462 bp, Rattus norvegicus
  Genbank Accession No. AI170053
gtaaatttttcattttattcaaagttggtacagaagttctaacatttccataaaataattactacacttcagttacaggacaaaataccacagaaaggaacggactttgcaagaaatatattcatcttaaattttcaaatacttctgaaggctagtgcagcagctggcaaaataacacgtgtacacaaggaacagagaggtttgtagtcagcaataaaaacggacagctctttaagcagatttgcttcagttttctccccatttaataaacagcaacacttaacacagtaaaccaagattatacatgtctacagttttagaaatcagttgtatacagtataggcaaggtaaaattgtcgcggataattaacaattttaaatctacagttttaactgtttttctttcaagatggaagtcagctggcttacaccaaatcctaatttctttgaaactaaagcctg

SEQ ID NO: 1020 - DNA, 393 bp, Rattus norvegicus
  Genbank Accession No. AI170224
ccgtggatgaatctcagtgttttattcaccccttgcccgagtcatcagccaagtaggcggctggaatgacttctctaagatcctgatagctcgctcagcaattatcatgcagaaacagggagggaagcaataagttagaagccacataagttatgaaaaaataatatatacgttctatatttcatgtcccttggaaacagataaatagcccgagagagagcagcaatgagcagctgcttcgggaactctaggttaagtatattgctgggttcctttgtcctgggagagtaggtagcctacgggcactccctgcaggcctggcgggccagcggccttgaggatacctggtctgagagaatgagatgcaggggtgggagacaggctaggagagga

SEQ ID NO: 1021 - DNA, 609 bp, Rattus norvegicus
  Genbank Accession No. AI170263
cctttcaaattgtttatgtcaggaattttgttacaacagtgggaagctggctgacacaaaaatacaaataaagaatatttacagaacactaatatttatacaaaacacacaggtaagggaggaaatctctttgctccttgggaattcaaaacatccatgtctgtccagcatggggccggttgcttttgagatgagggtggtctactggcattcgtacaattttatagtgtttccactcccccccccatttgaaatatttttgtttgtcactatttaaatgtggtccttgttttagtgagcacaaagggctaaaattacattcagtggtcataaaaaattattattaacatatctctctcttacacagggtctctagtacagcttggccttcaacttcctgtatagttcaagatatccttaatcttcctgtctctacctcctaagtgtcggacttataggcagcccccatccctgtttatacggtgttggggattgaagccaggacttcatgtatataagcaagggctctatacactgagctgtgccctcagcccttaaattattattagtctttataaagcagcaaattcccaaatggagaatgtgtta

SEQ ID NO: 1022 - DNA, 602 bp, Rattus norvegicus
  Genbank Accession No. AI170279
cacaagacaaaaatttaatatatttaagtctatattggaaatacacaaagacaattatgtatgttattagcaagtcttattttgtacaaattacagaatatcctttttaaaaaaaacatacatatgacctttgttggtacatttctatgctggcaaatatatttctgatacaaaggcactttgaaaacccaatatggtttggtttgtaagtttgcaaggtacaaacaatttttacaaacgtatgattacactgaagaacgtcagcaactgtgacatcacatagaaaacacttctttttgtaaaaacaacactggttttatggggataaaagcagtggtttccagcagctgtagtgaagacattcagaagggtgaaggcctccggtctgaatttctcactggctgggtggggagataaggatggggtgaagtgatcagcgagaacccccagggggagagataacccagtaccctagaacgaacccagaaacctcagcagtcagaatggcttgaagggaaaagcacacaggcaggtctgggcggattggctgtgacccccgagctcacactggctctacctgcgtgcttggtgcttccgggctg

SEQ ID NO: 1023 - DNA, 487 bp, Rattus norvegicus
  Genbank Accession No. AI170340
agccacatgtatatatagttcatatgttagaaacttcataccatgaatatattaacctcaggcccacctttcccttctagatacttctacctgtgcccaaccctatatgcaaacttgtcaaatatggcggccacttcagactgtagtatagaacctggcctgcaggagaaaggccagagagagtggaattttctcagcactagcaatctgccactagtcccaacccttgggctcacccagcaaggacaaaggggactcccagccttagttctatcaactgctattatcaccccttccctgcttgctcagtatggtcatgtctgcagagtctgagagtgcagacaccttttggctcaggcttgagagctgagagttccaggcattgagtagcgctggcgggcgtgcttctcacagtacaactcgtttcccacccagaagtgaccccgcatcttcaggttcagcccgcagtctgcacaggtgtagcagc

SEQ ID NO: 1024 - DNA, 604 bp, Rattus norvegicus
  Genbank Accession No. AI170363
cttagtgattctttatttataaggtaggcagaagcaactgttacaatgtagaagggagacacattacacgctgttatctatacaagtttcaaacaaaaactgcacagggagaggtcaactctcaatacaaactagcaactaaaccacaataatttacctttagaaagggtttgttttcagctgtgacactgcttttacaatgtgcaaaaacacaaacagaactacccaaggtgtttgtcacattctttctacattgaatttggcaacagtttatattaactttattcagattatactaacgtttaaaaactaaacaagtgagaagctgtaccaaggtacagttacatccattcctttcaaaggtttaaaataccacttgtctctattagaatgacctcgcagcgatttctgcatctgcaaaaaccatctcaagcatcatatgcacaatgcatcagctactttgagtcatcaaggttggtgggctaaaccacaggcactactgtttgcttatagtctgtaaaaggagcttgtttttcaaagaaaagagcttaagtcatttctaataatcatgcctttgctttaaagccataacacctcgtgccga

SEQ ID NO: 1025 - DNA, 333 bp, Rattus norvegicus
  Genbank Accession No. AI170525
catgtacaaagctaatttattatggacaaaataaatgtacactctttaaaaatattacagcataaatttaagagactaacaaagtgcaaaattttcaactatttttgatcatactatacagaaacaaatcaaacattaactcatatacattcagtgaagttcttaaaaatatttatgtgacaaaacaaaatacatcttgtgtacttaagttcataaggatgagagcagaacgaatgaattgcaccaaacagtaatttggttatcagaatgctataattaaggttatttacatccttataaagtctaaaacttgtttaactttgaaacccccct

SEQ ID NO: 1026 - DNA, 513 bp, Rattus norvegicus
  Genbank Accession No. AI170542
cttaaaaccgtttacttacaaactttaattcagcaaaggtcagggagctggggagggcaggaagggggaaaggggagggaatgccccctactggagtgagtttggttcatcaggtttgaggagggaggctggtggtggctcagctggccaggggcagagtccctaggtcccctcagatgggcagagaggagacctgctccagtgatccagcctggggatggtgatgatctgggtttgaaggaacatggtagaggtccagtggcctgggtacaatggtcacctttcacagacagcaggggacactgttgaagccagcagaaaatactggtctctgcacccaagcttagggcaaaaggggtggtttgccaagaccaaggctttggccttctgtccatagggcagacaccctggagaaaggatgaaccctaggccagagctctttggtcctgagctgagcttttggagctccgcatctgagaggctctgacccatcaggacctgtggcccaacttt

SEQ ID NO: 1027 - DNA, 634 bp, Rattus norvegicus
  Genbank Accession No. AI170570
aatcaaaggtttttattactacacagaggagtcaccgagatgctgtccctcatttcactcggtaacaatccattctaaataaagtactttaatgctggtcatacatttatataattatcttgacagagtaagaattagaaatacccaatacatttttgttagactgttgttttaaaattaacactggctttgacaaaagcagttggggcttaagggggacacgaaggtaaatagcagccggctcgtattaatactgctatttccctcccttatcacactccacagttcaatttatttatgctcctctctgggataccacgctctgtccagtaataaagcagtaaccttattgcacacacagttggggaaaggtgaaaggtggaaggtgaaaggtggcgagcagctagcatggagtgactcagtgcttggggttttgaagtgtgtactgcaaagagccagagaggccccagaagaaacttgggctgtgccaggtaagaaccctacagaatatcatgcccagcagttttattttgaaaataagctaaactgtttttggaaaagctttgaaggaatgagacagatgttgctcacagaacagctttctaagcaacaaagtaatgatgtcagtaaaccc

SEQ ID NO: 1028 - DNA, 419 bp, Rattus norvegicus
  Genbank Accession No. AI170692
aaagctcacacacagcaaggctgtggatcgtgttgtccccatcccgctctcacagccaatccaacacaagttcttcctgggctggggaagcagagaaaaagtaacaattgagctcgtgaataaaagacgacagcgtgtgcggtgtgatgtttcctgatgtcttcaccttgcgtctcctccatggttgggagccctccctctggttccccaagtcccacacgcacccctcccctacccccaagtccaggcgctcccatctgctgggcttctgcctcatttcccgtagacactttcatcactgtaggccacatacagaaaatagtcttcctcatggttgtcctcatacagctgtcccatggtagcactggtgggagggatagtgttgttgacaaagaagaataaggcgtcctcaggtctca

SEQ ID NO: 1029 - DNA, 483 bp, Rattus norvegicus
  Genbank Accession No. AI170693
gtaataaagacactgcttttatttagtttgatatgtttctatacagaatgcagaaaacacatcttaaaatcatatagaaggaaataaagacacgtcagtggttggtgaacacttgaatgtgagattggctctctgtctcagagtctgatggccatcggcagctcagggcttagggaggaggctgcctgcaaaggcattgttgctcttgttattctgttcactgccccactgcctccagttgctatgacaacaagccactctgggccagcctcctctctacatggcaatgcccaatggtggtgttgctaagagcaacaacagttatctggaaggctttccaaagccctcacctggaatactgggattgattgattgatttttgatgaggtcaccagaaataatttcatcaggtcagatccctgctcttgggttaagggggtacatatggagggggtgatcggtatggggtcatgttcttgggac

SEQ ID NO: 1030 - DNA, 618 bp, Rattus norvegicus
  Genbank Accession No. AI170770
aggggccaaaggtggctaatttaatataatttctccttttctagtacatgcacagaaagcctgtgcagctaagtcaacgagtacatgtatgtttgctgaaacacagcctcgtttcccaccacacaaaggcctcgctcgatgaagcagctgacaggcaagggagctcacaggctgtgcttttgctcatcggtctatttctccaaatacaatatcctgggtgcctatgatggctacgacatctgccagcatgtgtcctttagacatcttgtccaaacctgccaggtgggcaaaaccgggagccttgatcttacaccgataaggtcggctgctgccatcagataccaagtacaccccaaactcgcccttaggagcttcaatggcggtgtatgtggctcctggaggaacttggtagccctcagtatacagcttaaagtgatgaattagtgactccatggacgtcttcatctctgctcgtttaggtggggacactttggcgtcatcaaccttgatctcccccggcggcatcttgttcagacactgttcgatgattcgaagggactggcgcatctcttccacacgacacagatacctatcgtagcagtcccctcgagaaccaat

SEQ ID NO: 1031 - DNA, 498 bp, Rattus norvegicus
  Genbank Accession No. AI170894
aaacattaaagaattgtataaaatgatacatgacgcagaacaagttctcttacaaatgttcacgtcatttacaactaagatcaagcagccaaaaaggagtagattaataaagccacaggaataaaacagatgcaaatatttaaaaaaaaagatacgtattatgtgttgaataaaataaagtctttccttgtgttggttgggtagtcttttgccttaagaggacaaagctgtgtgtgatcattgggttcagtcttcttccaaaggaataatatcaggaacttcatcagtgtcagatgtcgagtcaaaagcagagaaatcaagcatcagccagttgagaggcgtgttgttaacaaggtaatccataacttcatctaaggactccttcattttctgcagctgccccttgctagaagtgaggacgccatcagacacttccttgaaggaggtaacattgcggaacgccgagttgatgtcacctgccatcacccccaagtgttt

SEQ ID NO: 1032 - DNA, 454 bp, Rattus norvegicus
  Genbank Accession No. AI171185
cagaagcaatattttaatttattaaataaaagttaaccactggttgggtgagtgagtttctgtatgactttattttatattacacatacattcagaggatatgcagatgacgaattctctataaatcttacatgtaatgtttttcacatttgcttgagagcctgggcatgtgatgcttcctttaatcctagtaattgggaagacataagtaagtagatctgagttcaaggacagtctagtcaaaagagggagttctaggacagccagggctacacgaagaaaactaatctctgactaagggggaaaaatccagatttccagtgtgtctgaaaattaaaaggctaatctttaaaaaaatgtgggtttataggccaaactatgtatcttaatttagaactggcatagagctaagggatctggaaacaaataatccaatgactttgattaaaaaaga

SEQ ID NO: 1033 - DNA, 531 bp, Rattus norvegicus
  Genbank Accession No. AI171354
caaagttaaaaatttttttgatttaaaatgcacttataaaatgtccacagaagacatgtcatttttcactgctatataaatttattgggaatgttattcacatttattgtcacctaaaacatactgtaaacaatgggttattccctaagacaaatgcatacgtgattctcagcaatcattggtttgattattagtaggttacaaggtcacatctctgtggaatgtcagtgaccgctgtagtgtgacaggcttcagcgcatcattgcacacactgcttcagaacagtccccaccgggtctggacccaggacgcaaagcaccccctctgcttgaaacggcagcatgaggttcaggtcaaggtcttccaaatcccggacacgtcagtccgtttccaaacttctgagttatggctctgcagcaggtttagcatattaaatcccaagtgttctaactccctctatttcaagtaacaatgaactcttgaggctcaaactctttaggttttaactgaaagtaaccaaactttagaaag

SEQ ID NO: 1034 - DNA, 576 bp, Rattus norvegicus
  Genbank Accession No. AI171361
gggttatattcacgtttaaaagctgttggcttatattacagcagatagtagatgggtgagatgagatgtgtcaacccttaatccaagtgtgccacctctggttgggatgaggagtgaggctggtgggggatccaggtctgaggacgtcacctaaacaaagggccactcagaaacttcgcccagtcttgcctggacatccaggtatgctctgatcctcgagccgctgccacagctgccgccgccactggtccataagccgctgctgggaagcctgggaactggtagccatagctaggagcaaatccaggatagcctctgccataggttgccacaaagttggggtagcccaacatccccatgccaagcatgaacgcgtccatggtgtatggcagcccccgggcccggcctcttgtcccaggtgggaacatgacttttttcggctgagctttcttacattctaccattttattattgatttcatggaaatgaattttacagactttttccacaacgtcttcattctcaaaagtgacaaaaccaaaccctttgtgcctgttgggggttttgtcgaacatt

SEQ ID NO: 1035 - DNA, 644 bp, Rattus norvegicus
  Genbank Accession No. AI171362
ttttttttgtatggttggttttttaaagatttattttattttatatgagtacattgtagctgtttttatacataccagaagagggcatcagatctcatcacagatggttgtgagccatcatgtggttgctgggatttgaactcaggacctctggaagagcagtcagtgctcttacccactgagccatctctccagcccgatcagtgttttaacatgaaagaacaaatgatagttttattaaactacttaatgcttgcacacacttacataaattttaaactgccaagatttttgataagtgcaacaccattttcaaataagcatagtctaactttaaatattacatcatttagactcatgttggaaaacgttaacttataagggttacaccaatgtccatttactgtccgtagcaaaacagggtccctgatagatgtgtcagcatatggatggctcctctactgcctgagcgccttctgtgacggctttgacacacttggccattgtctgtgaggctctgctaattgaatctgtcatatagaagtcttttatagttagctgaggtggaaccagtgggtcagcaagaaattcctgggcttataacttggcaagctcacttgcttgttgaaagtaattagcttctt

SEQ ID NO: 1036 - DNA, 589 bp, Rattus norvegicus
  Genbank Accession No. AI171369
agaaacatgttttatttgttttgcttataccatcagaactgaaactactgtctgtcatttccctaaaatagggaaatgaatcttaaacatatactggtgcttttcaaaagggtggtagcagcagaaaaccatgtggccaaaagtgttatgattatccatccattagcgatcttcatcagtacctattaccaatttgagtaacaatacagcaagatccagggttagtgatgacaatgcacattattgtgaggaccaatcctcatgtaagtcattgtttcagagaaactgttaaagtgttcaaaagatatctaaataattcacattgagcacagaggcagcccatccagattataccccatatttgatgcatatcttccagaagagtcagtcaaagcctgatttgcatctgggctttgtcttacacagtatccactagtaaagagcagtttacatgtgttttcaatcacagtcgtttggccagaagactagtgagtgctatgtcagggctggtgtaagccaacctcacttgtgtgattagaacccatgcataatttggtatgcttctaatctgtccgtgctccaatttaat

SEQ ID NO: 1037 - DNA, 498 bp, Rattus norvegicus
  Genbank Accession No. AI171448
caaaaccatttggcaaataattattgaatattattagttaataatatcaaagttaacactagatcctgatgtccaatcttagggcagcaaacactgcttcttggtcctcaggatccctaaggaagtcgtctcagaggttctgatggagccggccgctttaccaaggatttattcaggggagcagacagtggtattcacagggagtggtgcttctcagacacatttattaatgccacattgtaaacggtacttaggtaactgtacagtgatgttccatgttcccatctacacagcttgcttaagttcagctgacgtattcatcctgagtggactgggggagcagttagtgatggccatgggcatgcgcaggactgcagcctttcagagctttacttcttttatcagcactcctgattttataaacgatgagggacatcaaccccactcctacccaaatttcctggtaaacctgggtatagtagggtttcatggggaccc

SEQ ID NO: 1038 - DNA, 426 bp, Rattus norvegicus
  Genbank Accession No. AI171492
  misc_feature (1)..(426): n = a or c or g or t
aatcattagagaaggctagacacattcagcataggtgctgattcttggcaagggcgaacaaacaggcaggagcaggtggagaggagaaacacttcaggttggactagagaatcccttatcttacaagccgtggtgctgatctgggcttgctgtcataacggcagtcgcaggcagcttgccagagccccatcccacagggcaactgtcctgctgccactttgtcagttgctctgggaaacctgcagtgtgtgttcatcagagccagacagacaactgagtggcttttgtctggggctcagggggatccgttgggctgagtcggcctttttcctactccaataccaccaaacgtgccaacacagcagagattagctcggcccgccgatgtgagggaaattctccggcangctggctgaaggggctcaa

SEQ ID NO: 1039 - DNA, 420 bp, Rattus norvegicus
  Genbank Accession No. AI171542
gtctctagttacttttattagggcaagtgtgaatgtgttctgtaactctcacttgcaagcatgaacagtgcggtgcctgtctctatgtgggccgttcccgaggtctggtcacaatatgccaccacaatgggggcaagtcgccttcctttctggcaggaggcaaagcttcagtcataataccatcaggtgacgtttcttcctccagctgtttaaccttccgatcccagctctccatcctcagtttcttccactgctctctcttggaaaagtaatcaggatacactgctttctcagaaggatgccagtaatctaagcaccattctggaaccttgtagcactcgtatctctcataggaagtacccccaggagagtctgggaagatatacggctgaggatgctggttttgccagaattcttctt

SEQ ID NO: 1040 - DNA, 631 bp, Rattus norvegicus
  Genbank Accession No. AI171587
atatatacaacaaatttttaattatgtactgaaaataaattacaggaaataactttaaaatgcaacagaggacaagtcacaataaaacattcccattgaattctcttgggggtgagattgcagtgctcaaggaagataaatatcacaaatatatcaaaacttcaaactgtctatgcattcacacactgacatgagccacagacattcctttcacaggactgtacttattagcctaccacagaaccagattttgccataaactacaaaacttttaatacaaaattgtatttatatatttataattcatatacatgccctacctgtaatttttagaaaataaaagctacacactgtacagacactcttaactcacagctgtaggcaacatttttggatggaatttctcccccaataaaattaatggcgtattttatgtacatgaaaggctaaactgcaaagacagctcagtttcccagataatgcatctccgttcagggcaggtttacaaatttaaaaaggcaagacaatgtacacctcagaattaccttctcagctacgagttgtcatgtgatttctgtgaagtttctgatacatgcatttatgtaatactggcattgaaggcagtaaagca

SEQ ID NO: 1041 - DNA, 538 bp, Rattus norvegicus
  Genbank Accession No. AI171676
ttttttttttccctcacactgctttattgcattctctggaaacagggtgagcaaccttcctgctgcctatctctgggcaacatggagctgaaatgacatggtactcataggctgaacagcaccctgtaccttacaaccctctaaccagggagcccctaatctgctatacatacggatgcagcccagaaataggggtgggatgggggtgaggtcaaaccgggggtacaatctacttttgaagacttcttaggcatctgcaggaaaactaaaaatctaccctagaagtctagatttaaagaggcctaggcctctcaggagtccatatttggagggatgggggtgccagagccttgatgtgggaaggactcatttctagagtccagacttggagaatggcttaaatcatgggcgtttcacaagagcccagatttcggctcagggagtaccagtgggatatgttaggattgggtgactgaatcttgaagtctccatgagtggggaactggggaggcccattctagggaggggctgggcccca

SEQ ID NO: 1042 - DNA, 452 bp, Rattus norvegicus
  Genbank Accession No. AI171692
gagggtcctaataacttaaaactttattaggaacagtagcaacatcctgaggtcacaggagaagatgtagagaagccacagagccttggcagggttaaggtggtaccgggcctgatattccaccctttcctgccccaggcagagaggccagaaacaatcaaaaccctacaggcaacctacagaggagtaggctgagacccagaactggcccccaacccaatagtccagatggacactgggaaaggatggcttcaacccccaagacatggcctcttttctggaaacatgcgcagtcacacagctgggcccttcagtgccatccctgtgctaaggcatagctgaggcctgtgttcgaggtggggctgagggcagccttctcagggttggagctctttccacttgcgcagtctctaatccatggcctggaatgtggccttgtccttgacaaaaca

SEQ ID NO: 1043 - DNA, 623 bp, Rattus norvegicus
  Genbank Accession No. AI171794
gtggctgcaatgattctttatttcatgcgaagctgaagaaaaagatcaaatccagcggaggaagatctgaggtcctgagagttggccttgctatcatggcccaggacaagttttgctggggcctctgggaccatgtctgtggtgcctgaggcacagggacctcattggagagacttcctcttctagaaaccaaaatattttgccaaagaagcaagcagaactcaaatcatggactgggtgcagggaaggggtagtggaaaccatcccgccctctggggctccctgacttggagactgcggttaaggttgtatcaaagccgcctcccgccctgccggggaagagggcggatgagaagtctggggcccagaagactcccacctattttattatgtggcagggtcctacgagagcctataggaatgccggagtgggtgctgacaatctgtatcacagtcagaaagctctgccaccagggctagaggttctgatgtgggtggagcccaggtcaggtgactagaccgagggcagagactcagggagtccaccctagctggttgctaggggttgtttgaaccttggggctccaatggggttgtgacaacctttgaaaggggttctagag

SEQ ID NO: 1044 - DNA, 666 bp, Rattus norvegicus
  Genbank Accession No. AI171800
aagagtttaaatacagtataattatgtaaagttaaatggcacatgattaggatttgactaaattcaattaatttgaatttttagtccagagaattacattcatgcagtggtatgaagcattgattgaattttatttttaatgtttagtagttgttatctactgtttgaatatgatgttctaacagtttaaacattgtggtatataaaacatatacatatgtttcttgccgatttttgagatgttgtaatattctgaaccgtgcagatctcgctgccaataaaaaggaggtggcagcttcatgagtctgtggatgagtccgaaccctctggagagtctgagaagtcaatcacaatatcgtcagatggctttggtgaagaaagtaaataccgtgaagtgactgtttgtatgtggtcttgatagtggtttttataaggaagctcctgtctataaggaaggtgaacgacatcctggcctgtatcatgccgcggctgctcttctgggatgtccatagtgatatcctggcctgagtagagcctttgttgctcttctgggatttcattcaagatctcttcatataggttggctattgaaatggggctctgtgaagtgatggtctgtccaaatccctggtacaggcccaccggtgaggacggcttggaagagtc

SEQ ID NO: 1045 - DNA, 637 bp, Rattus norvegicus
  Genbank Accession No. AI171802
aatgtttgaagaccatttattagaaagaaaccagggagacattgtggcagcagacaggaagggggtttagggccctgtgaagggccgggggcaaagggcaacagccacagtgctgctgccacctgcggatagttccaggtttaggtacttgacagcagcgtttagaaagtggttattaacaatccagataaggcagtaaagaaacactgacaaaggacaaaaggttcattgtaatcctaagcctaatccattttgaaagatcaacagtgaaatttaaacatcagagattccttcccactctcaaatatatcagaaccatttgttggcatttgtattttgagtgtctgaaataaagtaggccaaaatttcaaaggctcgaacaagggcttgattctttaatttaccaccaaggaaaataaacagtggaattgccctttgattaaacttctcatattttgtcccttcaggccacaatatgtaaggacaggtccttgtcccactaaggaaactaaagtgactgacattttaaaataggttctcagagttgatttagtggtacacacctgtaatttaagcactcaggaaactaaaacaagaggaccatgaatgatgaatgtgaggccaatttggactataa

SEQ ID NO: 1046 - DNA, 711 bp, Rattus norvegicus
  Genbank Accession No. AI171807
  misc_feature (1)..(711): n = a or c or g or t
gtatagaattagctttattagactggttttacagaaagcagccagattagtttctctgcctacctaaaatacaagttacgtgcatccagattattcttaaacatgctgtagcaaagtctgtatttaagatgaattctaagactctttcttagagcaaagagaggtgctccatgatacatcccccgagggaatgttcatgcagtgggcacaatggcaaactctcttccaccaggctcgtcttcagtgagctgtgttcatccctgacctcacactggtaactccctaccccaggacagacttcacactacaacgttcacagcagcgcacaggtacactgctcgctgtgagaggatgggaaatttagcaagtgttaatttcctggcagatacacatacatagggagctcagtcctgccgggcccaggcttccatgcccaacttgaatggtgatggtgccagccttgtagtgtgaattctggtctctctgaccctgacctggccttcctgtgcccgactttcatcatctaacttcaatcctggcattttagcaattctaggctggttttgccaagaaggcaactgaataccagagcaaagcacgtacagtcccatgaggattatacacgtgaaaagactcanaacaggattacctagtataaaaatataacgataacacatcacaagtagagtataaacagtcctctgagtgaac

SEQ ID NO: 1047 - DNA, 398 bp, Rattus norvegicus
  Genbank Accession No. AI171844
gccgagagtgaaccgtgttaatttattggcatagtcaattcatcaacaagatgggtgtctgtctccaggaggtacggctgacctccatctgccggaacaggtgcccacatgcttcacctggaagactccgcacgtcaggcttcagtcaggctcggctactccttctttattttcactgtttttatgctggtgcccgaagtcttctcagcgttcgctttgaactcagtcttcagggcatccctaactggttttgcacagatctgggagaaccggatgtagctgagtccagcctgtcgccagtacgccaccatggtgtctcgagcggggcgtgtcaggcagaaccgctgggtcgcttcagagtagcctgagcccggaccggcagcaggaagccttgtgcc

SEQ ID NO: 1048 - DNA, 386 bp, Rattus norvegicus
  Genbank Accession No. AI171916
acggggacttacgtatttttattgaaaatacaaagaaagaagtccaacaaagctaaagccattccacgtccccgtacactaagctcgcacgacttagcacatcaccttccgcatgcttacgtaacggcgttacgtgtgagtctacctggcactgtgcttagtagcacagacacatacttctacagtcgtcccaacagtgtcgtcatggcaacagtgtcgtcatggcaacagtgtcgtcatggcggcatacctcactacttcgtcagcacactttctttaacataaagatttttctccaatgcacacatacacactctcatgcagttaacattttttcatcattctttagtttaaaaaatacaagagctcacaaggcaaaggacata

SEQ ID NO: 1049 - DNA, 653 bp, Rattus norvegicus
  Genbank Accession No. AI171948
caggtactttattgctcacctctcacacaaacacacctccagctactttctttcacagcttgacagtgtttacatgtacaaaaacccggcagaagcatcgagtgacttcagtatagacgtggagggtgactcagccaggcttctgtcttctgcagcaataatgaagggcctcctgcactgagcaggactcgatctcacttcgtagtgcacttccgtcacaagaagggtctcttgtgtaaagcaagccaacttgtatttgtaactagtgcataaaacacatgtctgctcaccctttcttctagcgaatttcaagtaaaaacaaggttgaaggagggacttttgtcttggatggatgcaggtctgtttgagttgctatacttaactaagtgcctacaggtactacggttcacaacttagtttgcttttgtcgtgttcatggatttggccgtgttcgtggattttggaggagcatatggtatagtattccacccacaggataaggctactgaatgtgctatctgcaaaagagctcacgtaataggaaccaacccaacaggtctaccagaaagaaaggtgacgaaatttctctggacaaaatgccaatcaaggcagagctatgctgggagaatagtttacgaaaacacacatgggtt

SEQ ID NO: 1050 - DNA, 647 bp, Rattus norvegicus
  Genbank Accession No. AI172056
gggggggaaaaggtttattttttcctcagaagaaacagactggggaacatttacaacccacattaacttgcagttggtcctaaccctttcgggaacaggtgttaaaatgttaggtgctctacggaatgaaggtgttcaccccagacagaatgtacatggacgatgcttgaagactgcatgttttttccctgagagacgtgtaagacaaacagaatttgctgagagccatctttccaaacaggaagcataacaagccaacatgtaaaggaaggagaagccaaggttaattcaataagacaggtgagacacctagaaagaccaatacaaaaattccaaacaaagcttggcagtcattagtagaaaagaaatacatatttgttttattgacaccaggcttaaacttgtgttaaacaagtaaagcctgtgaatagcaccgtggtaaagattagtctgctttcccaaagcattttacaatttagtaagtcaacaggggatcaaatgtcttacatctacctgtgatccttaaatacagaaacagattggataattaaccctgcatagttataactcggatttgttctactacaaccagtccacacacacaactggctctgcatatacactagaactgatcatgacaaagtttt

SEQ ID NO: 1051 - DNA, 660 bp, Rattus norvegicus
  Genbank Accession No. AI172057
aagtggaactttctctttatgacagatcagcataagcaccctgcggagtatttcttataaaacagtataacagtgatgcagaatgatctcacaaagccatcttcggacctgacatccgggctatagcctaagagcctttagcaagtgaccgatcaatcacaacattactatgatgctcattatttaccaggtaaacctgaaataaatcaacaaaataaaacaaggacaaaatccaagatctgccaaacgacgactgtgtttagtaatgggaaaaacactgaatctgagccggtccatctgaattcttgtctttgtccttggatggatgatctgagaggacagccttggttaagtctttcagtttaaattgacagagctgcttttatggttgtgtacagtctttttctaacaacgcaaacttggcaaccaattcgacctgcatataccatataactcctgtgccctgtgtcatctcagtcctcaaattaacaaacatcgtgtggttccttaccagacacaaactcgagagacatggtttcatgacagattacaaagtcacggaagtccgaagaaatatgagttgacctcagacatccttcttggtgaaacaatgcaaggacttacggagagaaacaagcgagttcatacattaattacacc

SEQ ID NO: 1052 - DNA, 560 bp, Rattus norvegicus
  Genbank Accession No. AI172102
ggctgtaattgcgtttattagcttgacaaggcagatgtgaatattttctgtgacaaaatggtgacaaaatatatcagccacatatcggccacatatcagccggcacacattagatgccacaaggaaataagaactaacgattttagaaacagtaggcatgttcttccctgaagctactggtgtgggaaaggcaggagatggggacaggaggcgtgctgtatccttgcgttgctcaacctccaccatgcatgtggcctgtcctgacagtgcagctcctgactacctttatcttgcaccctgaagagcatacagggcactggcagtccatgtatttccaggtcctgaggtgcacagattggtttgggggccatgctttcccagcccttgggccttacgcaacttcacagcagatgaggcacacgctggcacgtggtctgtccagggcagtggtgcaggccaggccctggtgggctagctgtcataccagtcgaggaagagcaaggaaaaggaacacatcaccaggaagaagaggatccacactcggaagcctgcgttggttt

SEQ ID NO: 1053 - DNA, 611 bp, Rattus norvegicus
  Genbank Accession No. AI172103
  misc_feature (1)..(611): n = a or c or g or t
ttaatactttaattttggatccctactttgtatacatgattgttatttcaggctgcttcaaatctcttgtaaagcaggagaggtttaacacactaaggatgctcccagacttctgcacaaaccaggttccatcagccccacgttgcactcgcccattcatgagtttgctggacattcactgggtgcttgttttggactaggcgtggtacagggcgctgagagcgaccatgaacaaatgtctctcgcggagctcacagtctagtggtaaattactgagttgattgaggcacagagaggtaaatgacttacccactgaggtagagagcgctaggtgactgggaaggcgggatgagagctggagcggggtacaatgcacaggaggtaaggtcctctgactgaggagcaaggctacccacggaaacacattataaaatctgctcatgaaaagcacaataatgcttttaatatcaccaggaccaaattcacattgtagtgaactgatctgttgccagacagaattctgtacttgcccccagtgcttttgaggcatgccatcaatctactggggcatgactctgtangcagcttaaaatcaagagtatgtggcttca

SEQ ID NO: 1054 - DNA, 585 bp, Rattus norvegicus
  Genbank Accession No. AI172107
ggggataaaggtctttattcgacaagattatcttactcagtaacaaaacagcaggaggtaacaattcccccaaagatctggaacagtatctgcccctggcaggggcagtacagcctgctaaaaaaagtcagctgcagccagggtctctagtgtcagccatttttcaaagattgtagttggggttctttcgaagaatgacaaagccttccagaattggggtgacagggagaaactcctcagtggccagctccgcccgttccccatgggccaacagcactggagttgtgtgagtctggaaccccgtgatcgttttgggcttcccagcctggcccaccacatccactgcctgacccacgcggacagaaactggcaatggtcgcaactcctcatcaaatgtaaccagcatccgaggctgcatggcggccaccagcccatacagtacatagtgagatttccctagaatgatgtttcgcacatccaggaaagaaacaagcacggtgagcagccccgccacagccacttgactcatgagctgccggtcactgtggtaggggcagagggtaagtgtgcccttccctaaatgtg

SEQ ID NO: 1055 - DNA, 719 bp, Rattus norvegicus
  Genbank Accession No. AI172184
attttaacttttttattgtttgcttattaaacatacattctcaaactgacactttgccatgaataaagcaacaaaaataaggcaataccataagatgtgctttacatacaaacatcatcctggaagagtaggaagtctgaatccatgtacaacaaaaaaagccaggaacaaaaagcactgtattctgaacacacacaaatgtgtatgtatgtaaagacagcacacacacaatacagtttacttgggttctttatgagcataattccttaatcatcctttggaagaatgaatcttaagaaataagaaatctgaactgcatttattttcacaatatcaatgttaaacttaggagaagcaacttcattgactaaatgttaaatatttcaagagtaaaaggcaaccttaatttttagtaaccctctaaacagggtctggaaaacagtaggttttcctctcttggtatgaacaaaggatggtaagcaagcatcattgagagtgtggacacatagaaaaccatcttgggaaccgtgctcttcacaagcctaagaaaccaccagaaataatgagtagaccccatgcaacccaaatgcaaagctaactctatacatgttacaattttcaaactcttgcttctaagacaattttagtacacctaataagtacagcaggtcatttagaaaaacagaaacaaaatatatacccagtctttgcaattcaaa

SEQ ID NO: 1056 - DNA, 631 bp, Rattus norvegicus
  Genbank Accession No. AI172208
cccattcaggaaggtaactttattcctgcatttcccccagtcgtcagtattctcagaagtggcacagacagctccatgctgaccttgaagtctactgtaggggccaacagcagttcccagggaggtgtggctgcacattaaattgtctggaggccgtgagtgttctttgggttcgtgtttctgccactgcacttgagagacaggccttgagctgggagagctctgagagactgatctgggtgtccatgtatcatctgctgagggaaaggaaagatggtgtggaccagccagtgttcttctacagcactgagccaatgagaaggctctgtgtcaactgtcaccttccacagcgatgatcctacaacaacacgctctgggatgagtcagcctctaagagggactggcacctcatgatcagctgaggtccctcttgttgaaagcacgcttctctcctctgtgcgtggcagcacttgcccagtaggagcaggaaaccctcgccaatggaatggaacgcctcctctgccgtttgtggcttctgcttcacgaggttactgaggagcctaaggcagaagcggggggacaggcattagctcctgagtttgcagggctgtcttactgctttagattctca

SEQ ID NO: 1057 - DNA, 625 bp, Rattus norvegicus
  Genbank Accession No. AI172263
gggtggtgggctttaaagaaaacaagttttattttttataatcagaacattctaataaaaatattattataacattactccctctgtcctccaggccttgactaacaggcatgctgtggagtgcctacacactggctccctgaggtaggtgtggagggacccactgcccagcctgtgggcagcccatgctgccagagatgcccactcctcccctcccagacgtgtgtgggctggaccttctccctgtgcagctaggtcatgctccagactggtacaggtgacaatggggggctgggtgggcacagagcctgcctgaggggcacagggccagaagaaggcccccatggcacagcaacagacacctgagaactcgccctggcaggcacctctgcaggtgaggtgggcagcatcagcagacaggagcccagccccctgcagggctgcagtttgtgagggcaaccctgcgggggaggggcagctccatcagtgacaccggcacagagaaatactgtcaactgtctccacagggagctactgaccaaagccagtctctaagtaaaaataggtttggggctctcggtgctgatggtcttgcctgcaccacagaaaattcccagcaggacat

SEQ ID NO: 1058 - DNA, 579 bp, Rattus norvegicus
  Genbank Accession No. AI172271
caaggtttagcatgctgagtacagccatgatttattaaaagtaacacctgaaaacatgaataacatacctgtctctacagagaaacatggcatgatttctacttaacatttattaacacacttgcaaaacgccctgcattaacacagggggaaacaataaataccgacaatggctaacataagaacacaaagaaaacaggcaagtctccacagatcgcggctataaaacccggaagtctagactcagctaaggcatgtctaaactcagcaggctacctgcccaggctgggggatcacggttcctcctagaaaagtccttgaaaactagagttgtttgattttctacgtctcacacagaagatgtccagagttctttatgattctatcaggggatagtatgtcattcctttgctgggacaggcaactcgcgtagactggtgagaagattggaaattgtatcggttccgaggactttcttttctccacccttggagtttagaagctgaagatgaagcttatttattgcccaggtgtaaggaggatccatcacgatgtcagttcttggctttcccctgtgca

SEQ ID NO: 1059 - DNA, 625 bp, Rattus norvegicus
  Genbank Accession No. AI172272
ttttccgtctagatttattttatttctctcagtgttttgcctttgtgagcgtacacataccagaggtgtgcctggtgttcttggagatcagaaagagggccctggatcccctgaactggatagttgtgaggcactagatgggtgctggcaactgaagccaggtcttctataagagcgatgggtgttcttcaccgccaagccatctctccagtcccaacattttctgttttgtttaaaggaaagagctttgagctgggggtgtagctgggttcgtagagggctttcccggtactacatcagctggccacggtgacacaggcctctaatcccaagtattggagagtggaagcaagaagatcagaagttcaggtcatggggtctgtgcttcctgctccgtcttcctctcctggcaggtggttcagtcagcagaacttccagcgattcccacattcattgcataagacaaaggtggtcatgggctcatcagcactgcgtgtctgcacctggttataggtacaattcttcttcttgcacttgctacaccgcaagaggtcagtggtggtaccgcctgtcttggccatctggtgctcgcggatggcctcttgagtcatggcgttcctcaact

SEQ ID NO: 1060 - DNA, 730 bp, Rattus norvegicus
  Genbank Accession No. AI172302
gggttttaattaaataaacttttattttagaatgactttagattcacagaaaagttgcagagaccaaagggttcccatatatcttcatccagcccaccccagagatatgattacaaactggaaggtaactaagacccagacagtatgagtcctggttgacctgctaaagtgctttctctccctggtctctgtttggtcctaagaatcaatccagcaccacaatacactttattcctttcaatctcattctctgggacactcagtgggtggggaagctggtgacctcactattgagctgggaagacagaggcttgaaaatgacaagcgtagcaagtgccacctcaccctgctgcttccgttgccttgtggactctgggtttgcggaagcccctctgaatgccccgttatccacctcattctgcttatgaatcatccttggagtggggtacccagctctagaaggcaccgtgccacgacttcttctaggttttaagaaccttacttaaaggctgacttggcccctctgtgtgcttatcaataaacttgtgaacgggagtgcttatgtgtgggagtgagaaattctgtctcttgtccaccaagattcatctgtgatgaaagatggccccacgttctttatagttcctcccattgagagctgggtccacttgcacccctggaatctaaggaatgaactgaccagtggagacacagtcctagcaccggggcttga

SEQ ID NO: 1061 - DNA, 457 bp, Rattus norvegicus
  Genbank Accession No. AI172329
atcattgcttaaactttattatttacaagttaaattacacagcagctttacacagcatgatgggaagaaggaaggagagtggagggcggcagctggcacgacattcctgtctacctccacctccttttgtgcgtagcagtcttcagtgcggccttcacccaaatctggatcaggtcttggagcacaggtgtaagctgggctcaggttctgacagccccagggccaccagggctcccacaagcagctttttcacaggcgttgatggtgagtgtgaaggcatcagcttgtccaggtgatggcgacaaatgaggccactggaattcaggtagaaggtggaaaaggcatcaaaggtccggtaaagatcctccttatcgcgcctgtagaatcgcaggaacagcatgtgtacgggcagacctatcaggcgccagcgggcttgtagggtccagttctcagattg

SEQ ID NO: 1062 - DNA, 609 bp, Rattus norvegicus
  Genbank Accession No. AI172414
tgccattaagttcagatctgaattacatatggaaaacaccgctacttgttatcactggaaattatgtgtagacatgtgaccaactgagggttatactatagtcattaaagaaaaagtcaagaattttgaggacttaagtgcttgtagttataaagttttgttcccttagattttttattacacaaatcccaatagataatatacatattactacagattgctatagataacatcattcaaaattattaaattagctgcatattttgaactactcctgatgaagacaaataaagtttagcattgataaggcagccgagagttggtttggggattcttggctattcaataatgttggcatggtcattaaagatagtcttccgtgttttcccctcagcacgactattcatgctgacgtgatctgtggccgcaacagtggctggagcactgtccctttcaagagctggtccttgcactgctatgcaaatggccgcttactcatctcgtagttgataagtcgtcctccctgaatgagctgagcgacttcgtttgtcacatggcacgcaaacagaagccagtttcggggttgtacctttgtggcaaatctcatga

SEQ ID NO: 1063 - DNA, 558 bp, Rattus norvegicus
  Genbank Accession No. AI172447
aataaatatacatcttagaagtaccaaaataattaccaacaaaatacaccatatacaacatttacaagaaagtggtacaaatctcagctggggatgacttaagcacataccactgaacacctggttcttacgtgagagggcacactggggtcagctacagtctatggcggttcaaccaaaagcacaataaataaaatgtggtccttttatcagattctggaaaatcacctcaaaaaaaaaaaaaaaatcccacaaacatgaaccttaggagacatttcctttgaatttcaatgatctgtttccccaaatttcacaagaacaacagctgaatcaccacaatagaatgctcggggctaggcgctgtgtgctgtggtgctaagtataccctttcttatttttttttctttttctttttttttttttagaaaaataaaactctatttgtacaaatatacaagtccacgttcctttggccactttcctcttataacgtcagacgctggccttcaaacacacagtcattgtagggcaactcatcttccgtgaattctgactccg

SEQ ID NO: 1064 - DNA, 606 bp, Rattus norvegicus
  Genbank Accession No. AI172491
gggaagagctttttagtagctaaatatggcaccacgtgactcagggcaatataaattacagtatgcaaaacacactgactggctgaggtaaagcgcaccgttcctgcctcgtgtccactgtgagggaaattgctcacatgctttaaaaaacatctccatcatatatatatatatgtaaaaaaataatcccctagaaaggccaccagagaggggggctacaacgcccaccctttaccatgtacggagcacccactggagctgggtagtgtaatgtccacccctactgcttgcccaaagctctgtccaggttgctcttaatggtgtccaggaagtctgtggtgttcaggaagtgctcattcagcttcacattgctgaggccatggatgcagccagccaggtccttggtcatagctccgctctccacagtctgcacgcacaccttctccagagtctgtgcaaacctgatgaggtcctggttcccatccagcttccctcgatgctccaaaccccgtgtccaggcaaagatgctggcaatagggttggtactggtgggccggcccttctggtgttctcggtagtggcgggtgactgtcccgtgagcagcct

SEQ ID NO: 1065 - DNA, 174 bp, Rattus norvegicus
  Genbank Accession No. AI172506
aggcccaagggcccaaaggtcattaaaaagttatgaaggaagacaggcaggcaggcaggcaagcaagctaagtgggcaggcaggcctgtcatgcacaagccaaactcccaagaccagggaaggcagatcaatgaaccttgatgtggctcaaattctgggcattgggttctgaga

SEQ ID NO: 1066 - DNA, 346 bp, Rattus norvegicus
  Genbank Accession No. AI172595
tttttttttttttgtatgtcttaggtgcattataaaaacaaaaggaaataatacacgtaaaacatctagaaaaacatgcggcacacaggcaaactgttgatatttgcgtcgctgtgaacgtagggtcaactgggcatggtggaagatgcatgcaaacacagcaccttagttgcttcactgctgatttggaacctggtgctgtcctgttctgtgccgacggagtctagtgaagcccggtaggtggtattcttggagagttgctgtttctgccgcctgtagaatgcaatcttgccacagtctttgaaaatggttttatccactgcttcatcttcaacacttgatttgg

SEQ ID NO: 1067 - DNA, 535 bp, Rattus norvegicus
  Genbank Accession No. AI172618
  misc_feature (1)..(535): n = a or c or g or t
tttttttttttttttttaattttancaagtttatttgtgcttcaaaatacaaagcccaatccttactcaggaaatctatcagatggttttctaagctcagcagggcctccccagctgtcaaaggcttccagggtgaccacagtcactccattttgctagctcctcttgcagaacaaagtccaaggtcttttgatggctctttgggaaattaaaggcaggagcagcagcaggctgtgtggttctctctggcaccacagggcaataaccaggacgcagccatcctgaaggccctgatgtgccacgcctttcgatgatgcccctggagccgtcctggaatctgccacttagcgcagaagcacggatgctctgacgagctgtgtgtggaagctcctctgctcgcaggcagaagtccaggcgcaggagggctgcccccgtggctgcagcaacaccccttgaaggcccagaaactatggttcagcctcccccatgcagactggtcacgaaggcccttcctcaccgcgcaacacctcaatca

SEQ ID NO: 1068 - DNA, 527 bp, Rattus norvegicus
  Genbank Accession No. AI175342
  misc_feature (1)..(527): n = a or c or g or t
ctgccaaaacaaactttattgcaccaaaaaggaaaaaaaaagaaaacttcatttatgtacagtcagatataaagacatctctttgactcctgtgcatatatttcctcaacttaaaattagggcataaaagtcaggctgctgtgccagacatgctctgccccatggcagggccaaggagaagattgtcacttgaaagtgggaacacttaatggatgacagacaacactggacccacagaccaaaggcattctcagccctggactagctctgggaatggaagagggaaattggaagcagggtcccttctgaaatctccacatatgacccagcctccatgtaggcaaaacaaaactgctccccaagtgacctgtccctgtccagttctctgctttctgcccttccaagaggtccctctttgtgccctattttctccctctctctccaagggagtcccatgatccacaaggcagagacctttatagcancgggcagggcaggtagttctccattcctcagggttggacact

SEQ ID NO: 1069 - DNA, 646 bp, Rattus norvegicus
  Genbank Accession No. AI175452
atgacataaaagttgaaactttaattaaattctttcctaagaggtttaggatttctcattgatgaccagtttaaaaggaaaaagttcaaactaaaatacatcaatcagtatcactttatttcaagccaaggttttacattaacaccaacaaactaaattgttcattcacattgacaatgtacatggtttctatttagtttttgaaagttgctgttgctacagcatgagactaatctgaaaccacccgcaagtgtaaatgtgtatcctaagggtgttgacagtggaaatcattatgcaagtttacacagctcatgaccatagtgcaaactcattaatgttgaataagtaatttatctgttttgcaaaggtagtgaaaaatattaacaatcatcaaataaatgctcagaattatcaaggaacagctaaaaatgaccaggatccaaataggttatttatattatatttctctataaagaagtgacaacactaaaaacacattgaaaaccagtgttttaaactttgaatgtgggcttttaaaaaaatatttgttaacttgagattttcagtaatttttaaccaagtatcatttgactgacaatcctgatataatttacagctgtactattcctgaaaggaacatctacac

SEQ ID NO: 1070 - DNA, 382 bp, Rattus norvegicus
  Genbank Accession No. AI175466
tttttttttgttggcagtgatatttattatactgacagatgggagttatatacagcagtgacaagatgcccctcaccctaccagggtcttgtgggggaaaggaggaggtattgacagaaggcacatggtggtagccccaggaggccagaagtaaaggtaagagggtgtagtgtgtcctggggaacccagaggttgaaacagaggctcagtcagagagagccttgggccacacagcaagtgtgaggcagctggtcccgagagcttgtgctggtcacttgaggctacagcaggacacaggggcacctcccatccttcttcctaggggcactgggtgggctaggagggagttcttgctcctggtatttccggacagtccgcacca

SEQ ID NO: 1071 - DNA, 665 bp, Rattus norvegicus
  Genbank Accession No. AI175475
catttaaaacgaaatatcaacatatttattaggctgctcgacagtgaacatgtaatcactttcttcatggagggagaatacacccgaccttgttgtgggaggaggaggatgagggctccacaagaactccccatttaccaaggagaggctgtttcctgctagcactgtctctgctgtacgctccagccaaacagccatgatttccccagaatccctttgagctgttattgcctcagatatgggagaatataaggttacacacgtcaaaaacacataggacattaataaatggcacctggacaataggcctaacattatcaaatttttttcaaatgataaggggtgggagggactgctacccaaagaaagttcctcagtcacagtagcatttagagagatcttacatcaaaagcacaagggaccagtaaatatctactatccctggcgtaagtttctcctggttcttcttgttgctaaatggtgacgttctgcctttcacctgtcttagctatcatttcaattaaaaagggaaactaaaaaatggtagaagaggacgaggagatggtgaaaaacaaccctgttcagacaaagataaaaatacaaaatcagatgtagcacaatataatagaaactggctgaaaacagtacacgctaacagacatgat

SEQ ID NO: 1072 - DNA, 641 bp, Rattus norvegicus
  Genbank Accession No. AI175551
atctttcaagcttttatttaagtgcacagacttaaggatgatttagattttgttaaaagcagccacatccatggactgtacatagtcctcaaaagcagtaatctgctcttccagcatatctgttccaaccttatcatcttcaactacacactgtatttgaagctttttaattccgtatcccactggaaccaatttagaggagccccacaccaagccgtccgcttgaatgcttcggacacactcctcaagtttcgtcatgtctgtctcatcgtcccaaggcttcacatctaacaagatggaagacttcgcaacaactgcaggctttttagctttctttgactcatactgagcaaggcgttcttctcgtagcctctttgcgtcttcactttcctcctcatcatcagatccgaagagatcaatgtcatcatcgtctttagcatctgctgctccacttcctgtggtatctgccacactgacagggccatacttgcccaaagatttcttcactcccggcaagctggccttttctttttcgtaagatttgatatgattataccaacgcagagcatgacacaggtcagcgggtggtggaccagagattgcttcaaatactgccacatcggcttgtgatggcacgtacc

SEQ ID NO: 1073 - DNA, 412 bp, Rattus norvegicus
  Genbank Accession No. AI175628
gtgaggctagtaacatcccatggggcatatatatttacatatggaaattaaggtagaattacattaataaataggtgggtaggatgtcagagcaaggtggtcaagggctcttctgacatgggaacaccagggcaagagggtggggatattgctgctgctggtgggggaagcttggtcctgtcatcccctccccctgcagggcccaaagcaaggcactaatgaagggggcccaggtgcgatgggcatcttggcttggtaacctccccaacaacaccagatctgggtctcagccctggaaacccaggctagagccagacactcccccgactgggaggatggctcataagtgagaagccccctcctcaccatctccccactcagctgctgctggacaccaaggtgatgatctgct

SEQ ID NO: 1074 - DNA, 382 bp, Rattus norvegicus
  Genbank Accession No. AI175833
gaagagaagcagggacaggctcctctgcctgttgaggctgggcctggcagacaccacacagggactggggatagggaggggaggcacaggagacagctcccaactgcgtgaacttggtcccacgtttgtcctggttgggtccagggagggcctgcccagggatggtggcaccaagaaccagggcagaggcatcagcagcacaccccaggcctcctttgggtgggtcaccaggatggggatggcagacaaggcaaggacggggagaccacatgctcatgcagacagggagttaagagttagcgacggcccccagtacacgttccacatgttaaggcatcatggttagacagtgactgacagtgatggatgacctgcccatgga

SEQ ID NO: 1075 - DNA, 395 bp, Rattus norvegicus
  Genbank Accession No. AI175875
atacacagcaaagcttacaggtttattagcggtctgtgtggcaacttctctttcaacgtttcagtggcagttctggcaacaaattcataaaaagcttaatttttatacaaatagttttattacaaatttgaattcttaagaaataacacatttaaagaaattacacagaaggccttagtagtcttaaaaactttttttttaaaaagggggtggggtaagggggacttttagtgtaacgccacttcaagcatagtgatcttcccctcctgcgcctgacctgtcggctccctgcaagatgaaaggccttggctgtcatactggaagtcagtcattcagtctgcggatagtgtggcaaaccctgaaaatactccgcgcaaagcggtaagcaggaagcg

SEQ ID NO: 1076 - DNA, 421 bp, Rattus norvegicus
  Genbank Accession No. AI175959
atctcttatttacaaacactgggtaggacacccaaacaaacaaacatggaataacttacaaaggcaggaagctgtttattatagacagtaatcagctttcatcaaattaaaaaaaaatatatgtacatacacagttgagagaggcaggccaggggagttcatccgcaatctagcctggtactcacaagcctccctccccttcccagccctccctgctttgtgttcttacggagcactacagaagcaatctacagtctctattgcagtttgtaagcccccacccaccccccttaatactgaatgagatcgaatgttaggtccatgcagttcttggtcaatgttaacgaaaagtccatcgttctggtcgcgcgggcacagcccgttcgcaaagcgtggcggtcaacaggccgctgctctctgg

SEQ ID NO: 1077 - DNA, 609 bp, Rattus norvegicus
  Genbank Accession No. AI176041
acatagcaattatttttaataggcacttaataatttccatcaaatgaacattgtctttttttttaaagcaacaattaaacttatttgcatgtgtcaggaaatatcttacatatatcactaccattttttattgtttatacatttccttttaaaattagttaccctgttctttgacaatttcatacatgtatataatgtattctgaagactcactacaaaaaagtcctttcattctaatgtgaaattctatttttttatttttgcattttcaagacaaggtttctctgtgtagcccagctgtcctagaactgagtccgtagatagatgggcttcgaaatcagagatcccgatgtctgacccctggagtgctgggactaaaggaatgtgtcactatgtccatctcaatgtagaattctttagacgtttcagctaaatcagctttgaaaattgaatataaggttggtgtgcgagtgtaaaccttcgactttattcccaaggcttctcctgaaatgacagcgactgtcacaccatctttgctgggtttcgggatctcttcacttttcagttcctggtactgaggctccaccatcttttctgagcgtttcaaat

SEQ ID NO: 1078 - DNA, 450 bp, Rattus norvegicus
  Genbank Accession No. AI176061
ggaaaggaacagttttattagcctggagttgaaagtctttgggaggccatatggtgggtaccgccacggctgtacaggaagtaagatgaaaccctgtccagggcttatttggattgtagagccctggagaaggcaaactgcccagggaagaagtagatgcgggagtcctcgccggcctgtgctatcttactgcactgggattcctgaggctcctgaggcccttgcttcagtattgggcagtggaactcctccagagccacctgcaggcctctgcgctgtgtctcgctgagctcaagctctgtcccgtgtatgtccgctgtgcccagccatagggccagggagatcagcaggcacttcatggctttgctttagtcctatggtccttgaaaaatatcaggttcgttgctttagagaggcccttttctgtgtggttcctcgaaccctcgtgcc

SEQ ID NO: 1079 - DNA, 463 bp, Rattus norvegicus
  Genbank Accession No. AI176160
tttgttttcttttttttctttctcaaatttatttaaaaaggattagagctgatatagtaagacatttatgacagggtcaacataaaaatgatagctttggttatactcagcacatgcaacttactacagcgctaacacgggcaagcttcccatgtgaagctgcatgggtgggtggggcagagttgagagaacagggctcacgtggagtacaggagagcaaaggcataaggggccacagggaatgcctactgtcacactagcagcaaggtgcactgtatattacacaaacacctgtgtagcatccccttgttctgatacgtcccatgtttctagttacgtaacagcatttgcagtctgtggttaccagactaagctggtgatcacaggactaagaatctctacccaaccagtctggtgcgttttcatgctgaccccctcactggtgttgacaactaattaaaac

SEQ ID NO: 1080 - DNA, 580 bp, Rattus norvegicus
  Genbank Accession No. AI176169
gaagtagcaatgaaataattttatggttgggggtcaccacaacatgaggaactgttttaaagaggtgtggcattaggaaggttgagaatcactgcttgggggataaagaagagctatttaccctaaccttcaaagtcctgacctttggcttctctgcagagatagcactggtctgggctctgggcatggtttatctttcacagtgcagtttgtggaaagagctgctatcaggagtgtttgtagcctggtgtttgctatgttgctcaaggtttgttagcattgacttgctcgtgtctcctttaattttcagttccaagaaaatgtctctcataactgactcccgccgtctgccaatcgaacagagaacggctgagattgcctttcttacctacaatgttcactctagaccctcgctcagtcatctgtaacatttttcatctgcttgggagacaggctttacttcgactgttactctttcagatgttgacgattaaggattaccgcggagctatttttcattctaaatctctctgagaatggtttttcttttgaggcagggtgtcaccatgtaaccctggct

SEQ ID NO: 1081 - DNA, 555 bp, Rattus norvegicus
  Genbank Accession No. AI176172
gagaaggaagtatatttattaggatgacataacgttctaagattggaaaataatgacagagtctcggtaaactccagcttggtattctgaacgttattccaaagaaagatacagtgtagctttttgaaatgtggcataagaaaaatcagccgggtctaagacaactgagcctagaccaagtagcatgatacttttattcaaataaatgcttgctcaatcaactgttcatatattcatcaaggaagtggcaatcattgatcaaagattagaaacacaaggaggaacaatagtaaaaggtcttggtgctgatcctttggaatattaaaggacaataaacaagtgaggtaagcacgaatgtcagataagtaaatgatatttcaggcaagagcttcattctctattatatagattcgcccattatcaaaggtggaaaatcaaataagaaatggtgaaagacgtgaacacacagtttgacacaaaaataggtaattttttttaagcaccctctatcgatacaaggaaaataagttgttcaaggctggtatgtgtctgtaa

SEQ ID NO: 1082 - DNA, 477 bp, Rattus norvegicus
  Genbank Accession No. AI176185
ttgctacatctccggaagaggtgaggactggagtccagatgtggatgctttcaagtccttgaggtccacagcctggtgtgtttcacgcacagataaggtcctccctaggtctacgggaacccctcgagggaagacttgtttcttctctctgtaatgcaccagctcagtcagtgccggctgccctgccttctctgactgctcacagggctagcagtgtgggcgagctcagtgagtcataggagggctcgttgctgctgctgccctttcggtgggcagctgcgcagctagggaaggagtcagcctcggggtaggtgaagacaaaggaagacgtataggtagtgcagctgggagtgcacgtgacaacgggagtgcacaggggctccagctctgtgaccatgggccccatccccagggaactgctgtgcagaggctcccagtctgctgcatagaaggaaccagacaggtccacatctggca

SEQ ID NO: 1083 - DNA, 528 bp, Rattus norvegicus
  Genbank Accession No. AI176265
ctaagacaacatgagtttattaatgttcatttaaaactatgcatgagtttgtcagtatgtggattgggttcattccacctcagagatgacaaatgactgtccaaaaaatacactaacttaaacaacatgatcaacataaacaacataatcaatccaatccaaagggcatcttttaaaaaagaacatgagtacttagttctaaaaggtaagttagtccattaaaaggcatcatttttaatgggtcatatttgtcacaaagaatcattgtataatccaagctaaatatatccttgccaggcatatcaaatttaagcaaaatgtcaaaagaactaacattgcactaaaaagtaaaacatcttcatgaattgtataaacatcacagcacattattactatttgacaacagaaaacgacgcttcaatgttgaacttttataatttctagtaaggagaaacagaaacttcaacaacttatgtaaatcatataaatctaacaggtgattcattaaaaaaaagcctccctcgtgcc

SEQ ID NO: 1084 - DNA, 590 bp, Rattus norvegicus
  Genbank Accession No. AI176275
  misc_feature (1)..(590): n = a or c or g or t
agttggtcactccaaaattgccaccctcacagtgttcgttggcccacatggtgaccttgggcattggatttcccacaaggttaaccctagagaaaattaagttggactgtaacagtaaagggtattggtgacagagcatcctggatttcccttctggtcagtagaagtaatatacttcatcatgattctttggctaagacctcaaccccttcttccctcctttgtaacattcctatcttggggacagccactgcaacttagtagtaagatggccttaaacatcttttcgcactgtatgttttggaatctaagaggaggccctctgtccttttgtactggcctgactccacggtgctttcatagatcctctttctttttaagaatgatttgcccaatcatttgtgacacatgaggtctgatggcttcaaggggttcttctggcctccagaacttcacgacttgtccctcagggttgaccagatacttccaaaagttccaccttggttccttcttggaagaatcaacangaaatctaaacgcaagttctgcttccggccctaaaatcttaatcttgtggaagatggggaatg

SEQ ID NO: 1085 - DNA, 497 bp, Rattus norvegicus
  Genbank Accession No. AI176276
actgtccagttattttcttaaaaaactttaatgcttgataaaataaaacaaaattttagtaccatagaaaccttctgacatgtatgatgacttatcaatatgtacaacttcaaaaccaaatgcttccagcacaagcgaagtcatgctgaacgtcccaactagaggcaagctgatgaagcttcctgtttgccgtgtgagccttggcttggaagaacttagacagttagaaatataaataaaaccttcaatgagaatcaccaaaaaaaaaaaaaaatgcttgtaaaaatgaaatccagtcgtctggatctgggaagtctgtcctgcttatcagataccagcaagcaaatgaaactccatgaacgtccaaatgtcagcggtccaggagaggtcctgcaggtgcacagttgatctatcagaaaccatggcttcctaggtggcccttaaggaatcatatgccatttttcaccagctcatgaactccgttctcacctcgtgcc

SEQ ID NO: 1086 - DNA, 525 bp, Rattus norvegicus
  Genbank Accession No. AI176294
aaaaaacaaaaagcacagggttttatttctagctcattgggcagggctctgcgggacttggctgggcagggagcaggctatcagcgggctgaggctggcctctagtttacttgccagcgatgagcgggttccgcagcaccacaatgactgagtccccgcgcaggaacatcttggagatgtagcggtccttgttgacaggcttggacttcttcttgcccttgccgctcttggggacctcagtccacatctccttcacattttccagcaccatgttgcagtgcctgtcaaaggccttcacccggcccaggagcttcttgttgtttcgacagttaatgagcacttgcgtgttgtttttgaccgactgtgtgagcaccgagaggggacctgtgttgaattcctcctcctcccgcttctgcagctcctctggggtcatctcactcttgggtttattgaggagactcatggtgaaggtttcgctagcagatcactcccgcctccaagcgcgttgctttagcccctcgtgcc

SEQ ID NO: 1087 - DNA, 672 bp, Rattus norvegicus
  Genbank Accession No. AI176298
aaacaggtaccagttttgattttatttcatcgtattaacatacatgacacttcaaaatgagaaatgcacaagtgaaccattcaacagcttgccttactccaagaacactatattcatattaaacatttatacagtctttcctctctaactttataactggtctaaacagtttccagcatttctcacagagtctagttttgctcattaaaatcaccattttgcattgtcccaggagacttcaggcttccctgtgcttacatgaggaaacctaaccaccacactacccacaatgtgcctaggggcagccctttcaacatggtagttgtgattccaagaactgataggacattagtgatggtggactgacagctgtagtgtatgactacgctacacggaaggaaccacagcccagagagcacctccctacatgacgtatggcattaggcaatgtactgcccaaagacactgaagccaaatccccagtcttcccagaacagacgtactgttggagctgctgcttcattctggaactgtctcactggtgtgaccagattttaagaaggtgggttcttacgtactgagtgtgtgtacacaatggatcaaatttactgtgaggctctgagaatctaatcacaggctgctgaccagtgtccttggaatggcccgtgctct

SEQ ID NO: 1088 - DNA, 556 bp, Rattus norvegicus
  Genbank Accession No. AI176362
tttttttttttgttgtaggaaaaacatttattgcaattcagtgtcaaaaatgtttacaaaaatatgccaccgtcttatacaaacaactataaaaatgtcagttcctcatgcaagaaaggtgtgcaaataagttatacaggattcagattactctttattaaacaatcatctttgcatgtaatctgtccaaccttttgcatttagttaaaatgttcaacccactccaatagatttctttaaaacatacacttaaagctcctaagcttagacacagactataatatactctctttagccaatgtgattggcatttggtagtgtaaggaaggttccgaaagctcccaagtctgaagcagggcttggagccatgtgttaaacagccttgtgcatagctaataaacatcgtctatactaaaagacagagtcagactctgtaatgctgaagcaaatgacacatccagaaatttggagtttggatgtggccatccattatttttcagccaaatggagagagactaagttcagagagctttctcaagaaggtttgcttgatgga

SEQ ID NO: 1089 - DNA, 646 bp, Rattus norvegicus
  Genbank Accession No. AI176363
gttggaatctggactttaattatatacataaatagtgatataagaatgaggagttctaaggcttgtacattatttccacgtgaaagattgcagattagttggcctgtaatatggcatcacccaaaccagcaaaaaggcttaatgtttttcctgatgaaagccagtttactatatccaatactgattctgccatttgtctgtagaaatactgagttactgtctggagtttccaatgtttacctataactgattataatgggtagagcgtagagttttctatttatttccaggtgaactcttcacatttcctggcttctgaaaatgttgcttccacaaatcttctacaactatgtaccctcgtaatccccagtcatataacttctccccagtgatctgggcaatagtgatggcttgttgtgggtaatagacagaggcacctaaccccatgaagaaaggaggatacaccagcttctttatttttgaacctctagcaaaaaggagtccaacaaaaccagcaaaaccaataactccgagtcttgggtaaaatccaggaggtgcattttgaagatagttatagttgtctacttcccactggacaaagtgttccaccttgggtttagtatgggagtatatttcctgacacaaa

SEQ ID NO: 1090 - DNA, 516 bp, Rattus norvegicus
  Genbank Accession No. AI176393
atacaaatagttttattacaaatttgaattcttaagaaataacacatttaaagaaattacacagaaggccttagtagtcttaaaaacttttttttaaaaagggggtggggtaagggggacttttagtgtaacgccacttcaagcatagtgatcttcccctcctgcgcctgacctgtcggctccctgcaggggctgtgacacagctcgagaggggctgggaagtggcctgtgtgtgctcaggtgtgaactgcctgccccaggattgcaggatgaaaggccttggctgtcatactggaagtcagtcattcagtctgcggatagtgtggcaaaccctgaaaatactccgcgcagagcggaaagcaggaagcgccaggcacagggcgcactatcatagacaccatgtttcggaatggttttggctttggttatgcaccttctctgatgtgggagtgagtgagaaaggctggtgttttcacattcggtggcctggtgttggaaaccctgttaaaggacagt

SEQ ID NO: 1091 - DNA, 512 bp, Rattus norvegicus
  Genbank Accession No. AI176396
aaaatgagtagtactttaatcatttccaaagaaagatggtacatgaatttagattagaaaaaatgacattaaaggtgtatgttcctagaaatgaaaaatgaaacaatcttaatacaatttttttttgatcttcctcatacatggaaagctgtctgtctttctactattacagttctgtaagcttctctactgtgcccccaggggatcggaagcacatgacatctaaacaaatcaggagaaccttggtggctggagggaggagtgacaaacaggaatagagatcagtgtgatgatgcacaggacggatgtgggaatcccagctcttcatatggctgccagtcctgcagaggacagcactgcaagaaccaagaccgtcactccagacaactggacctgggaaatcgacaggcctttccctaggtcccacatcaagtgtcggaccccattcaatgagtggtacatgagaggaaagacaagcacgaacttggctgcatggatcagcgctggcccct

SEQ ID NO: 1092 - DNA, 556 bp, Rattus norvegicus
  Genbank Accession No. AI176435
caaggcacatttaatttaatatcaagaattcgatacaaaaggccccaaatacaatgaaggaacacattcccccatttaacaccaacgacaatgctgtttaacatgtgcctgctgaatgagatgagggtttactgaataatgggaatctcatcacagccaaataccatatacaatctagttgtgaaatgaatgcttataatgcgtcaaacagttaaaacctgaagtgtgagaccacaccttcacgtttgtacagtcctcggttaaggttatctacagtttccacaaccattcaaaaaacaaaccattgatgaaaaccacatagatttaaggctccattatgtaatatagagctcaaagctaaatggataaatatatgcactacttgtactggtagctatgacgtgatagtctcacggctattagagttggttcttagcaagtaaatcctttaaaggcaaaattcacctcatttgagttttgacccagtagttcaacaatcatgaagtccacagtcttattggcataactgatgtacagtgtctctaagtcactatgc

SEQ ID NO: 1093 - DNA, 370 bp, Rattus norvegicus
  Genbank Accession No. AI176456
caagtcaagtttttttattttattgtcagttacatgctttatagaaaaaagtgtggagaaccggtcagggttgtacaaaaaaaggctaggttcctacgttgttttatttacaccattgtgaggacgcccccacttcaggcgcagcagctgcacttgtccgaagcctctttgcagatgcagccctgggagcacttcgcacagcccacggggcagcaggaacagcagcttttcttgcaggaggtgcatttgcattgtttgcatttgcaggagccagcgcaggagcaggatccatctgtggcacaggagcagttggggtccatggcgaatggaggcggcagttggagatcaacgagagatcgctcctcgtgcc

SEQ ID NO: 1094 - DNA, 630 bp, Rattus norvegicus
  Genbank Accession No. AI176473
gtagaagaaatatttaataaagaaatacagttcaaatacttaaaaataattatgtaaataccaggtagacatatgaacaaagatgacttctgagttaaataaattaaacagagaactataccaataaataagaaagtcactggctgaaaacagtcaagattttatttttcaatattatttcatttggaactcctagaataattttctccaaatgaccactctcctgtacccagaaagctctggccagggctcctagactttgctgcattggtcctgagacttctagactgcattagtgcttctggctggtttgaaaccaaatttcactgttcaccagaaagcagctcttaatgcattctaattctgcagtcaagttacttaacttataggcagggctggggtgagaggggcacttaaaataataaggtcactctaagaatgttcttccctccattctcggttgacacatgaatctacagagtaaatataaccttcccctgggtgcaaggctcaacccgaagcttctggctggcctacaggattcagagccaaggacactgcctaaaaagctaggctacagatgtagctccaggaacctcagccaatgaggctttgccaacctgtagtaga

SEQ ID NO: 1095 - DNA, 678 bp, Rattus norvegicus
  Genbank Accession No. AI176546
atctcatctgtatttacctttttaaagcagaatgtgattgggcactgttattttcacattcacaagccttgctgagttacaagacctaggggaacttagggttttgttctcagtactttggaaaacaagccacttggggaattcctgtcaagttgttttagcttgtgtttacttctaagactagtacatgcagaattaactacagggaatgaaaaaaatttaagatgaaacttaagtcatcttaatttggtctactaaaggaatccagctcaacagctaaacacttcagaccacatagttaacagtaacagtaggttacattacgtcttacaacaaacgttctatcaacctcttgagtcaaacctatagtatcacagtatcacatgtagaaatttttaccttcccctagttttcatgccacacagatgttttaaatgttaacaaaaataaacaaaaatcatggaaaatatattatcagaaggaatgaaggtaagcatcaaacacatagttctggtgaagcctagtctacttcttccatgcgtgatgtgtcatcatctccttccaggggtggcatttcttcagttacagcagcactggtatcatccacagtaggatcatcctcatcaatacctagaccaagcttgatcatcctgtagatcctgttagcatcctcgtgcc

SEQ ID NO: 1096 - DNA, 758 bp, Rattus norvegicus
  Genbank Accession No. AI176592
  misc_feature (1)..(758): n = a or c or g or t
attagaaaacaggttcggtttattgatccgtcataggcactgtacataaattatgtggtttgtgattacataatatttggcatctgttgcagaactataaaatcaagttcttcaataataaaaaaaacacccttcattattgaccagtataaatatatattatttttaaaaagtcactaaaaatggctcaatactttctctatcataaagtaaaattcaaaaggcaggagagagaaaaatataaattctgctaaaccagttttaaacactggcaattaatacacggttgcatgtgcaaacttctgcaacacttggcctttttaaaaaaaacaccaccagaaagtacggtgaaatctaagtattgggcaaagcgtgatcctcagctgacaccagacacttctggggtggacggggagaagtctcagaaagtttcctctgcccttacgtgatgtctcatcctcttagatggcccctgggaaccagcaatgaccctactttcttgttgaggggctttctcgggacagattctatttccccctcagtgtcacaagatctgtggctctctgttcttcctctcccccttatactttctggccaagtttccattaacactcattcacacataatagacatgcacgccaatacattttctgggtgacagacaaaaacattatcagcaagcttaaacctttaaaacatcatgagtcaagatatcacctcggtccatcagacttctggctgcantgtggggcaacctt

SEQ ID NO: 1097 - DNA, 395 bp, Rattus norvegicus
  Genbank Accession No. AI176610
ggtggttcagaagaatttattaccagtgtcccagagctgctaccactctgcctgattcaggtgtgagagcagctgtaaacatgatgagggcgggcctgagccgtgtggcctagtccatgtcggccaggctggcagggaccccttctgggctgcggtggtatcactggaggctgctattctgcaactgttgcagatactccttgtacactttctcctgagcttcaaagagcttcttcaacttcttggtctggcccttgctcagctctttgccttcaatgtcgtgggtaggcagaccattttcatcaaacttagaatacttgtcggtttctgagcggaacatctcactgggtggcgtcttcatcttggccagctttgctgcctggaaccctcgtgcc

SEQ ID NO: 1098 - DNA, 667 bp, Rattus norvegicus
  Genbank Accession No. AI176616
ttttttttgactaactccagagttctttatttaattggaacatccgacggcaaccacattcacacacacaactgttacaaacagggagcacctctcagtgactgcggaatatgcttgcctctcctggtctcctagccagagtagcaaatctgaacttctattcaggtcaggactgctatggcctgtgtgtccctgcccaggacactcatgctcagcctcaagattggccacttctgccctagatcctagggaaaggtgaacatgagggagtcctggtagcactacaggagtctcccttctttctgtagtgtcctcccccacccccaccctggcccccatccagagctctagggtccatgaaattgattccctcacaaaatagtgctagggacctgcaggggctggtcatcagggttaccatacaagccatccattcattggacagtggggaaggcatatctgggggttatcctgggctatctccacctcatctgatagccaagaaggaagcaaacttaaggatggcagcccacccaccattcacaggtccctggtaagtgttggtcaccaaggtctccacacactctgggcccggcgagctgtggtcaggatgcctaaggatgtgggcaccaaatctggcccctcggcaggcacccggtttagttca

SEQ ID NO: 1099 - DNA, 571 bp, Rattus norvegicus
  Genbank Accession No. AI176792
ttattagaacattgcttgttacattaatattcttttttttacattaatattcttaaaaaatataaaatgattttaaacacttcttgagtgattatcaagcacttatatagacatgcctgtagtatctgaacccatttttaatctttacacaaatctatgagataataattactatgtatttttttgtttttaaatgctgggagcaatctagaaggatgtaaagaaaacggttttcaaagcaaagagcaaaggtggaggtaattggagaaggcatttatcacaagtaaaggcgggatggtgtaaagagagctttctagtgtttcccaacaagtacaattttctctcttctggcccttcacttttaaccacagcagactttataacccttaggcagaaatcaggtagctggtgggaaaaaccaccggtgcagtatactacccatttcaatttcatgagacactaaaaagaaacaatattggcatgtttcttcagtaggtattctaggtttctactatccagggttttgtttgtttttgagacaggctctttcttgttatgtagctgggattcg

SEQ ID NO: 1100 - DNA, 445 bp, Rattus norvegicus
  Genbank Accession No. AI176828
aaagcgaacaaatccatttatcttcctttccatcccctggccagcagaggtgggggttaaacagttcattttaaaaaagacaacgactcataaaatgaaaacagaagaaagaatccagagctggagagctgaaatgtggccctggggagaatgtgtatgtttccagtcttgatgttgggggtcatcccagagtaaggaactgacaggcttgagactgaggtgctccaagcttcctgaggctctgaaagggggactgactacgctcacaccataagctggccactggacctagagttcccacctctgtgaccttgttgttgctactgctgggcacaatggaaaacagtcaagccccctgggtgaatcgccagcccaagcttgtcttaccagctccttccgaaacaactccttagcctcgtgccgaattcttggcctcgagggccaa

SEQ ID NO: 1101 - DNA, 478 bp, Rattus norvegicus
  Genbank Accession No. AI176839
aaaaacatcaccaagtcagatttttatttctacagacagaaggccaaaagtttctatttcagtagcagtgtacaccaaaccactcctccccagccaaagctgactcttctttgcatcctgcatgcctttgaaccatgcccagccttgtgggggtggcagcaggactagactgctattctgtgttccaaggggtacctgaaagcaagaatagaccaacactggcatccgtgggttcctcaggccaacgcgctcccctctgagttcaccattcattcaaagcctggtcttggccgtcagcaaaccttgagacttaaggtgctcggcgatttctcatctccctggaggaccttctctccctccgacctccattctgtactgcttgatcagtccagccatctgcaaatgaatatcacagggaagagacctatcgtaaccacgagaacacctcacggagactcacctcgtgccgactggtgcc

SEQ ID NO: 1102 - DNA, 660 bp, Rattus norvegicus
  Genbank Accession No. AI176848
ttttttttactgaaaggtcagacagtaaatagttcaggcataatgtgcagtagaatctgtatcatgactgcccagctccctcactgtaacataaagcaactcgatagcatgctaagcaattgccaataaaacttcatttacaaatataggctgtgggctagaattgcttacggtccaagtagatcttgccaagtatggtttgaatgaattccctagagggaaatagttccaagaatgaagtaacttctcagtgagaaaaagaaacataatggacataaggtcaccctgtatacacatagaagagggcactctgaaaacacacaagtcattagctcagccagttaatctttttattttgaattttataaaaaaagaagcttagagaaaacacgttaagtatcagtaaaagacaggaaacatgaggctagctttacaatagcaatctaaacagctctaggaaggcgcaagtaatcgttgaggggcagagagcacagcaaggctcctactgcagttttccctattgcacagaaaggttgcagataattccacatctttaattttcacagttaaaacacactttgttatcttctataaaattctccccaatacactatgtcagctctttataaaaagttccccagaatgtcccatcattgcaat

SEQ ID NO: 1103 - DNA, 645 bp, Rattus norvegicus
  Genbank Accession No. AI176849
aaacagttcacatttattattgtaacaataaaaaaatcttttaaagactatcagtattgtattaccaagagtgaggtaatatgtttacaaaacatttacagaatttgatatgcaaataatggttcagggaggagtgagttaagacactagaaacaggagagcccagagagtgcagggagcagcatgttaggggagtgctgggcactggacaagcagctctgtgagccacacagtcacctcacagccagcctccctcacaaggcagccagtgccctgtggcctggggaagctcaaggcctgtgaatgtgtagttgtgtgctttgagctcttaaagatgctatcagctctgagggggctgaacagagacacttctgaatggacttaaagggagcagctcttcagcctggggcatggctgcgactcagataggtctacaaacatccctgggcacatgtgggctgtcgagtgaagcgctttcttggaggttgtcagcaaaatcgccatctgggacatggagaaagggagagggaaaaggagagagaagagagaaagagcaggggcatcttcaggtcctttcgcttggagctggggagccctgactgaagcagtgtggacgcggcagccacaagcccgctgtgcgtgtac

SEQ ID NO: 1104 - DNA, 459 bp, Rattus norvegicus
  Genbank Accession No. AI176855
cctgtatattcctaatgtttattggaaatcgggcctctgactcacaaccatgttccccccagaatcaggccccaagtgtcctaaaacctgtactttgccttctaatttaagtaagcttccacacatgcatgaccagagaaggaatgttttgccccattagtgaaactagaaaggctcgctttaagaggaaggatagcttatcccaaggagagaggtacgcacagagtctgacgatccgcggagtccttagggcagctcttcaggaatctcaagttccagagaccttggagtagacattagaggaaattcagttccaaactttttggagcctgaggtcactagactcacctgcaaggaaggactaatttactggggaaggggaatgggattggaatcttggcgcccaagcggggtgtcagtccagtgtgccaacagaactatagcatctgtcctcgtgcc

SEQ ID NO: 1105 - DNA, 535 bp, Rattus norvegicus
  Genbank Accession No. AI176916
gtcttgtgaactttaatgtctatgacgaagtcctttgagtaatgccccttccttgccaatccaccccttatcagtctgtggctagcaggctccagagtataagtcccatgccaccctgtggtaaaacctattctgtccccaaaaccagcagcgtcagaggccagggccatcagggtagagtgcagggatgcgtctcgtcaggagccacctggctggggacggttcccacagacctggtcctgtgtaggtgacctgcagtgcccctcaggatgctaggcgttgggccagtgggaggggaaccgtggcatcccatggttctgtcttcaggcctggtcagagctctttgaaggtccaatgctcagctgtgggcaccgtcatgcctcatgcgctgtctctgggaagaaaagctctcggcatcgttgtacagtgtcctgaggggagaccacgctgtggccgactgtccgggggtccgcatagatctcaaagtcattcccaccaggactggtctcatttccaaagaagtggacctcgtgcc

SEQ ID NO: 1106 - DNA, 411 bp, Rattus norvegicus
  Genbank Accession No. AI176951
ctctttgccttttatttatttaataaacaaacaattccttcttgcttttctcacagacttctgcttacagagcttatttttaaattttcaaaacatcttcaatgagtcattatcaaaaataagtttcctcttgacttgttacaattctggttctttgtaggtaactgtgaatgtccctgtatgactagaggaaaggtcaatagacataaaaatggtttggggggaggggggagtgattcaggttaaatgtccgagcataaattttagtggctttcaagttaacaaaaggttgctcaaggaaacctttccccctctgcagtagatgagtttagagggtggctcaaggtgactctagagggtcctttcagggactgcagtctgatcatatcaaaccattagtcacaaggattg

SEQ ID NO: 1107 - DNA, 595 bp, Rattus norvegicus
  Genbank Accession No. AI176963
atttcttaactttttattgacattggcaaattaaaatagaataaattaacaagtattttttcaaaaaaatgttttgtacaaaaatactgtcaaaatttcctaaaaagctttcaacacagtagtatcttttcatgtactgaatataactattagcacagtgtcaaaaatgttgaagacagaaacaaaataaaaatctgtgaaatgtttgccactgacgacattccacaccctatttattgtctgtacatatgggggagggggagacagccaacttgaaagtgaacggtatgacttttcctgatccagaacggtttggcccacatctgttttaatcttccagtttagcatatttgaaaacttaagtctgtactcgaatgcatagtttaaaaaaaaaatgaagcgagacggcagtttgtgcagtaatatctgcccttcaaagttcatgcagccaagaaatgcaatttttcctttcactcataaatctgaatgcagtgcgcagtcatttgaaaccatctacaaaatccacaagattaagcagtttgccaagcttaatatctaacagttgagcacgggagaaagtgaggaaacaaggagt

SEQ ID NO: 1108 - DNA, 536 bp, Rattus norvegicus
  Genbank Accession No. AI176969
aaaaaaagtaagaataacaaaaacaaattttaacaaaagtcagggacagttttttcaagcaacaaaatcctggggtgaggaaagcttactctgaaggtgatcggaaactggtaacaatgtaataaaaatcgagaattgcatagcgctgcacgttcagcctttagcaaaacaaaaacagaagctatttggtattgatacaaatccatctatttgatagttagtcactcgttattatgtacatgttttatatactgaatgtcatttttaagtccccttgtccacactctttttctctgttggcaggttgttggtttgacaagcttgaacaaaaaggttttctggtgtttttgtttttcctccgaacgcactgcatcgatgttctctctctgagcagacgcggttctctgctacatgtcatccgttcatttaaaaaggaaacaatccacagtgcgatgtgtctgggatcaccacacccattgacacccaggctaaaccaggctggaccgatcggccccaggtgcaggctccttggccct

SEQ ID NO: 1109 - DNA, 601 bp, Rattus norvegicus
  Genbank Accession No. AI177058
agttagatgacagctttattgagggtcacaggacacccagagaagggcgaagaggatggtacagtggtcagttgaggtggggagggtgtgctgggggtgggttcgagtgccatgcacaaagggatgatgatgtggtactcttatggcagagaaccaggcacagcggggccagggacacttgccgcaatctaccagcccaggaattccgcctttgtgcagtctcaaatccccaatagttaaaccccttcaactgtgcttcactttccaggctactagtgcatgcagtgtctgaagggcttgcctatggccggacactgtcaggaagccacaatcacgttcccgacaccagtaccagtgctggacagacaatgtagaaagaaaccagcatagccagcctgctgcatccttcacctggcaggggcgagggcctggctcaggaggtccaggggcaccaggaatgggttcagtgggcagaccccagctgctttccaggtcagcctcggttctgtgggctcagaagcttgaggactgccttggccagtctcttctggccccgtggagtcagtccctccatcttcagtccccggcctgggcctctttt

SEQ ID NO: 1110 - DNA, 605 bp, Rattus norvegicus
  Genbank Accession No. AI177059
cagatcctgaaggtttattgagacctctacttcccaccactcccagcccccagagttctctgctgcctctctcatgacaatccctagggaagtaggggaccaaattaagctgcttttccgtggctccttcagagtcgatgggcagcagctgtggtgagtgtggtcttggtgttgaattttgagggatgagtgaaggcagatgggtttgggctccatgatgctcacttaagggagttagttgatgagaccaaggtaggaagtattctgaggagagctgtgggagtgctggggtgtgactgtggccatgcctgagctgattggcaatgccataggtgctgtatttctctgtcgagggtagccctaaacagatgggtctgcagtaaggaattggctgaggtgggatgtataagctggcagctagaaggtagcttctggctttcagctgtcgtgaaagggtagaagcaacttggagttttatggatttcagctagatccaggctggaatggtttggccacagaaaagcctggagggcgctgacagcctaacctcaggtagagtgctacagagcctgcctgtatgtggggcagggatttgccagggcata

SEQ ID NO: 1111 - DNA, 602 bp, Rattus norvegicus
  Genbank Accession No. AI177065
gttttgtattttatttacagagttttacagataataaaaaagcaaaatgtgtttcctacgtggcttggtgcacgcccgagcctctgctccaacaccttctggttgtgctcttcctggtactgttgtgtccacaccccagctgcgacaactgcattagtatttgccctggaaatcggtgatagcactgcagtatgcacagtagatagccaattggatgtcaacagttgcctagatggggtgggggtggggtgacccagatccctggggatccttaccccagagctttagaactgctgtgaagaggtttttgcctgagccctcaccaccacctgctggggaggccatgctgagcaaaagaaacggcaacaggaaacacctgtgagaggatgttggcagttcactatagtctggtgggggtagggccgacagaagcccttacacactggcacagcagggcaggataggggttcagcttttggatgatcagcaggggtaaaacaattaggtgacagaccacaccaacgcccatagctggttagttcagaggcagtcccagaaccaccagtagagtccttgcaggcctgaagtcacagaaaaggccc

SEQ ID NO: 1112 - DNA, 595 bp, Rattus norvegicus
  Genbank Accession No. AI177092
atccatttttttaattcttaaattcttgacattacagaactaaactgaaatttattaacattccactcttacatttttcgacaaacagaaaataaaatccatgagccaaaaacccaaacgaaactaaaaacagggaaaagcttataaaactaaatatggatcccagcattaacagctgaacagagaatgtgatttttctttaaattcttagcggatgataaagtgtagaaactgaacacttacaaattatttaaaacctggaatcactgaccagaaattacacagttggatcatgggaaaacagcagaagggggttacgagcgaacctacactgttctagctgcaccccatgcccttctcagaggaaagcctggcattgattagatactgggccaggctaatactggcagcggagccagtaatagtgacctgccttccagaagagccttccactgggttggcaattttgatctgggccccggacatctggcggatctcattgatgttggcgccttggcgcccgattatgcagccgattaagttatttggaatggtgagttcatgggtggtttgagtagatgcatccaaacttgct

SEQ ID NO: 1113 - DNA, 597 bp, Rattus norvegicus
  Genbank Accession No. AI177096
gcgtgtatatcaaagcagtttattgacctccagtagcacagctctgctttactcgagggtgtggcaagcgtacaaaatgcaaggttccaggtgatccataggcatggctatctgctgaccaatggaatgccctcattcacgaaagggcagccggtagcttacaaaggtcacttaggtgccctgggcccagccactgtgtacttaattatcaaggggtgtgtccaccttgccagctcctcactcatactgcaggagagagaagaatggcacaggtcccagcttctccctgcccttcagggaggtcagctccaccaggctcacacactccaccacctcagcccgcagctggctcagcagctcacaggctgcacacatggttcctccagtggccaggagatcatccacaatgaccactttctgccccggttctaaggcatctttctggatttccagctcagccttcccatactctagagaataggaggctgatacagtggggcctggtagcttcccgcgcttacggatgagcacacagcccacccccagctcctgagcaagggaagggccaaacaggaagcccctggagtccagacctgc

SEQ ID NO: 1114 - DNA, 568 bp, Rattus norvegicus
  Genbank Accession No. AI177119
agtgatctatttatttttctctcttcccacctgaaaaaaaaatagtctcataaaggtctcgataaactgccactggaatggaaccagtcagtgattcccagagaaactttgaggagacagagggctgatgggtcaggaaccagggtggacttcctgaaggaagaggtctgagtgaggatggggaaagcagagggagcgaggcgggcgtccgggtgctggacccagcctgccattctagtcaggaaacagtaggaaaccagagaagacgctgtcagagccctcagtgcccaccatgccgttgtagtcgttgacggccagccacaccttgtcgcccctctgcagccgcaggagtactcctcctgagctgacctgcttgctgttggacatgtggtcgcaaaagctggtcaccttggcattgttgaggagcaactgcacgcacaggttggccgtctgggatgtgtggtggaccaagtagtagaggccgggcactttgcaggtgaacttccccgtgtttgtgttgtaatccccctgaggattggtgatggcggaattgaacttgacaaggcca

SEQ ID NO: 1115 - DNA, 537 bp, Rattus norvegicus
  Genbank Accession No. AI177341
aatcaaaggtttttattactacacagaggagtcaccgagatgctgtccctcatttcactcggtaacaatccattctaaataaagtactttaatgctggtcatacatttatataattatcttgacagagtaagaattagaaatacccaatacatttttgttagactgttgttttaaaattaacactggctttgacaaaagcagttggggcttaagggggacacgaaggtaaatagcagccggctcgtattaatactgctatttccctcccttatcacactccacagttcaatttatttatgctcctctctgggataccacgctctgtccagtaataaagcagtaaccttattgcacacacagttggggaagcctcaggagccagtcaggagctgggcagcggcacaagccctccatgtgtggtggcgagcagctagcatggagtgactcagtgcttggggttttgaagtgtgtactgcaaagagccagagaggccccagaagaaacttgggctgtgccaggtaagaaccctacagaat

SEQ ID NO: 1116 - DNA, 636 bp, Rattus norvegicus
  Genbank Accession No. AI177360
catcaaatacatttattgatttaagggggagaggcaatcttaattattctcagaagttaatatccttccttgtcatttaaatcatggctatttaagaggaactgaataatactggagctgttatttaacctgctgtcaggtctctggtagaaactatatgaatttaggaagccttaatttgccttagggcagccaagaatattgaacagatgataggatttagtgaaccacatagcagcaagtgatgccatgaagttgatcgaggaacgagagtacagaagaagcattccgaaggtacagtgaaacagagccttgaaatccatggctaagaactcctgtgagccagcagcacattggccagaagtgttcgtagaaactgacctggggcttaacacagcccctgtccagggacaggggagaaaaacttttctatgaggagtagtaaaccaaatcacaggttttttaattttaagtctcgctgattaaaactaagaatccttggcaatattttttaaccactttcttattggttgttccacacgtgcgtgcacacacacacatatacacgtccaagtgtgtgctcacagacgtttacacatgtactaagatacttcaacatcagttaacttatacatt

SEQ ID NO: 1117 - DNA, 618 bp, Rattus norvegicus
  Genbank Accession No. AI177366
gtattttaggccttttattttaataaataacttcagttaacagcactgtcaaaattaaaaggcacttaaaacaaggtggtgactagcttgagtcagggcgagcacagcagggaaggcacgtgcaggaggtgcacagtggtcgaattgctgctgaggggccctgcccaggccctacagtcctgcaagcagcaggacggcttacagtatttgtgaaaaaggcaaatgtacagccacagaaaagaaaaggttataatagagtctgacccccaaattgcaaacagacacattagagattagaggtgataaaggagcaccaggaattaaagaaaaacaaagcagaacaggcccctgctccacaatgctactaaagttatggccttatgtaaatagtgctaagtcagggactttttagcagagaagttcccagtacttttatccaagcttggatttataaagagaaagcgttgggagttacaggatcaagtaactcacaatggcacacaggttttaaagctaagttttcctttccacatctcagaatttttccaatggacttgtaaatcaactgtgtcaaatttattttaattggaaactgtcaacacacttgtcttccgcacg

SEQ ID NO: 1118 - DNA, 610 bp, Rattus norvegicus
  Genbank Accession No. AI177374
cataaaaataaacctttaatggctttatagttggcacagatggtataattcaagctcacatttgtatttaacaagctgaaataccacgctagctttgatggaaacagaacaagaatcacagtggcttaggtttggaaattaaatccagcagcagcgcgtcctgaagttgtttgttaaatgaagaatgagggctggagtaaacaagagaaaaagctgtcaggatataagcactggagctctgtggggattactgcagaattgtgctttctggcttattattatttttagatagctcagttagcctttgtctatccttgaactcctgatcttcttgcctgcaccccgcggatgccggagttatggacaagtgctcctgggcccagctgtttcctcacttctgaagctcttacggcatcgtgaacaaccagggcccgcaacattctggcttgtagatacagtgtgtactggggtagctgtaaatatgcctgggacacagccccagaagaggaaaagcaagtgaggccttgttgaaaccttgggctagaactggaagcttttgtctcccaatggggcagtctttgctaggaaccaggaaagaattatggtgggg

SEQ ID NO: 1119 - DNA, 634 bp, Rattus norvegicus
  Genbank Accession No. AI177395
ggcttttaagagggactcggtgctatgtggcagagttagtgcgtcacgcttatatgtcttggaaccggatggagttgactcacttaggggcacacctctgcacatatctattaggccagaagtttccagagggttctgaggaaagaaaactcacccttattgtgggtggcacctccccaagggttggggtcccagaataaatgaaaagggaaagagggagaaagctgagtcctacattgcttcctttgcttcccgatcccctatactgcgggatggagccccacactctaacgccataccctccctgccatcaaggactccctgcttgaaccaggagcccaaataaaccctcctccctcaggttgcttcttgttgggtgtttgattgtagcacccagaagagtaactaaacccaaggctgtagagtggtctttacggggtgggtccttgtgagagtgcccagacccctggacaagactgcacattgccctctctcttagccagaaagggagcagcttgactctaccacatgcccctgccgtgttgtgctgcctctctatagtttcaacgcaataggatcatgacagaaacatgaaatgctgaacccaattaaccctttttaaaaaatgcataaa

SEQ ID NO: 1120 - DNA, 434 bp, Rattus norvegicus
  Genbank Accession No. AI177683
tttttttttgaaaagttaaaaattccttaattttttattcctggtaccactaccacaatttacagggcaatatacctgatgtaatgaaaagaaaaagaaaaagacaaagctacaacagataaaagacctcaggaatgtacatctaattgacactacattgcattaatcgatagctgcacttttgcaaactgtggctatgacagtcctgaacaagaagggcttcctgtttaagctgcagtaacttttctgactatggatcatcgttccttctgtggcagatttttacagttcctctaatgcatttaggacgactgtctcaaagtaacctgcagctttcctgacaactcctcgctctctctcctgctaagaactgtagccgtttgttttattttaaaaccttctgctaccatatccaccacttccaccctcgtgcc

SEQ ID NO: 1121 - DNA, 587 bp, Rattus norvegicus
  Genbank Accession No. AI177706
ctaagacattttactttattccaaagaagccaatatacaggatataaagggcacagtatttacaacagtacagtaaacaggttggttttctggtagggtcagtagtctttttatgagtacaaacccctcccggtgattttcagacccagctgacagacacagcaacggtgggtagggtgggactaaaaaccaggtagatgctacaatgtgcggaaaggggtcatgtcatggtggggaattcacatctcttccgggcttgggaaggaactggaaaggtgaggcatttgcctgagactcacacacagcccacgctgagcctggaaatcccttcccagagagactgtatgtctgaggagagcctccagtttcctggtccttcatctaaaaccaagcttgaccttgacctggagtagacacagacagggctgagctctgagcatcggggtcccttctgtgccggctccagctgcctgacaactttacacatagtaagcccctaagccccaaaggagtcctgtgttccccaaccccacagaacttccctcctactttctccacacagcttaatggaaacaggtctggccaaa

SEQ ID NO: 1122 - DNA, 590 bp, Rattus norvegicus
  Genbank Accession No. AI177755
acagtttaatatccaatttaatttttaaaaaacttaatgaaaatataacagaatcaaaacatttaaaataagtacactcactacccactccagcagttcatttaagtcataccaactatagaatatgaaaaataaattcagaagtgtaattactttaaaatacactgcttccacttttaatattttacatttatgtatatattctatagtggaagcagaaattctctctaaaaacattatcttcttaaaatcttgaggtgcatattagagccacaggcaatatccgacatataaaatcgcagaacaggccttcgggatttggcatcactggtacaatacaatgaccaggctacagaactgtacaatgcctaaacatcgcggaagaaccatgattctcttcagtggacaatgattactgcatattctacaagggcagtgatgttagtaattctgttgggtatatgtcctgacataatttccaaatgtacaacaacacaaacaactctgttaaggccatgttttatttgctgattaatggacaaaaggcaatgtaatttatttcaagtattttcttgaaagtctgtgctcat

SEQ ID NO: 1123 - DNA, 429 bp, Rattus norvegicus
  Genbank Accession No. AI177790
taaaaagacaaatcccataaaacaccatatttcccaccagatccaatcaggggcaaacatatatcctgatttatttcccgcccgtgtacctccccactacctgtgaacgagcacacccagtgtggtgtgtcaaacaaagttgtttaggggagcaggccacatggcttgttgtctcccaccaacagcagcctccagcctttcaggaacgtggcccacaatagaggtatttttgtttagtgggtctcttaggcaccgtaattgaaacttaaaatagtatagcattgtctctcacatcctttcctcgagttgtatcccgagtcgaatccctggctctgcgatgggtacctgtttacactgggatctaacagccatcagcctaacagtacccaggcaggaattattatctacttaagtcactaatgagcaaga

SEQ ID NO: 1124 - DNA, 441 bp, Rattus norvegicus
  Genbank Accession No. AI177813
tcacaccagtgtctttttattgggtctttcgtggccaacctggatgccttgagctgataatttagctccccagcctctcagacctcttggcctctgtggaaagagaaaaccagctcaggtactttcatgatcttaccacaacttggtccctgggctttgggcacaggctgcttcattcagacaagcccactgcctcctcctgtctgtgcgagggagtcagactcggggaggctagtctggcctgagatgcgcagcagcatctgcccatttgaggccccatctccgaggcatagcaggatagactcaggccctacagtttggtgttgaggtggaagaagtggggtgccgcataggttgtgacggggggcacgtgccaggcagacgaagctggacccagtctgttgctaaggacagtgtcatatggcgtgggagggaaatgca

SEQ ID NO: 1125 - DNA, 482 bp, Rattus norvegicus
  Genbank Accession No. AI177843
gttccctgcaaggacctaggcaggcagtccagctctttggctgacaagatcggagaggatctttcaaatcctttctttgaatatttggtcaaaatggctttagtttaagtccactggtcctgtgagattgtaggtgaggctgggatgacagactggtagaaatacttgcccagcacttgtgaggccttgggttgtaactggttttcctttggtgttctgattttgttcttgaagggaaggaaaacagttatgaaaggctcccatcagccacctgtgcttctaggagtgctagaccctcctaggcagagaaatggagtcctctccccctccataatattcccatcaaaatacacagacataaataaatgtagccatcacttgatcagttcttaggagtgaggtaagggacctttttctctctaaaacaaaaacccctgttgggggtggccatcctaggtttccaagaatttaaaaagccggga

SEQ ID NO: 1126 - DNA, 605 bp, Rattus norvegicus
  Genbank Accession No. AI177867
gcctctaacgttatatattaaaaatatcatggttcttgtgcacaaaatcccactgttcacatccaagcatcacccatgcctcccctctgaaccctagaacagctttaaaagaaagatggtggttttcctattcaagagctaaggaaacaccgctcagtctttatggaccttgaaaaatggtgaccccttccctcccccaatctctgcccctccaggccccagcccacctgggcagacaaagaactggcgggtagaaagtgccagcagccctggaggtgtggggtatctcaggcacagaagtcactcatgcctccgtttggagggtgggatgagatgtggaggaaggtcagcgggcagctcatggccctctagcttgaccttgataaggtggttggccagggcaaactcctcgtcatctagcaggccatccttgtccacatcagccagcttccagatcttccccagcactgtgttaggcagcttggacttcaccatctccttcttggcattagcgcccgtgatcttgccattgacaggagacagtgtgtagaagatctcatcataggtgggcttgtccttgccaactacccacttaacatcatcaa

SEQ ID NO: 1127 - DNA, 565 bp, Rattus norvegicus
  Genbank Accession No. AI177869
aaactgcagtttatcatgaaatgcaggccactgtagacagctatggctcaatactgcttggtgttcactcaggacatcatcttcttacactccacagaacagaaaaccatcccttccacaggcatgaacttctgcccgatcaggcacttgctgcagcaggagcagaggaagcactccgtggacgcgtgccagctgaagttattgtacgtcactcgctgcacttccgggtcgatggcattgtggcacccttgacacaccacagcatggttcttcacatagcacggcttgcacacaggcttgtcacggaccatcacgtatatttttccggccaggatgttgtcgcagtcaaagcagcagaagtgcttcagatgccaattctggttttctgcctgggtatactcattgctgaatatcagctggcaggaggagaaaaacaaaacccgtcaggcatctctctcctttaccccgcaggaactcacccagctcctcctgatggccgtctaagcctacaagggcagatgccttcttgagggctgaatatttgaagatggtaacgtcaggcttg

SEQ ID NO: 1128 - DNA, 558 bp, Rattus norvegicus
  Genbank Accession No. AI178025
aaagaaaatactttattacatcatgaaaaaggtatccaacaactagattcatacttgcttgaatctataaaaaaaaacaaacaaacaaaaaactgaaagtttattcattagactgtatgtggggtcatgttccacatgggaacagagaggcacaagggcttctaagtattgcacagtcttgaaaaaaaaaaaaaggagttgggaggagaagatcacatgatactgggaacgtctcacattatgagaaactaccaagaaacattcgaaaagaaaaccctctgtttctacagtagctttagtctgcagttcttggaatgactattccattgaagacatcttagtaacaggaagcttcgtttgagcaatcccatgtgcaaatattaataggaaaatatataaaataatgcatctcttgccatcacccccggcaattcaggaccgtattttggagaactgttttgtttgacactcggttaagctgtgagtttggcctgaagctccatctctgctgcctgcttgagcgcaacgtccaccaggagctgaaatccactaaaatcc

SEQ ID NO: 1129 - DNA, 510 bp, Rattus norvegicus
  Genbank Accession No. AI178245
gttagggcggcggcgaggtgcactttataagttacaggccaggatcccgctcaggctaattatggctattggagggagagggtgctgggaccagcttttttttggggggcgggggggtcttcaaggctagtagtctagaaggagcagatgcccgatccagccgagctaaggaccaccacctttgagctccaacctgcctatggccctatagaatccaccagcagaaacagtggctacagcgagaggtcagcagtgaccggcagtgggggtccaggggggcgccggcgagcacttcggcgtcctgtgtctgcacggatgtagggctggttccgaagatctgtgatgatgtcttcaatggccccatctcggtcactctcatagatgagtgggtctttcagctgcttccgttttagctcagagatgaggtccatctgttgtcgcctggccttgggaggagacttgggtgctggaggctcttccctggctgaggtgtcccgagctgcttccttc

SEQ ID NO: 1130 - DNA, 545 bp, Rattus norvegicus
  Genbank Accession No. AI178267
tcagatttatttggaaattcacagtttctaatggtactacagctctgtagttacatatttaaaaccctcttttcacaacacatagtgacttcccactctggctctgctggcatctggacttcaagggcctgctgtaccatcaggccctattgctctgaatggctaattgtgcagactggaaggggtaaaattcatttcctaaaacgtactgttcacctaaagcagcaacttaaagaaaaaggccttaaataaatcacattacaaacaacaccaaaaaaggtattagacaaatttaaaaacaattattaacaaaagtgctcaataagttataacttaaattttacaacacaaaatggtcaattctctcaaaaacacatttcactttcactcatccctgtacaatccaccttaaagctttgtagtgttgcagcttaaaaaacctaataaagttacaaaacaaatcaactgacagaaaaagttctccctcctcttccagtggcattataaatagacaaaaggcacataaatatgggaaggtgcaagaa

SEQ ID NO: 1131 - DNA, 532 bp, Rattus norvegicus
  Genbank Accession No. AI178272
ctgagcagtaggtacctgtgatctttaattaactctaaatagataacgtatctctataattataatatagaaatgataatgaacaaaaaatagatactcggggagtgaggcagggatttttctaaaatattgctgtgagcaaagtacgctcaaggttttcagcatgagcagtcgcgcagccagggagcttggtcagcacttggggactgaggtaaatatccggaggccgtgcatgcccttgatctcttctttcagtgcctgattgaccatctggtgctgctggaccatcctcttcgctttaaattcttctgactcgattttaatttcatacatcgccccgcagcctcctgagatgtctgtgacttggatagccgtggctcgaggaaacttttctttgagaacctgggtcactttgagctccccctccgtctgggaggcgaacatccgatgtgcacagtgccacagagggagcccgcggctcccgcggagcaaaggcatagcggccacggggccccatgccgcccctcgtgcc

SEQ ID NO: 1132 - DNA, 456 bp, Rattus norvegicus
  Genbank Accession No. AI178291
ttcaagagtcttacattgagataaaaaaattccttaggaaaaaaaatcatattcaactacataaaataattaaagtgggaaaaattatcataaacatctaaatgaaatggaggtttcctttgccataccactgagtgttttgtggctatttaagagtgagcatggactaaggagacagtgcagtagtagtgtgctgctggcagctgtgagcttctgagcttgatcctgaactttatgtcctcaagcatgaagaggttgagctcttgcctaattagaagttcagcattgctcactgattagtgtttatggtgctagaaggtactctgcacagtcctcctccaggtcatatgtaactcgtcaccatcttgatgatagctggaccatcagtgggggcactgggatgcctgggcattgtttccacttaatctagtagtcctctgtgttccagtcatagct

SEQ ID NO: 1133 - DNA, 488 bp, Rattus norvegicus
  Genbank Accession No. AI178326
tgcctagggaacaataattgtatattcagtttaacagaaataaaagagtatttgtcttaaaatgcaagattttgagccatgcaattaaattgttaaaaaaaaatttcaaaactgaaaatcctttgctatttaagggctggaatgtttcagctttttaaaggaaagcagagatgtatggtacagctcccttgcaagaggggattcagattcacagttaacatgaaaatcatgtagcagacgtgtgtggagcattcttcgtacactggtttgcagcagtgacattcacacagatttcccagcgtcctggtaagcccgtgtctgcagccttaccttcccacatcgtggaaatacaagttcgcacatatacacagcatgatgatagaaaacaagatatagtaaatgagattcctaaatttcggttctaagtctcctttgcgataccagtagataagtatgcaggcagtaatactactcaaagagatgcagac

SEQ ID NO: 1134 - DNA, 465 bp, Rattus norvegicus
  Genbank Accession No. AI178392
cacttatgaaatgttttatatcaagctatatatatatatatctggattctgtcctgagtacatgcatacaaaatcaacactataaaaataattcacaatattaatgtcatcgacaagttaacatctacaagcatacaaaggctgtgtgcattgcttgccctggccagctcggtaaagcaagtacctgggaaaggggacagaggagagacttcagatcccagcctcgaaccatgaggaagcaagcctgggtcagggctgagcagggctttcatggctggacgggagcagggtctgtggtgtagcaggtgccttgctggcaaaccgtgttcctgttttccaggatagacccctcgggatactctggtccctatggccaatgactactgggtgacaggagttaacggcccaaatcgaggctgctgctgaatctccaggcagattcactgcagtcacagtgggatccga

SEQ ID NO: 1135 - DNA, 616 bp, Rattus norvegicus
  Genbank Accession No. AI178504
cactgcaaagttacaaatttattggtctggaaataaatacaaacatctcattaagaaactgtcctggaaagacataatacaatgatttcttgtcagcattcagtcactctagcctggatccctgatctttctacacaaggtcagtggaaggctccatagtaggagttggcaggtaaactgattccttttctctcatgccacctacatggtgtgactacattcctctagcaactccaagatcctgggactcaccaagccttgagggctgactcccaacagtcaagtgtctctgatctgatcacatttcctataggaaaattccaaggttagccacagtaagaatcgaaagacagtagtatagggcatgggcattaggctggcattgcttagagaggccaatgctgcaaacccagtcagcaggaggggcaggaaagggaagcaagttcccacggaatgtacagaatccaaaaaccagtcattcccccagcagtacacatggttctctctgaagaaccagcaaggggccaggtgagagacattcagttatcaagtttaaagtcaatgctacatatcaataatgggagacaaggtgtgactcattctcacaagattcccc

SEQ ID NO: 1136 - DNA, 552 bp, Rattus norvegicus
  Genbank Accession No. AI178527
aaagcattagtatctttattatggcataatgcagtactttatacagtaattcattttaatgtaaaaacattttatgtacaatttcagagaaacaactatatagacagctggaacataaaaacaggtaattcaaaagtccagagttacttgataaactggaaaatattttctctgtagaaaatagtaaaaatgataacatttcccactaagcccatttaagccaaataagagctgaattatacataaatattggatagattgtgtgacccaaaagaaacttctcttgctttatttgaaaagccatattttatttaaattgtgtcaattgaaattctttccttctttcccttcactgtttggttttccgcagatcattttttctatagggtaacccattaattcaaaattcaaaaggttttagttttaggctgtcctcttggaagtagagccagcatgtccttctaccatcttgaaatggcgaattcttacccaatagtgaaatgtttcattaaatcatgcccatatttattacaagccagagagtcgtcaaca

SEQ ID NO: 1137 - DNA, 494 bp, Rattus norvegicus
  Genbank Accession No. AI178684
ttttttttccacatgtacaaaatagttatatttacttagtcttggatatttaggtcaatacatactagcctaattgcaaagaaagctctctccaatccaactctgtgatctgcctgagccaccttggcacagcagaccccaaggtttcctggactaaagtgcttgggggtggggctgggggtaaaaacacatgtaacaaatgcagagaacagctgtgcccagaaacacggctcaagtcatgaagacttcccaacttagcactgggaggcgtgtgacccagcgctcctccagctcttgccccacagaagtcattctcaaagcttccaaaggcctgatagtctcgccatcagcttccatcactgacagttactggaaaatggagacaaaggctggggtcagggcagcctcagataaggaagacgatgccctcagacaccatgacctggttatcgtcctgcatccggctcagcgaggcctgcatttcccctagtgcc

SEQ ID NO: 1138 - DNA, 474 bp, Rattus norvegicus
  Genbank Accession No. AI178700
cagacaaatccaaactatatttttcccatacatattcatctgttccaccagggttttcctcaagccaaaatactttgatttgcacaatacattctgtggcccaggggtctgggaactgtgggtctgaacaggctccaaaatggattatgtaaaactgctgtcctttctctggagctttaaaactggtgcagatgcgcagaaggaacttatcaacggtagcgtttctggtaccatagccctccctacatgtctccctagtatctctttccctttgtcacataactggcacagtgactggcacaatggttatggcaaactgcctgggtatcagaagtgtccagaggacagcagatagctcagtagctgcatctgtgtgggactgacatctctagagctgaggtactaccgagggagctagaacccgagaatctgaagtgcatcagagaaaaggccaagtctgtgcctgctactcct

SEQ ID NO: 1139 - DNA, 453 bp, Rattus norvegicus
  Genbank Accession No. AI178735
agtcaagcatgttcgtttattaagtataggatgggaggaaccagggtaagctaactccagaggactgagaggacagccactaatggaactgttcttggaactgaggagtcaagaatggagggaactacctccctgtttcccacctcaagcataacctgtgtatcttaaggatgccttgcctccttccttgcccgcctgtgtatctagggaatgatttgcaaaatgtaaaatgtatttgttacaattgctaaagaattgcttgtgtaactttggcaaggaggacagtgaatggtgcttctgggacccaatggctctgccctgaccgactctgctcccctctgatggcaccatcgcattggttcggttgggacaaggtaccgagctgctctcaagttgccacgcctgttcaaacctggtagggaagtatgaaaccatggcctccaggagtgaact

SEQ ID NO: 1140 - DNA, 542 bp, Rattus norvegicus
  Genbank Accession No. AI178746
aaaaatagagtgtctttattggtacctgtcagctcaggtacaatgtgttctcacaagcacacaggctggcaaggcctcctgggcaaggaggcaggcccagagcctgcgtttcttggcacacacacacacagagaaatgaataaattatagttctgacacttagagacaatataaaaatgcatataaaatccaacatcagctaatgaagggcataaaagcccccaagagccacctctttcttgccaactggccggggggtgtgtggtgggtcaggatggattcagtgcccagaaaggctagagacagtgatctggggtgtgcttcatgtcttagggcctctggctccccatcctacatagggcctttataacccatggccttggggagagggaaatggacagagggcatgttagagcgtctgggcagggggcagagggagttttgatcaccgatggtcaagcacagcctccgtctgctcagctcgaacctacacgccacaccgaagcccagaccggcgggggacaccgaagactttgcctcaa

SEQ ID NO: 1141 - DNA, 539 bp, Rattus norvegicus
  Genbank Accession No. AI178971
tttttttttttcctacttttgctttattcaaagacaggtgcaagggagtgaagaagggcctggtcagaaggcaagaccgacaggaagtggcttaacggtacttggaagtcaacacagtgctcacagaggcaaagaatttgtccagagaggcgtgcatggcgggtgtgaaatccccagggtggtggctagccaaggtcaccagcaggcagtggctcaggaacttgaagttgacaggatccacacgcagtttgtgggcatgcaggtcgctcagagtggacagggcaccaggcaggtcatcgaggtggcttgcagcattggtcagggcatcagcaaccttcttgccgtgagccttgacctggtcggagccctcacttgtattaaagtgagggaagtaggtcttggaggaggggaagacaatgaacaacctccctatggtctctgcgccaatttcagcagcatggttaccaatcttcacccaggctttcttgatgttgtttttgtcttcttcagagagcaccatgattgcttcccctcgtgcc

SEQ ID NO: 1142 - DNA, 624 bp, Rattus norvegicus
  Genbank Accession No. AI178979
acaaattcaaactcaagtttattttcgatttcatagaggtaagaagcattccatcatcgcaaatgaataccagccaacaataaattcaacagatttctcctgtaaaatatctaccattatgttctttcagtcacctcttactaggcaaagctagacacgatcttttccctttccaagtgacattgttcataaatcaatacgtcccagctttcaagatgtaaggtggttttctaagcctgtactgtgcataactcactgaacatagtactctgtgaactattccctgcattaactcactgcaaggggcgcagggaaaggggatgtcccaaattcacattctcaggcagaagacaagaagtgaccatgttgttccacagcattttccatggcacacatggctgaggactactctgaagcacattctagggcttaagagttaaaaatgaggcaggtgcagtggtgcacaactataagcctagagctggtgcccaggagcctgaggcaagtcagcctgagcaacacagccaatcttaaaagcataacaaaagggtagtatttcaggtcttcaaggttcttttcttttgatgaaaaatacatttctatcatcacctttgaaagcaaaca

SEQ ID NO: 1143 - DNA, 467 bp, Rattus norvegicus
  Genbank Accession No. AI179099
ggaccatttaaaagagaaatttattgcctcaatattctgggggcctggaagttcaacatgttagcaggttgctttctcctgaggcccctttccttgttgtagacggccatctttctctgtgttcacatggtcttcacttgattctcacctttgtcctgatttcttctgaggatagcagtcatatcagattaaagcccatgctaaggatgtcacttaggtatttatttcccaagacaccaagacagtcacgttctgaggttgtgggaactgggacttgaactgaagaactaaagctacaggatttgcctcttaagagaatggaaatgtatttattgagataatatacttaatagcccaaatgaacaaacttactgaaaattttaaccataaccgagtaagatgtataatagattcaaatgtcttataaatatatattatgatattttgaagtgccttttcctcgtacc

SEQ ID NO: 1144 - DNA, 261 bp, Rattus norvegicus
  Genbank Accession No. AI179167
tcggtgctcgtgtaaggtttttcttttcccctcaaattttatttcaataaaaggagacttgggcgaggtggattccccatagccggattctccccctccccccgagggtggctaatgctatctggggatgtcttcacagggaagagagaactatgggtgggctcctgcctgaggtctccaccctcagcccagcggacatatcacaggcagcttaaaaaaaaatcctaaaaaaaccaaaacacacatttaaatcctcgtgcc

SEQ ID NO: 1145 - DNA, 457 bp, Rattus norvegicus
  Genbank Accession No. AI179288
gagatttgaaaaacaacagttgtttattatacaaaagtctcagggtacctttaagatttaattatatttatttgtggagggggcgtgtgccaatatacaaacatggaggtcataggacaacttgcaggagtcggttctctccttccaccgtgtgaggcccagggatcaaactcatattttggtggcagggcccttccttggcaggccatctcactggcccacctttgagattcaaaacaaggttctctggttgcagagagggctggacctgcagggctattctggatactgaggacagctctgagtaggagcagaccagcagttcggcagacaagaacactgagtgcctctgttgcagtttctcaggaagactcaactccgtacgaacaagcaactgatttgcaaactggacaagtgacttcagctctgcagacatcaggatggtaaccctcgtgcc

SEQ ID NO: 1146 - DNA, 526 bp, Rattus norvegicus
  Genbank Accession No. AI179314
ggaccagggccttgcacacactaggcaagcaccctcccatcgagacacgtcctttgtgtgtgtgtgtgtgtgtgtgtgcgtgcacgcgtgtgcacacactgatgctgtggaggggagagtcacagaagtatggatcagtgtccgcaggcaagcaggggaatcagcatagcctggtgacatcttgcctaattaagcacaagctgagcctctgcatggcccccaaagcctctctcgctcccctcttttcttgatccactactgcttagaatctcagcatccatccccagatgcttccgggataacggtgactcaggaaggcctttcttgtggaactgcctgccagttctttgcacaacctggagttagagaaacaggtatagatccctgacggggtgagcagaaggcacgcatgactaatataaattatctgggaaaacctatagtattaccgacagtgacttttctgcttagagagataccaggaaattctgtaacgcattcaggttgctcaacgccagtgctttcc

SEQ ID NO: 1147 - DNA, 581 bp, Rattus norvegicus
  Genbank Accession No. AI179315
caattactttatttccactttttttcccagtccccagtagcacagaggagaaccctctaaagcacaaaaaatatttcaagagagcacgttacaagagaagagtcagcgataatttggcagaactttattttctctagcagttcatacccccccgatccaaattcgataattcaaaaataatagttaactttatttaacatgttacagcttgacatttaaaacatcatgctaggtgctgtatctgggaggagacgggggaggtgtgtatgcaatcaaaaaaaaaaaacattgtatgaaattctcaaagaactaattaaaaaatgaggaaaaaataaaatcatgctctagttaaatatttcacaaacaacactgtatacaaataaaacatttcacaaaatatttttttttttaagaaaatgttttggtctttgatctaaacaataaataaaaacactggcaccttcacttagatcgggaggcgccgctacccaggagaggtttatctaaggaatgaacatgggacagagaatatggcaagaatagaacctgggagtttaagctgaccaaccacttaggaaaat

SEQ ID NO: 1148 - DNA, 631 bp, Rattus norvegicus
  Genbank Accession No. AI179378
tgtgtcatttattaataaagcaaattctgctggtgtgctggacttcggaggcaggaagaagtgctgaagggtgatattcttcatttcatttcacatccagccagttgtgttaaaaacatttcctccttcctccttttactcctcaccctgaccccagccccagccagctccggtgggggctcagtcctccggagtccaggagattaaggctgctgtcttccctgtcagaaagacaggcaaagccctggaggcaggaagaggacgaagtgaagggctcatcaggcagggtgggtcggccctgaagccagccttctgcagcagtcagctaggcagctgctgtgtgctaaatacaggttgaagtgaggcttctgggagctccataggagcctaaccaataaactgcagataatagagaaaggtggctagagtcctggtccattccacaggctgtaaacttcttggccctagattaaattataatcccaaggagcaaatgcagaagagtgggctcaaagatcaagtctgcgtgctgacctcctgaacaggcacatgtccttgggcgtgctgtggtcgtggaagcatggtcaactttgaggattaagtagcttaatgcctcgtgccgaattcttgg

SEQ ID NO: 1149 - DNA, 589 bp, Rattus norvegicus
  Genbank Accession No. AI179399
  misc_feature (1)..(589): n = a or c or g or t
ttactttttgtaaaggtggtcattgtcgttgttttaatctaaactgccatattgaaaaaaattaagtcaattaaacttgagaattgtaagtaaaataaatattctgaaggataaggtggtcaggcacttcagatcatatgtacaaagctgatgcaggaccagccattacttcaagagtctcaggatgaacttcaaacagtcacagttcttgtgttggtcattgatggtagtctcgatacttctggacttctgttacatgaaacaaactggcccaatttcaaagccaaattcctggtctgcattgccaatatccacaggaccgatatctatgatgggcaagcgggccacattctgtgttctgtattcaaagacagtcttgcctacatttccatttcgctttgaacaggtatcttgaagaacggtgtatctgaatctgatgtttccttctccttttatttctaagtcatttgaccctttaagaaccacagctttcttgaggtttttagtttgatcatccatataaccaacagtgttccctcgtgccgaattcttggnctcgagggccaaattccctatagtgagtcgtatt

SEQ ID NO: 1150 - DNA, 357 bp, Rattus norvegicus
  Genbank Accession No. AI179407
cagattgtcaagacatttaatatttggagagaaggtgagacagcccggtgttgatctcaggacaggggtttcagagtcctcgaatcacgagagagaaacctggctctgcccagccacagatggaaaggaccatccatcccagccacccttccagactctgtctccagcgccacctcactgagacttagtaccttgggctcattttttccttggctcatctctacatttttccttgcattgatgtcccttctcttcccctgacagttcccagaacgaaagtggtgtcattacggaccagctgacccgggatgaagcatctgtcgtcctattccatggatcaaagaattgcctcgtgcc

SEQ ID NO: 1151 - DNA, 668 bp, Rattus norvegicus
  Genbank Accession No. AI179422
ggttattgaatatgtattttttaactgaaaaaatcattcataaattaacatacagaaatgtacaaacacatgagtgaacaatgtaatgacaaggaccatttctgtgaaaagtgtttttaaaacatctttaggcttcagtgcaaaaatgtccccctggcacctttaaaacaaagagcaagctcagaacaaagacagtaatggtggctaagccagtggcgtcagtgcctcgtcgatggtatgcacagtcagtgtgtgctctgccgctctgaggaaggaactcgatgacaggagtccccattttagcaaaattaaagttttgcaaatcccccctccccaaagaaagcctgtgcggacagagaccttgcacacacagggcagtcagtcaagggcaggtcggcttaagggtcactcgtctgtagcatggagtaatttcagctgccaaagtacaccaaggtcacacttgattctcaatgtcattttctttaagcaatgacctaatgtgtggtccagtggtgtggctctgactgtgacatttcccactcggtatgtgactgggcggacaatgactgacagtgcccacaagagtccacactaataacaaacttggacatgattgcaagggaacataagtgacccgacttgagcagtaaaaagactttctttgtccc

SEQ ID NO: 1152 - DNA, 607 bp, Rattus norvegicus
  Genbank Accession No. AI179481
taaatttttgctaaaacacagaagtaagaactgtttttgagggttttttttcttttttaaccccttgggcagtgatggtggggacttggggatcagtgtgggacccagtgatgtttgcacaaccacaggaaagtgctgattgatctgatgggggctcagcgtacttccggatgcttggcgtgaagtccgtgattagaattcaccaggggaagtcacagagagttctagcaaagacaaaaggcgtggtcatcacaagaagccgtggatgtccgcttctaatcctctctcgtctcctcccagggaagccccccgaatcctgaaagtttccgagaattccctgaagtaaagaggctgctcttggggaaaaactgtggcacccacccttgcccaccagcagcttctacttagtcccatcgtattatgtactagaaacatagctcagaagaaaaaggctccaacgtagtgtcttcagcttgcaatcagaagagtagactttcctttatcgcgtgcttcctgcgttgtaatcaagttaataatgtggaatggatttctccttcagaaaggactgactgggacagcgactgaccccgccccagaagactgctac

SEQ ID NO: 1153 - DNA, 520 bp, Rattus norvegicus
  Genbank Accession No. AI179580
cccaagacatattttcttttattgctttgaaactcaaaggaaatactttcccagggattccttggctggtaaaaaaaaaaaaaaaatgctttcataaggacacagtctccaagttgttctggcaccattaggagaaaggctgtcactctcaggtggagagcatgaaggtgaggggtggcagtgggcaccattgctccgagtgggccagatttccaggtctacacccattactactgtctcactatgcagtaaaggacatactcatgtattgggtgggcggtggaagaaatctggtcaacaaaaacatatagtgggggaagcaagaatactggccacagtgggattagatttcttgccctgacatagcagcaggactttctatatcccagaattcagtttacgactgttctgagctcagcatttgttggtctctgatcattctcatactcaacgctatctgcctcacagccaagcgtcagggggcaaacaggattatatcagtacaggaggacatccatca

SEQ ID NO: 1154 - DNA, 570 bp, Rattus norvegicus
  Genbank Accession No. AI179599
ctctttataataattttatttctactttttatatttacttatttactttgtatgcttgtacgtcacatgcatggtgtgatgtggggtgggtgcttacctagagagaacaaggctctgagtctaatccccggcatcaccaaacacagtgcacaagtgctaatttttattccttcccagaaactcatctgacagtggaagaatgaggtgatcattgtcacacaggaaacactgactagagtacacgggctgtcagcaagtcacagacaacatcggggaacaacaaatgcatctgggttccaggcagccattcccaagtcacagtggtgttcctttctaggcagttggcaagagacaggtcaaatactttcaacagaatttttaggccaggtgagcagccaacaggaggagatggaacggctgagagacctggagaggaaggcgagctagcagcatgtccagcctggggagggtttggtctggagattgatgtagttcccttgggtggacgaagacattatatcttctctggaattgttcatcatcttttccacgaggactctcatggcctca

SEQ ID NO: 1155 - DNA, 472 bp, Rattus norvegicus
  Genbank Accession No. AI179601
ctcagaacggcatatcaacgtatttattcacagccttgttacaagtgtacgtccatctgtggagttttgacacactttaagtcacccatgcctcttaagatccaatttccaaatcatcgaggacatccttaagccactctgtgctcccgcgtgtcgttctggaagttatccgtcagcttcagacacctaccttgtgacttggatgtccgcgccatttccgcccagttgtgcgcctgggcatgcggcggagatctacgtcgcaaacggagctcggcttccacaccgacccacttcacgcggggtccggcgggccgtgctcctcacgcggccaccgagttagggccatcccccgatttcccgggaaggggacgtaggccaaagtctaccgcggacacgctagatagcaggccacagccacctcccaagccccagctaccaggaaacccatactacgcgccgcgtgcctcgtgcc

SEQ ID NO: 1156 - DNA, 590 bp, Rattus norvegicus
  Genbank Accession No. AI179605
ctgtagaaactcattttattcttattcagactatttccaaaagaagcagtggtgcgctgtttttctaaaaatatgcctttatagatttatgtgtgtattataaaatccatacgtgtatttacacaattgctacatacaaaattacagcactgtggtatgtacatgtctgtaagtacattctgtcgctcagccctgctgtgcttgtccctgtcgagggaggaggctcagtgagtggagagcagtgcaggccggccccacagagccttgagctggggcctcggctgagatggggtggctgctgcggaaggagcagaagcagcaggctgaaggcctttgtcccttagagacctggtgggcagtatctggaggctcccagcagccttgccccatctaccctgtggcacccacgctgccttcagtgtgagggtggtaaaaccaggcccctccaaggccactcttgtggcctgaacttgcttggcttggccaagaagttgcatttgaggtgggagggagctgtggaagacaagtgccctcctagtcctatcccgtgatgggggaaaagtctggaatggtaaagcctacagggccaa

SEQ ID NO: 1157 - DNA, 613 bp, Rattus norvegicus
  Genbank Accession No. AI179610
attagataatgccatttattatttcacacagaagttagagaccaaggttacaattattaaataccacccacccctcaaaagacagccctacttggttagaataaaaaaacaatcgatacaacaaaaaataccattacactggtagaactggggaaataacaaaaacaagacagaaacacaagacagaaaatctctgcacactgatatcaaagtggccatgacgctgggggaaagcagtcatggtcagtcaacatggacgccgactaccaagggcactgggctcagaacagccgcctctaccgaccacagttctggggctctgttgcaggatttggggctgctggtttccaagttcaggcccctggctgtgcttttggtgagggaaatgtgccaggcatctccttccattccagagagacaaaggaagacacaggaagggggcgaggaaccccaaaagctttcttagaggcccaagaaaagagagccaggcaagattctcccctgcagagagaaggctacatgagacagagttcacagcctctgggggccaacactgcatttacatggcataaattcccactgccacggtcgccaacaggaaactgagtgttga

SEQ ID NO: 1158 - DNA, 503 bp, Rattus norvegicus
  Genbank Accession No. AI179717
acaatgaacattttattttatttaaaaaaaaaaagtctaactcgccacttgataaaggtcaccaagtgtttatgatacagaaaataaaatgccctgggattagaaagacaataatatacgtgtaaaaacatttagccttcagaaaccagtgtgaggtaactggctccaactgctcagagatggggcaggtaacagatgaaatgtatcaacacaagttaatgctgtcacagggagacagtgtgtgaagacagcactggctgccaatctgactgacaagaaaggctactctaattcacggctgttttccttgcaaggggaccagaaatttaaaacacctttaacgtggtaatgaagaggtaattaactcttttcttaagagcagcctggccacaggacagagtctgtaaacacaggatttttcctcctatataatacagcatagtttgaaagtttgtctggactggggcgaggtccttagtgacctaaggggcgacagtccctta

SEQ ID NO: 1159 - DNA, 444 bp, Rattus norvegicus
  Genbank Accession No. AI179750
cagtttccttaaattcacatttataagttagtcttcacagttaatcctgttgggaataaaaagtaagtgaacatatttctgcttttcctgcacataatacaattatattttaattcttgacacgaatggtccatgacttgaattttctgaaggggtgacaggccatatttttggatcacctgccactgctggctgatctgcatctctgttggtttggcttttgttggttggtttatttttgagacagggtcttatttatgtagtccattcctgtttcaaacttcctgtattgctcagggcaaccttggattcttgatcctcctgcctctacctctcaagtgctgggataacatgcttaaactggcccagctgaataacatcttttgtttaaatcctgtcagccacctggaagatagataccttattagtcccatttgcagatga

SEQ ID NO: 1160 - DNA, 418 bp, Rattus norvegicus
  Genbank Accession No. AI179795
tgtgttttttttttttttttttatttttttagtttatttttctacttaacttttaataaatgagaagaaacacagtagtcttgtctcatatagaacatttataatacagaacaatccataaagcctcatggtgaggtaggaacagctttggaaaaaacacacagtcatagaacgcacagaagttagggaaaaggctgccacactcgggttcgagatgagccgtaacaactgcgccgttggcccagaggacggacggacaggcagcagcagacaagaccaacacgagagcgtctcagagaatcagacacactaataataccccattgtgctgtttcaaggcagacccatatcatggccatttgtgtcttttatataaccacgtattaattctgttacattctcttcagcacctcgtgcc

SEQ ID NO: 1161 - DNA, 614 bp, Rattus norvegicus
  Genbank Accession No. AI179875
aatctcttttatgctttattgatagccaggcaaaagtgacctcaactgtgatgggtggggactgtggacaggtggcatgggctattattgtccctgaagttgtccagccttggtgcccctcagcagtgagagagaaggtattagaaaccattcaccagctcaggatgcccgggcagtacttgtcaatcagcccctgatagtagggccgcaggctcttgctgactgcacagctgccggtagtcaccgccggtgtgccacggatagaaggaatggaatcggaccatgtagaaggcctggggacaccacagacagcatgctcagctctgctagactagctggactgaatgaggctcctgactgggcccctctccacacctacctctgaaggtagggagaacttgttgaacttcatcatctggtataggtactctacagaagagggagtcgttagagtcaggcgcccagacgggcagccctcgacaccatccctgcaccgtcccctcgcttgtctctagcggtcctcaccatcatggccccaggacataaggacattctcaagtccacagtggggctggtacatgccaagttctgtgctgcaatgatcaagagatgag

SEQ ID NO: 1162 - DNA, 568 bp, Rattus norvegicus
  Genbank Accession No. AI179953
gatcattaaagtttggtattctattaaaaaccttatttaattttaaagtatacaaaataatcatattttaataaatgacatttaggagtttacaaaattatatcagtgacaagcatgaaaccacaactcttatttattgttacagaatggcttcccaacgacattcttggcaggaagaagtgtcccctgttggatttgttgactgtcatcttgtggacaacacatcaggcagaatgacaatgctaaggttcaacttgtcctagaaaagttacacattgacctaaactagtttcttctattttttccaaatatcaacatttctgtttccagtttagaaggcaatgctgaaaagggaggcaaacagacattcaaagtagaaaaactcagttttaatcaacaggatttagagtctagaagtttcatcggttctttgaaaaccaccccatcttgtttctgcaccattaaattgtaccatggcagtgaaattcccaagcaaactcatgaagtcttttgatactgactgccacatcccacagctacagagtagacgagctgggggtggaggggg

SEQ ID NO: 1163 - DNA, 471 bp, Rattus norvegicus
  Genbank Accession No. AI179967
aaaaaatagttgcgaccacatctttattgcatacccgggtgaataacttatcacataacaaatgcatcccacgccaagaatagacacttacggaggtcagggtgaacggattactttagataaagagcagcggttggggaggagcaagtgccaggaatttatggccagaacaaagcccaaattctcctggctggaaaaaactgaccttgtctactacagtgatgtccggaagagcttctggcaaaggacacagaggtctggggttggcagcaagtttaaaggtgagatgagatgaaaatatggcccttataagtcggtgtcggtgtcgacaccgcgaggccatcgtggggcagtgcacagagggtagacacgtgacctttagctgctgtttctctacctccagccgatgcactttgtcccgaagccgtgcctacaccggttccccacctttcaccagacctcgggcctcct

SEQ ID NO: 1164 - DNA, 284 bp, Rattus norvegicus
  Genbank Accession No. AI179971
gcttcctactcaggctttattcaaagacccaaaggtttaggtgcaagggagggaaaaagggcccggtcaaaaggcaagcccggcaggaggcggtttaacgggacttggagggcaacacagtgctcacagaggcaaggaatttgtccaaaaaggcgtgcctggcgggtgtgaaatctccagggggggggcaaacccagggcaccaacaggcattggctcaggaacttgaaatttaccggatccccaccccgcttgggggcatgcaagacgatcaaaagggaccgg

SEQ ID NO: 1165 - DNA, 597 bp, Rattus norvegicus
  Genbank Accession No. AI179979
aaatgatcaaagagatcctttatttaatgtagacagcctagtaagtcatcaaaataatttataatagttagatgcctcttaaatatacatgttatcttctgaagctaaaagtaatatgcactcaaccagtttttaaaatctatttggaacattaaacatgataaaagtagaaaaaaaatctcttatgaagtcctctacgaaaggaaattgtgacaagttcctgttaagacagaaaccattccatctccaagggagaacaagagaaacatgaatatgaacagaaacacctacttcctgggtttatcctaggtagaccaactctttacagttattttctgtcttccctggataaataagaatcccttaacagcagcccggaaattaaccaattccagtgaagaccctgagatggctgccctgcagcaggttcttgccttttgcagtcaacaacatcttttacaaagcaccttgacttatggcaggcgtgacaaaaccaggtgaattagttgtccccagccagggcccggccacctttagccttctaggcgccactgttgggaaaaggagccatcacagatcgccatgccgacgtagccc

SEQ ID NO: 1166 - DNA, 446 bp, Rattus norvegicus
  Genbank Accession No. AI179986
agtaaaggcatttaatttactatgcacctcagaaagctccaggtaaaatattccgaggaatatacacaaagaattcagaatataaaactctccatgtaattagtagtcatattaatattggaactacagtagaaaaaaatagctgtctcctagactcttccaggagcccaactgtgtagcgtcgagaaggtggagttgttctgagtgaccgggaagtccagatcattcttccagttctcctagcagttcaacaaagtcagtgatgtaccacttggcattgtccttaacctgctgcctgatcacgttgcctccaaagccaatgaaggcatcagcgggagggcaggcttccatgtctgtggctccgtctccaatcatgattattttcttaaagtgaaatttttcctttaaaaatccaataacctttcctttcccacctgactcggttg

SEQ ID NO: 1167 - DNA, 667 bp, Rattus norvegicus
  Genbank Accession No. AI179988
gaagagaaaatctctaataatttattgaccttcagtttcacatcgtgaaaaaaaataacagttttacaaaacctcaaaaatgtagtggaagcaaacaacatacgaacacgaccgtcttctaacttctacagggtttggtatgtgaaccacatattcaatagccaagagagggatattatgcggctctaatcactcttattcagacaggtgtcaagcctgagaaaagaggctccaccattatgccagaagtggaaggctgccctttgttatccgtttccagggcaaccggctcacaaaataagaagaacctcccctgtcttatgccagggtttttgtgtgtactgtgctgtgaattgtatttgcttcaaagtgtgggacatttcacagggcgagaatggtcaagtagcaggcccgaatgcctagatcaattgaatgagcggggagtctagaaagttcccctgccggctgggggcccacccttgctgggcagctccctctggctcacacagtaattaacagaggattcaaggccgggccacaactttgaaacagctgcagagaattctccctgctctcagcagcagtgacgtgaagatcttgagacagatttgcattgtaaactgtggagctgagacagctacgagacaactgatcataccaccagggt

SEQ ID NO: 1168 - DNA, 680 bp, Rattus norvegicus
  Genbank Accession No. AI180004
caagttgcaactcaattctgtactttcttaaacatgaccaagaaaagaattacaagtaataatgccatgtcaagaagaaactattaacagtgggctcggggaagctacacagtatcactgcactgcatgtgtgtgcagagttcagcacgtgccagcatggaaaactgtcttgcactgaggttttccaagaggtacaacgagcctgccaagaaacatctggtctgtactaacagcttgctgtcttcagtacaggccttcataatgtcagtcacgctgctcttgcaaaatcccttagtgtaaaagagttttcagtgctgataggtagggctatgatcgatgatgtgggattgaatccatatgcacattgagtttcatttcattgtcaagaatttgaacaagttgttgcatggatggaagatgtccagattccagcttagaccataccggtacatcatttaaagttatctcaaatgcacctgttgacatacactggttctcaatcatgttgctcaagaagaagaccatcatacatgcataaaccttattttcttggccccactgccagatgctaggagcttgcatgccgaaaaaagcaaaaggatctttgccaacaattattaagcctattaatactagtttgaagactgacaggaaagatgctatgtgtctataaattggtt

SEQ ID NO: 1169 - DNA, 448 bp, Rattus norvegicus
  Genbank Accession No. AI180165
ctgcctcaggattacgtttaataactgccaaaggcatacagatatttacaacaggcataaagaccaagagagatcctatccctgcgatcccaacaataacaagaggcaccgacatgagctgcatataatgtcttgaatacagttgttctgaaagtagagctcccttgaaaacgcgtttaaacaaaaaaagtcctgatagtccttacatcacactttacgtctttactgggtatcaatgcgaagcagctgctccttgccattaattatcagggattttaactctccatcttcttccacttccaccctttcctggccattctaaacgattctctggggggggatttttttgccattgattatttcgggggaagttgacaccgacttgtatttgcctgccgccccaccgccgcaggacatggaaaaagaggaaaggcctgattttcccgga

SEQ ID NO: 1170 - DNA, 545 bp, Rattus norvegicus
  Genbank Accession No. AI180170
ggttccacttaaattgcatgttttatttctcccaaccccagccatagcatagaagccccatatatccatcccagactggtttctagtaggctgaggttatagggagcctcagtagagcaccgtctcccaagagccgggcacaagcgttgcccccacactgatgaagccaacagtgcactggccccgtgtttccgcactcagtctgagtttacaacacaacctcacccttgaaacggacagtctgggagtgggggtgtgagggagtgaaactgaaattgcctattagctcacccttttcaacattaaacagagaccaagagagaaacggttccaacatttcaccacatatatttcttcttgtgcagtctaagccgagaacgccatgtaaatgggtcactgcggaggcagcgaacgcagcaatttagttactctccgatcagagggagaaaccaaccagtatgatctcacgtctactgacttctgaaggtttacagcagttaaagtattttgcttctatgtatgaaggttaaaaaaaacattttttt

SEQ ID NO: 1171 - DNA, 368 bp, Rattus norvegicus
  Genbank Accession No. AI180239
gacttagcagaggctctttattaggtgggacagttgaatgaagccagtgggggaggggatctgtgatagccgctgtaggaactggcaaggcctggagtccacctgacatggcaggaggcactggacctgcaggtagcacgcagcctctgggccggctgggaactgccacagccaggacagataggggctccagcatcactagagcagagccgggagaggccctcagaacccaaattctctgcaaacctgggtagacacccattagacactgagggttaaagagatctgactgagaagagagggacagtccctgtagtgtttcacagcactgctataaaacccaaggatgccacaggctgcctcgtgcc

SEQ ID NO: 1172 - DNA, 523 bp, Rattus norvegicus
  Genbank Accession No. AI180281
aaagggcatatgccactttattacaggttacttaaaaatcaagtcagaggaagctacatagggggtttgtactttaagcattaacattagacacaaaaactaaactggccattaaaagggggcacagtgaatgataagatctttcagttggcttcacctaagttctccatcacccaggagccgtaggccccggtagcctgccacctttcactcactgaggacagtccccctctaaacataatggctttatttgttgaaaataactatcagttgtactaatcccttttaataaagaaaacacagaaggttatcaggcaggaatgatggactgcaggtgcaatgctggcggcaagagcaagtggagtgcagcatgactccacagctccctggcaaaggccaggccgagggaaagcagcggaagcccagccacagctgcttggatctgtgctcaggggtcagcatgtgcacactcagactctcttctcatgcactttcctactgcctaaaaaggcctcacagtccc

SEQ ID NO: 1173 - DNA, 507 bp, Rattus norvegicus
  Genbank Accession No. AI180306
ggccttcataaatttgtttaattgaagtcatctacttgtaacaggacagattcacaactatttgaggtttacaaattacatctttgataagggaaatggtttcgtgagatgtatacaattgctattaaaatgtaactatattctatatgattgtaaatattttatacaacatccaaataaaatatttttctattatatttattatgttgaaagcacagtaactgtttcctgttagctaatataaataacataaacaacactgtcaaacaacaaggcggatgtgcggacgactctaggcttttagggttaactcatgctacaattacactcttacatgcggtttggagtcatcccaatatttattcagtagattaaaatggatgcacatttaaacaccatttataagccattattttgtacttcgctaaagcggcctctataactgtcttgttatgtttggcataaaggaaacaaaagcattgcagcatctaggcaaacaaagtgtca

SEQ ID NO: 1174 - DNA, 553 bp, Rattus norvegicus
  Genbank Accession No. AI180334
aaaacaagtaaacagtttattaagagttaagtgaggcatggaatgtgatacaaggagacactccgatgggcagatcaccacacacacacaaactaaatttcacttcaaaaaaaaaaatcacaaggcaaaagaaaaagcaatttcatcattataaagtaaggtatttcatgcaaagcactaaaccacacccccaaactcccagctcccaataaacattgccatgccagcgtattgaccacagtggaaacacgtaagcaatggggttaggaggtaacacagctcataaccagaccatgattttacatgaaaaacaattccagatccatacacagagtaacataggccaaccttagaagtacgtaaatataaaccccatcaattaatttcattatcttttaactataaaacccagaagcttacagaacctgaaaattttatataaaatttggcatactccttttatattcaagaaatggttttaggatgtttgtagttagcagagagctgtataaaagcatttccaggttaggatttgacctcttaacccttgacc

SEQ ID NO: 1175 - DNA, 492 bp, Rattus norvegicus
  Genbank Accession No. AI180392
ggcccttcaaatttttactaagactgtgcgttccaaccatgaaatgtagggagtcaagagctatctcactgaggacagggtttgtttggatgctgggttcctcacaagatgggtgatatgtttaacagtggagttctgtaaagtcaccagatgtaactgtaaaccacactgtgtcacaaaaggctcacagcacagcatgtgtgggcactcagggtcagtcggggtgagaaagggccagctcctgtgtggtgtggctgttagagcaacctgttgacctgggggcagaagtgaccagggcagaatgaaagcgtacagactggaggataaggctagtgctgtcttgagggaccaggacccaagctctccctcagctgtagactagtttggtgaagctggtgtcagcgaatgacatggatgtaatcgcatagaccagccactgcctgggccagcaactacaggtcccaagacaggcctgaggacctcagctcccga

SEQ ID NO: 1176 - DNA, 530 bp, Rattus norvegicus
  Genbank Accession No. AI180414
aaactctgatgtccccttttctttacagaatatttacaaacagggacaggtatcagccaccaaatgggcctgaaagcgggggcagtgcttagatgcgcctcagcgcagggaagacgtcctgaggaaggtcactagtatgacccagctgctctgaggggccaggcagtcccaagcaggtccaggctggaactcaggcaaggtcagtagtgggtgaacccagctgcttagaggccaggagcaggcgggtggcggcactctctgactccgccagcagcctctggttgttgtgtctgaggctccgaacctgttcctccagggctgtcctgtccgccttctccctctgcaggtcctactggagcttcctcaggatggactctaggtgagagaccttttctgacaggctcccaggttctggctcagaattacactttgaagtttccttggggtctccactctctaagatgggctgtccctaccgggacagtgactccagaattgtgttgcaagtggaggcgatctctgagatggac

SEQ ID NO: 1177 - DNA, 339 bp, Rattus norvegicus
  Genbank Accession No. AI227647
gatccacaagactttaaaattttattagtaaaatacaaaatggcacagacattggtaatgatgcttgaaaaaccaactccttccaaagtcctcctcagattgttttggcccacgaggcgcgggaaccaacaaagtccaaccatgggtgtcccaacccttgaaggcctctcttcctgcaggtccccagctcagcctccatttgggggcccatggggtaggatctgcactctcaagtcatcccttgccagccctcagaatcacagcatacaaaagtgtcagtccagtggaatggcagtgactattcatgttgataagggctggggggggggggtggcctcc

SEQ ID NO: 1178 - DNA, 619 bp, Rattus norvegicus
  Genbank Accession No. AI227667
ccatttaatttaacatttattttcatttataacgagatgtcacattttctacattaaaatataatcatgctgaccgcccccccatcccctcagagaaaaacaactggaaggtggaatgctcggagtggggaagttatggctgcacctgagaacacacagcacagagacccaaacagcagacacggcagaggcacacagaatacagctaagagctcaagccaggaaggggcaggaatgaaagaaacattgctacacgtgccacaagatcacccagaaaagggagagctgagtcagaaagcttgaggactgagcagagtttaaagcatccacaaacctaaggcaagtcatctccatgccccacctcaggatctggagggcaatgcagagacctaagccaccataaacacaagatgagggtgggatgtaggttttcttaactgtgccccagcattttccaagtctcagttctcctatgactgcagcccagtgggggtcatcagcacaaggcacgccacccctgcaggagaatgccgctgcacagtggtgcctgactctttaggcctcaaagagaaagatggccacacaggaatcccaactcgcagcactggcagaacagaac

SEQ ID NO: 1179 - DNA, 480 bp, Rattus norvegicus
  Genbank Accession No. AI227761
gcggtaacagctttaatctgtggtggctgacacatgggacaggatcctgttggcctcccatccttccatgccccagaggaagagctacttctcagggagctgaagcagatgccatgagcaagttggtaattggtgtgtttcccagtgtctcctggagacctgtgtttaaagtgagcactgcagggcggacagcagagacaggctgcaagtccttacacacagggcttggagctgggcacagaaaggcagggctccagtattgatatattatacatatatatatatatatatttcatatgtatacacagatagttttctctctggaaagtattaaaaaaattgatcaaccttcaatctataaaaaatacctactctacatgatagaaaaatctctcctccaagtttacactgatttacacacaaggctttccccaaaatgtacaatacgaggcaacgtcttaaaccgtagtgtagaaggga

SEQ ID NO: 1180 - DNA, 568 bp, Rattus norvegicus
  Genbank Accession No. AI227867
gggttaaattgccatgctgataggaatgtttagaattcaatgcaacaattaaacaatgtttacgtagaaatcgttaagtggaaacaccaaaagtttacagaaaagataccccacaaaatacaagcttgtaaaacagtggccattttatgagcccagagaaaaccttagatttcaaggtatgaggcaaaagtcgtaatgattgtcaggttcaggggttcggaaacgcgtgtaaggcctcatctgttgctccttagactttctcttggcttccatcacctgccctacgaatctcccaacctcctctcccccttcactgtgatcaacatgcctattaggtatggcccatagaaagttaggcacaagtcgcctgactttcctcctgacattgcccccaggcttcttgttttcaacctcttccagatggtgggattcttcttcactttgtttggaggccttcccaccttttttgtttttcttgtctttctccacagtgagatccagtatgacttgtttgactttggacgccattactcctgggcctatccttgccttctcctcttcctagcga

SEQ ID NO: 1181 - DNA, 508 bp, Rattus norvegicus
  Genbank Accession No. AI227885
tcactaacaaggcatcctttatttttatttgagttggccaaatgaaatgttctacacaaggcaaacatttccccatgaaatatttaaatcaatgataaataaatgagtcccagtctacatgtaaaataaatctccaggtgccacacacacatttaagacatcgattttaagttaaataaattcaatcgttggagactctgtgacctgtttggttcctaactttgttgtggatcccaacttaatatcatatgtgacattggatggttcactgggacacagcacttgatgctcaagtgtccagactttgtttggacatgaggggtcaggtgctgagggtctaaagcaacggtggaagagcagcaaacagcaagaacctggaagttcatctttgacctactgccattttccagttctcccaaagcatcgggaacaggagagcagagtccacagagcatcagaagcgagcctgagacccgaacagtttaaactccttcttgtgctaagacct

SEQ ID NO: 1182 - DNA, 539 bp, Rattus norvegicus
  Genbank Accession No. AI227987
agggatggaacttgtgtggtcggtcaggcttgttcgtcatcaagcacctttacctgatgagccatctcctaagccttggttggcacttagtttataatttcaatgtggactcattttttgtttatgtcccatcagtttataaatcttttccaagacgacaatctaagatcttaaaagtggtttggctctgcaggtttcagcatttattgtgtatatgggtgggcatgtatataccatgacataagtacagaggtcagtacacaaaccatctggggtaaattccttttatcatgtgggctcgtgggattgaatatgggtgatcaagtttgatggcagtcactctacaccaagttatcttgttccccctttttatagtatggggctggagttctaaaacccaagccctctgtatattatactaaatttccagcccccctttctttgtcttctgagatagggtttctctatgtagcttggttggtttcaaactaaaaatctgcctttgcctctggagtgcaaggattgaaggtgtgtgccac

SEQ ID NO: 1183 - DNA, 429 bp, Rattus norvegicus
  Genbank Accession No. AI228068
aatgctctgaaaacactttattacacaaattacattcagattctgaaaaatagtgttctaacagtgtaaccatctaaaaataagacatcccggaaacacaccaactgaggagaaatttaaaaaaagaatttaaatagagactttttaaaatttctctcattgcaatataatgttagtgattttaaaaaaatagaaggagatttagcagcttttcgtcgtgtggcaggttggttctcttcactgccacaggctgagaatgctgaacaggaaaggcaccaaagaaagacactggcgatgggtgtggactgggagaatactgtgttcaagcagagaatagggctatttacatccaccaactaaaacgtctccaaatgtgaatgagctaaacttccctcgggggttggagcgctaccttggaagaggagggcg

SEQ ID NO: 1184 - DNA, 115 bp, Rattus norvegicus
  Genbank Accession No. AI228128
gggggaatctggactttaattatttccataaatagggatataaaaatgaggagttctaaggcttggccattatttccacgtaaaaaattgcaaattagttggcctgtaatatggc

SEQ ID NO: 1185 - DNA, 482 bp, Rattus norvegicus
  Genbank Accession No. AI228197
gatgtcatataatccatttattccaacctcagtgaaaatgcagctggagcaccctccatgggaggggccacgtgatcccgagaactcaggacaagggggccagcgaactactcaggatctcagcagaagcctgaagaatccgcagctcttccatccgcaaagcttccaccaaacagagctgacttatcagcgatcctttcctttccttcatgtcagaaaccttgcgcagctcggagtgaatctccgcaatgaaatcagagcatattttctgggccacgcccaagcttgccttctcattcctatcggagattacgtcaccaatgagcacctttttccaggacgtaaaccggtcggctttcagacacaacaacttgagagctgtgagcattctccaagatggtccatcccatccaaacgtcaaatttcctgtgaagccatgatcctccaagatggacagcttcttgtgcacctgcttatcggct

SEQ ID NO: 1186 - DNA, 588 bp, Rattus norvegicus
  Genbank Accession No. AI228236
caattactttaataaggtgttctgaggaaccaggaaattaacagagaggggcgaataagtaatgcttcttaagccctgctcagtatttcgtcagtcatcttctggtaactggatcttgctgggatcaaaatagttggattccatgatggggaggccgttgagttctcggtatttcacaagtctctcagcttcccggcgggcccactcttgcatcctgtaatcaggcaggtaagccacaaaggtggtaccaaaaaccaggacgatggaaaaaccaaagaagaagacagctcgcatattccagacgtccaccacagggtcactgtcataaccgtgaaagtctgggttcttcgcgtagaggttttcgtcctcgggttctgggtcctcctgccataccatggtcggttctctttgccgctttctctccacaccggacggggcgattacagccctggaagattcccagcgaacacgggcagccgggacctctcgtatcgccgccgctactgacaggcggcgagcatacaagcttaacagccgggccgccatgaccgcttgtactgaggagtccagggggtgggggcggggtgg

SEQ ID NO: 1187 - DNA, 505 bp, Rattus norvegicus
  Genbank Accession No. AI228299
cctttcaccaacctcacagagggcttctatttgtttatttaaaaacaaattttaaaaagtaaaatgaaaccaggtgagattaagatacattaaccaaactgcaacgtagaaaaagggacttgctggaaacatgacggagaccactggagatttcacagacacacagaagagctcacattgtcaacagaattaagctgctacgaattctccccagaacatcaaggtttcattttgctcagcctgagatctcgctcaatttcaaactgcctgtggtccacgcgctccagaaaagctttccgttcgatgtacccctctttccctcggttatggatggccagctcttcaccaatcccttcttcctccttgaagctctcccagtccaatttggatttctcaagggtgctcattttctgtttcttggctccaattttccctaaaaggctgctcatcccacttgttctttttatccctgacccagcagggggtggtcttgtcacttcagccg

SEQ ID NO: 1188 - DNA, 462 bp, Rattus norvegicus
  Genbank Accession No. AI228301
ccagatggacccgttttatttccaaacaagactgcaagcataaataaacttccccagtaccatactgggttttcattctataaaatgtatttaattcctaaaactcttcataaaatctgcctttccccttgcagcggaaaattggcaaaagtcaaaggttgaaaggtcatgcacaaaacattccattcggcatcattctgtaagtctgtgagtctgtgagtccttgcaaatggacaccaagaggattcctgcttcactgtactctgcagtacctcaagattttccttcagtattccacagtgtgacctttccataacacagggaagcgaggccaagctgtcgtagactgaaaagatctgctgttagcctgctgtggagcgtaacatatctctaagaataaagccctaaagagaaaggaaactcaagtttgccatcaaatgcagtgggtggctcctttgcccc

SEQ ID NO: 1189 - DNA, 475 bp, Rattus norvegicus
  Genbank Accession No. AI228313
gtcaaataatttgtcatgttttaatgggatgattaaaataaaggctcaaataagttttcaatatattaatttctttaaagtcatcttcaagcaaggtgctgtttaagaaaaaaacttagctttgtccacagatattaaatctcaaaagctacccaaagtaattttgacattggatgcagctttaaacaaaaaaaagaaagaaagaaagaaaacacctaggtcttctcaaagcaaattatacaattagagcccccaaatttgtaaactaaacattctgacacaaatgcaaacttaagttggcaacattaaagaaaggtcacaagtgcatgtgtagatgtagtgcttgccactgagtagagaaagtgacgtccatttggccatcagagaaggggactgcctagaaacctcccaaaccagttagggttaacaagaccctcccatcatcctacagcacacaggaaaaccagaaaagaac

SEQ ID NO: 1190 - DNA, 512 bp, Rattus norvegicus
  Genbank Accession No. AI228326
ggaggagaagtcagcttttatttacagaagatttgtcaaatgtcctttccagtttcctacgaggcccaactctgcgactcaggatcaaggacggggagtgactctgcctgcttcttatagcgaatgtgtttctaaggtgacttctgtgcagccaaagcttggagatgcacagacgtcctgcactctctgcccgtttgtacgttcatgatgaagtcagttgccgacatgttgggttttgcagtgatcttcaagagtgatgattccactttatgatgcagaaataaatcaaaacaaatgtggatctacaaagaagagacatcttcagtgtgcccgtccactgcctcagaggcagcagcccagagggcaaagtgcattgacgaggaggaaaaagatcctgtcacgtctcatagtgacgtggtgatgtctcgctgtctcgcagctttacccggtcacatttttattattagttgtgaaggtgacagttactttctgcttctgtccccttcaatcca

SEQ ID NO: 1191 - DNA, 432 bp, Rattus norvegicus
  Genbank Accession No. AI228335
atcagttctgctgtttatagatttcacgggaaggccgaatacattttaagggaatgaggaaaccgttcagtgtctagtaacatgaaacagtatcacattattccataggaaacgtgtatatttatgtagaacaggtcagtcctgagaaacggcgtcagctcagttcgtgtcccatccatcctcctctgagatcgctcttgctgcgtccataccagacatcccaggttggttagcagggcatacatctgaagctctcaccagacctccgcacctcatctacggctacatacagcagcctaaagaagcacggctttcaggtgtggtgtaaagactctgaggtaatagggaacgagttaatttgttcttggctgtagttggctcccaaagagtgcctgtgtttttcaaatgatgtcaactagaaaaagacaatgt

SEQ ID NO: 1192 - DNA, 449 bp, Rattus norvegicus
  Genbank Accession No. AI228356
tattcacaacttctcagaatttaaaacaatgtttccaaatcacctaagtagataaacaaatcaaaggagcaagaaacaaaactgatgacacaaataataatgtggatggatcacagatccattacgctaagtgagagaagacagagtcgaaaggtgacatgctataggtctccattcatgtagaacttatatgacattccggaaaagtcagaccagagatttccagacaatagagtgggtgtgaagaaaagtaggggatgatggaaatatctcaattggactgtggtgtgctgagatgacaacatgcatttaataaagctcacagcactggaaactgaaaagagctaatttcatggtatgcaaattatatctaatttaaaagagaaaaataagacactaggtaaaactgcatgtgtctttaggaatggtacatgcgctttccttcccct

SEQ ID NO: 1193 - DNA, 180 bp, Rattus norvegicus
  Genbank Accession No. AI228494
aataaggggggcaaatttgtttattaaaatcagttggcaaatcccaatttttccaagggaacttaaggcaacattgtttttaaaaaaggggcccaattttaacccaaccaaaccccagtttttttcaaaatcccttttgtaaaaaacaggactcacttcgatctgcatttaaattcggcc

SEQ ID NO: 1194 - DNA, 620 bp, Rattus norvegicus
  Genbank Accession No. AI228587
ttttgtgttaatttaatcatacaaatattcatttacatggtaaggaaaacctcatcttcatctcctaggcaccacaagcccccaccagacagccatcagtgtccaggagggagggacagcaggctgccccacattcacccaaggaaacaaggggtaagagggcaggtggagagagcacactggtctgcacctgtgagcctgatgattctgtcctttcctgctgggagctgggctaaatccgggtctttacactcatgctcacttcccaccttggccaccagctatctcggtgtaagcgcctggcttatggctacagccagtccacacggggggataggaggctgctttgtagacaaatattccaaattcagttgtctccatgtcaaaaagacataggcatgcacacgtgcgtgcacagacacacacgtacacacacagattcttcccaagactgcacccactgatggccccccaatcctcctgaaacttggcatgtgctgtcagatgggggtcctgccaaaagaaggccaagtgctcatgtgtgacagctctaagggctgcagaatggtcaaggcttgcaccagctcttgcctttctgaaggagctacctcttccaggat

SEQ ID NO: 1195 - DNA, 611 bp, Rattus norvegicus
  Genbank Accession No. AI228596
caaaaataaacaatttaactttattaagtcatgacttcagcccttacatggatttgttttttaaaaaaatatcagttcagactattattgaaagtgactatgcacaataaataggaatggcctgcgtgtgctgcagacatgggacacaaaaggttggatgcaatcagcaaagagtgcaaagcacctgggaggaagtttcaaatgtctagaaaagtagctcagagctctggaccactcaccaaataaaacaaaaagcaaaaacaaacaaaacaaaaaccccactcagtacatctggcaaacaacttcccaacaacactgaactatctcctgcgacccataagaacaatttaaaatacccaaagtgctaagacctcattagcagtactttaaatctgagttttaatgttaaatatgattactcgaataccctaaactgtatgacatgcctaataacaataagttacaaatattcaacctaataacttagacatgatatggttaatataacagacattgtatctcagctaacctttcatgtaaggtgagaattaaaagacttgttcatctgtgcactcaaatgaggaatgtggtatcctagcaacagtgatgac

SEQ ID NO: 1196 - DNA, 552 bp, Rattus norvegicus
  Genbank Accession No. AI228672
ccaggttttctccttttttaatcaatgatcatctttgtccagctttggaaatctggacaaagagaaggctaagaggaggcctggtccagtgtctaaaggtctctgagtgagtctgtcagcacatggaccccgaacgggcctgtccatcagctgggcacagcagttttcctgagtatgagccagtcccaccctcagggcagcatcctggtccagagaggaataaaggccccaggttgggcctattcccaaggccctcgggacagtcaataaataggttctgagccaggcctgggaggacggggtgtaaagagtggatcagctacccagggatcccaaagagggcctgggaaccctcctgctcttcttcaacaaggaagtaaataaatagaccttaaactcaggaataggggtgttggagcaggggatccttccccttagagttagtaattaaatcccatgttaaaaacaaaccagccctaacccctaccggcatctacaaaaatcctacaggatagggcaatgggcttgcctgtctgggggtacacagttccc

SEQ ID NO: 1197 - DNA, 453 bp, Rattus norvegicus
  Genbank Accession No. AI228682
gctactaaatgaaaagcagttttggttttattcatgtcactgtaaaaactaaatattcacaccaagcatggattttttttcttttttgccagcaaaaattaaagcatcaacaaaacctctttcaaatactaacaaatttacttacaaacacctatatttattatttcataaataagcgaaacaagtttcattaaaaaaaaaagagaagaaaacgattaaatacagacacggatgagggaacagtaacacagagccacaggtaacggtgatcacttagcgctgtttgacctgtttctgcagctaagataccaggcgagcatttggcagttttatacataaaaggacttagatgacgcttactaaccattacacaaaagtgatacaaaaaagaatttttttcctgcaatacaaaataaatgtgtttgcgcttccctccacacgaaagcttccttt

SEQ ID NO: 1198 - DNA, 487 bp, Rattus norvegicus
  Genbank Accession No. AI228728
aaaaattctttgatacccacaacacaaccgactaatatctgcaataggatgtttggtgctcaggtggaagacacaaattaggtcccaccttatttttgaggcaagggttaaagctagtttgcaataaccataccagcagaaagcaaacatctgcgaattcaaatcaagcattttgcaggacaacagtggatctgcctctcctttccactcccacagtgcctcctgaggcagccatcctccaccccaccctgtgcacctttcccagaatacaggtccccaggctggaaagataccagccccattaatcaccgctactgtactccagtcttaagagaaagtcagccaggactcaacagccatgcttgctgggcagattccgtttgctgcctccagcctctcattcccgccttaattgtagggctctgtattataaccacataattcatgcctccctaattaaagctgtcaacagcctcattgtaaagct

SEQ ID NO: 1199 - DNA, 372 bp, Rattus norvegicus
  Genbank Accession No. AI228848
aacaagtgttttatcagacaggcagtcttagatttatatacaaaagtaaaactgaaaatatagttttgttctctgtacatttcttttaattttttttccctaaaaaaaaggaaaaaaaaaacacgctgtatacttttctaaacaggataaggtaaaacagagcatagagttctcttctgccaagtcatttaatctgggatggggtgggagcagcagggtgagggcgtcagtccaacgagataatgtctggtatgatgccaaagatggatgccgtgtctgcgctgctcctgctggccacaccatggccatggctctccctcagactgttggaagacacaaggctgctgttgctgccactactgcttccattgg

SEQ ID NO: 1200 - DNA, 517 bp, Rattus norvegicus
  Genbank Accession No. AI229036
ccacttggcagatttttttatttttgggtaaaacaaaacaaacgtacctctcgggttggaaaggacccgtgaacaacatggcaaacacgtgtaagcaataaatatgcatgtacattcaagtatgcgggcggccaccgtgtcccgcccgagaccctgtgctctggtttccgcttctgccctcagagtgatggtgtctctctctctcaaaagttgggtccccagttgcccttgccctggctccctcctaggctacagggtaagaggctctgggttagaaggttgtacagagccctccaggagggctgcctatagtgcctgcaggcaagaaataggaccacggtccccaagggtctatctcatggatgtagttctcagttctgcctgagtctctccaccccagctatagtgccctatgtccaactcagatattgcagctggacccctccttggggagaaagccaagataccatctccctagtaatccaaggtagatgttcaccaaaaggcctggaggatc

SEQ ID NO: 1201 - DNA, 466 bp, Rattus norvegicus
  Genbank Accession No. AI229154
ggttttggttttggatttattaaacaaggtctcactctgtagcccaggatactgtggaacttactatacagttgagggtagccccaaaattcccaggggtctccctgctttacttttgagaggacattttgcaccaagctggctgtgtcctgtcccctgagtgaggatagagctgatggaagacttgtacccagagatagcacactggtccctgggaacctggatcagtgttccagtgccctcctcttctgtagtttctcttccagctcagcggtgatatccccaagtcttgtcacaagggaggaagcctggggtgagcttccacctagtttcctggtccagatgttggtaatggccttgagatctggcttaggcacaactggtggctttgggggttttgctgggagccttgctggcttcttgggcttcaaggggactgcctgactggagagagatacatcccgat

SEQ ID NO: 1202 - DNA, 469 bp, Rattus norvegicus
  Genbank Accession No. AI229196
gtggtaggaatttgtatttttcgcctttgttgagaatacatgagattggtaaatctgtcacatgcctttggtggaaggacaactcttactactatacataaactgtgagactgggttaggaaagacacggtggtaatgacagacacaatggaaaccccacatcacctcatggcaaacaaagaggatgtgggaagcttggcttcaactgactgcagatcccaaggtaagttgcatatttgctcatgcacatgggtgggagggacagaagactgcagagacacagaagggggtccagggtgaagtgagaaagaaagtagaaggactaacagccccagaagaacaaagccaactacacctggtaagccttggagggacagaaacccaggaaataatcccccgctggggctgggtgggccaacagggtaaattggctccaggcttggagcacaccaaggacagtgtgggttct

SEQ ID NO: 1203 - DNA, 505 bp, Rattus norvegicus
  Genbank Accession No. AI229304
agatatatttgaactgtaagctctttgagctgtacacgtgcacaaatgattcagttggtggaaaccttccccttcccctacatttaaaacgttgcaaacttaaaaagagcgctaaagaggtttgcataatgagcatcatggaaggaagtgttgaggcgactttctcggtgctgggaggtcccatggcttccctattctttctggggaaagctccccttctcccctctccgtgctcaacctagtgcgagaatcccttgctctgcagcaggttaacatcgacatatggcaatacagtttactaagactaatcacctgggccatctgtaacactgagttcttaatgcctacccaaggtagtcacatcaacttttactaaactggaaatctctgctatcattgtttggaagcacaaattatttccaaggctttaatctcatttagactgttcatttttctctctttctcagaacctgcatcctgaaagttaacgcggattagaaagtca

SEQ ID NO: 1204 - DNA, 524 bp, Rattus norvegicus
  Genbank Accession No. AI229320
tttttttttttttttttttttgttgtcaaattttttttttgccaaaaataaaaagcaaatctactttcagaaagaaatcttaaagatgacttcatgcaacaaaaatacacaaaaagaaaagctgtctgaaatgctttgtaaatatccaataacaaaacaggtgttgagctctgtagaattaaaaaaaaaatcagaaaccaactctttggagtacacttaatagcaatcagagtttatacaggggatgctaccgcttgattatattggtaacactttaatctggggtcctccatccaagtcttgctcatagtactgagttactgctgaaggacgggaacgcccagaggaatcgagaaagcacgtacttttcttaggagagctggtcaatcaaataacactcttgtgaagacctcaggttgtgaatgttgtgtgaaggccacagctgcatcaggacgtggggaaagacacctttcctgtccattgttcctatttcccactgtccgtcccctcctcatgaggggcct

SEQ ID NO: 1205 - DNA, 449 bp, Rattus norvegicus
  Genbank Accession No. AI229404
gacaattcacaattatttatttatgtaggagtcataaaatacttttataatatacataagaaaacccacatttaaatgagtaagaaatataatggcaagtgatagaatttagtgtttataaatgaaaccatcaataactgacagtcagaggagaaacacagactatttaaaaactgcagccatgcattgtaatatttttaaattgcaagaaggcattgggctttaaagggaatgcatagctttatatatttttcagtgatctcaaaacagatttgtaaagtgtcttagattaacatgaaaggaaaacgagacaagaactctgggaagcaaaggagtagtcacagcagcttggtagaaattcttatgtatgtgttcttcaatttacatttgctcttggtataagagaaaaggctgaacatgttaatgaggatcctaaacttcatgaaaaa

SEQ ID NO: 1206 - DNA, 542 bp, Rattus norvegicus
  Genbank Accession No. AI229421
  misc_feature (1)..(542): n = a or c or g or t
gaaaaaacgttaaaaatgtgtttattaatatctgaatataaaacccagcagcactgttgtggctgacaagatctaaggtttcccagccagtgagaaaggccaggatctaggatcatctaggaaggagactgggtgccaggcacttgttaggtcaccaatcaaccactcagcacctggatgttaccctgcgcaggatagggcagagctggctaagtctgggctccgccaaggaaaaccctctctgctccactcaggctacagccaggaccagaccccttgaaggcgtggctcagcagctcttcaccacccaggtctgatccagagtacaggaaaaggtcctgggtcacagggagccaagcactccctttcacaaaagggtagccagtgctagccgcagagacaggctttcctacctgagatctggtgagtaggaagagatgggagcgtttgtcacagggaagttctccagttgagatgagaagttaccttttagatcagggggtaatgacaggatgcttggtgccagngaccctagtgtctct

SEQ ID NO: 1207 - DNA, 444 bp, Rattus norvegicus
  Genbank Accession No. AI229497
gatggccaggcctgtcattttatttcagcagtggatgaaacaagagttctttgtctggtgtcttagacggcagcagtctccttggcagcctttctctcttccagcatcctctgcttctgctttgccaggcacttcctggcagaatagtaggctcccaggtcctggtagcggtcctggtaggctttagacacttgggtgaattgctccaattccttggcacagttctgcagtgcactctctccttccctctgctgacaagccttaagtctctcctggatgatgttgatgatttcttggtccactttgaagtcccttctccactgcatctcagcctcatagatacagatgacatcaccctctttgcattccgtgatgtctggcactcgacggtactgtcggtggtagtagtaggttcggttcttggcgtgctgttgttcaatgaac

SEQ ID NO: 1208 - DNA, 572 bp, Rattus norvegicus
  Genbank Accession No. AI229508
ccttctagcggccgcaaaggtttttttttttttttttttaagttgtattcaaatttattaaaaaataaactataggaaactgtacaagaagcgaatgaaggcactggctaggcaggaagaaagtcagcacaaggagcatgggccctccctcggtaggcaggctcttgtgctcctccatcacaggctccaagaacgttctggaaaagtgtgcaaacacttctaagttgctctttaatctaaaaggggaagaaacagtccagaaacacaactcatggcaaagcagcaatggttttggtaaattctgtcacctgaacacaacctcagctttttaaggagcctgggacagaggggctggtcaagaagagtgctctagagaggggcaggagaataagtacagtcatttcatccttggcccaggggctcatgggtaaaggtctgcattgagcatcaccccacccccacaggacacagagcccctggtggaagtgggctgtgtctgcagagtgtgactgagcctcgtccagacagagtcctgtgctgacctcagaactgctgtaggatcagcttgcgtt

SEQ ID NO: 1209 - DNA, 495 bp, Rattus norvegicus
  Genbank Accession No. AI229638
gcctgaattacggggtttaagagagaagcgttgggttgggggctcacaaccattataagaagggaactaagaaaggtttcaacaagcagataagccaaggtgcaatgtccagtaggaatggcaggccccgcccctttccctgctctctgggagtccaacctggggaaggagctggcaggccccgggtcccctcagttggcagagttacactgtaggatttgctgaggggcaaagagcttcctgacagccgggatctctataggctgccccagcactgagtagttctctttgttgtctgcagtctgggctgaagacttcttaaagtagcacaggcggcaaacagagtggtacttgtccgctccgccaatcacctccacctctttctccaggcccagcctcttggtgtaggaagcttctcgaaagcactccatgcacacagcggtgagcttcaccacactctcggccaagggcaccaggttcaagatgctgccgaaa

SEQ ID NO: 1210 - DNA, 647 bp, Rattus norvegicus
  Genbank Accession No. AI229647
gctccaactaaatcatttagttttccttgaagaaatgactgaaaaacacaactctagaaaaacaaggctgagacagcattcttcgtgttgcgtaacaaaaccgaccctttaggagacacggtcataatgcccatggcgggtctagctatggagatgtgaaatccatgcatacaagtttcataactgaaagagaggaaaaaaagccaaaggaaaaactccaaataaacgctgcgtatacatgatgtcccttttgcattgcacgtcagaaggggggaccagcagcagcccagcccccctcagtaaaccaagggcaaaaccctgcagacgaccgacctcggcaccagacatcagggcttagcagtctccagttgcaggccgcagtccttgaggtcgtttgtacctgcacaagcctccccctcccctcggctcacagctgccctgctaggactggaggggagggcttttgtatgatcttctcaggtaaataaacacaattggaggatgggtgggggcctcttgtctactgggaaatcatttttcaagctggggcataagaaaccttatacaatttgcataaacagttaagagtaaacgagattatttggaataaatgcaagtaacgtattttgacagtggcagattcagtc

SEQ ID NO: 1211 - DNA, 550 bp, Rattus norvegicus
  Genbank Accession No. AI229680
gaatgtccactggagtttatttacagacaaccttaggtaaggcattttcctctaggatctacatcttgcgaagttacttggcttcaggcttcttgtctccagcttcaagcttgagatgctcagggggctgacgataggcagggaaagcctcccaggggctgttcaggtcaaacttgcggaactcttgtgccaactccactggctcagccactacccgcttcacctcatcgtcataacgtagctcaacatagccagtgaggggaaagtctttccggaaaggatgtccctcgaagccataatctgtcaggatccttctcaagtcagggtggttgaagaagaaaactccaaacatgtcccagacctccctctcataccaattggccgcgatgtgcacagacactatggagtcaatggctgtcagctcatctgcataggtcttcacacgaatcctagagttaaaccgcagggacagcaagttgtagacaatctcaaaacggttctgccgagttgggacatccactgctgtcaagtcagccaaagatttgaactg

SEQ ID NO: 1212 - DNA, 393 bp, Rattus norvegicus
  Genbank Accession No. AI229698
tttaattaagttttcccacaaatctttattaataactctaatgacagatgaacccatattgccttgagggttagggccacccaccagtgccctgtatttggaaggcccaaaccattcaccacattgaacactaggttaaaataggtcttctaaacagtggacaacccacaatggttaatcaaaagataactgatgaactctcccatcagctccctgcaagctgcaggacctcttagctcttcatgatgtaatcttgtcagagatggctccagaaaatgggtcatgacctgcatccgcaccaccagtagtagtccatgggatggtacggtataaggggtggcagcagtcagggcatgggtgacagcgttttgacggagacgtatcgtggaaccg

SEQ ID NO: 1213 - DNA, 487 bp, Rattus norvegicus
  Genbank Accession No. AI229707
ttccttttttttccaattcccatttatttttggctctcggggcaatgtcatcttttcaatatgaaaaaaaaaaaaaaaagccaagtttaacacaaaatagaaaggtagggaatgaccaagccaaggaacaggagggaaatggggcagagatgttacctcccctctggggagtgtgtgaggcacccaggtggaaatggtaattagagtgtttctggacatttagagaacaaggccttgctgccctgcccccacaaatccccatgcaacgtcccttggagaaccaacacagggaagacacctccaatggcagatttggctcaggacagctaggatataaatggtgataatactgttaatacctctcctgaggccgatagatgaagcagggaaaaaagaaagccccatcgactgaaagcctcagcgattcccgtgtctaaatggccctgactggaaaatcccaccccctaagtagcatctcctttaccca

SEQ ID NO: 1214 - DNA, 581 bp, Rattus norvegicus
  Genbank Accession No. AI229708
agttgtcatcaacagcccagtaaggccgaatatttattagacccacttcacagatgagaaaacggaggcaagcaaaaccaaagtcagccctagcaagtcacacaagctggagatggcagagctagtgggaagcctaggtaaatttcagttatgtcctgttggcctctgaacctaaagatgtgtgacccaaggggcccaacaagccacagtaatccattctggtggcatcttcttcagctttaggaccggcgagcatgaggcactggaatatctccttcagcatacagtttgagggaaaaatccagggctggagcagcctgggtcagcattcccaacgagatgacatcaatatttgtcccacagaactgggggaggttgtccagtgtgacacccccactggcttccacagacacgttggggaatttggctttaagtgtagctgctgtggggtgcagctcctcaggcttgaagttgtccagcatgaccaggtcagccccagcctctgctgcctgcaaagcctccttcaggctgctacattccacctttaccttcaggggaaagccagctgcctgccgggcctt

SEQ ID NO: 1215 - DNA, 490 bp, Rattus norvegicus
  Genbank Accession No. AI229793
taagggaggggaggcatttgctctacgctgagattcgggttgcgagagcagatcctaacgcaacaagacgctgctgcagcacacttcttaagaggtcgagtttgacgcctgggatcgggtagggcgagaatctgccttggcggcttcggctacggctgcggccaccgacgggcactcgacgtctgtcggtccgaacgctgggtcgcgctggtggccgaggtcctggctgattcggatcaagtctagtaaccaggaagctgtctccggagaccatcgcccaagccatggccgacgggttgagatctccttgggaggatcggtgggccatcctgttggcttgatcgccggcggacagcgacaccgagttctgggccatcttcaaacaccgactgcagtgtttgctagacgtacgtcgatcaaactgagccctcggcagcaccgcagatcactccagccccgcgtcggacgcaaccgttaccgatcccagcct

SEQ ID NO: 1216 - DNA, 499 bp, Rattus norvegicus
  Genbank Accession No. AI229832
cccgggacttggactcactgtattggttcacgtgggcttgatcccaccagcacagtttttatgcacaagacctctgtatgtgaggacccagcaaccagtccccagctccagatttcgaattccaactccctaggagccaatgtgcaaaggcagggagggcttggagatcacgcttccagtctcacagctgaatggcactgaggaagtcctcattatctgagtcttggaggaagcagggtggggcaggagggctggggggtgagaggatctgggcccctagggccagctgggacacagtgagctctctgcccttatgcatgacgtaaaagtggaagtgaaaaccgctgctataggttgtatgcctcagtgaccagtcgtaacagggttgagcatagtgtctgatcctgaagtggggacccgcaggattcatggagatgaatcggcctccaggaaccagcacccggttcacctcactcagcacctggtccacagtgtggac

SEQ ID NO: 1217 - DNA, 450 bp, Rattus norvegicus
  Genbank Accession No. AI229979
  misc_feature (1)..(450): n = a or c or g or t
caggactcagtggaatgagatctcctggagccctcagcaaagctgaggagagcaaaggagatgacaggtgagtcctcaacaaaatacatatggttggcacataaatgggaggaaccctgggcctgctctggaggagatggatcaagaatcctaaggcactgtgcttctgtggatgccttgatgaagccaaagagctggcactgtcaagctctggtttccatggccactgccttcggtggagtttagttctctcccagcccctcctccttggggcagggaattttagtatctggtgcctttatcacaaggtcctggggtctggaggtagaaagtgagatgcaggagaagaaatggggcanggtgataagaactccacttcctgcaagtaggaaggccccagccaaccagatgccacacgccccacaaggtcagaaatagcagcctcgtgcc

SEQ ID NO: 1218 - DNA, 409 bp, Rattus norvegicus
  Genbank Accession No. AI229993
aagtccactgtaattgtcttcagatacacacgaggtacagacaagggcatcagatctctttacagatggttatgagccaccatgtggttgctgggaattgaactcaggacctctggaagagcagacagtgctcttaaccactgagccatctctccagcccatcaaattactttcttatgggctaattatcaggccgtcctaggaggcaactacctggcttatttccggtctgaagggggactgctgttcaacgccagttactcatttagccagcaaaggagcgtaattatcacacacagcattcaaagcccaactctgtttccacagactattttcctggggttacacgaccaattcaatgtcatactgttgaaccataagcagtacagatacggaaactgccttctgg

SEQ ID NO: 1219 - DNA, 478 bp, Rattus norvegicus
  Genbank Accession No. AI230002
ttaatacacatccatgaaaagacaaggaaattcaaaagtgagctagtacaggtcttccaaactgaggtacaaatgcctccgttcctccagcaattcccactggtattcccatgatgcaaccgtctgtggcaacagtctaccgtaggaaggggtggaggcagggcaggaacgcagagaaatgtgtccaattcagagcaattttcaactttgccctaactcaagtaccctcatgggactgtcttgcaacacatgttctattgagaaaagaggtttcaaaccaaagggtgggtgactgcaataaatatgacatgagatgaacaaggcttgggagtttccatttatttattctaacatttgcccttctcactagacactcaactccatgagggtagagaatgtccatactgttccactcgcccctggcacctagtagtgactcaataaatatatgttagaaggatggattatccatgattta

SEQ ID NO: 1220 - DNA, 513 bp, Rattus norvegicus
  Genbank Accession No. AI230042
  misc_feature (1)..(513): n = a or c or g or t
ataaagcaggggctctttattggcacgacaaaaatcagggcacagtgggttcctaggtaacaaattactgtataaaaccttccatcgtggctcttaacacatacaaaatgattgtctgcacggtgtaaggctgaggtgggggaggaggagcaagggggaggggtcgggcacagttcccacaagagtgcctatccccagtctggttccatagctgcccctgctaggctatgacagggagccaccagttcccactcagctgaactgagggaaggggaagctggcttagacaggatcccaggggcctcagcttacatccctgggtgacccaatctgttccctgctgggctagcaagtttgagggtcagcttggtgtgtgctcaaggtgacttctgtggggacaggttttctcaggctacaggacaagctcagtttggcctgacagcccaaactccctcaggcacctggctggtatgtgctgaacctgggggttttagtacctctatcanggcccaa

SEQ ID NO: 1221 - DNA, 418 bp, Rattus norvegicus
  Genbank Accession No. AI230074
tttttttactttttattatgcatttcataacatgtgcatagtatataatatgctgcacagccttctaacaggaacagatgaccatagctgagtaatttttttcatcagccaggaaaatgcttccttagtcaatgttctccaggcccttggacacatagtagcgattgacaccagagatgcgtctatcgcgttccatcaaataccattggtaatgaactcgagcaactctcttttccttgcccccgttggtgaacttgtggatgtacgcagtggacaccccggggatgaccaggcacacccccataatggcgaggccagggagaatctcgaaccacatcttctcaccgttactcacactccaacccgtcaccgttaccggctcctcagaggtgaccgggggcttcaccgccctcgtgcc

SEQ ID NO: 1222 - DNA, 400 bp, Rattus norvegicus
  Genbank Accession No. AI230113
aggcagtgtgctggagacatttagctttcttcaccttctgattcagattcttcttctgcattttgtaaccactccacaaatttcttcatctggtcaaggaagacgcttttgcctttggcggcatgtgcttctttataccacttcagtatcgcctcctcgctcagaacgtcggctttataaaagagaaccacgatcttctggaaggctttcatgaagtggatgttgtcatagcagtattcctgaaccttctgcaggaggacaagctctgactggccttgggaactgaacacggccagcaggggagcgtattgcttcaggtgcttaagagcctgctcagcaaccagctcctccttcttgttccattccacagcgttcatgacgcaggtccacagcagcccga

SEQ ID NO: 1223 - DNA, 480 bp, Rattus norvegicus
  Genbank Accession No. AI230121
tttttttttttttttttatttgggatctttttttatttttatacacatgacaagattttacaccaatagtcagttaaatagtacaaatttacattcaggaggaatgttaaaaaaaaaaattcaactaaaaaaaccacttcttcctgtgacccataatcccaacattttacagtgcaggggagagggaggcttgggggagcatccaaaacaagtctctcaaaagaaataactttaaaatgtcacattccctctccacacaggattcatagtgagagtataattacaattcatccttctctgtaggttccttttctgtttcctgttcttcttcttcttctgcccctgcgtctgtctcttcttcatcctgctcggagtcatctgtggtgtcttctgtggtgtcttcaggctcctcctctggctcttcttcttcctgtgacccataatcccaacattttacagtgcaggggagagggaggcttg

SEQ ID NO: 1224 - DNA, 436 bp, Rattus norvegicus
  Genbank Accession No. AI230173
gaaaggaaagtataatttatatgtacaaccaataacctgatacagaagaagggattgggacagaccaggagcgggagcaaagagactgggaaaggggcagcaaggaggatatgggggttccccatgcaaactgccactccctggcccctccttagagggggaatgtgcccgaatctccctagcctgttatccactgggttgctctggtcccaaggcaaggcaggctcctgactgggcccctggcctgacctactcaaatttagtctgtattcaggccttgaggagggaggatttagtcccccagaaacctgagccccagagtgggggtctgccccatatctggccctctgtattctctcccaccctttctaggtcacctagaacaggttggggagctcctctttggcttgagggagtatcacccaaccattactgt

SEQ ID NO: 1225 - DNA, 466 bp, Rattus norvegicus
  Genbank Accession No. AI230247
cccagctttttaagttgcatttatttttgataatctgtactgtagccaatcaattctattctccattcttgcttaattgtattagccataaaggagttcaggttcataggactcagtttctctattaaaccgtcattgattatggaaatactgtcttaagcactatgcagattaacaccatacttttcttccattacatctttcaagacagtcactcacaactcagaagactgatacagcattagatgaaaaaaacaagattcacagatatatgtagtgaaactcaaactaggagtcttagagataaaaaagataagtagatatttaaaatgtagtctgttaaagatttaatcggtttaaagtataagattagaaagacaaagtttctattgttttgaaagttttaagtaaagaaaaaaaaaactggaaaaaatgtctttgttgttctttctccgttcttaattac

SEQ ID NO: 1226 - DNA, 418 bp, Rattus norvegicus
  Genbank Accession No. AI230284
atgcaaaaatttatttgaccaaaatgtagaaaaagtgataccattacgtatgatacaatcgcaagaatctaaagaacagagtagattttatcagttgcacagtttgctaaaagttcatctccctggtagtgtgatgcttaataaataggagtgaagggagtgtgtacatggaacagtattaaagctcgatcggaaggcacatgggcagcagtgatcaccccagcattctcacctgggaagctgaagtaaataaatctgttctccacggcggagtgtggaacagactcagtaagatcgggccaatctacttgtgctttatgacttcccatagacgggttttaatttttgctctgggtggaaaatttctacatttttcttgcaacaacccctagccgctccaacatcagaaccttgtgcc

SEQ ID NO: 1227 - DNA, 563 bp, Rattus norvegicus
  Genbank Accession No. AI230362
ctactaaaataatttaattagaaacaggaatttgtatcagggaggctagaaggatgatactcccaagaaaccaagtgaagcctttaaggcctctccgcctgccgccagggggcgcccgcggatggcccacgtggcagcggtcgtagaggggcggagccgctcagtccgagctctccgagtcagggccactatccggtgtgggtgggagcaggggccgtcttcgagaccgcttgatccggcgcgagggcaagggcagcctccgtttcaggatagcagccacggtgtcctggctgtctgacgtgggcccccagtagatactctcgctcctgcggaagttccggtgcagtctcgtgcaaagcgtagccaaggtgagcaggaccagcaggaaggtcagggccatggcagcccaagcggcctcttcagtacgtggagtgggccctcgagctacccggggaggcactgctgctcgaggagctggggaaacctgacccggacaagcacaaacctccaaggttgccttgcccactgggcatctgagcctttggcctgaacctaccattgcc

SEQ ID NO: 1228 - DNA, 616 bp, Rattus norvegicus
  Genbank Accession No. AI230549
caaaaagtcctagtttgatacactttactaaacaaaattaaaggttaactgtacaagcaattaaaacatgatatgtagcaagtgttatcaggagttttctattggcaaactgtttaaaaatagtcacaaactgagcagttagaagtaccttcgaagtaagcactgctcccaagtgacaggaagcctctcccgaaagctcccctaagagtgccagctgcccagcaccctcaagtttgggactgaaagtcaatggcaattgagatgggaggtgcagacctctgtagggtcagtttccagtttgccaacaggagtatgagggacgccctcaaagtagaggaacgtggaactgtatagcctcgaaggagggcacattaggctcacatgagccccagtcagtctataaagaccttgtttggactagagatgcagtcagtgcttggctggcatggagtcttgttggagaacttcatgcatgcccacaggtttatgtcaaacaagaaaaagttaagggctgggttgtgaacacacagagaattccacgatggcattcacaacaaggtgcccaagtccccttgtcacaacactttctgtatgacttaaggaatgtctttatgta

SEQ ID NO: 1229 - DNA, 410 bp, Rattus norvegicus
  Genbank Accession No. AI230554
tttggggggttagttttttttttcttccacctttacgagagctctggggatcaagcttagatcattaggtttacatgacaagtgtctttacccactgagctagcccatgattacaaaaagtattttctatatactgaatcgataataattaggcatatcatatgctagtaataacaactaaagattattagtacagacatactcactgagaaatctaaatccaaaaactcacagccaagttttcaaacaaaatgtacctcaaactatgaccaatgtttagctagggcttgccaggctgggcccatacaaatgttttctgagaagcctaggctttgtgtggccagtagcaataccattgggagctgttagcatttggactataatccctacttataattctatacaccttt

SEQ ID NO: 1230 - DNA, 441 bp, Rattus norvegicus
  Genbank Accession No. AI230616
  misc_feature (1)..(441): n = a or c or g or t
gtggaaataataaaaatggattcttttatttggccttgaacttggggaaggggttaattagttagggcaggagttcagagtgaacggtgagtaagagcagaacctataaagactgcggttctggtgggggcttgctggagggctggctgaagctggtttggggctaaggtcttctgaggagatgctcactcgagcttgaaggaggagatctggagcccatccatgcttaagtagcgcaggtggttgtggcccagcctgttggggaaggtcagcgagtgtccatcangcagcgtcaccttgaagtctttgtcttggaaggtaagggtgagctgttaacatcattgtggatcttgcctttaatcttcanggacatccctgatttcatgttcaggtttgtgacctcgaatttctccgacatggtgacggctcctggacacagct

SEQ ID NO: 1231 - DNA, 502 bp, Rattus norvegicus
  Genbank Accession No. AI230647
cattccaatgtagggtattaggttctttgaatttatatattcaggatagaaaaaaaatcaataattttctgatacaaacataaaaatagagcacatttattaacagtaggaaaactacttacaataacaaaatctcacataataaacacagccaaaagagcacaagaaacttgttgatactctgatgcagtatcatcaaagaccgacccatacacaccttaacatataccacatgaagcattcatttcataggcgggagaaaaatgacttttgtccatcactgaaatagatttcctggttttcagctttgattatgtactacagatagagttcaaaaattatttaaaaaaaatgttaacaaaagctgagcatggtggcgtatctgtagtcccaacactagagaagcagacaggtagatctctctgaaatcgaggccagcctgcgctacagatcaagttcaaggccagccacgcctacaaaatgagacccagtctttacaaaa

SEQ ID NO: 1232 - DNA, 630 bp, Rattus norvegicus
  Genbank Accession No. AI230702
caaaagttgggtattgtttactttaagcaacagtccaggactaagaagtacagggatgcgactttcttcatggtcaagcaccagcgtcatgcacatggcagagttcttccagcgtcatgcacatggcagacttctttcattaggagtccctgtgggccctacagccccactcggggacggcctcccttgtggcttcaccttgcaattccaggcagcttgcttgtatacctgaagccatcctctgcactggtggctctgcccacggccggccagtcacagtggccattggcttcctctgctttgcaggcagtgggatgtgaggtatggccactttgatcattccatatggcacaggaccatgcactgtgcaaaggacaccgatgtatggtggggcaacagcaaggagagcagagcgctgccctggggacagctgggagcaggggctgcagggcagggcctgtggctgctgtctgccccacagtaagccaagtacagcgtcaaaatccctggtacacaagtctctacacatcaggaaccagatcatctgttcttaagaacaggctactactccggtctactactaaaacacactcatgccgcggcccacagacctaggagtcagacagaccc

SEQ ID NO: 1233 - DNA, 585 bp, Rattus norvegicus
  Genbank Accession No. AI230716
atgcaaaaatttatttgaccaaaatgtagaaaaagtgataccattacgtatgatacaatcgcaagaatctaaagaacagagtagattttatcaattgcacagtttgctaaaagttcatctccctggtagtgtgatgcttaataaataggagtgaggggcagggttcagataagctataagcaggtgactctccgtcagcactgtaaactcgaggtggccccacactgctggggaatgtggaatgtttcagggagatgttaactgaaaaagcaaaactacaatgccaaaaaatatgtgcagcctctagagcgctccacgtccagttcagtcaggagttctcggactgtattagtgtcattcccaaaggaattcaagtctcagcaaactcaagctcccatttcttgatccctgaacaatggatatgaagttaagccaattgctttctctatcactactttgcggctggagagaccctttgttgcctaacccttggcatcaatgttctgatggctggcaacctgcatattatttgagacagagtctcgctgtgtatcgctggtacctggctttgctagcagtcttgat

SEQ ID NO: 1234 - DNA, 729 bp, Rattus norvegicus
  Genbank Accession No. AI230724
agttagaaacattttatttaaatgtgtcaaataaaaacctacatttccagaccataagatgttaatacattcaacaaaaacaatatttactgctgtgaattttacagagtaataatccagatccattttgattagatggttgatgaaccttcctaggttacactttacagacataacaaatcccttataataatgtaaacaaaataacttttccctaacgggtgaacttgagaacttcagtccattctttctggacttgcacttctgtgtggacttcctgatggggaacgacttcttttaggagatggagatctggattttgatcggctgcttcttggtcgtgaaatagacctggatcttgatctcgaccttgagcgggatcttaataaaaaggaaaggggacacaattacaagaatgcctttataactaagcaccttcccagagagtagataggataggaaagagtagaaacaattactgcacaagtcttgcctctcacatggatccaatctaagaaccactatttcagatgcctacctccaccatacacagtatggtcactacgcctacaaagacacaacagtcccactttctaacactaatcaccacaatcaccaagtggttccatccaactgctgagctgactttattcttgttatcataagtgctccgtttgtcaaaccaaattaggctgaccatatcttttgaaaatcttgggaccctttaat

SEQ ID NO: 1235 - DNA, 628 bp, Rattus norvegicus
  Genbank Accession No. AI230746
gtaccaagccaaagttttatttgttttcaaacaggaaagttatgttaatataaaacagataaaaacagacaaatatcagaacacacaacacacaaagaccagcgcaaacccttcccaagctcactccccaagctctcaggcctttagtacagttccccaaagagtagacagtattggagagccacagtattgaaccagaaaggacagacatgtttcaaagggtctgtacacagctagtggggatgggtggggatgaatactttcagtccaaccgcaatccgtaagacggtctcaaggactccctgatgatgtctggagcccaaccggatatgctagcttcttgtccacattgaagggttgcactttaaaggataaaagtgcacacacacagacacagactcacacacacactcaattccataaggcacagacagattgtcatatgggtagttccattggggacttgggtgaaacagtgatacactaaaatattaaacactgggaggctgagtgttcctgagccgtgtacccagccagggcaagatggacagagcagttacccctccccgtgctccaaggctgcacgatgccgttcgcaactcttggggaccccccaaagcctggacgt

SEQ ID NO: 1236 - DNA, 468 bp, Rattus norvegicus
  Genbank Accession No. AI230773
gagcttcacacactggaaaacgactttattcctttagaggacagtacaatggtgccggacagccagagctcagtttcccccgcccaggcaggtgcaaactggcaactctgtactggtgccaagacctctgtgccttcacaggcacaggcactgacagtgctcagaaggatggcatttactgggaaatgggccgatcccacagtgttctcctggaccctctgactacctaccactgggaatcctgggtggcactaagagagccagacatcagctgacccaggcctccatcctacagacaggtagcctaaggcccagaggtaagatgactttgtcctgccacagctgttacacaatttccctgtggagacattgaggccagtggcctgtctgctcccattcaggccctacactggctccatcgtccacaagcttggtgccagggtctcaaccctgctctgccgttcagga

SEQ ID NO: 1237 - DNA, 555 bp, Rattus norvegicus
  Genbank Accession No. AI230798
  misc_feature (1)..(555): n = a or c or g or t
agaagtctgcacataacatttatgttcaggatggcagtagcactccaatacagattacgctagagaacttggaacttcagctgcggctgcgtgtctgggctcttccttatctggacacggatcttgacagtgaatctcttgatgacagataggcagctaacttgtcccggaattcatgaagatagttatattgcttgatggtctgtatcgccccagatcccctgacatctcgaaggctgtctatggcttgctgtggtgaaattgagtcagacaagtataggaggagacaagcagctacaagacaagatcttccaagtcctccataacagtgtatcagggtttttcggttgtttttaaggcaggtggccagctcctccatgatttcccagcagctgccaatgtcgggagtccctccatctgggatcggatgatgatgggtgacaattccatattgttggtagaggtccagaaagtttgggactctatattntgacagttcccctctggtgcagaaaacaaatacgtcttggatcccagagctctttagttcctctg

SEQ ID NO: 1238 - DNA, 510 bp, Rattus norvegicus
  Genbank Accession No. AI230822
agggagaacaggtccatcgaagttttattggaaaccttgatttcaagtaagattgcatgacactgtcggttaaaaatgtagtccagtcctaccagcaaactaactcactttccttgtttgctcaagcctccaggcaccggtcagataccgaagtcggataaaaagcaggtctttgcccattggtagccagctccaaaacggaactaacttagaaccctcaatttctgtccagttgacagcaacttctgctattgggatttgaagaaactgtgctatgtatagcagttctacatcaaatgcccatcgttcaatgtgcagagacgagaaggtgcgggccgctgcttctcgggtcagtagtttgaatccgcactgtgtgtccctgattcctttgacacagaggaaccacaccaggaaatggaatccgtacataagaagggtccggaagtaagaacgctgagcaatcgattctttctctagatgagctcgagacccacatgcaatagccatttg

SEQ ID NO: 1239 - DNA, 547 bp, Rattus norvegicus
  Genbank Accession No. AI231028
cagcatcaaacacatttatttcacttttattgagtatacaagaacagagagcacacgcatacagcacggagcactgaggtgggagagcgtggggacgagagaggagagaggggagtgggtgaaaaggaacagaacagcattgcagttggctggtaaggtgcttttggaaaaaaaatagatatctagagtggtttgctcatgcaatttcaggccagtcttcgtgtgtgcttgcaggattcagaaactgaaacaggtcctggcacttcctgtacccttgtgtggaaaagattcacaggaagcgaacgtgggggaaacaaaggtgcatgagacacagcgtgggaagaagcctcagggtgcaactagtttgccctgcttgctgaggtacacgggacggggtagcccagtgtcacgtggtgggtcaggagttgcatcaggacggtcatctggaaccctggctgctctctgaggcttttcccactcggttacctggacccccggatagcaaggtgccacagatacaatgagacactcaaaaaaggcaaaagaa

SEQ ID NO: 1240 - DNA, 461 bp, Rattus norvegicus
  Genbank Accession No. AI231127
cgtttctttggttttattattacaaatgcgccgtggctccatcacactcaggggaatctgaattctacatgttcgccacaccctttcctttctacctgggcagggccacgtagaagcattcaaaccacgtgtggtcacaagacataattgacagaaacagttcaactcatagcttatagtgatgccatttctccagcggtacaagagctttacaggatggtgccagggctttcctggacgatggactgcttggttcacatttgtaagctccgaggctggagctcccttttcccaaggccttggcaccgttgttgaattccatgctttggaaaggtcctttctggtagtcagcgccaagatacgaccgccagatctgtgtgttcagtggttgaacaaccgtgtttggagggatcgaaagctaaaactgacctctctccccttaacatcccaacccatccaag

SEQ ID NO: 1241 - DNA, 523 bp, Rattus norvegicus
  Genbank Accession No. AI231140
atggtggaaaaaaagtatatatttagaattaaccatctggactcactttagatgatcccaatcttgttggcaacatctagagcatcataatcaggagccaagcgaacatatgccttcttctctccgtcaggccgtatcagagtattgactttggccacatctatatcatagagtttttttcacggcctgtttgatctggtgcttgttggccttaacatccacaatgaacacaagcgtgttgttgtcctctattttcttcatagctgactcggtggtcagtgggaatttgatgatagcatagtggtcaagcttgtttctcctgggtgcactctttcgaggatattttggctgcctccggagccgcagggtcttgggccgtcgaaagcgaagaaggaagctcctgcccctcccaaagccgaagccaaagcgaaggccttgaaagctaagaaggcagtgctgaaaggtgtccacagtcacaaaaagaagaagatccgaacgtcacccactttccggccctcgtgcc

SEQ ID NO: 1242 - DNA, 638 bp, Rattus norvegicus
  Genbank Accession No. AI231219
gtcaagtgtttatttatacctacaaaagaaaacaagatggtatcaaaaggacaatttacaaactaagaatagtagtaacatagctctgagcatcctatgccctaacatcacgcctacaattcaagtctcaatgacaggaatgtgttgagagaccagcaagggcattagcagagcactgatcccaagcaaaagccaccaacctttttagatgagaagtctgcacaatggattgttagggagcagcagcccacagctttatacctaagcccttccccctaagtgagtaaaccacagaaggcaatcaacccagcttcagggtttgcctgcacctgtgctgacaacggactgacaaggaggcagaagtcacttgcgctaagtaggaaaactgctagttttctgctgtacccaggccaaaagagcttatgaaatatgaaatgtgctatttatctggattctgcctctgctggagaggggacagaagcaacctagctactgcttcatccccggaggcagtaatagaaggggtgggtattttgaagagctacagtagcacagaacagcccatggtataatgcttaataaaaaataaatctgaatttggttgtagaaagtatcttttacaggctggtcagtgtcag

SEQ ID NO: 1243 - DNA, 436 bp, Rattus norvegicus
  Genbank Accession No. AI231379
ggaaaggtggactagagttttattctgaaaatcacttattttacattatgtacaacagcaacaacaaaaaaatacacttagaattatcctggacttttctcacttgattcttttatgtacgtaagtacattgtagctgtcttcagacacaccagaagagggcattggatttcattacagatggttgtgagccacccaccatgtggctgctgggatttgaactcaggacctctggaagagcagtcagtgctcttaaccactaagccatctctccagccctccacttgatttccaatgcacaattacagagtaatctttatgccacacaaaatttcctaaagctgtcagatggtggtggtgcacataaacaggaagatctctgagttcaaggccagcctggtctgagtgtttccggactgccatagctacacagagaa

SEQ ID NO: 1244 - DNA, 454 bp, Rattus norvegicus
  Genbank Accession No. AI231391
  misc_feature (1)..(454): n = a or c or g or t
ttggtttctgttttccatgtctaggtgcatccaacacgatacaaaaatagatagaacgacaggacgaagacccacgacattatgtacagagctctaaaatgagctgtgaatatctacgaggatctatctagcgcatgctggtttggaagggggtagtgtgtagctttctagagagttcacagtcctccgaagagcagttaactccctggagctgcaggtgcggtatttagccttagatggagtttaccacccgctttgggctgcattcccaagcaacccgactccgggaagacccgggcccggcgcgccgggggccgctaccggcctcacaccgtccacgggctgggcctcgatcagaaggacttgggccccccacgagcggcgccggggagtgggtcttccgtacgccacatttcccgcgccgcggcgcgcggcggggattcngcgctgggct

SEQ ID NO: 1245 - DNA, 549 bp, Rattus norvegicus
  Genbank Accession No. AI231433
aaagaataaatatttttgtaattaaacattatgcaaacacgtgccacgcttgctttatccatgcatatgcgctatatacaattttgaaaaatactgtgttgtcctcttgttttaaaagtcatatacaaagtttttgtgttttttgtttaatcctcttgctgcctacccccttctccctcccaagaatttcctttacaagtagctaataatcattattcactcatgaccttagggtatgagagaaagtgaaactgtgtgtggaggtgtgtatgtgcagggcaggaaggggaagaggtcctttaccaaagtacaacgaaatggctggtttggacatgaaaagcagtgtccaggagctgtctgaatgtttaactgtactacactcaggaagaagaaaaggaagtcagctttgagaatgaagctacgttacaagttagagttggagggcttttgtgtgtctgtcacactgttggcggcctagaatactgttgtacaatggtttatctaccttttttattacactataatttacttaaactttccgttaacaaa

SEQ ID NO: 1246 - DNA, 594 bp, Rattus norvegicus
  Genbank Accession No. AI231465
aacgtttagagtgctttaatcaatggaagagaagtaagccaatgaatggtaaagtaaaattcatacagatgaataggttctaacacccaagtaccacacctcccaatgagaatccggtcagacggaagggggcaaaggtccaaatcaagaatgaagggagatgtctatgggacaggaagaaccctgggactgaattgtcaagatgagctccactgatgcctcccacttttagattcctcaagccctagctggagatttggtcataaacagcaacagtaggacctgctggatctggaatgaggaaggagctcagaatcctgggaagacttcagacactaaactccataacaagatacagagtatagggtacaagagcgctaggaggctctgtgctgtgttgtgatgggtgctaatgatgccacagcatgaaaaattgctcaagctacacctctagtggaagatacaatgggactaactacagggagggctccatggacatactcagccaatatacaggaagcaactaagcattgggaataacaatagtgccacggttaagagttggtagaaatacgggtctctggttgacttgca

SEQ ID NO: 1247 - DNA, 446 bp, Rattus norvegicus
  Genbank Accession No. AI231506
tttcaatcatttaattaataccttttaatgaaacacagctttgccatgtgtctcactcaagcttcaaaggagaaggaatagggaaaggattgtttatatagacatatcaaagactcaaaagtaaggaaatatatatatatttctctcttctaacatttttatgcaaattaaaaatcagaggcttttggtctctccatttgcacaaggtcaagctcatttaccccacaggacaaagagattgtcccttaaactctccttccttctttgtactctggcccacccagtggggaaacagaagatcccaaggcagggcaagagctcctgtgacccgggaggaggaaagacaaggcagctacttccccaccctgacagctcccacactactgccagggcctggttccgaggggtcctgacagtcctggatcccggggcaaaacagtgcttac

SEQ ID NO: 1248 - DNA, 590 bp, Rattus norvegicus
  Genbank Accession No. AI231532
agagtatgaactagttctttattttgattcagaatgtatagctatatacaagatgggcaggcagcctaagagttctagaagttaactgtattgatcccatctgtagcactgtcatataatacaaaacttggatattcttcttagaaaacttaatatttcttcaattacggttgctttggtttgaagtgaccaaaacaaaaagtactttgagatttgacaattgcaaaaaatctaagtaaaggcaattagattccatcggggtcttctgaagtgttagaagtaccaccttccgcttttcggtatttctccagtttagcaatcagttctttggcaggattgaaaaccccatgggtctgttgctcacaaacatagcaccgtggagtggttcggaaatgctgcaatgcacaggtctcgcagaaataatgtttacacttagtaacaaccggattctggaaggtttggcgacagatgaaacatttgaatggtatttcctcatcatcgctttctacttcatagttttcatcttcatacacaccataacggccctcatcgagcttccgttctatctgccccttgtgccgaattcttgg

SEQ ID NO: 1249 - DNA, 664 bp, Rattus norvegicus
  Genbank Accession No. AI231792
ccccctccccgaaatgtaacaacattaaagccattccaacgtagatctatttctacggctccttgcatatctcattgtagctgaagttagatgtttcagtaacgaaatgaaggttatctcatcaaaatggtggcacatctcaaagacgggtttcttgttcctgtaactctctgcctatccctcaaaacctaaaaccccctacggtccagagctaacaggaagacagcccacagccaaggctaaatcaccgtacccatgcacagaaagggctcccaaacaagcagaggggttagacttctggaacgggcaacttgtttatttatacgggtaagaatagggaagagaagcccccttggttagcgctttgcctccaccccaagttactgcataccaagcggctatgaataaagacaaccagctgactgcaagtcccgcagtgcatgcatcttaaaaagtctctacaacgcggaccctagggagccaccgggttgccagccgagtctgctgtgctgctggggtttggaggcgtggcggctttggcttctagctgttggctttcagtttgtggatcttcgttttcaggacctttcttatccttgtcggctgccacggggcccatgatttcctgcagtggctgctcgggctcaaggttgctgggctggaa

SEQ ID NO: 1250 - DNA, 410 bp, Rattus norvegicus
  Genbank Accession No. AI231797
gaggacaaaaacaacctgtttatttccatgtaatttatatacaagttataaacacttccttctgctgctcaaaacttttccggaaaggtctccatttcttctttaatcctgttttctacgagtaacgtgaagttactgtctgtattggagaggttgtagctgacaaacacctgtttgctggtcttcctggctaaacgctgagcaaggccggtggaagtcgtatcagaagtgtctccaaaaagggaggtgcacacagggatggagtcaggaagagcgagtccgttagccgcatgacatgaaagtggacgagctgctcccacagcctcgcactgaagttgtgaagcgacacgtccgcggcggcttgcggctcctccatcccgccagccaccgggccacagcctcctcgtgcc

SEQ ID NO: 1251 - DNA, 512 bp, Rattus norvegicus
  Genbank Accession No. AI231829
cctctgaggaaaaagttttattcaaggtccaacaacaaaaaaaaagtttgaaatccacaggaagggaatctgtaatcactgataatggcacgtcatttgtggcccttccactccctgacatcgaaagaaggaggacatctgtgatcgctggtcctggggctccttttccttccagcctggggctcagtgttgttctcccagaaaaagtgggtgatgctgtcctggtacctacccctcagctgggccgcaaaggacccagggatgtactttgaacttgatgtcttcctccctgggacaccaaggatgtcagaagacttccaggcccataactgcctgtcgcatcgtttgcagccagcataagatgatacgaaggaatgctgggaagactcacagaagggcgccatctccaagacagttcttccctcaaaaggcttcaaactgtatagactccgcagtctttgtcccctctgagttgtccccactagtttacactagatccaggagctccacac

SEQ ID NO: 1252 - DNA, 610 bp, Rattus norvegicus
  Genbank Accession No. AI231999
aatgacttaaatagatgtacattgatgtaggtgagagatcacaagcaatttggtgaagtttggagtgacttggccagctggaggcgacagtcatcaaatagtgcccctgtggctctgcacactgacaggcctcagcactcccagacatgcatagtggtatggagactgagccaaaagcaaagctaataattagtagctgcatgtttgggaaatacattgagttacacagacaagaataggaccagttaggaccgtgctccaggttgcctattttaaaggtgacatttgtaaacactccagagtaatggtcgactggtccatcgtcaacacaagtgcgaagagaaatcatttcattaaactttttggagaccccatttaaataacaatgtcaaaacttggggttcccggtgggattttggtcttcataacgggatgagcaggcaaactgaccggcagcagcccaggctgggcctagcactgcagatcctcttctctggtctgccggatgcctgctgaagcattctgggagctggcgtgtgctgtggagctcaggacctcctcaaaactgccaccactgtggtttgtcccacctactttcgtcttgaggctt

SEQ ID NO: 1253 - DNA, 578 bp, Rattus norvegicus
  Genbank Accession No. AI232006
gcggagtctcagtctttaatctcagcagtgctcacacacatgaaaccacacactctcggactttcagatcttgttgaaggctgcaatgtcgacactctgcacatgctcctcaaacttggtgatctcctcttcctcatcactgccgaacaggtcaatgtcattgtcctcgtcgtcctctgctggtgtggctcctttcttggctgggggctccacttgacgcataggagagacatgttgggtctgtggggctgtagctcggtgagtaggtgaactcttctccagagtgctcagccggacctccaacttggaaatggcctgctgcaaatcttgcaccacgcctcgaaagttctggttctctacttccagactggcaatccgcacaatgaggtcactgtggtctccaccaggtccactggaggctccagggcctgaacttccagccaaggatttctggatgttctctctggctcttgcaatgtctcggaggatcacgctggcgccattctcctgccgagagccaacggtcacaggcccattcatctgctcgtagaaatccctttctggatcggcatatttaa

SEQ ID NO: 1254 - DNA, 604 bp, Rattus norvegicus
  Genbank Accession No. AI232014
ccagaggagcttattgtgctgatttattatacaatgcagttaaaaaaaaatatctttgaggttggcctctccggttcaaagtgcagaactagaaacactgggtgttgacaggatggccgcccacttgtgcgagcgagcactggaagcagggtttggagaacatcaacccatttgctcctcaggggaagccaccttctgagctcccgaggcatgcactgttaactggcattcagttattcagcgtgacaaactttgtaatggcatcgtaggaccaagatagaagaattcctatttgccagacacacacaatgactagaaaaggagaaatacccaaactgagtgtcactccgctgaaggaaaggggaaaggcactgtgtccctctaggaacacatggctacggcatactccacatgctccagattcaccccattaaacacatgacaggaacttaacttctaccacgcacaggtcacgggtggcttgaaactccctctgccctctgttcccacccaagtacagacaggtattaagatagctcttggctttatttacaagttcatcctcatgtttccatggggggtgagaaactgtcaaccaacagtt

SEQ ID NO: 1255 - DNA, 650 bp, Rattus norvegicus
  Genbank Accession No. AI232021
gaaaacaagctttatttaaataaggatttaaatacattacataacattaaaactggaagggaaaagaaaaccaaaagaccagtttgttccttcacatggcactgggcagtggcttgtattgtgttgaagcctttatagctagccataagaccaacagcaccagcttggtatttgttcccttgtcgtaagtttaactgataccaggctggccttacccttcatgtttcaacatcccttggctaggagagatctgcctaaaaaagactactgccctggtggtgagctaatgtccatgacttctctggaaaggtagccctttctggattctgcctacctggtcagacaccaggggttctttttacagccagagagactcaactctaatgatatagctggggcagttacccatactctcagtcacctgggctgttcaaatggtgacactcttctagggctggggactgtgtcaagggagtcccaaggaacttctggtcagacatagcctccagtgatttgggggttcttggcttggctgaaatcctgttatttattgctttgttccagggtggactgtcagggcttactgcttaacctgtttaaaatgagggactttaagactacacagcatggctcttttcagtttattgcat

SEQ ID NO: 1256 - DNA, 433 bp, Rattus norvegicus
  Genbank Accession No. AI232076
ggagacggagtcagtgtatttattagtgagttcaccatcaggtttccagcagggattacagtaggagggagtgcaatagggaggtgcaggacctgggcgcccttaggtctcaagaaaggaatattctaaagcaggtacggccaacttaaagctggaaaaaatgggagtggaatcccacagaccactccagaacagcagttggtccttgctccaccttttgctggctttcagaggaggggccaggtcacagggcttcgggggacagtttccagggagattttctacacctggtgactggtgtctctcaggctgacttcaggggctgggtgccgagcttgccagcttccaggatgggtctggctggcttctgtctctggactttaaaagaaggttagttcatcatcgtattccttggggggacagacggcaacca

SEQ ID NO: 1257 - DNA, 505 bp, Rattus norvegicus
  Genbank Accession No. AI232157
ggccgccaaactttttttttttttttttttttttttgcagtgaaaatatttatttgtgggtagtcatagaatgcaccagaccagcacacaacagacacaggtgcacagtgctcatgtccacaatcactggcaggggacagcacacatgggctgggggaggggaggactcattggtgtaatgtacttcacatccactggggtacattcagaaagctttgcatgactcatcacaactagtcctttagtttctaaatagatagcataagaatccaggtataattatggagaaacaaggttataggggagaagatatgtgaggggcagaaagcactctttatttcatatggtaagattctgtcctatttacgcggacgtatggatcttaggaatgttgaaagtcatggtaaaggaggatcacgggctgtgtatcagccctcaggagtccctactgtaagggcagtttggacaggaaagcctgtgaactgcgaagtaggaagaaagtcct

SEQ ID NO: 1258 - DNA, 506 bp, Rattus norvegicus
  Genbank Accession No. AI232174
caaactttttttttttttttttttttttttttgccatttggatttttttttattctctttttaaatactggacagtgaaaaataaatacgccttctcatccaccagacaaggttatttcccaactccctgggagaccttgtcaacccccttcatacacacccctggttctattccaaaaccttccccatgcctcccacccacaaataccctcactatccccgtcttccacagtgatgaggccccagaaatagggggtacaggatgggaggagggatagcaggggagcccccctgaactgtcaaatctgggtgggtcaaggagcacccccaccaacaggcggagaatgggggtgttcagaggttggggcattagaggataaaggcacatccagtctgatagggaaggggaggctcccctcaccctgggggtagggtggacaagagggagggggtatgaccctgtttcacacccctccattagctcctggaggttgggggggacccaa

SEQ ID NO: 1259 - DNA, 564 bp, Rattus norvegicus
  Genbank Accession No. AI232266
aaagctttaagctgaagtggctttattgcaatctttcaaaattagcattacagtaaatatttttatctgtaaagcttggcttaatctacagttcagttactttagaagtagttaaattcagttaacaattaaaaagataacacaaacctaaagcaatctatgaaacaaattatttacaattaaacacttagggtcctgattcacaaaaattagtgcatttcatgattgatttgtaagttttatacagaaagcaagcaggatgcagactattcccctgggaaaatctggaatgaaatgaatggctgttagaagacagtctgccaatctgctacagcaaacttgagagagggcggaaacctggtggctgcactgacgactgttctcagcagaggtcagacaggtggtaatggagagcagacatttgacagagctcttggtgtacatagaaggaaaaggttttccttttcagatgaaactaaatattctctgagtctgtatattcagacgaatctaggatttgtagtttcttttctaatagctggcagagttcaattccgtggcagg

SEQ ID NO: 1260 - DNA, 625 bp, Rattus norvegicus
  Genbank Accession No. AI232270
ccactggggaaaagagtttattgtatggctgcagggatctactacagaatccccctggctgcagttagctgtgcttactctggacatatctccgaagacttggagcctaaatggttttcttcttttagagctttagtacccgatccatcagacctaggactgcacaacgtgagtccttgaaccaggctctggaaaaggtgcccagaccacccaatggggacacacagtgaggccagcccccagtgaaattcctgctgctacctggggcccttggtgagactctggcttccggctggtagaagccaaggttggacgcatagttgcaaagctcctccttcaggcacaaagtgtctatgcttctaatagaacagcagctcccgtgtcctggctgaccggagcacacaggctgagcgtgccacagcgacgacggaggccaagcgtggtgctggtggtgttactttcccgtgagttccagcaccttcttcaccatggccccaatcccgtcgtggatgtggtggagttcggtctcacacatgaaggccggggtggtgaccaccttgtttttctggtcgacgtgagcttcggtcacacccttcacacagtgcttggcacccagggctttgac

SEQ ID NO: 1261 - DNA, 575 bp, Rattus norvegicus
  Genbank Accession No. AI232272
aaagttagggtcctttattggagcagatgggaaatgggaaacagatgtcttcagggtctgagagaaaacttagaacagaaaagcccatcctgggagaaagaacagctcgtgaagttgtcagggagtgcccaggggaatggtgaaggagaggtagtccccaagagcaccccagcggggccggtagatctggaagatggtgatccaggtggtgagaacaatcacccagaagaggaagcccacagctgagcgccaaacatagcctttgatttggctctgctctgtgtaggctggagcgaagaaggcctctttgaagaaccagaaaatgttgaccaaccaaagaaaaggcagaaatgcaaatccaccaagatagtacttccggcacaggttcaacttctcctcattggacacccgctctaagttcatagttgcgctggagcctggtggcactaatttggcttgcagagcaagacccaaatgacaggcacaagatcacgaacaatcacgccccttgtacgcatgcgctcccaggaaacactcgcttgactgtcggcgaaggcaagttggcccctcgtgcc

SEQ ID NO: 1262 - DNA, 521 bp, Rattus norvegicus
  Genbank Accession No. AI232281
  misc_feature (1)..(521): n = a or c or g or t
gactgaatcacagactttattaaagtcatttcacaactgtgcatgttcggacaagtgtctgatttaatacgagctttacacgctttcgtcagtagtggcaagtgcttcatctgaatagatcttcttcctcacaaatgtgaccgcatcctccatctttagtttcttcagctcccagttatggatcaagatgacatggaagcccattacattcaaatgtcgaattttcatggccatcaatcctctgaggtggtttgaatttaaacagtaagcagacttaggaacacacagcacggccactctctgcatgtttgtggcagaacttgcatctccctcagaaaatgaaaatacttgggtcctgttagtatccattctgatttcaaaatcaatgtgataattatgtggcaactgcacatttctcgagaagcatccatccccttccaaaagcctgctgagcacctctgcaagcttctcgtttggatgtgaggctgtcagtggcagctgtggnaacggtatatgtatac

SEQ ID NO: 1263 - DNA, 641 bp, Rattus norvegicus
  Genbank Accession No. AI232294
aggattaaatgattttattcagtttcacctcaaaaatcatgtttaattaaaaataacactattattaaaaataatacaagacatgtgcattacaaagtaaagaatcggaaaacgttgagggtttagttctaaagaggtcctagacccacatcttatcaccattagcaaggttaggaagttgatttctggctaatgatcatcacaggttctataatacagaacagagaggagttttctaaccatcatcaccacacactaaccatcaacactcaataatagtgtaatatctttggaaaagcgcaaaaagatttctttagtggaatcactttggaaagagtaacaaacaggtctctggattcccaaccttccctccaccatcctgcaaaatccatgctgggttctggcgtgaggtctgggttttaataggaggcacaaggtatgcctaactaaggtcaagctgtgcccaccaccatttgtcctgaggactatgcaacatctctttctgggagccacgttcctcctcaagctggcaccaggctttagccttttccttctcctggcatgaaattcctgaggtaattccagtgtcttgtggtcattgtctcagcagtctatggagccaaagaaagggcacaaaggcg

SEQ ID NO: 1264 - DNA, 614 bp, Rattus norvegicus
  Genbank Accession No. AI232303
catccacaaaaacaattttattaattcaagaaccaagaagtgaagaccatgtccctatggcttctagccccctcaaaaggataaggctgggttcatgaacctggggtagaaatgtcccctatccctcatcctcagcttattagactggaaaagtttgtgcaaagagatcaccagaggtgccaaatatgggggttgggtcaggccagggcagcagatgaaggaaaaggtgaggggtctgtggagggccccggaaagaccaggggagcaggagctagggagccaaaggaggtgggaagagtagggctagagcctaggagtggggtccattctgaagcaggttggtctcttggctcccgatggacaggctgtttacagatagggcaggtcttgcgggtctgagtgagccaggggtccacacagcgactgtggtaagcatgagcacagggaagtatccgaagcttgtccccgtcctcatactcatccagacagatggcacagacatcatactcatctcctttttgataatcatgagtaggaatctgtttcagttgctctttggtaagtctgttccgttgaagccgcttccggtgctggatgcaacgaactatcaatac

SEQ ID NO: 1265 - DNA, 575 bp, Rattus norvegicus
  Genbank Accession No. AI232313
ctcagtgcacccacgtttattcccatcagcatcactcacttccagagaacagcaagggggccaccacgcctgacaacttaggttcagtccctggtatccgcacggtggacagagaaccagtttccacacagtctaacctccagacttgtgctatggtatgtttgtcccaccccccacacaaacaactgtgtaattaaaaaaaaagctagagacgatcatacttgtccagtttagtgggctgccaaggctccaggtgagatgaaaagctctcaggaacagtcacacttggcccacgccacatctggctgctaccatgcctgggtgctggaaggctatctgcctggtccacacccaggacgaagcaagcaccggctgacagcccccttctgtgagccagctacaggaaacccagggacagccccgagaaagcagaccgcattctcaggttcttggctgacaataagctttcagtctagagatgctaattaaaaatgacttgctggcgctagcatttaaaacttccatttaataaaagatttttcattctggatgaggaatttagaatccatataaac

SEQ ID NO: 1266 - DNA, 562 bp, Rattus norvegicus
  Genbank Accession No. AI232332
ccaaaagctttgagctttattttacacagaaaataaaacacaggtactattcggttgtactgtaaacctgagttacattttaaacaagcctatttatcaaaaagttacctaaaatattttttgttgatatgaatagctgtaacggcatctgtcctgaccctatgaagtgtagattttaaaagttaacaaccatattaccaagtgataggccaaataaaatgcttgtgtacaagattacatatatataaagtgttgtatatacaacacgcacattctcaatgaggaaacttttcacccccaagggaatgaacattggctattttttatgtgcaaaataagacatagatacagtacataaaatagacaaagtatatcggtgagggtgcaggggaaacctgttctctctggtatttaagttacataggaattctggaaatgtagctcagttttacaacatttgtggactgtgactacacccagtatggcccacaaggcaagtatccttaagagtgccaatagttgaacaaagctaacccccacttcaaaataaaattctttacaa

SEQ ID NO: 1267 - DNA, 601 bp, Rattus norvegicus
  Genbank Accession No. AI232340
caactagtagattttatttcaggtaaataaattcccacatacagtaggaggcttacagcacgaaacagttggcattttattgctagtgcatatagtgtcacagttgatacaatttcattacaagtggaaaaatacactggctgacattggcaagctacaatacatctatatgtcatatatatttctttacaaatcgccagtagttcaagaccgtagaggttatctactgacactactatggcttctcttcaaatataggaattgactacaaatatattctgaaatacatttgtcttccaaagaaacataaaaagtgcacaaaaatatatgtaaaaaatgccttgcaaatagttatcaaaaccaccagggccgtctgtgatcattaggacgtatccaattttatcttggtcccatttctgattggaacccagaatccccactgtggcttcacggcaagattctggcttattcatttttttcatctctgatattcgaaaactcagagcccacggagccactgttgaaatatataggactcaggggcaattgcaaaagtccaattccttaaagttttcaaatttaaaattgcgtttcggataat

SEQ ID NO: 1268 - DNA, 572 bp, Rattus norvegicus
  Genbank Accession No. AI232341
agattcccacaacatggtcctctttattttcagtctccctacctttgcgccatggaagaaacaggctgagggcatgggcagaactgtgaactggcccagaagcttcttgctgacatgacagaaaagaggggtgtaaaggaacccccatcttctaatctagttgggggaacaaacatggagtagatctgtgggaggtgggtggagcaacagaggagggcttcctaaagcacaatgggccctgggaatcagtcctctgtcttcctaccagaccctgcccttgaaggcctcttataaactctcagactgtgagctatgccatcactgaggatgaaaaaccaggaggtggacatccatgacattggttcccgtcaaccctgtatgcagcaaatgtgttccaccctggaagctgcaaaagaacgtgtacgagtcattgttgtcgaggaaggtggcaaaatccaggttttcagcagaagcctggctaacaaggtcagacatgacccaggccccggccacctttgtaggcccgtcctgcccatcagtgcctccactcaagaacagcacatcaacaggcc

SEQ ID NO: 1269 - DNA, 579 bp, Rattus norvegicus
  Genbank Accession No. AI232346
caaattacaaatctgttccaaaatatacttacattaaataaaatacgcatttcagtaagatctacagtgaatgactatgcattctgggaagcttcacatctaggtagggtcagcattcgtggaagaagctaagagaatgtgcatccaatcacagtttatagcgggtttcttattgccaatctgccagtcacacggaacatgtcattacatcacttgtgcaggataccgattgttgggggaagggcagcaagcgctacatcctcagtggtgagttccttacaacttcggaggaattccaccagacagcctagacagtagtttcagtaaacatgttaagggaagtagacaactctctcgaggcccagacacactttcttgctgtattgtgttgttctccacctacagtgggtagtcaggagggtcttcttcaggacagcatggtcgcaggactgggacaatcccaaggggctgacagggagtatgaggatggggaagagggataccttgagctgtttcacatcagagacaactgtgacaaagtccttagacctgccatctctccttctatcatctggcata

SEQ ID NO: 1270 - DNA, 629 bp, Rattus norvegicus
  Genbank Accession No. AI232379
tttaaaatcatatatcataaatcatttattgaaatataaagatctccatttacacttctttttttttttaaacaaaacatgaacacgggtatctggaagccatcttggattggaagaccctctctatggagttgctctcacacatttaccacaccaccatgttgggaacatgtaagtatttttctctttattccttctaaaatataaattttggacattcaaaagtgcaacagttaacgtgcctgtggggaatatcacagttaaaaaaatataaacaaaggcagtgatacagcttgtcatacacgttttggcagtattctccaagtctacatagcaacagatatatacatatcgatgtataacatcattttatctcacgtccctcttcaaaaatataggaccattttgtacaggttggcagaccacattttaaggacatcactgattatttaaaaaaaaaaagtcacaaattgggttcttcgggccagctttgattgtcatcataaaaataagaatagaaagcagagaaaattggtaaatttccttccagggactctgcaggaggccaaaaggaaaccaggatccagtcaaaacactgtttgaaaataaaaatgtatccctgctgaatg

SEQ ID NO: 1271 - DNA, 441 bp, Rattus norvegicus
  Genbank Accession No. AI232461
aaaatgggtaaatgaagtttattttgttcatgattctggaggctggagggctcaaggacacagtggcagcttctggtgagaggtttgtactatgtcattacatagtagaaaggtcaaagggcacaaataaatgcatgaaaaagcgataagaggcagccttgctttatgacaacctgccctatggagactgatccagtgtttgagagcagcactagtctgtttaagggatgtcccagataacttcctccattgccaaactggagaccaactcatgagttctgggggatgtaccacagtattcgggaaggggaaaaccttccttgcagcttactttgcaccagttcaagaaacagtgaagacttgtagataagtaaaagagagacaatcaggacaggtgccccccaagtttttaagtaacgtgagagggaggcaggctcctgg

SEQ ID NO: 1272 - DNA, 436 bp, Rattus norvegicus
  Genbank Accession No. AI232489
gacctgattttattaacagtcatccagctgtcttctatccagctctgatctcagggggcccctatgacagttcagccacagtgtgtcacacattccattcccaggaggctgggtagaaaggtctctggtaactagcagcaatccatttcttatgatgggttgcttgactgccatttggtctcatgctccagaagaatcttctctgtgaatagtcctctccagctggaccgggaggagggacgaagcctctctggtaaacactctgattttgtgaccattttctgaatgagtacgctgagctctgggtctgaacatgctgggacgattccagatgaccaccacgtcggcttttcttaggtcctttgttcacaggtttgttagtggtgtggacttgttctgtaagatgtgctgagtcttcaagaccacctgatctaaa

SEQ ID NO: 1273 - DNA, 460 bp, Rattus norvegicus
  Genbank Accession No. AI232490
ccacagctggatttcttgctattgttatgtttaatgaaagatgaataagaaataaagcaaattccaatgtctcaaattgtgtgcttctggaaaaaaaaatctaagggtgtgaccacattagggaagattcttctcaaatatgcatctctcaatagctctagcataaactgacacttctctcaaaagcagagtgattttcaggtttatatttgacacacactgaagaaagccctcaagagactgaattatatttgttctcagacaagaaggcagacggtgccctgtgaccatagcatgatgaattctgctctgacatttaagtagtttgatcttctgacaagaagaaagatcctacacgtggggatggctgattagggcgaagcgtgacattacccctcgagatgaaaataattacatctgtctgtttctcccaatgtgtgtgcatgtgtttgcgtttgat

SEQ ID NO: 1274 - DNA, 547 bp, Rattus norvegicus
  Genbank Accession No. AI232494
caaacatatttattatttttacagactctaaatgtactaatgatcctgcaatgcacactggtgtctgtgatgccaggttcagcatgaccatccaaaaggcacctgtctaggggaggcagctttctgaggggatccagaggagcagtggccaatggcaaatacctctgtgagcacactgtctgccctgtgctggggaagagcccccactatgtgtcgcctttggaccttggttgtgagcccctaagaatatttctcaggggattttgatcgacaggatcacactctgtggctcaagcaggcttgtaattctctacatagacaagcctgcctctgaactctcaatcctgctctccagtcttctgcgtactgagaatacaggtatacgtcactatgccccactcctagagaacagttctaaggtcaagacatgatcaagatgcccgtgacaccatggcagagtcatgccaagtttctgtggtttgaaaccttggatgtgagtctcattattcaaacacacagctgcaatgcaaaaggcaccagaaggcca

SEQ ID NO: 1275 - DNA, 535 bp, Rattus norvegicus
  Genbank Accession No. AI232534
gaaatttaacacataaatatattttctaccacatgcttcctcattcctttaaagttcccctcgcctctatcgagcagcttctttgagactgttaggtcctgggttttgaagactgtgctgacaagactgagcccatccttgaggggttgctttcacctccaggatgctctgggcttcttgggctgactcaagacttcataggcagcctggatctctaggaagtgcctctgggcctcctccgtctggtgccggttgtggtctgggtgccagaccttcaccaggtctcggtaactccgatgtatttcttcattggtggctccttctggaatgcccagaacctggtgagccagctgacgtttctcatcctgaaaactgtcaacaaattcatagagcttttcccattcctggaactggctgctattgaagccaggagccccaaccagtagccaccagatccggcaaggcagaagcaagacagactccacgagacgaccgagaagtgggaaaaagttgaaccaactcaagaaagaaccaa

SEQ ID NO: 1276 - DNA, 510 bp, Rattus norvegicus
  Genbank Accession No. AI232552
ccattcgttcattttatttttcagtgcggggaactaaactcagggcttcgtacatgctatagtagtctcattgaccacattcccagtcctgctgttgccgtcgtcgtcgtggttgttggtgagacagggtttctctctgtgtagcactggatgtcccaaaactcactctgcagctcaacgtccagtaggaatacattccctaggtcaaggacacagggacagcaactcctacaggattccagaacaccagtgtaaagagaaaatcctctgagacactgaccctcacctgagcagggtaggcggcctgagccagccctccacccttcagctgggacagggccttgcggatcgtgttcagctcctggattgtggctcctcgggccgccagcagcttggtgagcgtctgtttctcctctagtgtgacaggtgggataggagcgggcagcagggctgagcccccacctgagatgagcacaagcagcaggtcgtcggcagtgagcctctttgcca

SEQ ID NO: 1277 - DNA, 437 bp, Rattus norvegicus
  Genbank Accession No. AI232631
ccagagaaaatagattctgtcattggctttctcagcaccatcatcctgtcccatggggctgcaggatggatggcctgtctctaggatcctgctttcaaggcaacagtttggccaaggcctctggggctgaaagcaggggactgagggacagcggtccctaagggggtaaggggacaaaggctgcacatgagcagcactcactgcaaagctaaggcaaagcacagagctgacagaaggcgcctccctcaccctacggacacggcctgctgaggcccggcccagacagtgggtagggatagcagcagcccagcccggagcagcagcaggactctgggtatgcacatgaggacggggtgggggtgacatgctgaagaggcagcctaccagcaaatagaaagccttcagcttgcacattcctctgccccaacagaggtccc

SEQ ID NO: 1278 - DNA, 605 bp, Rattus norvegicus
  Genbank Accession No. AI232643
  misc_feature (1)..(605): n = a or c or g or t
ggctttaaaaatagttttatttttcccttcacagacacacaggcctctgaccataattcatggcaccccaaattaaatatagacttaagagtatatttgtctgacatgattcaagaaagtggattttaaatgtgaatgggtgccaaccatggggactggaggagggtggtaccagcaaagaggggcgtacatcattcttacagcgactcttagacttggaatcaatatgtgctcatcatatacatatttagcccaaatcagtatgctcaggagtagaatttcttctgtctctataataaaaaggccaaagcacttccttaacattcgaaatgtttccctagtagacttggtatagtaagagaatgattgctaaacatcctcaatgtggttttcattatgaaaaaacatgtttcacataaaatcttcataatataatccagaggccaaatttgtgcatgtttaaaatttgagtccaggctagatatttggattttcccccccttccagtgtttttcatttttataaatacatacctagncttctactactttaaacatactcggaactcttttagaaaccatggctgcctttcagtagcatcagtg

SEQ ID NO: 1279 - DNA, 595 bp, Rattus norvegicus
  Genbank Accession No. AI232784
ccaaaaaatcaatacattttatttgatttatttaccatggtttcagaagagacgagagactattaacgagtcgctcttgggaacgacccttacagggcttgttttcatgagtgtcacccaggagagatgctcacccggccagtttgcttttctctgtggctagggagggcctgtcttccagcagggatccatgcactcacagactccaaccgccatcgatgacgacaggggtgccagtcacataggctgactcatctgaggccaagtatacgcagagcagggcgacctcttctgcagatgcaaaccttccggtcttctgtctgtttaggaaagctttcagtgcctctttgggatcatctctggcttgtattctttcttgcagagatggggtgtcaaccgttcctgggcacacacagttgcatctgatgccctgctggatgaagtctgcagccacggacttggtgaggccgatcacagctgccttggttgcactgtacacacatctgttctccacccctttgatgctggaggccacggaagacatgttgataatgttgccagatttttgagcaagcattttgggcaggaatgccct

SEQ ID NO: 1280 - DNA, 388 bp, Rattus norvegicus
  Genbank Accession No. AI232874
gctgatcgtactttattaatattttcatagtctactacgcaaaactatatctgcttaaaatgtctgtctctctaagaagaaccctggttgtgttgacttctttgggactgcaccccagtagcagttcaatgagcaggtcccgtaacagccacagaggtctcctccaggaacgactgttccccactggagccccagccttcaacgtcagctaggctcccaaaggcctcctatacctggaggtgactaccctggtcgacatccagccggacaaatgttgagttgcaggcctctggctagtggggtcaccctggaaggtacgctttgggcctcgtgggatttccaggggccagccctgcagagttcattgcgtggaccatcacgtaggtgt

SEQ ID NO: 1281 - DNA, 476 bp, Rattus norvegicus
  Genbank Accession No. AI232924
cttcctccctttcttagatgaagtcttattctgtaccaaggctggcctttaatctgtatcaatcttcttgtcttggtttctcaagtactggtattctgggcctacattaccatgcctgtctccaacaatctagtttttaaaaaaaatatggaaataccctctaatagcatatatgtcatacataacatttcagatcaaatgaccagtagaatttaactcacatttaattaaaacaaagatgccatgagtaacacgagctttggctaagcattaaaattctcttttacacttaggaggagtatacacacaaataaatgatctgagaaatagaaaaagaaatctgattagaatttggagactaatgcaaggagaagaggatattaatacaaacccctgctcgagtgcttgtctggcatggacaagaccttgggtttgttgcccaacaccaacaccatcacacaaaaggaaaaagtctg

SEQ ID NO: 1282 - DNA, 410 bp, Rattus norvegicus
  Genbank Accession No. AI232984
cttagaaaggacatttaattggggggagggtatacagattcagaggttcagtctattatcaaggtggaaggaatctcagtgtccaagcagacatggtgctggagagagttctacatcttgatcagaaggcagccagaagactcttctgccctgggtagagtttaagcatggggtctcaaagccaaccaccaccaccccctcccccacagggacacacatcctcaaaggccacatttactccaaaagggccatacctcataacaatgccacttgccatgggccaagtatattttaaccaccatacctttgaatatcacagtaaaggctttactgcattggttacattcatagggttactctttagtatgtatgtgttcttttatgtagttggagttggcttgattgtgaaa

SEQ ID NO: 1283 - DNA, 484 bp, Rattus norvegicus
  Genbank Accession No. AI233031
  misc_feature (1)..(484): n = a or c or g or t
taaaaatcactacaaaaaccttacaaaagagtcttgggagctaaaggggcccttccctgcctcagcccctgagcttcctggcagaggaggacgagaggaagatggaggaaggctcctggcagtgctggcatctccaaaaaccagaggggtggcttgggtggcaggacacaggttggggacctgaatgtcttcagcaaggcacatcagagtcagggtaggtccgcctccacccatggagtagaacaccaaggccggtctaagctcaggagaccaacacttgtctttttcccacccgggcatctggggatatgtctaaagagggcctctctagcctctgcttacaaatgtggagggactctaagttagggactagcccaacctacctcttgccaaaactatccacgagtgccagcccacaaaaggtcacctcctgggccccttgggaagcaatgaagactccctgggcctgcctnctcccaggccc

SEQ ID NO: 1284 - DNA, 513 bp, Rattus norvegicus
  Genbank Accession No. AI233121
gaatttaaagatgtttattgaggcttgagagaaggctcaatgggtaaatgtcgtctttccaaactctttgatccccagagatcaaaggtgagaactgactcccaaaagctgtccacaagcctaaaagcctctgtgacttgggggcacagctcttttcttcatctaatggggggggcttgggccttttgccattacataactgatggccacaaatctatgagggtacggctagtgatgggcctagtgcccaggcacaggcaaagctcctaccatcccttcagtgtctctgggctttttgcttagctcacccggggactaggctacctttcccggtcccacagagccccctgtccctgggtcctcatcctgagagcctctcctcttcaggaactgacggagccaggcctttcttctggcctggattctgtagcaggtaagtccaagaaacactagcaccaggcccagaaaaccatgaggacacacagggtggttgcttgaagttcccatctgccc

SEQ ID NO: 1285 - DNA, 549 bp, Rattus norvegicus
  Genbank Accession No. AI233147
  misc_feature (1)..(549): n = a or c or g or t
ggcagtttccaagtaattttattcagaattttgtgtttgtttcctgaatcaataaatactatacaaaacaatgtaaaaatggctaccattttctctcccctgctcccctcacctggggacaagtccctggacaacctcattcagggggttctccctgtagatttggtccagcaaatgaggccagccatgttttagccccttgactcacttttggagatttggctggggtaggaaagcctttaggaatgaggtgattaggttagggaaatgcattattgtttgggggggaaggagacagcgccctgggcanaaccctaccccaaagaaaagggtgtctaaaatgttcacggttccttctttttgcctcaaaaagtgacatttattcaaagagagagagagagaaaaaaaaaacaaaacaaaaaaacaaaaacaagatgtccatcccttggctcccttccctcccccctccagctgttcctgagccctgcccccaggactgaaccctgggctagggccaggtagcaggacagcccctcaaatgaggtcaac

SEQ ID NO: 1286 - DNA, 364 bp, Rattus norvegicus
  Genbank Accession No. AI233155
tgtataatactttctttgctattcttctttctttttcttttcctttttgttttgtaaatgtgcatgggtgcctacatgtctatctgtacaccacatgtgtgcaatgccttcagaatccagaagaggatattggctcctctgtgcctaaagttagaaagttatgaaccgtttatggggggtcctgtggattgaacttcagtcctctgggagggcaactggtacccttaaaagcatgagccatctctccaggcactttctttgtcattgtcaaaaccaggaacttcctgtgtacttttctatacaccatttccatttctagggttgccattttactattctagcctacacttaaccttttgctgga

SEQ ID NO: 1287 - DNA, 539 bp, Rattus norvegicus
  Genbank Accession No. AI233182
cttagaaagttactttattagaattttaaacagtttaggcaatgaaaccgttctaacagcaaatgcacttcctgcttacaatgaaatctatttcaattctgataatgacatgacaggtccatccaagtttcttccaacagaaaagcccacagctcaaaagttacggggggaaacatgactaagccaaaggacttcacatgtttaccacagaagtgatacacattaaaataccacataatactttctaagagaatcaagccacttgtgaaaccattagcaagcatggagactgaaacaactgcttaggcacaggactaactcaggcaccataaaaccctctgtcttctcacttaacaaataagattccctagagacaattatttgggtgcctgcttgtaaaaataaggtacttaatgacggaacggtttcttgatcatgatcatacttgggtaatctcaaggaatgaagatgaggattattagacatgattacattaacatgaaattctttatctatacactctgatttccatgtcctga

SEQ ID NO: 1288 - DNA, 565 bp, Rattus norvegicus
  Genbank Accession No. AI233183
ttttaatggtcaatagcttccggttggcttctgaatggtatagttaaacaatatacttaagacacccccacagcaagttcatacccctcaaaaagtagcattggctctatccatattccactgctcagtcagacttccacagcctgggagccactcctgggttatggaaatagacatcttagtgtaatgagctgaaacccctggcacacccatgatctgttatttttgcttaaaaaaataacaagtattaaaccaaacactttcccaggtgctgctgcttcacagagaaaacccagtgttgctgtagggaatctgagtcctgtgggccctgtggttctgcttctcgtcccactctcctgcagtcatacggcgtagagctcataaaccttctttacacagtacaccagggcagccagggctattgtgttgtgcagtctctttctgtgcaggtcgtccttccgaaccagcaccactggtgtggaggaggtgaacttgtgcagaggcaggcgggacaatttataggcatcatactccacctggtacttgcagcaagggtcaaactgcc

SEQ ID NO: 1289 - DNA, 602 bp, Rattus norvegicus
  Genbank Accession No. AI233191
ccgctgtgaattcacatttaatgtaaggaaggcccgccacaaagataagtcacccagtccacaccacaccgagtgcctggtggccctgaggaacagtcccaggcgtaccttgcaccagctctgcagacacacccgctgtaggagaatggttttttctgctggtccctgaacacagtcgtgaacatatcattgccctcagcctggagggcatattccaagtaacactggccaccttggtcataaagcccattcctggcacgagggacagggatcacaaactcatccactgtcttttcttggatctcagtgacggaggacaggtctaacctcagcctatctcatctccctgcacagccattcgtagactgagggcggacgaaggtggggactgagtggcttcccccctggtggggagaacacttggttccagtgtgtgcacatggctttggcttggaaactgtctttaatgatagcatcttttaagcgttagacattgagaatgcatttagcccacgatggggcaaacttggctgggagccacactggccacttacaaactaaacctggttattttgcatttctaaatgggcgggaaaaatgag

SEQ ID NO: 1290 - DNA, 701 bp, Rattus norvegicus
  Genbank Accession No. AI233194
gcctgacactgaactttaatatatttttggtttaaaagtttaaattgattaatatacaaaaggctcttgtgccagtgaaaatgactgctaaatattccagagcttgttagtaaaacaagaggatcaccatatacatacacatatgtatatatgtatcaaaatagtatcagtacagttccattctccagaccgtgaagcactagggcagttttgattacaaacacaataacaaaagccttccactttcccaagacctcttaacactgtttaccacttaactgaaacgcagtactaaaataaatattttctattgtagaaccactctccaaatttttgtaggactaccttaaaacagcaggctaatgacttttttcttgttcaaatggtatctgcttgtaaaacagtaaaaacattcaaaaccagtttacccaacaaatacctcacattaggtttccttttccctcaaaattctcaaaatgacagatgctgacaagacacacacatataaacaacctcccgagactctccaaagtaaacttgatggaaacccttcctgctcaagggttatacatcttaggataaagctacccagcattttgttttgggtgtgaaaatgccataaaatgtccaaggattgtttttgtgttcaagcctatacatctacaatgtagataccccccagaaaagaattactcctacaa

SEQ ID NO: 1291 - DNA, 596 bp, Rattus norvegicus
  Genbank Accession No. AI233195
atctttcttagattttatttttatgtgtacaggtgagtggctgcatgtatgcatgcatgtatgtatgtatgtatgtatgtatgtacaccacatgtatgcctggtacctaaggaagccagaagaggaggtcggatctcctggaactggagttacaggcacttttgagccaccatattggtgctgagaactgaaccctctgcaaatgctcttaagtaccaggccgtttgtcccgaccccaaggtttctctttagtccagaaagcaggtaatttattggacgttgacctactgttaacgacaccttttagtacaagaccaatattttataaattacactttagaaaactgggtcaagttttacaccctctaacagtctatggctgcagacggatgcaggaaaaggtgagctctcaatgggtcagtttccacttgtctgcagagttcaggacttgtcagaggtcaacacggagtcaaacgctgtggataagaccttgcagattgcttgggcttgttccaggctgttacactggtaaacccacaggctgtattcttcattgcttgcatcggtggtcttgagtgccagcaagccctcgtgcc

SEQ ID NO: 1292 - DNA, 563 bp, Rattus norvegicus
  Genbank Accession No. AI233224
tttttttcatttttagaaaagcttttatttcaaattccattttgcatattgattttttttttttggaagaagacaagtgcattttccttgagcaaaagaattgagttatgatttagggacaggatcttcattcagcactcttaagcaaagtcaaggttagggatgtgatcttgcaggtgaataaatgcttgcttctcccagaaaccgcagcagcggtggttttgttaggatcaaacttgagcttcaggatcttgctgttggggtgccatgggcaggctaacattacaggaagcttacaaggtcagggcccagtgtcccagctgactctattttgggccagagggtgcaagggccttgtcacagcctgccatgcatgcttcaatttcttccacagtccggggtacacatgtcagcagctccatgccactgtcggtcacgacaacgtcttcctcaatacggaccccaccaaagttgcgaaaacgctgtaggacctcttggttaaagaagcaggcttgggccgggtctgccagggcctggtccaggaggtggtcaatcctcgtgcc

SEQ ID NO: 1293 - DNA, 374 bp, Rattus norvegicus
  Genbank Accession No. AI233269
gtatattctttatgtttttattagatctttaaagttttgttttaaaacatagaattttatatcaattaacgcctacatttaaacagactggtatatcaattaaatgccttgtcacaactgtgataagttctgttagaaaaataaacatctcacaacaatctacagtgtcagcttttaataaatacataaacgttagtagtcaaccagttacgcaaagagattcatagtatagtacgtgaaattgtcatatttaccaatcttccttatttaaggcaatttcacctttcatataatcaaagccagaaacaacacaaaatgtgttgatgaagaatttgtttctctttgagctattttatattcaaatatcttgattt

SEQ ID NO: 1294 - DNA, 480 bp, Rattus norvegicus
  Genbank Accession No. AI233365
tttttttttttttttttttttttttggttttattattatttatttttagaaaagaagagaaggtgtatacgatgcaaagtctcatacagtatgctattgttggttgcctcctaacaccagccctgtcttgtgactcagtgatggagatgatggacagcagggatgtgctggagactgatcacagacacacaatacaccacagtaaacttgaggacagatgatgctgggctagcctgttccaaaagcaagccaacacatggtagaaagcaaggaaaccaatggacctctctctgtggggaaggcatgggtgtgaacccacaagcattcccccgtcccacacacccaccacaccctacttcatcagaccacagcaatacacaaaatggaatggtcctttggtgtttctcagcaaggatattcaggttcccagtgtcttgtttctgattttcttttcatatttgagtcccgaattcttaaagc

SEQ ID NO: 1295 - DNA, 424 bp, Rattus norvegicus
  Genbank Accession No. AI233407
gagttctgaagatgctttatttagaaaaataccaatactgacttaaagatttttaattttttaaaatagcgccctaatcagacagctaattctgtatactaaaagtatttacacatggaatacgaaataaatacacagtaactaaaagagatagttatccatggattcatttggcaccccctctgctcatcttctgctgcagtttccgatgccttttgtaaatccttctctttctcgctttcagatccacttttggctctggtttcacccattgtacttctattggtttctcctctgctggtgtaacaaacacatctgcagtgggatcgtgtggaagaatagtctttggttctttcttccttaatttctgaacatctttgacttgctgtttctctctgtacttggcagctgtgatggaccttac

SEQ ID NO: 1296 - DNA, 504 bp, Rattus norvegicus
  Genbank Accession No. AI233425
  misc_feature (1)..(504): n = a or c or g or t
cacaggaaagtctgcattttatttgagcccacaacccctggaggatcagcccccaccagatgcaacccttcccccacaccttcacaaaacactgattttctcacagagctaaaatgacaccctagttaccaactacagccaccccttcctgtccctaggccagtatagccttctattctgaggacttggttccctttcctcggctggcttctcacttgtattctaagtcctctccttaaaaccctccctccctgactaggttctnatgtgcacaatcatccagagtggcttcctgcctaatgtccatgccaggcctggcagcctccccccgacacccaactaggactacctgcaaaaacacacttgttttaagactccanagaccagggatcangctggctcctctgattccctgagggccttggtttctcagttgcactgaangggtacagaaactgactatgccaaataacccataatggggataggcagaggggagaccta

SEQ ID NO: 1297 - DNA, 515 bp, Rattus norvegicus
  Genbank Accession No. AI233433
  misc_feature (1)..(515): n = a or c or g or t
caaggaacacatgactttaaagtgacagaagcccggcttctagaagcatcccccgccccttcccgctatccacatatggtagaaatagccatccttgggagccaaanctctgctcatgctgccaggtctttgggctcctctggagttaacttcatcagtttgtccacgcacagcaggatgagggtgaggaaccagaaactccagccaaccgccgcagcgatccagccatactcgtccacagaagctcggcaacacagggaggctagtgggcagaagtcgacattagcacactgctcgagggtcccggggtctgggtggtgtgtactcagggttgagttgccgctgctggcttctgtaccgcagcacaagtagaaggaggtgaggaccaggctgaataccatggcggcctgcggggcagaggtgaggtacccagggctgcggaggaagacacctgtntgggccatgttgctgcagaggtgctctggggtggggaacatgtgtcctgacctcgtgcc

SEQ ID NO: 1298 - DNA, 475 bp, Rattus norvegicus
  Genbank Accession No. AI233468
gatattctaaagcctttatttagcatcataacacttgttaactccaagacaattaacataacttactggaagctccctaaggccctttagggcaagtacgtcagtcgggttaggttactatgagatcaccccaattaatggggaaaagctactgtacagcaggtctccagtaccttgcaaactcagaatgcacaaggccttctcttacctataatacatgagtgcagcttaatttctctgtggcatttgccactggaagttgaggctaaaggtttgtcattagatagtgatattgattaaaatctattttagggcatttttgtgattttatgtttgaactgaaaaagtctaatgactgatcacaaatgtgaacgtaaatcacaaatgtgaacgtaaatccagagtgctaagagaagtaaatacctgctctggtttagaattttcggatcaggaattctgcccccacccttgtgcc

SEQ ID NO: 1299 - DNA, 411 bp, Rattus norvegicus
  Genbank Accession No. AI233494
tattggttattttatttacttacatttcaaatgttatccccctcccagtttgccctctgaaaatcccctaacccatcttatcgccctccccctggttttatgaggctgctccccatctatccatccacttcagcctcgctgccctagcattcccctatgctggggaatcaagctttcccaggaccaagggcccctctcccattgatgccagacactgccctcctctgcagcatatgcagctggagccatggatccctccatgtgtgctctttggttggtggtttagtccctgggagctctgggagtctggttggttgatgttgttgttcttcctatggggttgcaaaccctttcagctccttcagtccttcccctaactcctccattggggtccccatgctcgatccaatg

SEQ ID NO: 1300 - DNA, 504 bp, Rattus norvegicus
  Genbank Accession No. AI233530
agagaaaataatatcacttttattgaaaacatttaagacattattatggatctcatacatggaatacacttatattttgtatccatttgtctgccagtatttaataagtttacagcccattcaacataacatggggtatataaaaactttggggataattcccaaatttaaaaaaaagtgataacatctatactatatcaacttaatcttacctcaacaggttgtgcagagtcaagagagctctaccacagccccagtaatgcaatggcaaagagaaggtgtggcaagccaaatgttgagaaaaatttttatctgaaagtctaagccagtagagctcaatattatctacatgggatttttttatttgtctggtttttaaaagaggagccaattatttctgagcactgtaaacaattgtactatttaaaggttctctgaaatgactagatgtattttattaatgaatttaagaattaaacccacaaaagcaaatgctatttccca

SEQ ID NO: 1301 - DNA, 501 bp, Rattus norvegicus
  Genbank Accession No. AI233570
aaaaattatttaatccatggccaacattttttaaaaactgagacacatggtgcttcactggaaaacaatccccttgcccagtaccaaaaggcacccacagctggctagaagagcacctagtcagggcctgtgctctcctgcgggccactgggcagctatgctgaaaacccagagcagtgacaactgggaggaaacactcacccagaaggcccataggcccccaaactcccaaattcttatctccaccatcccactggggagactagggcccataggaggttaatctgcctttattgagggccagcccgtgctaagactgctggaccagccatgcccaccaccttggccgaggctcagacaatcatctccagctgccgggcatactcgatgacctgcctggccagctcagtggaggggatggtgctgtcttctggcttctgctgctggctggcaaacctgtattagttgttagggcccatcagccaaccttgttttttggca

SEQ ID NO: 1302 - DNA, 345 bp, Rattus norvegicus
  Genbank Accession No. AI233583
tttttagtggggggtttttttttcgtctttgataatatgatttattgtccattgacagagcaaacgcataaaaataaaaagaaaggctgacacagagcaatcaggcgcactcggcttgttgactttcaacaactctcatgtacgaatcgccggcggcgtggggcgtgggatgagggggttggggtgcattacaccagctacggctgtacacaggagcatccgtcacatgttcaccttcagcactttcccagtctgccgatctttctccacacagtatcagctgtcatagaactctgtgaaagtggttgctagctcataaatggaatcacacagagtgtggagaaa

SEQ ID NO: 1303 - DNA, 464 bp, Rattus norvegicus
  Genbank Accession No. AI233602
atgtggcagtttttcatgtgtgtatcaaattacagagtaccatgaggaggcagaggttacaatctgagcacagcgcaaagctgggattagtcagctgtccccccaagtccaccgggtgtccgcagcacatggaagagcttatgcggggcaatgtggtgtgcgtcaacgtttctgtaccttatttgacaattatcaggaatatatatgacatgtgtgcacacacgcttccaaattaaacacatttatataaaaagctcaagaatgacgttagcattaatctctttaaaaagtctatcatattaaattgcacccgcattataagcagaaatataaaaaaaaatcaacttactaaatactgatgaatttataaacaattgaaaaggaacttaaaagtttttactgaaatgttggattcctgtgtgacatttaagaggctctaacagactatggaaataaacattttt

SEQ ID NO: 1304 - DNA, 631 bp, Rattus norvegicus
  Genbank Accession No. AI233712
aagggcaatagttcactgatttattggatagacatattcatataaccaatgaaagcctgtatgatataaaataatttaggaaatgttgggtattagcagcaccatctgttattgaaatagcaagaaaaacttcacgtattttaagcaaacactagaagagagtaactatatggcctaatgccactggtctgggacagatagtggtgtgttaggcaaacacaccgccatctgtgccagagatttcagtaagcacaccagatgtactgttctagaagaatgctactgaagttacaagatactgcatagtgtaagtgggacaaggagactaaaatcagctacattagcacagctcagtatttttcctatgaaaggtttacttctgaattatgaaatgtgaaataaaatgtaattttaaaaagacactgatggtccctaggaaacattaagtggagcacagagcactatgaaaatacttcacttttccagtttgcttagtaattttctttaaaaagtcacgtgttcttcacaaggggtgtatacaagtgtgtaataagcattttaaaaactttaaagacatttttaaaatcgtaaagattcttctgacctttcttcaacattagccctgttgtca

SEQ ID NO: 1305 - DNA, 556 bp, Rattus norvegicus
  Genbank Accession No. AI233717
ttttttttgtatttcaatatattttattaatatattttatatattaaatatatatatttccagctataggagaaatgactgagcacttaagagcatgaactgtttttccagaggactgactggagtttggtttctgacacccaaatcaggtggccgacaacctcttgtaactctagctccaaggaccccacccccacccccatttgtggttgccatggtcatctgtatatgtggcccatacacaaatacctaagtaaaactaaaatttaaaaagattatttctctgtgggtgcatgtgcatttgcacacatgcacatgcaaatatgtgtggctgccaggggaaaccagaagttcacaagtgctctcaactgctaaaccatctctctgtccccacttaggagactttacacgtctggtatttctgggatagtttcagaactaaaacattctcttcagattttaagcacagggttgggagtgtggaccagcagttgaatattcagtttgtatgaagtctggatttgatttccaggaccacaaaacagaccctcgtgcc

SEQ ID NO: 1306 - DNA, 687 bp, Rattus norvegicus
  Genbank Accession No. AI233729
gccaaacaagttttaatttattttcaaaggaaaagtaaccaagaaatcttattaaaactatttattcctgtatacaaataatacaatccgatgattctaaatgacttagtttttagagactacccaagattttgaggcaaaatcagataaggaaaaagaaaatatggttaagagaatccagaatcattttggcttcattttagttttaaacaaggtcaagagtgtacccatggaaactttgagaaaaccagtctttgaccttgcagcaaagactccagtagccagaggactcagaaaagctcgagtgctcttaggctcctgctgctttcgctatgttccaagcaccaggtccacacagcatttaagtaggaacgacactgctgatggtaagactgtgtccgaaactccatgacagctctgggaaggcagacgtcctgcggagtggagcatggatggaatcatgtaccttgagaaattctggtctgtcttagacggaatcagtcagctccttctacggctgttgtggcaacaggtttcacgtagtatggcccttcacttaggtacgttctgagcctcaaataatttgagttcccaaagatctctgcaactgtcttggaattggcgagcgcttttaccagttcgtatttcgcatcctttgaagttttgtcatgttccacagaccggtcc

SEQ ID NO: 1307 - DNA, 547 bp, Rattus norvegicus
  Genbank Accession No. AI233740
aatgtaatgactctttattattttatctgcataccctcaaatgttaccagagctccgggtttttgacaaacatttgctcagatcaaattagtgtaggagatgtccattcacttctccaagtcacatctgctcgcaacggtctgttcctgattcagcatggggatttaaccacagccttgcccacaccatgatgccaggcaggctgggattgagaggactgcaggagtgaggtatgcatctgcaaaagagaagtctcgccggctggttcagctttcagtactctgcgtcatagggaaactcttccatgttgactgtctcaggcagcaggcaggccctccagtttctgttgaagctcaggatagtggccatctcctggtcgctcaactggaagtcaaagacctgaatgttctcctgtatacgtgctggcgtcacagacttggggatcactaccacgttcctctggatgtggaaccgaataagaacctgggctgtggttttcttgtgcttggcggcaatctctttaatcttggggtcctgtaatagtgaa

SEQ ID NO: 1308 - DNA, 574 bp, Rattus norvegicus
  Genbank Accession No. AI233743
agaagacaagtacgtacaaaacagtcgtgtggctgatcatcactttcaaaaattcgactatgttttttcaatagaagagttacctccagtttagcacatttttaggcatttggaatcttaaagtatgatttcaagtctgtgtttataatgactgagtaggaagtcagacaggaaaaagaaacatatatcatagataattaacgattatcattaaacagaagcccacattacttcagcttggattacttggggctaatcaacagaggctcacaaggctagctccttgtttacaacctgagcagtcattctattcagcgaaaggtaagattgtactaacacccatgagaacctgagcattttgggtcaagagataacattaaaaaaatactcaacagaagctaaagaaaacacaacttgtcaggaacaaacccttcagtcctgtacagcaaatggcctgaaaatgaaaatgtactgcgtaggcttccaaggttatgaggaaaatattgcagatttttcaatgataactccaaatacttgtccatgattgtggcttcaagaaagttttccagttgct

SEQ ID NO: 1309 - DNA, 534 bp, Rattus norvegicus
  Genbank Accession No. AI233767
ggacacagtatttattcaatgatgttccatacttagtcaccacatggctctctacctgcatcgcagctccccaccttggattgtgagggccacaaggccagcccccagctgtgatttacaacaatgaacacagggtcacaatgaaagagctctgagatgtttgtgaacagaaagaatgaagatgacattgtgggtcctgagtaagggcccagacaggctgcccaacccacagaacccaaggcctgaacaaggcctcagagggtccatctaagggagaatctaaggcactgtagtgaaggacatgattggcccaccaagtgtggtctcctggtctcatggcacgtcccttgccggaaccggtacaacaaacattccatttagaaggtcttcctgaacgtctgcaagcagcatttgctaatgaaaaatgaagacaaggccattcttggaagagtgtgccccagaagacacactctgtcacaagaccaaccaggtccctttctaaggtccctgagaatagcagcctggcctcgttcc

SEQ ID NO: 1310 - DNA, 587 bp, Rattus norvegicus
  Genbank Accession No. AI233771
gtgaaaaatgtttttattataatctcaaactttcagtgtatatcttcattacaatcattggtacaataaatatggaaatgctaagcagacaattatcacagtggcctatgggctgagggacagggacccagagatactgttacccctggtacttcctcagggccaatcaggaggtcttcaaagagtatagagagggagaggaatagaaatattaagactgtcagtgcagcaaattttagaatgtccattaaagccatggatataggatttgctataatagaagacagatactaacaaagaacagagagactcaagttttcctgttagaggcagaggaaatattacagaagccagtgccttcctcaggtccctggtgtgtgccccccgcccacccacgaattgtgtaggtcatctccacttgctatgtgcccagccctgtgccagcccaggctctcccaggcacccaccttgcacctcacacagcatagttaaggagtgcaaggctgtgtatcatataccacagcactggttttcctcagtggtggccaggtgtcccacagaatgattttgaatctgaagaaagctgc

SEQ ID NO: 1311 - DNA, 629 bp, Rattus norvegicus
  Genbank Accession No. AI233773
aggtctacacagatatttattcttctacaaggctgtgaaataccctaaggtacccaactgggattgaaatggcttcatctggctccttatcaatgcatctcttgctttggcagtcataatcaaaagaagggacagcatccgtgtctgctatagggactgaagatgcatacacaggcagagcccggatcccaccaccaggagaggattctggagaatcaggagaggattcagcacctccatcaaatgtcttcccttctctggtcttcacgagaggactgagggcaccacttggtgctgtttggttgggttgggttgggttcttggctgtagagaagagttgagctgcaagcccagcataagcatctctaggctgtcagcatgccctccaagacaacagcggctccgcccttcatgtcaacccgcccatcaggtcgcagggaaatgtccagctcccctcctcggcaggaacactgaaaggctcgcatctctttcttcccgagctgctgggaccagtaactgctgagaacggtgtgtgcagatcctgttaccgggtcttcaggtacaccaacccaaagcgcaaagtatctggagtagaagtcatatggggtcgtctggagaatactggatgt

SEQ ID NO: 1312 - DNA, 563 bp, Rattus norvegicus
  Genbank Accession No. AI233818
aagtgaggcaaatatgtttatttaaatcagttgtcaaatcacaatttatccaaaggaacataatgcaacattgttcttaaagaaggggcacagatataacacagacaaactccagtatctatcaaaataccatctgtaaagaacaggactcacttcgatctgcatatgaattcggtccagcatagaagagtacaatcaaaaaaacgtacaacagattccttctgcattaggaaacatctcatggccttaggcacactcatttgtccatatcattaagagacagggcttaatctgacacagaggagacttctttccaacctggactggattagcaaaaaggggggaaaaaatcatggtaatattgggacatcctggatgtttcaaaatggggtttttatttctgagctcgctgtgcataggaaaacaaccactttcagaggactagaagcccacagatctaagcatcagtaaactttaaaaaagacttgtcttttcttgccaggaatgttatttgtttgctgcaggttacagttgaagcttggagcttttcaaagcgtcgcttt

SEQ ID NO: 1313 - DNA, 319 bp, Rattus norvegicus
  Genbank Accession No. AI234079
gaggccaacgaatatttgatttatgagctcaccagtcattacacaatgtacagacatgatccactgaatagtttatgctccacacaaatggttaaacaatgatttatgaaatactaaacaaaaagcttctataagcagagtatcgtttcctgccccctcccccaaaaaaatcagcttcaggcatacatttgtgtttatgtctattccttgagaatgttacgttagcagtgcataaagtttattccataaaaagagctacaagagaattcgattttcaagagactcgatgcattgtgctttcagataaaaatcccaagag

SEQ ID NO: 1314 - DNA, 355 bp, Rattus norvegicus
  Genbank Accession No. AI234100
ccagttctaaatggctttattgatcagatgataaatcagcttaaacagcccatgcctacagcccttgcagaaaatagctgtacacagccttgtcccttttgtccccgtttccatccccaggagcattaaggcccagtttttcccctccctccctttgctcctgaccttggggcctggaagggatgggcaagggagcaaaggtttactaaaaaaagggggggtgaacaaagggtctgggttggaaaggaggactggggttcggaggaccctcaggaggggctagaacacagttttaccctgggctatgctgaaacaaaagctgtccatcccagcccctcgtgccgaattcttggcc

SEQ ID NO: 1315 - DNA, 512 bp, Rattus norvegicus
  Genbank Accession No. AI234162
acataactttactaggaagtaagggaaatgacataatggcttatttacttagactgaaaatgacactaacatttgttggttgggtctttattcttcaatgtaacatcacactattgttcagccctgccctgaggtaaccaaagcactggagaacaaaggcaaatgaaaacaagcctcttggggccatccttggtgctgagttcaggtgccagtgctgaggaagcccctcccaagccacagtctttgccagtccacatagacacagcagccaaggtctcaaggcctcagtgtccacgaaacaatgatggggacccctctctctgcttgcagtccactgttaatgccaatggtgggaaccagcacttggatccccacaacacctaagagtgtacctacctcctgggaacattacaccgcactagctccatgacctagaaaaggggcagagtggacaccaatcccagaaggagaaaagccaacttctgaagcagcacaggcttacctcagggcca

SEQ ID NO: 1316 - DNA, 449 bp, Rattus norvegicus
  Genbank Accession No. AI234620
ggccgcttccattttttttttttttttttttttttttgagttagaatcaagccaccagatttttattttcatgccataaataaagttccctatcactcccattttcttacaaatacatgaaatacagagaagcagaaattcatttggtgaacaatcagcttttgtatatctaagtgccaatgagataatgaagacctgtgaggcactgaaagtaagactagcacaccatccagtaccaagctcttttcatttcagagctagcagacagttgttggtgcctgtctttctggcacatcctggctagttattctagcaccacgagccaggcattgtggattctggacacatgttctagtgtagagcccagtctgttcaatgagaagaatcactactgagcaagcactgctgatagttggatcccagtcaggaaaatggaatggcaagaagga

SEQ ID NO: 1317 - DNA, 456 bp, Rattus norvegicus
  Genbank Accession No. AI234629
ggccgcttccatttttttttttttttttttttttttggtgttaaatacatttattgtaaactttagacacaaaaataggttctctaggccattcacatgcacataaaacccagaaagctgcaaactacaacaatgatataattatacaaaggatgacactgacaaatacagggctgttttccatgcaagtagaccagaagtagtatctacaaagccttatgatccagaagtgttgttactaccaaacctctgattaacactgtgaagtaagtgttttggaaggcagctccacgagttggctagcatttctttaaagcaaatgactgcttctaagcttagccgtacaagagattttggttggactgaaaatataagtacttcgttactgtgtgcagctctatgatggaccagcagattgttggcacaaccaccaaaaacaattacttccctcgtgcc

SEQ ID NO: 1318 - DNA, 559 bp, Rattus norvegicus
  Genbank Accession No. AI234678
cagtaacattgtaaggcaacaattaaccttcaacaagtcaataaagaagtggaaaagagatggacagacatgttcttccaacagcttcctgagtcacctaggctggcttgtggtctaacctccttcacagcaagacagggtgggggatcttagacatttagttatagctgctaaactggaaatgctgtatagaacagtcttccttaaaaaattaagaactgtaaagtcagttctttatgcttcttcctaatgtgctgcttgagtttatactcattgggggatgcattacttagacctggaactgtcttttgagaagagaacgacacaagtggtcaggtaatcttcaaaagggaaaggagctactgataacgacagtgtgctttttaaaagccatgaatactgtatgtaattacttgaccatttctggccttaaagcatgccctgaaactgaaccttttgttagtggctgcataataatcttaagagaaaatcaaaatcctttgcatagagaaacaacccaaagacagacagaaaaccatgattgattatactggaaaag

SEQ ID NO: 1319 - DNA, 349 bp, Rattus norvegicus
  Genbank Accession No. AI234748
cacataatcacttccctaatatacatacaacagaacacatttgtaatatttaacctgtcaaaccttgcctgggacaaacaagattctcagcatcgtttattattttacatatggataaatacagttctcaataattgccatgaatcaggactgttgaaaaagaaactgagtacattccgtctggggttatgtgtacttgtttatcttaacacggtcttctaactgttgatttacaagtgagtgtataactcatctctgggaggtcctgaaaagaccctgagcagcttacgtggttatttctagagctcttgaaatctgcagagttgacatgagacctaccaccaccagc

SEQ ID NO: 1320 - DNA, 282 bp, Rattus norvegicus
  Genbank Accession No. AI234753
caaaaaaaatactttagttcatatttaatggattggaccttttgactcaggatcagagaatgaatccagcatgaaaacaagatgaaatgaaataaaacaacaaaattccccaaaaaacagaaacaaactttttcccattgaaagggcttttccctgggggttaacttccattagtttttatggcatcatttttgaaatgccaaaaaaggggtttgggacgtagggttggctgttcaactaaaccatagggttaaattgcttgggaccattagctaaacccca

SEQ ID NO: 1321 - DNA, 660 bp, Rattus norvegicus
  Genbank Accession No. AI234822
ccattttaaaattattttattttaaattaaaaaaaataataaggacctcacacaatagaaatgtagagattttgttcatgtcacgttgacactggaactattaaagtgcaagttttgtgttttgttttccttttgggtaattacacacacacacacatgtaaacaagttgcctggctatgattgaaccctcacctctagccaaagtttccagtttgctgaggacagaggtggctgacagcagtcatggcaacaccaatcacagacgagataatgccctgttagtcctggccccacagcaagccggacagttacttgaagtctcagaggccgaagcccttcacacactctcaaagtctctgagaaaaacgccaactaaccctctgctgggtcctggcatcccagaatcggaggcgaaagtcccagtcttagctagttctttcctctcacagcagatgactgtcccttactgtcttggcagcatctccctggtgcacagggctgggtctcagggagggagggaggaggccagctggcgctcttggggcacggagtgcacaggttagcctgcgaaaccgatttgacttttgaacaaaaaaggtcctcaagttgtgtggctgactgaccctgggggctcctaactgatgacacagggctccttg

SEQ ID NO: 1322 - DNA, 574 bp, Rattus norvegicus
  Genbank Accession No. AI234865
aagatttatttattttatttactgtagctgttttcagacacaccaaaagagggcatcagatcccattacagatggttgtgagccaccttgtggttgctgggaattgaactcaggacctttggaagggcagccagtgctcttaaccgctgagccatctctccagcctaggaatatatatatatctttgatctggaccatgccttctccctgcagcctatataaaggacatgaaaggaggaagcctgcttcttacctgcttgctagcgctcttgatggtaagtaagtcagttctctcactagcattggaccacttcttagcattcctgcggttgagctttggtctttggctatgtattgtaatgttaatactggcccacaaggcctggtcaggaactagagagtctatgagtaaccttgttccccaactcatccctctctgactggtgaaaagatagagtctatagccttctacaggcagaagagagatttttgagttccgggcttggggttggaagaggagaaaaaaagaggacgaggaagaggaacaataatacgactggagaggaaggagaga

SEQ ID NO: 1323 - DNA, 460 bp, Rattus norvegicus
  Genbank Accession No. AI234939
cctcaagtttcagagatttattcatcagtgtaataaactcaaaaaaaaatcaacatgatttcatgcattcggagacatagttcctgcttaagtggaaaattgtgcggatggcttctgaaagaccttcattgtaagcagctttgcagtgaacttcacagtttaaaagtctgggccttcttttttcagtttgctgtagtccacgttcacagaatagaacttatattgttcattgggacccagtttgttaaccacagggaaagcacggtagggtccgactgcttggtagacggttcatctaaaaccaaaaggcccaggtggtcaggctttccatcaggacgcggcacctttaaaaatgcatcgatatccccaacagctgggataaaatcaggaatgaaaggtttcagtttgtggtccagatcaatcaactgaggtgtgtaccggctaatgtactcaaagagct

SEQ ID NO: 1324 - DNA, 597 bp, Rattus norvegicus
  Genbank Accession No. AI235047
  misc_feature (1)..(597): n = a or c or g or t
ggccgctcacttttttttttttttttttttttaaaaaacacaactgcagtttattccagccatgtttcccaggagcagagaaaagctacgctccccggggatagcctgtcggttgtatctactattttgcaagcctgaccttgcatttcgaacacctcaaacctcttgttctgtgcactaaggagaaaaagtatcaaatcgtaatttctctcgtaattggaagtagnnntttaagccgaaaggaggccggttttgccgtacagtcaccataacatcactgtcatcgagtaacacttgcccttcagggcaactaaaggtcggtcagctcatgttcctcacactcctcccccatttcctttaggaagtgaaaggctactacaggaaagcaaacattcaaaccatcaaaattcagacaagttatttcaagataataaaaaggggaaaacgtgactgttaggcctgcagagcacagaactgctggaacacagccaggatgtgaggatctaactctgccgtgaagagcaggttctccagggtcaccatgtactgctggattatctggtgatgctgtaggaagatctgctgcagcctctcgat

SEQ ID NO: 1325 - DNA, 193 bp, Rattus norvegicus
  Genbank Accession No. AI235135
cacggaacagttttatttgccaaccttttttgggggccactcactccttgtgagcaggattaaaaatgtccataggtgtcctctggttggatgcagcttgggtccacaagggggaatgctgaccagggcatttttaacctcaacaacctgagcaaaagtccaaactcacctccatttgatgttcttgccctcc

SEQ ID NO: 1326 - DNA, 511 bp, Rattus norvegicus
  Genbank Accession No. AI235192
gaaggtgtgtagcttcctcctcctttattggacacttggtagatgacacatagatctacactgttaaataattattaaaataccgaccaggactaggccctggcccagagctccaaaccagaagcaataaagaacgggggtgatgggctggtggtatttctccaacatcaccgaaacccataatgaggctcttgaatccttccagggccagagcagggcttgggccctggggttaacccaggcacccctggctgcatctttcagggcaaggtcaccagcaagggtctggagggaacagccagccgagtccagacagacagacccaaatggaaggagggtaggaaatggacaggcgctgtccagctggagataggatgcagcgaaggcaggctgaggggagaggctgggggcagcattgcggcagtgcgggagtgcggccccagggtcctgtcctgagtggctggtcaggtgtcagctggcagtctccaggtggcattcctgacccaagcct

SEQ ID NO: 1327 - DNA, 572 bp, Rattus norvegicus
  Genbank Accession No. AI235210
aaaacgttaacactttattattattattattatcgtagaaggaattcaccaaaggcttcaaattatgctatggcatctttaattataaaaataagcaaataaaataacttgcatctgtcattaccatgatatgtttcataacttttatatgcacatggagcttaaaaatgtaatttaacaataaataatgacatataccagatatgctcactgtttattccagtactcagccaaaaacctaaatatcatttaaattataaatacataatgcaaatataacggcacaaaaatgttctaaagtgcaaccaaatcacgagagagatcatgcaaactggtctaggtcagcccccaaatcactctgcagcaaacatgagaaaaagcgttggaagttcaaggaggaggtggagaagggcaggcagggtgaggaaaaaaaaagaagcaaaaaactagcaacgttgtgagaactgcttctttccatatgtgtagatatatgtattgttgatacatataccaatatcactgtggggagaaaggagggtataacacagcttgaagaggtcacagcaacaaat

SEQ ID NO: 1328 - DNA, 486 bp, Rattus norvegicus
  Genbank Accession No. AI235224
caccatttaagagaaagaaagatggaggaaaggtaaacagtgttcaggcttcagcttttgccaggggaaggcttcgggtcatcgagaccccaaggtattgccaggtgcacaaatctggattccgtggcaggcaggcaaagtgatcgctctggtagcccttctcagagcccatgaggatctgatctgtccacagaggctctccatggctggggtgtaggcgaaccggaaacctgtggcatttcccacagcgtcgaatcctttgagcatcttagtcatcttgatctcataacgctggtataaggtggtctcgatgatttctggggaacccatgaatttagcccttataaccaggtccgagttgcagaaagctgtctgtgggtgggttggggcacagctacaggctttactggaagctatcaatgatagcaacaagaggatgccagaggccagagatgcaaagggcgccatcgtggtatctctagcgtg

SEQ ID NO: 1329 - DNA, 442 bp, Rattus norvegicus
  Genbank Accession No. AI235277
gacagtggtggtgagagatttgattgagatgccttatggagtagtcgcattctgaataaagcaccacactgtgtcagtccgttcccacactgctgctaacacagctggtttgcttagggagtgcccaacttagccagatcaagggaaccccaagagagcaggggcaaatcctgcctctggtgccaagcctcagggcaggcaatcctggagaacactgccagccttgggaagcttgggagacctctaggctgttttcccttcttttcaaatcccacaatttcctgacggggagaagctgtaattagcccagaccaggcaacagatctcagctagaggtacagctgcagggaaaaccccatggaatcttgggaaccagtgtttttccaattacaaggaccgaggaataaactttttctgtgggttctattgaaaccctcgtgcc

SEQ ID NO: 1330 - DNA, 439 bp, Rattus norvegicus
  Genbank Accession No. AI235284
caagggcagaactggtttattctgatccccggccccgccccaccctccggcccgaccctgccctctacaggcgacccgcgtggattctgggacctggggggcggggccggggtccaggcgatgtcatctgggtcgcaggtcagtcagcctagacgggggcggagccgccttcccgaaagcacaggcgccgcttctgataggctacaaagctggacacagcccccgcaagcgccgccaggactgcagcgaccacacctgggattaggccctggggctggccttccgactccgccccatcagtaccgcggtcccccgctccgcctcctcgtcccccatgtccagccacatcctccaggtctcggtcagagattcctcctgagtctctgggtggcccaggtggtttcggatcaggcttgggccggtttcctggcctccgggg

SEQ ID NO: 1331 - DNA, 384 bp, Rattus norvegicus
  Genbank Accession No. AI235585
aaagaggcccaaaacaactttatttgtatatcaactttggctcccatctgactagcccaggatgagggcagcagaggccagccaaaaccagtcagccaataaagacatcgcccaggatccagagcggcccactgggagggggtatgtccatccccatgaagccactcaggcagatcgtctttccagcctgcgataccttgagtatgtacttctctgggtgtagttcaaagttttggcctcctagcttaaaggtgataatgggcaggctggacaccttctcacaagggatcatatactcgccctggatgagaggcactgccccaatggccttctgtagttccttcacctcgtccacaggccccaccagaagagacgtccctgtgt

SEQ ID NO: 1332 - DNA, 512 bp, Rattus norvegicus
  Genbank Accession No. AI235631
ccacgcctctcttcctttattgaggcctagagcccaaatcctgcaagctgggctccaggcccaggccttcctcagggcccacagagcccacgaagcccagggggcacagaagggaaccccctacacacaaggggatccccaacctgccgccccacctggcacacaggtcagaagcccctttggggctggtatcagatctagcttaatccttcttgctcccgtgttgctggctgtggaacttctgatgcaccactcggagggtggtgaaaaaattgccaaggaagaggaggaggaaggggaggcctcacatgagcacctgccactccttgcactcagggtgccgggccaagttaaacaatgtcagcgcattaaaaagctgccagaaatgtccaaagaagaggaacggaagcaggaaggtgaggcctctccacatccaagactgaaagccctccacagggaggtccatggtgtgtcgttcgcccagggctcgcataactagttagcatgccaaa

SEQ ID NO: 1333 - DNA, 422 bp, Rattus norvegicus
  Genbank Accession No. AI235646
aatcaaaaacatactttgttacagagttctcaagaaaggttcaactattttttttttttaagccacagacttcaaccaagcaaaagtctatataaagaaagtgggcctttagctgaccaggttttcctaagagcacaagctaagagtgggtccagagcaggagacagagctgggagtatcaccaccaaaactgtccccaacgccctgtcaccttttccacactggatctgcagcacactggttttcataacctatagggagtcatgcttttaagtcacatgttagatgcattgaagaaaaaaccctccccatttggagaggtttgccaactctatagtaagggagtgaagctgcttttggaagactggactgccacttgcgtgcagctcgttcagcaatgactttgcccactaagtaacagg

SEQ ID NO: 1334 - DNA, 571 bp, Rattus norvegicus
  Genbank Accession No. AI235689
ggctgcaaagattcaaccatttaataacaaaagcttcccacccttactcctcgacagcatcctgagcacaggaagggcacagctatgtaggaggctgtagaaagctaaggaaaatgaggatgtcagatggattcctgggttaagactgggtcgggcacagtcccctttggccagacaatggcatgaaccacacaggagcttctgccaagtccaaatttcagtgagggacgactagagctcacacaggtcttgtcctcttggcctttttctcagacctcacagcgtcgtcatgggctttcctcttctctgcaagcttgttggcctctcggattttgcgccgcttgccaaacatgatcttttgataaaggtacttctctcgcttcttcatcatcatgatggccaggcgcttggcctcactttcttcctcctgggccaaccgctgcctgtcttccagcttcacagtgccggccataacctggggcttcttccctcccataggctttgcggagcttccggacaaacaccttgtactctcggaacttgttgacgatgggttcatggaggaggaatt

SEQ ID NO: 1335 - DNA, 587 bp, Rattus norvegicus
  Genbank Accession No. AI235692
cctttattacataaagccagcactgctactaagttcaactgactgtgcacctctacagtgttcagtgtcatgcctgtgatggtaaccatcatttccaagtgttgttgggcagtcccctgtgtcatccatggtactgcttctgtctcacacacagctggtaaactgctctaggcatttgcaccctaccaggccccagaggaaacataatcaacactctttccagtctactgtaccagacacagcagttttgaagaagagattacagatcgaaagcaccttggcttatcagtacactgccttgtcatttttcattaataaagtagattacaatgaagccctaatttgcaatgtaattagttgttacaagacacggagcattctcctgaggatcaccatgatttctaagacagaaagttgctctacgccatctcccagcccagcgagcctcttgcggcaggtacagggcactgactgcactccagcacggtgctctggcgctttgcaagatgagcgtgaactttaagcagacgcgagtctgaaacagtctcatgacacatctgatagaattaagactgcctggcttagtc

SEQ ID NO: 1336 - DNA, 558 bp, Rattus norvegicus
  Genbank Accession No. AI235732
ggagttatatagaaaatttaagaactgctgcagtctttggtgttttatacagaatacttttgagggatgcttctgcagaggcacttggggaatcattctagcacctttagtataaatacagtctgaggacttcaccgggcagtataaataggctgggtcaaccccatggtctgctggacaggggtctctgagctttaggaataagttttcataacattcgtttgcttcacttttcttggccaggtagaatccgtggcaaacaaaagtcagacttggtgtctgctctagctgattgcttatataacattctatctgaaacttgtgataacctttgtttttaaaaatacagtagtcaggattgaggtatacatttcacaagatagacttgagtctcactccactgaaaatgctcgttttgtgtgccaagagctcataatggccaattcctccttcactctttgccttcgtagcaatgttcttaggttcttgtaaacttgaaatcctcctgtacatttaatgctcactttcttcctggtggacagtagggatagactgcag

SEQ ID NO: 1337 - DNA, 441 bp, Rattus norvegicus
  Genbank Accession No. AI235739
gaaaacaaatcatggtaagaatttactttgaagacaatgatagaaagttagtgttaaaaatgctaatgttcatgttttttgcagctattgaagctacaacctgatttgggtttgctattttcccggcttgtgtagagtcccattgcagggaaggcagtaagcctggtaggcctgtctgtgaactgaggtgaaaagcgagggaaggtgtttgcgagcatccaggtaacaggcaatgacatggtccttcaatacagaatctcctagacaccagaggtttcctgctctcactgtagaaagtcttctaccaacctgttgaattcatccgcaaagcgcaagtgtaggttatgcttgccctctggcatcaggtgcaaccatctggcagatgtttaaactggtttatgccgtccacccacttctcacaggttttggcaaagtagtcat

SEQ ID NO: 1338 - DNA, 366 bp, Rattus norvegicus
  Genbank Accession No. AI235745
caaagaacaaagcttttaatactaaacagtctttttggcaaaaaaagaaaagtagggcaaccgccaccctacagccctgaagaatgtgtgtcgtcatacttcggtcacctgcagccggttcagaggaaacgctcagtccaaaggcaagttcaagtccacaggtgaggtgggggtccctggatctctgagctgggcggagacttgagttgctcctgcaccaactgttccagacgctgggcaaccagggcatagaagtctgaagaggctgggccaggctctgaaccatagcagggacggaggggaaggaagcagggcctagaggactcagggggaggagcttctcgccccaggggacaagggaggcat

SEQ ID NO: 1339 - DNA, 456 bp, Rattus norvegicus
  Genbank Accession No. AI235912
aacttgtctgaggactttaatttgcagagatctcatgtctcacaggcagaaccagaggaagaccccagtagttcacagtttccccatggctggagcacaaggctgtgcacttcagccagcactacccacagctcagcctcctagcagcagcggtcaggactaaacgacgacactagcatgcactcagcaattctcaaacagagagtcatcgaaatgaggtatgtccaatgtgtcatttgttaacgaattcaatgctgaagtaggaaaaaaatcatcaaaaatgtcagtcttcatgggactccccaagttcaaggctcttacacaggcactgtcgatgactgaatgcagatcaaccttacactggcttttctcagggctgcagtaattatgctcctggttcagacatgtgttctgggaaacagcactgaattcgctaggtgctggtgttggggtgct

SEQ ID NO: 1340 - DNA, 673 bp, Rattus norvegicus
  Genbank Accession No. AI235950
cactgtcaccatttattaaagttttataaaaactcaggccacatgggagaaaaaaggtacatcccacaatatgaacaacactgtctagtgacttctcccccttgctctgtggcactatggtaaagcagctcctcacttcctacctgtcagacagcatggacatgttcctaaactggggcaggttgccttttctcctgagaaatcttagcagggtaaaagttacttgccagccagtctctctgtgtgagaaagttccttctaaatttcatcaactgagtagtaaggtttcttgaccaggcccagagacagctacagccctgctttttatctggtgtgcaacggccatgggcatgtgaggctttcagaatgtgcttgaccctttcctatgtatccatctcacttcatatctgctatctttcctgtgtccagacagcatgcagcccagtttaggaagacttgggtgggaagaggggttagaggcaaggaaacaatccttgtctcaagtctggtgcacttcatggaacatgagctcacgggggatggctgtttctgggccaaacttggttgctgcccggcgctcaaaggcagcaacgttctgctttacaacctcatcaaaaaacatggtcgccagcttggagtggagcagaaaacgaaattcaaaggaaatcgagaa

SEQ ID NO: 1341 - DNA, 482 bp, Rattus norvegicus
  Genbank Accession No. AI236027
gaaaggagacacaggaagttctttattgtacattggagaaatagccctgtgtgctggttcaaggtgcagcatacagaataaagaattaagaaaagaaggaactgggactggggtggggacctcttgaggtccaaagttgcaaacaaataaaaaaaaaaagtaaaagattcctcacgcaagaggcatttttttttttgcaaataccatgcaaaacaggcagctggcgagagccttaagagaacccctataaataacagaaaagacactccaagcgttccagtacgaagactcagagcacaggggagaaaaggaaaccaaaatgccttttggcgtttcaagatatttggcactctcgtgattacattgttgttgttgtttgttacagtccattaaagagaataaagtgacacgatattgaagaaagaggggttcgcacaacagacccccaaggggaggttagaaaaagctcgagcatgttttgg

SEQ ID NO: 1342 - DNA, 586 bp, Rattus norvegicus
  Genbank Accession No. AI236045
cattattcctaattttaatttgctgctcagggccttcttaggtaagggcatcacagcatttcacagtgacaacacaatgcctctcagcatagtcactcacacacattcagaacagcatttgatgccagcactctaatcaataaacagttaatgaaatgtggtgattttgctcatgaggcaatgaaagaaatactacaagggtctgactgctttttatatcctgagttttcatacataagacttaatttttattaaaacaaaaattcatattttaaaggtttgtcaaaaaaagttgcttatctatatgaaactgagttaaattaagaattttaactatcacaaaataagttcaacacattaggataacatcaacaacaaatgttgaactgattcaggtgctacaaatgatatcctaaagaaggatgtgtctggtccccacggacaaaggctacgttcccaaagggaaataaaggccccaaggcagcccatgctcaggacatctccccagttggccctgctcaagtcaggaacatggcttatgccatgcacacaaacttatcctagccaacctggcggctgcctccta

SEQ ID NO: 1343 - DNA, 476 bp, Rattus norvegicus
  Genbank Accession No. AI236048
  misc_feature (1)..(476): n = a or c or g or t
gaggcgagaagtggctgctttattggcttcagatctcccaaagagccggccccctggatccagtgtgctagccatgtctacttcagctctgtataagttctggggcagcacacgcacgctcgcacgcacgcacgcagccactgtctggatagtctatggtcagtggcacttgggaaacaggacaactgttctcggctcctcgaaggtggcgatgaggatctgctggggtgggggtatgctgaggaggtcgcccatgtctgagggtgcacagggacctccttcctcctcttcccgggcctcgtacaacgtgctgatgtggagcagggggtgagtggcgtttcggctcaggatggtgagggggtcagccttgcccangctgctcggtgacagggaagcagcagcagaggccgtggggggtgagcacacatggaatgggcccccagacggcagggcagactctgtggggtatgggaatt

SEQ ID NO: 1344 - DNA, 675 bp, Rattus norvegicus
  Genbank Accession No. AI236097
ttaatggcttgttttatttttttaaaaagctgatttttataactgcatgtagagaactagactttataaaatagtttcattctttatgcacgtggattaccttaaaatatggagaaccaaatcatttctttggtttttatctcatgggaaaaacgacgcacagtctcatcacatggctttgtgatatttatattccattgcacagatatgggctgtacaaattagtaacatgagttgtttcttaaattccaaacagttgtctaaaatcttattacagcagaggcctaggatattaaaacatcaaggctgaaatcctctaaagtagttaacacaacaatgagaaggtgaccgcaaatgctaacaggctaggcagcagggctatcggcatctacaggcaagtcaccgcggtcctcttagcgatgcaaaggtctattctttaggtacccttccctcatggaagtgcagaagtaacacaaaaatccagattagtgatgtcaagacagttatattcttcctagtatgtaaactctatggaaaagcaaatcttatctaggaacccatacatctgctaactcaaatgccaaagacaccacacttagaaaaaaggaaggttttggtttcttttttttaagataatggtttttaattgaattattgagatgaagagacagtgaa

SEQ ID NO: 1345 - DNA, 609 bp, Rattus norvegicus
  Genbank Accession No. AI236101
ttatttccctgtccaggaactgaccgctaaacgtaaatatccagcataaagaccttagcctttctggtcgtgggtggctacagaggtgggttctggagcccttgtcccaggcagtgaaatcctggggccacaggtagtgatgcccctgagccagtagctgcaagaggcagcaaaagacgacaaagagatggaagctaggcactcatcccagtcccagagatgcaaacgggagtgcaagacgctttgggccccacggtcagactaagggctggccaagctagggtgcacacatgtgggagaagtgttagcccagtacaccgggtagaggctgcaatcttgaccgctttgcctgatgggtataatgccttgccctcctgaagtgaggtgaggtggtaccggtaaaagagcaggcactgtcgactaaggacttgctgaagggcaagttttgagccttttgtgtgggtgcattccaatccacctcagcttttcaaaggctgatttggaaggcatcctgcaaccactggtcacgggcattgtgagtctggggcacggtgaggggtggagggtctgggggcaggctggcattaggaggcttatcggcatcaaaca

SEQ ID NO: 1346 - DNA, 612 bp, Rattus norvegicus
  Genbank Accession No. AI236146
atttaaatcagttttatttaagaatttccaagagtgacaactcttataaaaagcatccaagcacaggacacagaactgcagcaaacagcattcttatgaatagctaacagacatgagaacttccacccttctttgagacacctgagctcactggtgaactctgcttccaagttctcctgcaaagcacaccacaagctcagtccatgttcgcagcccatcagcttcagttcacgttcccacacttccagatcagtaacagaggagaacacacaccatacagcattcacagcagttgacagaggggagggaagtacaagtatttcacttaacacattcagctactgtgggtttcctaagaacaaaactcaaagtcttccaacagacgtggatgtcctctgatgcagaaacactcgtacgttagttatctgctatcattgctctctgcacactctcgcaccaaagccacaggattgagggacacatctctccaagttaaaaaatatccattttccaccaccaagtctttgcacgcgctctctccttttctcgctcatactagcctttcatgcctcggcaccaccatcaatcccacacaaggtttcaaaagttcaa

SEQ ID NO: 1347 - DNA, 495 bp, Rattus norvegicus
  Genbank Accession No. AI236150
cacagctcagttttaggtgttgagttctttggcgtctaggaagaacattctgttgacttcactaatgggaatgtctcttaatgctgggatggcgtcctcttggtagcttttcctctgttggtttttagcatagttatctgtgatcgtatggatggagtcaagtggagaggtactcatcatgttgattccaaataagagcacgtaaccaattacaaccgtgatcaagagatagacaggcaacgcaaccgcccagtacttttgaggccagtaagttaagcctaaggagtttagccaagattcgggaacgaaagcccacacaagatagagtatgaagccaaactgagagcttaggaaaagaacaaagccataaatcgctctttctggcaatggcgacggtgaattttccaccatcttccctgtggctttagacaatctgaggaaaagcaggggctgccaggcgcccccgccgcttggcgcaggcgcacggcgtccgca

SEQ ID NO: 1348 - DNA, 447 bp, Rattus norvegicus
  Genbank Accession No. AI236152
gaaaaggaaacatacaaaaatcatgtacaaaaaaaattaaccaaacatgtacagaaaattcattccagtatatctacagcagtgcatgtacagtattttacaggctgggccgtccctccccgctcccagactcctccctcttctgagacttcccccctccctgactccccatcttcctccccagcgctttgccctggggactaaggctggggtggcttccgccaatatctcccaccccccaaatgaatgccagtggtcacacgtgctctctctaaacctatgcaatgggatggatggggactgggggagtggtcccggccagagcacaggattcacagtctggacccctcctggacacccccagatgaaggtgaggcaggcattgctcaccgtccgccggcggctcagggaagatggctgggcactgggttgaaaaggctttcacat

SEQ ID NO: 1349 - DNA, 534 bp, Rattus norvegicus
  Genbank Accession No. AI236168
ggtaacaaaatactttattggtaccacttaatgtaaaaaatatagtaatgctttcaaatcttagctcccatcttcaaataaaagctagttttaaaaaaataggagttaaagtaaaaatcatttgattatctcaaaaccaagctgaaaccacctttataaatcactaagtaccctaactttaaataccatggtcactgctctttacaataaataagtgtgtacaaaggagacattggctctgcttattctgcagagagcactttatacatcttaaaacacctcgcactcccggagccctcagcagttagctaccattggagtggactcaccttagcacctagagatttggcatttgtcacgtctgaggtggctgatttactgaaccaaacagtgactttccgagttcgcatgggctatatacaaatagccctgtaagagtcaagggctatgaaagcaagcccgccctcgccgtagtgccagttcctgatcaagtgatggccggatgataaaatatccatgtgtgataaatattat

SEQ ID NO: 1350 - DNA, 575 bp, Rattus norvegicus
  Genbank Accession No. AI236332
aaaaaagaatcaaaacagaaactctaagtaccagtgtgtacattgtacacatttaaatgactcacaagaatgaagttttgtttttcatatataaagatgataccaccttgttcttcatcaaaagatgttcaagaattctgcctccaaaccacatacatgactgccattttaaacagaccgaatttcaaacatgcaacaacgccactggtaataaagctttggaatggatgctcactctattatttcactacaaacgagatagaaagccggcgagttggaaattttattctaaagcacaatggaggtggtcattgtctataccggcacacctcactcctctgctgccatttttagcaagtattctttgtcaatcttgaatagtctccatccctcttcactggacagatccgaagcacctcttcttttgtagaagttgatagatggttcattccactctgctaccaagaagtgcatactgctgcagcgacacttcatagcaacctggcttagattcttcaaaatttctgatcctataccaaagcctcggtaatcactcatcacaaagaagtcttcaa

SEQ ID NO: 1351 - DNA, 552 bp, Rattus norvegicus
  Genbank Accession No. AI236338
  misc_feature (1)..(552): n = a or c or g or t
cgccttagcatttacttctatcccatattcttggaactgtcttcaccagagctcaacgggagatggcaaagatgctggctctccctccaagaacagctgtggagctgcctgggaagattcacacgtcaagaaatcgggaagatgcggcaagggtgggcagccgcctgtagtcagccagcatctcttagaacgggctgggttgcagcccaagtctctcacagaggtgtaggcagtgcctgcacctcctccaggcacttgtcataggcctcctgatagtcttcatggggcttcaccatgatcacacaagtgggacgttcgatcctgtagctgcacccaagtccgtcttagagggaatatagacgtagggcaagttctggtcctcgcacataactggaagatggcagtacacctcaatcggcaacgtatctcctgccaagaccatgatccctttctcgcccttgttgacaaatttctgaacttccttcaccccgcgacgaatctgcttctgctttacggccttcttgatgcatttgtnaagcttgcgcgtcaggc

SEQ ID NO: 1352 - DNA, 500 bp, Rattus norvegicus
  Genbank Accession No. AI236366
gacggacgcaagatggcgacggcaactatagctctccaggtcaatggccaacaaggaggggggtcggagccagcagcagcggctgcagcggcggcggcggcagtggtggcagcaggagacaaatggaaacctccacagggcacagaatccatcaagatggaaaatgggcaaagcacaggcaccaagctggggctgcctcccctgacgcccgagcagcaggaggccctccagaaggccaagaaatatgcaatggagcagagcatcaagagtgtgctggtgaagcagaccatcgcccaccagcagcagcagctcaccaacctgcagatggcagctacgggcagcgggcactggctatcatgtgccgggtgtatgtgggttccatctactatgagctgggagaagacactattcgccaggcctttgctccctttggccccatcaagagcattgatatgtcctgggactccgttaccatgaagcataagggctttgccttcgtg

SEQ ID NO: 1353 - DNA, 319 bp, Rattus norvegicus
  Genbank Accession No. AI236397
cccaaaaagccatataattaagaccagttttaaagaaaataaaaggaaaatcagaggcatcataaataatatgattaggtcacagttcttcagtggtcgcctttttcctgagcttcgggacagggtgttagtcctgtggaccctttaaaagctgtgtcttgctggcgggtaaaggacatccggctggcaatgaggctgagctttttttcagcactggcatttgccaaacagctttggtagggaaaccacgtaacctaaggaaggcttgggagttctcaaaacccaagccagcatgtggaaaaggctagcacacaccgag

SEQ ID NO: 1354 - DNA, 460 bp, Rattus norvegicus
  Genbank Accession No. AI236402
  misc_feature (1)..(460): n = a or c or g or t
atagcacagtgaatattgttacctttatttttttttttaaagaagaaggtacaaatggctagggacatattacagggggaggaaagatggtgttatctctgcagaatacactttcatgctccacgggaaagggaggaggaacctcaggaccaatctagagacgtgtaagcaacatctctgtggcttctggggatatggccgaacaccagatgtgtctcaaactgtggataacccaagatcccttcttcccttgccactcctgtctacccaggttcccaatctgagtcctatccacttttctttctttctctgtttctgncttgagactgattcccacaagttttcctggccctcatattcattctcattgttgggtctactgacatatgtctttgaatcaaggaatttctttcagcctaaaatctttcagctaggtcctaaaacccccctcccactcccc

SEQ ID NO: 1355 - DNA, 403 bp, Rattus norvegicus
  Genbank Accession No. AI236460
agagtagaggaaaatctatattcattaaactaaaaattattgtctattcaagttactcctgtggctactcggggcacatattttactgagagaagaatagtcaggcttctatggaagtctgtcccaggggtgagtctgtcctgagtaggatatgaaggaatcgtgtattagtgggtctgcagggaaggtattgtcacttagtgagggcaggaaatgggtggtcacttagtaaatctacagggaattgaagagaatttactggatctgcaaggagggatggtaacttcctgattctgcaggataggtatggtcaattaatgagtctgcagaaagggatgatcacttactgtgtctgcaggaagggatgcttacctctgagtgtgcagaaaggaatggtcactta

SEQ ID NO: 1356 - DNA, 526 bp, Rattus norvegicus
  Genbank Accession No. AI236590
tttttttattttttcacaaaatagaatactttttattataaatttcacatacagaagtacaaaccacaaataggagcctctcgattgacatcctcagaaaacctaaaatacaggtacaggagacactttcccaagggtgctttcaaatgctcaacatcaatcattgaaatgccccacgagctcgtgcaaagaggcctccattcctcctccagacactgaggggagacccattttctttatgactcaggaccctggggtgtgtgccctgagagggaccatgacattgtctctgtgttaaagaacttgagaggaatttgcaaaccgcactgctggggagaaaacaactgatcctgcagctgggttgtggggtgaagccaaactgcttctcctttttttttttaaatcttcagtttgctaaaggcccaaatgctatcacattaggggcctttctagactttgctttcaatgattggagaaaagagaggagaaattaacaatgccatcatcttttgtgggggtgggggag

SEQ ID NO: 1357 - DNA, 625 bp, Rattus norvegicus
  Genbank Accession No. AI236601
agaaatgacaccacagggtggactttattttaaagctcacaaggtgttcacaatgatcacatgatccacacgtctcccgtgtcacacctccacgggacagtgcatgtatggtgatagttacagccctgcttcgcatgctgctacggttcactagctgttgtattcttggtaataataaagcaaatcactctactggacagacttaatttggaaagcccttatgcagatcagactcagtctcatatgaacaaccccggccacacatgcggaaatgaagagcaaatgcagaagaacacagaaaaccccttggcaagaacagctgctgcagactgagcccagcgctgtcagtgcagttcacgtcctcagaagacaaacgacctccctcctcagcatatgagcagcaatactgtacagagctcagtggggtcccaactccacaggagcctgtcaccaaagtcactctcatttagggtcagagactacagactcaagctttttcttttttccctcataatacacaaaatgtctagacagtctttaaaaaaaaaaaaaaaggaagaaagaaaatataaatagactcagtctgtcatacagaatcacatacaatggcaaacacatttcatga

SEQ ID NO: 1358 - DNA, 550 bp, Rattus norvegicus
  Genbank Accession No. AI236613
aaaattgtttattttaaaacatgaaactcaagctgaatagagaccacagaaattacatggacaagaactttagttatttgccaagaaaaataaagttccccaaagaaaataaaaatcaaaccccaaacccagtttaaaaatgaaagcacagcaacagtaacacacagccatggccctacggaggctggaggggaacttggggctggctcgattcagatgacattgtccactgggggcagatgcaggcagagggaagtaactgggaggcaaatgtctcaaaatcatatacaggaggaagtgtgcagaacaccgctcttgtgattaaaaacaaagaaagagaccctggtcacctgtggcccaggagctaaccatccaccttctgggcccggcagagctgggacctggtagggcagacattggagctagggtcaggaattgcatagtgatatagggtgggagggcgggcactgggaaaagggcttgaaggatgctccaggccaggatctcccactgctcacataaactcgtttgctggggtggcagccttcag

SEQ ID NO: 1359 - DNA, 458 bp, Rattus norvegicus
  Genbank Accession No. AI236635
acccatagttcggttttattcggagtaatggggggaaaaaggaaacttctgctcatagaagaaactcagccacaggtctgatctgtactggaactacacatgcagtgaggacaaggctgtgtttgtctactgatctctaatattaacaattataaacagagcagtgcaactagcatttggaacaacccttctagtgttacagtgacaggcacagttcacttctcttcacaccactggttctctttgcgtacctgggcctcctcctcttcagtaaagtcatttttgatattgaaggttttacgaatctcctcaggcgttttccccttaatcatattagccacagtcttgcaggtgacatcaagcaaacctttgatgtctaagtagtttgcagccagaataagttcaaaaagtgttccttggtcaactttcaggaattcttggtcccaaacagggaatat

SEQ ID NO: 1360 - DNA, 652 bp, Rattus norvegicus
  Genbank Accession No. AI236753
cactacaagtcattttaattctaacacttatgtcaacatttacagcataaatcactcatgttataaaagaatcattccttcatctagaatgtgattgaaattagatattggtaaacaggcaatgtaaatacctcagtgtttgcctctgatagtttgcaatgaccaagacatgatactatagcctcatcaagtgcaactttgtacatgtctgatgcatatatgttgtgtacatgttgtggactgagaggacatcttcaggcactggtcctcacctcctaacttgagataatcttgtttgctgttgaatgcatcaagctagctggcccatggtcaaattttcttcctgtactaaaatgtacggcagcaatgggataaatcttaggttaacagtatattcagatgcactgtgtatagcaataaaaagctccagtgatgttctctttctaaagacacactgtccttctggggaggtgggatctgactctaatctggcaccatgtctagctcattttacaaaattaacctttacaaagatctacatcagcatctagaagagtcaccaatcaatgatcaagaaaactgttatttgcttttctttctttttgactgggtaatttccttaagctacattattatgggctaactggaaaac

SEQ ID NO: 1361 - DNA, 570 bp, Rattus norvegicus
  Genbank Accession No. AI236754
ggaggcacagctggttttattgcagatctgatggtgaaaggttaggtctgaggtcttcctagttggacactcagctggccctgtgactccagcacacaccgacagcttcaggggtcccaggcccctctggtctatggctactgctcccaccttgggccttgactcgcctgaggatagggcggcctgtgttccccatacctctggggcagatagtcccccatccacggggctcaagtcttcccctcctgcaggggagactggtccccgcatggaaaatctttaggcgggctcatgtgccactgggctatggtgagccctcttcctcctcagggattgggtgtcagagcatcaggctagtgttaaggtggcttcctggtctccttcttcagcagggagctggcagcagccagggctccaccctggacgaacctcacaaagttgtccccagccaggggccctagggcatacaggccctcctgttgagtgctctcatgggtgaacgggtccacatcgatggggttcctcttggggctcagtggctgactggggtctatggccaggtcagcccct

SEQ ID NO: 1362 - DNA, 655 bp, Rattus norvegicus
  Genbank Accession No. AI236772
gaaagtgaaagaggctttattttcaatatcatataagtcattccatttaatatttatagtgcatagttatgtatgaaagcatacacggaaaacattaaaaaatacccaaggatgcgcgtgcacaggcaaagaagacagcctttgtgtctatagcaagctcagaggtagcacaagagagtatccatctggtaacattggaaatcatgcaaacaactgagtcaaggcatggcattaaggtgacatcagcatgagttataattccctgggtacaaaacctatatattctttgggtttcaaaaaaattaaatgaatggcctacttttatcttctggacaaaaaaacaaaaaaaaaaaaatctctaagagcaaagtgcacatattgtcctaaccacatacatataaaatattcaaggccacagatggaggtcgctagatgacaaaagaggatactgagaggtaaagtaaccagagagagatgcaggagggaaaggcccctctgcctccatgggggatgcaaaggcttaggcactggaacacccaacgtggaccacactgcctgccacaaggaactcctcactgagctgacgtcaccatcatcaaaccgctcgacaggcggttgtaacttcctttacatttcccatgggggacaagcatgg

SEQ ID NO: 1363 - DNA, 428 bp, Rattus norvegicus
  Genbank Accession No. AI236795
attttgcatacttttaatttcagaacaaaataaaacaaacaaaaaaacacaatacacaacacccaaccctgctattctgtgggaggggatcttcctgccttaaggcacaaggacaggatagaagagattcttgtagacatgagcagagagccaggtgggtcagggccagtcaaggctgttgggggagccacagggatactatacagagggcgggggcttcccaggagcctttaatccacttcttccatgcgagaggcatcctctcctctaagtactctgtctggtcttctttgaggtgaaggatcactttggtaccccggccaatgggctcaccgtggtctgcacggacagtgaaggatccaccagcagaagactcccaggcatactgctcatcatcgatgtgcttcgtgagtgtttcttcaccacct

SEQ ID NO: 1364 - DNA, 458 bp, Rattus norvegicus
  Genbank Accession No. AI236856
aaaccagatttaagattttttttttttaattcaaatcgacccaaagcaaaacttacattacaaagaaagaacagaatatattatgatacaacacactgggagttacatggaagctaaatttgtgggcaaacggtcttgtcccaaccccatcctgggctaatgggtgattcagggggaagttagaaactctttcgcacggtccactctggtgattaagctacgcttttctggtgtcttacgaggggggagtctgacaggtcatgctagcctcccccatgctccagaagtgactcctgccactgccggaatgctgacttctccagcagaaacgtcggtccaagcatgactgataatgaattaaaaacaaaacaaaaccaaacaatcaagtcatccaaactaatgagcagggttattctgtagtaaatagtttagaaatatgggaattaaataatctaaaa

SEQ ID NO: 1365 - DNA, 410 bp, Rattus norvegicus
  Genbank Accession No. AI236989
atatactacaatatataataaaatgccatctgccaaaataattttatcacttaacaaaacagagcaccacctaaaagtggttttttttttaagctgaacattttctccagaaggagaaagttttttgtttgtttgtttgtttctcacatgggaaagttaagtataatatttaaaaaggagaattctgtcaaaaagacactgtgttggggaggagagtctgggattgccatgtgaatcacattttcttttttctcttcttttctgacacgtttgccattttcctcttcttggctggcgctgggctatttcttttagttggctgctggctgccaccagtgtggtcagatttctctgcattaggtgctgacgcttcttcctgaattttgtcagcagactccttttcgatcgtc

SEQ ID NO: 1366 - DNA, 469 bp, Rattus norvegicus
  Genbank Accession No. AI237002
taaatacacgtgtttttttgttgggtcacagggcataggtggtgctgtacagagctggtataggcgtggggtggtgttacagtggcactggattcagcttatgtcattcagggcctgtgtcagctgctgcacgggctcccggaagttggtgctcgggtttttgctacacagcatgaagccgatctggccactgggataggtgggaatggtacagtaggcatagctcaccacagggaagagagacttgcagaaatgcctcatctccttgatgaggtccaggtgcagccactggcactcgccctggcaacagaggatgccatcttctttgagggctgtcttcatgagctggtaataggactccttgaagaggctctcagcagggcccatggggtctgaggagtcggtgatgatgacatcaaaggcatcttggttctgcttcatgaactcaaagccatcgcccacgtggaga

SEQ ID NO: 1367 - DNA, 560 bp, Rattus norvegicus
  Genbank Accession No. AI237212
ccctcagaataggtttattgaccacaacaaagttctatatacaagtgacctagaccatgacaaatgctaaatcccaggatataggagtttgaagcaggaagaccataaatttgaagtcagcctgggctacacagttctaggccatgagggatatgatcctggactacagtggctgtcaccaaagagcagagtgacaaaagcccagacaaggccaccacactcctaactgacgtcttggtaactgactgtcatattaataagaagtccacattggacattaagtgaatggcccgatttctggaactttaatagttttacaagttaactgagacaggcatgactgaatcccggtgggagaccactggagagctggcatcagatgtcaagaggccattttgtgcacagccactgtgatgccatcgtgtttctggatcataacattcccgttatctgactctaaacacactacagggatgtcggtggggtcagaggtcagcttagctgcctgctgggcgagaacaggtatcactccagcatgctcatccgacagggtaccacgg

SEQ ID NO: 1368 - DNA, 472 bp, Rattus norvegicus
  Genbank Accession No. AI237535
aaggcaaggtctctgtcattagggctgggagagatggtacagatcaagccaaacagtgaaaaataaggcaaactgtagcttcgggttttgagcctggcaccaggaaggcctcttcttgaggaagagggggcaggcagtggcaaatcagcagacgagatgcaaatggagtaacaatcacagttagtggggtaacgagatcaggcggtaaacccttaaagcaacacccaaggtccacgtctttgcatgtgcagggcacaactccagcagcagtttctgggtttgggggtttgttacttttccgactttccccaccccctaaaagacacgaagacgagctcatgaagagatcaaggaagggacgtcttctggctgcgctgggcaagggttgggtgacttccgggagcacttgtctaccttccctgtggctggccgagtcctacaaacgtttgtaggtgcccaggagcgctttgca

SEQ ID NO: 1369 - DNA, 530 bp, Rattus norvegicus
  Genbank Accession No. AI237586
cgcagcacatgtattttattgaatccactatgaacagccatgtgagtttaacatttgcatatgtgtggggtaaacaggcaggactaaaactagagtttggggcaaactggaaggccccaaaatctgttatctaccgtgaggtgctgcaagatggctatgttcttttagtggcgtaaagaatgatcgtgaggatagccatgaggatggtaaagatcacggagctgatgttcaggcacttggcagtggaggcgtaggtcttggccccagtcacatcacccaccattttcctgtccctagacttcacagagtaggaatacgctatgaagcccaggcagcaaaagttcatgaagagcgtattgaacagggaccagaccacgtggtcaggcgtggagatctcagcaggcatgttgattgtggtggttgtcgcaaaatttgaggtgtggggtcctcccaggataaccaccttttgctgttccttgggcatctcttggcttttgaggatacaggcttggtcctaggagccctacaat

SEQ ID NO: 1370 - DNA, 592 bp, Rattus norvegicus
  Genbank Accession No. AI237713
tttttaatattgaattttttaatgtaaaaaagactaagtcaaaatgcactgtggcacaaacacagaagcacgcacacataaaaatatggcactatttccataatcaatgcccataaaatggcatcagtacaaaaaatctaagcagagacagtagattagtaattagagcatcatgtagcgttggttttaggaagaagcgtcacaggtaaaagaaggagcatatgacataaactcaaacatgcaattcaaatttacaaattataaaaattcaccgcttttatagctggtttcttttgaatggctaaattttagcctcatttttttttcaattaaatgcctgttaacaaaccaattggacaaactcatttacccaaatttacatcctagaatatgtaagtaaactgaagacattattcagatgaataagttctattcattttcatcatctctgtgatcaggttgcaaaggacatgcttttctctttgcttttcctaagccactgcttcctgcttcttcaggaatctgggtttcttttttagaatctttaagggacaacctgaagaattccccgatgcctttttgccacttggga

SEQ ID NO: 1371 - DNA, 452 bp, Rattus norvegicus
  Genbank Accession No. AI237724
aatgatccagccatttaataggaactcacgaaggcaaaagttccagggctgcccacctcacccctccactaaatccagatctacattggccagaggccatctgtgcagccagggagaccagacccagctggaaggtgcttcaagagggaagggtatggttaaaagaaaatggggacagggtccccaaagcaaagtctttacaaaagggggttctcctccccacaaaaaagtgtcacataagctcaaaataaaatataaagtaaaaatgctgcattagaaaagtttgcaatgttaagcctttacaataggagactggccctcaagtgtcaaacatccagtataagtccatggaagtgcagcctatacctaaaatctatgtaagtgttgcattgaaaaagtaaaaaattcaagatggcctgtatgtagtgctttggggcccatgtggaggcaaa

SEQ ID NO: 1372 - DNA, 528 bp, Rattus norvegicus
  Genbank Accession No. AI237835
gcccagccctatctaaacataaaataaaactacaggactgaaattaacaacccattaaaatcggcaataagttatgaaaatcataaagcttttttttttaagtaattaagggtagttaaattatttaaagaatacaaagtccgaacagcttggggtaaggtatccagaaaggcttcccggagcaaagcagtggcccagagggaaaccttcgagtttgaaaggagggagcacatgacatggagtgcgggctggaagtctcacccagaagataacatttctgcaggtatttgtgagagcaacagtagcacctgcacagtgggattgtggggaggaaactgcctgtagaaaatgcagatctttacattaaatgagacaagtgcggaacataactatgttaactaggatagtgtgcctaccacgggtatcagacggttaaaagctggtaaaagggaatggtcctaaagaaaacaaaaacagcattgccttcgtctacccagcccagacctcatccgtcctgcgcactgaaaa

SEQ ID NO: 1373 - DNA, 381 bp, Rattus norvegicus
  Genbank Accession No. AI638972
ttggactataaaggggaaaagcataatttatgattcaaacccaggctgacgagaagcaagagacagaaacttacatttttatggctttaaattcagggctaaagggaaggggttcaggtgtacccacacacggccaaaaggtacttgaatccacgttgaccttttatttgctggagcatttaaggttatgttctaacacaacatttgttgaaaaacttcgtaggccaaggaagcaagaggcagtgaggaaggctggctgggcaaaatcgattcaatctgcccatttttggtatcctaataaataatgtcagtgcagcgcaggggccaaaaaaaatacttttcacctaatacataaagctttagcttgttagggctgacatg

SEQ ID NO: 1374 - DNA, 358 bp, Rattus norvegicus
  Genbank Accession No. AI639017
ttgtttattaccaaacccaacatttattgagagcacagaaaatcagttggcagaggcccaacttcaatgagcgaactgaggccaggctcagtggggtaggccagccctgaagtcactcactcccagtgagaaaccagctctgggagaggggctgtaaaccttccaggccttactggggtcctccgatgggggaatgtctgaggggcagtgccccggcctggattttaacagtcctcaggtgttgatggggggcagggagctgaggtcagggagcagctccgggtgggggtccagacgggccaggcggctctgctccagggcgatggcctcagctgaatgcttgcacttctcagagcca

SEQ ID NO: 1375 - DNA, 442 bp, Rattus norvegicus
  Genbank Accession No. AI639082
ttcacagaacaattgctttattttcacgagtaaaagcagtggctggaaacaggaaaaagcaattcccgcagtcacatgtatgacaaatgcagcaggcttttcctacacatgaaataaaaagtctttcagaaaacatgattgggatccaacttcaacaggacaagcacaaagtgcccacgcatgtgccagcatgaaatccacggccatgaactcagctgtctcttctcaactgtccccaagcatcgctccagaaacggtctcagtgctgcccaggtcccggctaaggtaggccacccccggttcctggccgtaagtcaccttctatatctcaatcttcaagcaagtagttcgggttgactaccaggtaaggatcttcctcatagctctcgcttccttcactggagcctttcagtccagcctgggtgagctcaatcagaacgtg

SEQ ID NO: 1376 - DNA, 460 bp, Rattus norvegicus
  Genbank Accession No. AI639107
ttacaacagaggatatagggcagaaaagagttagtcagagttggagatcagggggaattctgggaggatctagggccccatggacttctgccttctgcagcattatgagagcagacctgcccctcctgctgtgagcccaccagtgacagtggcttctgccccaaggccagtaggaagagtcgctcctgatgactgtgataggcccagtgacaggcagatgaccgtgataggcctggtgacactcggatgacaatgataggcccagtgacactcggataacagcgataggcccagtgacactcagatgtagttttgaaacctcttttcatttgtgaacttggtcatcaataattatgtcaccaagtttgtgactttgacacttggtactgagctgttacatgggggtattctgagggtttttatattccctctgacgattgttacttgaagaacagttgat

SEQ ID NO: 1377 - DNA, 413 bp, Rattus norvegicus
  Genbank Accession No. AI639108
ttattaaaaaaaaaagttttattttggtttacgtttccagagggatgaatccatcaaggcagggaggcgggacagcagggggcaggcacagaagcaacaggaagttgaaaattcacatcttcaaacacaagaaggaagcagaaagggggggtgaggagaaagcagtgtttgatatttcctacacacacatgtcaacattcaccgttcttagaccactgagtcaggctctgacatccttctgagcctcacaagggaatggttttgccattcccatgaggccatgcactgaggtactaaacatggctgtggccatgtcaacaacatagccccactctggacctcactctagacactgtaaagaggacaggaggaccccatgcatgtaactatggggaaagctatcattcgcgctg

SEQ ID NO: 1378 - DNA, 383 bp, Rattus norvegicus
  Genbank Accession No. AI639139
ttgattttttaaaaagcctttttatttgaatattcatttcattaactgtacataatcaatattccttaagagggaaggagcccttttccctggtgacatgggtcaaactgcatgtacggatccaaggcggcaaacagctctcgagcacaggatcttctcaagtaccaagcattttcccggtcctatgctaagaccatctaagaacaaggacagactgtacttagaagctgaagtgttccctgaagagatcacgacaccactcggcatggtgaacctaatgttcaggcacatgcccctgcctcagtgttctctaaattcaagcaccctcctcctgtcagccacgaccggagctggggtgacctgtgactcatggctgggatctt

SEQ ID NO: 1379 - DNA, 393 bp, Rattus norvegicus
  Genbank Accession No. AI639167
ttgatgctgggaattgaacacagggttgtaacgctctatgacagctacagcaagcacgtctcatcctcagctgttcaacttaactgcaaggccagtatgttcctgtcgtctcaaagctgcacctggggaagcatgagcgatggcctcagcctgcagcaagtggtggtcatgcctgtgcacaacaagctggagcggagattggtggggcttgcacacccctttcatccgcattgctttaaatactggacacagcctttgcacagtggcccctgtggccacctatgaacactgcaagtgtagtaaccggatgtgtgtgggcaaacaccttctaaaccacaccagtgtacccgatagccagagcctaggatcacagtatagagaggtgactcaggg

SEQ ID NO: 1380 - DNA, 379 bp, Rattus norvegicus
  Genbank Accession No. AI639195
ttggtttggggggcaaaaaaaaaggtttaaaaaaataaaaggggggggggggggaagggggaaaaaaaaaacaaaaatttcccctttggaaaagggaaaaaaaagggggtcaaggaaataaaaaaaaattttcatgattgggcgaaacctcattttcgaattaagaaaaaaaaccatcttgatgtaaagaaaaaaaaaatatttttggagaattcgggggatttaaattaaaaaaagattttgtgggggaaaaaaaaaaaaattttccacccaaaggtaatagaccttctcatgctgggggcaaacaaaggggggggaaaaaaaaaaaaaggggggacttgtgttttacaaaaaaaaaaaaaaggacaaaggggaaaaa

SEQ ID NO: 1381 - DNA, 568 bp, Rattus norvegicus
  Genbank Accession No. AI639231
ttcggagaggtgacctttattcgccaataacatgcaagtgaaggctcgagaaagcacaggagaatcacattccgacggacaggcacttacactcccctgctggcgcacacagtgaccgctgagacctcttaacctggccctttctgtctcatggtttcaaagtgctacctctccaaactgatgcggcaagggtctctcgtacctcactgacctgggcaggaaccactctgaggctattacttggactttttgcaatccttagtgactttgattcctttggatcgccaggactggcagctgcttccactagaggactcaggctcttctaacagggaaggttgtagccagttggtccaggaagagcctggattctcttacaggctggtggcccttaggaaaggctcgtgggggcagaaggtgctgctgcaacagggggtgtcacccaagttttcagatacagaatcctcggttgaagcaagcagacactcattacactcccatttcttgctgttgggtctaagagaggagcagtcccagtgggttccgtgggatccacatgtcgcacaca

SEQ ID NO: 1382 - DNA, 458 bp, Rattus norvegicus
  Genbank Accession No. AI639233
ttgaatgcattttttaaattttattgtttttcagtatgacagtgaaaattttacatagcccatgttgaacttagatattcaaataagactttaccaataataaaggagattaatacattgctagagttctacatttgactttatgtcaaaagagtcaatttagctctatgaattacagaagactttgtattctgttccttttagctttattaaatgttgacatctatgattacatcagacttcgatacctcagttcacatctacagaaaattttaaaagtgattctgaatactacagataaaatatttttattgtaggtaattattcaatctgtatatttggcttgatgcatgataagtcatacgggaaaggcatccgcgctatacttgaatttccagaatctagcattctttctttttcaaaatatttttttctttttagcaataatattgacagat

SEQ ID NO: 1383 - DNA, 260 bp, Rattus norvegicus
  Genbank Accession No. AI639242
ttcaggggatgggggtttattcaaatttaaaactcaagggggcaacccttgggggtctgaaaagcaccacccaggctggaggaagaggccagtctgcctcaaacatgtaggaaacgggactttttctacttaccctaaaagcagccaggaccgcagttcctgagcgctgaggtttttgcgctgccatcctgtcaccaggcctaacactttatccttgtggccagaactgccaacagtttttcccaaaagccagtcagccc

SEQ ID NO: 1384 - DNA, 528 bp, Rattus norvegicus
  Genbank Accession No. AI639285
ttcctatcttctcattgattcgtgaatttctattaaagataaatatcattaacaaatcacaaacacgtacacccgctcccaaaacacagtatagtcccctgtagaacctcctccacatacaggcaagtgacaattccaaactccagtgacatagacattgaattttttatcctttaggaaaacaaatttgaccacaaagtgtccacagcttcggatgagtcgtttgcagtcatggaaggcattttttttaatgtgaaatgaatcagctctcctcctctgatagttccctgaagcagcttctgggctcccctctgtgtgggacagaggggtggtactggatgacatccagggcagggtaatgtgagaagggtccaatccagtgtgcgcatcaccctgagcatctggtttagcttcatttctgttaccatgacaaagtcaacttgtgggagagagggtttatttggctcacaagtccaggttgtggtgtgctattgcaggcctttcaaggcaggaacatgaagttgatgg

SEQ ID NO: 1385 - DNA, 361 bp, Rattus norvegicus
  Genbank Accession No. AI639354
  misc_feature (1)..(361): n = a or c or g or t
ttcttcccnccccccggcagaaaatcaagaaactttattgaatcatctattctttgtagtagagaccttgcgaaacccaagaatagaaagaacagggcccggaggaagaggcttccaaacaagagagatgggggagggctcacccctaggggggacaagcagaactggagttcacaaccctacaactcctcccgacccaaaagggcccaccctgttttctcccttaaagacaagggaagcgccccccccgcgcgcgttaattttttttcccaaacaccagcgtaaaaaaaaatttcacgaaaccctcccctgtggacaaccttcccctctttagccctcgaaaacacaaccctctcgggcg

SEQ ID NO: 1386 - DNA, 483 bp, Rattus norvegicus
  Genbank Accession No. AI639365
  misc_feature (1)..(483): n = a or c or g or t
ttncatttgaatggaactagatttgtccatgtggcacacagagagaagtatgaaatacggacccacagtgtcatagtgggtgagccagggtagcttcaggtttccatcacagatgttcatttgagacggccacacccaggctctctctcaatccactcagcctcagatccctcaggagcactcaggtgggacagatgaaggacagaaataattccacttcattgcggacaataagctttcttgggtggatgttgtctggcacagccaagctggaggtcatttcccacgcatccacaaaggccacgcggagaccaacaaaggcagcgcggaggaagcggttcatctggagtgtgagccagtcactgccatacaccgatttgtagccagtgttggccagtttgatgacgaccagagtactgggttcccggtccagcagggccttcacagctgcccgaatccctgccagtcttcgagcaaagatgg

SEQ ID NO: 1387 - DNA, 244 bp, Rattus norvegicus
  Genbank Accession No. AI639369
ttggaagggcaaagggccaagttttttttgaagccaaaccggggaaaagggggttaacccctccacttccccgagggggacccaactgttaaccggttaagggcagtaaaccaaaatcaccgggcggggacagggcctgaaagggaacaaacccttcaaagggggatgctgttttcgaccaaggccagcaccaccgggagggtccacccccccaaaaaacccactttggggaccagaaaaaaaa

SEQ ID NO: 1388 - DNA, 468 bp, Rattus norvegicus
  Genbank Accession No. AI639387
  misc_feature (1)..(468): n = a or c or g or t
ttgataaaaccatgtttattactctgctctgtgttccacacaggtttacaagacaaccgagtgtgaatgacaaacattttgttcttcgaaactctgcagtgggactgtgaacaccagccccaccgcaccctgacaatcacacagtgagggtgaaatatcagcaggggtgacagagcaggtctcggccagcagtccccatctgcagcaaaatggtcacgggctaaagcatcctagacaaacctatcagcacccatggtgcacttagaattgaacatagccacatctggtgaatcttctcacttcttccttctctttgntgaatacagtttttcttcaagagggactgggactatgccgtcacactcttttacttcctgggtcaagaggtgtttcacaatatttggtctaaccacatcagtgtctcgtgccaagtgttccagcatgctttccacaagcattgttggggca

SEQ ID NO: 1389 - DNA, 379 bp, Rattus norvegicus
  Genbank Accession No. AI639400
  misc_feature (1)..(379): n = a or c or g or t
ttctaagaacagacacaagccagatttactggcacatgcctgtaatatgggcactttggaggtagagacaaaaagatcagaagttgggggctatcctgagctacttagagagtttaaggtgcctgagctacaagaaaccctaagtcaaagaaactgggggtaggtgaaagatggcttatcaagtaaaggtactcagtcctaaatctggcaacctgagttcaaatcccagaatgcataaggtagaaatcaagaactgacctctacacatgcaccatgatgtgcaagagcacatnagacacacacacacacacacacacacacacacacacacacacacacattaaaattaaaagtttttaaattcgtcaaaaggtaagtc

SEQ ID NO: 1390 - DNA, 483 bp, Rattus norvegicus
  Genbank Accession No. AI639422
ttctgccccagatttctttattaaggccttgcatttgacccaaatacattaacaggagatggctaagatatagcccctaacacagtacctcccttcctcctagccagggtcaggacagtcggaaaggtttaagatttgagtaatgggagactgtaccgatggaagggacagagaagagtttgcaaatcgttaagtatggggagtggtagaagagaaacagtagatacagataaggtacgggataagaaacaagtcagatgagagaactgggctggtatcggagataaagcagctccttttctccagcgagggagaccaggatctcgagcaccctgcatgtagaccacagttggccctatagtagagaatgacctagtgtcccaaggagctcggggcagtgcatgggcggtaggaaggtacatgtaaagagcaaggggggctggtaaggagttgccatagcaactagtcatcatcgtcgtcgtc

SEQ ID NO: 1391 - DNA, 267 bp, Rattus norvegicus
  Genbank Accession No. AI639453
ttaaaagctttacctttgaaacgcctgggaaaacttaaggggcccccaggggaaaaacatgaccccaaaggggaaaccgcttaaaaccatcgatccctgcacttagggctggacctggagttgattttgccatgatccagggcctgcaggaaagaacaaaaattcctttccttttttccctttccctttccctttccctttccctttttccctttccctttccctttccctttccctttccctttccctgttattatcccccccccc

SEQ ID NO: 1392 - DNA, 401 bp, Rattus norvegicus
  Genbank Accession No. AI639488
ttagactaagacaatgctccggctttaatgtatgaaaataatacccatgttgtctaatttgggggtcatacattagaagtgtaaaggtctgcgtctgcccgccgtctagttgaagtacgtgagcacaatcatttggatcggctgtctgcacacggggcagggcttattcctcttctttagcttctttgcacacgtgaaacatgacatcaggtgtccggttttgccgtgaacaatgcaaccatttttaggccgcccctggcaaatcacacatggctcgatggcgttcagagagaagctggattccatactttcctctttgtcttgtgtgtcctccttcaactctttgccactttcttggctgctgtaaacaatgctactggaagtcgacggctgggaatagt

SEQ ID NO: 1393 - DNA, 401 bp, Rattus norvegicus
  Genbank Accession No. AI639498
ttcccttcccagttttttttaaaggtttaaaaattccacccccggtattttttcccgggccttagttcccttggttaaaaaggggggggggggcccccggtttccttctttttttaaattaaggggccaccggtccaaggtttttttcccacttcccggggggaaactaagccctagcttaagattgggttttttccttttccccccttgcccccattccggtttttttaaggttccttaccaaattcaattcccggggggtttttccaaaagtcaattccttgcttttccccttcttgggttatttaaaaaaaactaaaaacctggggggggtttaaaggggcacttgttaaaactgaaggggccccaagcatggcccctttttacccgggaggggggga

SEQ ID NO: 1394 - DNA, 543 bp, Rattus norvegicus
  Genbank Accession No. AI639504
ttagagagcatcagccgttctatttcttgcatgatcattggcatgaaggaaaagtccaaaacaggggctttgcattctggggattgcgggccaagtgttataagctcctcatagcactttgcctgggttcatgagacctcggggatccagtgtgtctttgagttgcctcatggtctccacacccacaggacccacttcctcttgaagcagctgcctcttgcccagaccgatgccatgttctccagtacatgtcccatggagtgccagggcacgcctgcccagattttctgcaaaggccttgaccctcctctgctcctccacatcatctgggttgaccaacaggatgcagtgaaagttgccgtcacccacatgcccaacaatgactcctgtgagttttgaggccttaagctcctccttggtctctaccaagatctctggcaaccgggagatgggcacacacacgtccgtggaataggccttacttcctggacgcagggccaaagctgcataccaagcattgtgccgtgcagcccaaagttcatt

SEQ ID NO: 1395 - DNA, 437 bp, Rattus norvegicus
  Genbank Accession No. AI639518
ttgggagaagagtctgaaaaagtaaactttaattaaaaaaaaataataataatacaacttcaggttcgtgctaggctctcccacttggccttttacagactggtcggttttccactgaattcggagaagctgaagatgtaccacagaggacacagagcaccatcacttctacaggcaaacagctcgtgcacaggcttgaccaatgtccgtggctcgagtgactaagcggcaaggctggtttcccggaagttcaaaacgccagcttcttcatcagcaggtagactcgggagtccacctcaaatccatgcaggttgttggcgtccccctgaagcctcatgaggaggccgccataggacacatacgcagagagacgtgtggctgcttccgttgaggtctcgtccccttcgatcctgtacactttcccatacattacatac

SEQ ID NO: 1396 - DNA, 1524 bp, Rattus norvegicus
  Genbank Accession No. AJ001044
aagcttggtaccgagctcggatccactagtaacggccgccagtgtggtggaattccagcgcgactgtccctggagccgtcccgcgcctcagacccgcgagtccccgccgctccgcgcgcagtatggcgccccccaaggccctcgcgttcgggctcctgctcgcggtggtcacggcgacgctggccgcagctcagaaagactgtgtctgtaacaactacaagctgacgtcacggtgctatgagaatgagaatggtgaatgccagtgtacttcctatgggacacaaaatactgtcatttgctccaaactggcatccaagtgcttggtgatgaaggcggagatgactcacagcaagtctgggaggaggatgaaacccgagggggcgatccagaacaacgacggtctgtatgatcccgagtgtgacgagcaagggctcttcaaagccaagcagtgcaacggcaccgccacgtgctggtgcgtgaacaccgcgggtgtccggagaaccgacaaggacacggagatcacgtgctccgagagagtgaggacctactggatcatcattgagctcaaacacaaagaaagagcacagccttataacttcgagagtttgcatactgcacttcaggacacatttgcatctcgatacatgctgaatccgaaatttatcaaaagtattatgtatgagaataatgttatcactattgatttgatgcaaaactcttctcagaagactcaagatgatgtggacatagctgatgtggcttactattttgagaaagatgtaaagggggagtccttgttccattcatctaagagcatggacctgagggtgaacggggagctcctcgatctggaccccgggcagactctgatttactacgtcgatgaaaaggccccggagttttccatgcagggcctcacggctgggatcatcgccgtcattgtcgtggtggtgttagcagtcattgcggggattgttgtcctggttatatctacaaggaagagatcagcaaaatatgagaaggctgagataaaggagatgggtgagatacacagagagctcaatgcctaaccaaccatgccgtgtgctgcactgaggagggagccaccggacggaaatggcgaagaactcaggttgcaaacggatagacctggggaggatggagacctttcgagggtcactgctttgttagctaagctcacacatttgtaacagtgaaatttgtactcataaatacaagcagcttgacattggcattaacaatcttaaaattagacgagtgtcttacacatgcaggtctggcgtggaactcagaacttagcctgccaagataggagagcttatgcttattgttgaagtgtgtgtgtgtgtgtgtgtgtgtgtgtgtgtgtgtcataaacagcccacagtagaatacgatgactactctcatttttgtgattaaagctgcccttctacacactgagtcttgtacataataaacgtttttaatgaaataaaacatttttaaactgaaaaaaaaaaa

SEQ ID NO: 1397 - DNA, 3166 bp, Rattus norvegicus
  Genbank Accession No. AJ001929
tagaattcagcggccgctaaattctaggtggccacggaatcctgcggcgtggagctccggggaaaactcagtcaaccatggacctgcgtcagtttcttatgtgcctgtccctgtgcacggcctttgctttgagcaagcctacagaaaagaaggaccgagtacaccatgaacctcagctcagcgacaaagttcacaacgatgctcagaatttcgactatgaccatgatgccttcttgggagcagaagaggcaaagagttttggtcagctgacaccagaagagagcaaggaaaagcttggaatgattgtagataaaatagacaccgataaagatgggtttgtgaccgagggcgagctgaagagccggatcaagcacgcccagaagaaatacatatatgacaatgttgaaaaccagtggcaggagtttgatatgaatcaagacggcttaatctcctgggatgagtacagaaacgtgacttatggcacttacctggatgatccagaccctgatgatggatttaattataaaccgattatggttagagatgagcggaggttcaaaatggccgaccaagatggagaccttattgccacaaaggaggagtttaccgcttttctgcaccctgaggaatatgactacatgaaagacatagtcctgcaggaaaccatggaggatatagaccagaatgctgatggttttattgatctagaagagtatattggtgacatgtacagtcatgatgggaatgctgatgaaccccagtgggttaagacagagcgggagcagttcgttgagtttcgagataagaaccgggatggaaagatggacaaggaagagaccaaagactggatcctcccttcagactatgaccatgcagaggccgaagccaggcatctcgtctatgagtccgaccaagacaaggatggcaagctcaccaaggaggagattgtcgacaagtatgatttatttgtgggcagccaggccacagatttcggggaggccttagtacgacacgatgagttctaagctgcaaacagaggagccttcatttcttcaaaagtaatttatttttacaggtctggtttcacataaaattgtttgcgctactgagactgttattacaaactttttaagacgtgaaaaggcatatcgagatagtgaaatcacccgcccccattcctcctccctctgaggggctggaaggaacccatgcttctgaggaacaactctgattagtacacttgtgtctgtaggtttacactttgtataatgtataacatggtgtgtttatttttgtattgttctctagttgggagtataatatgaaggatggagatcctcaacccacacttgtaggcatacattagccatttacactttctcaatcccttaccacattttttttttaataattctcacttaactaattttttaaagcctaagatcaataagaaatgttcaggagagaaaaagcagaaggaaagcatgtacttcgtgatttacgttcagagagagaatgcttcatcttgcttgttgagaagtctcatttcatgagtagctgttcagttgtcacaggcccagccacggagcctgccattgtctgggcaaggacagagtcctccgctgtaagacagcgtcacgcagctccacttcactcttcccctcaggactagctgtttgctaattttgtcaagcacagctgtggtaggaagaattagggcccagtgtcttgaaaaatcaaccaagtagtgtgtatgatgtcttcacagggctatttctagctctttctagagctgtttctaaccagaaacagctggaaaacaaaaagaacaaagtgtatgcagggcatgcatctcattcttagtgaaatcactacaaggacccatcccagcccctttctaagtcttaaccttgggttttactgcagtttaaattgattcttttcccatcatgacattgaaagttgccctttaacaggaaaaatggtcaccgaatgagaattgggactcaagaataacgaatttggggcgcccttacgttgaaagcatttgaacctccctgataccgaaggggattcccctccccgcctttttctcttgtaaacaggaagtaaatagcattattagttaaagcttggttgcagtgttcttatcttgtgggctggtttctaaaacctcatgctgctgatttgaccagggcatcctcatacctcagatgcaaaccactcttctaccgggcctctgtttaccggagctttgcctcaaggatagaaggctgtacagaggggctctttggtttgaggaccactgctcacccttcctgtcattaacctgtcacaccccattttatcatctccctttctctctgacacacaaaggtggggtacgtgggagggtcgtggattattcttattaaaaaacaaaatcatctgttgccaaccccatttacccatctttggtctcttactgatgggcctcttaagaattattgtattccaagtctttaaccctcatgttactaatgtaaatatacatctgggcagtctttattacttcctgtatctctgagtaatacatcaagctggtgctgggtgatggtcatatctgaacctagacctccccgtgggtcttccacaatcctgttgatgtgggctgcttggtgtggtaaaaagcccagtcgtggtgtaacttaaccttggcgattgcatcaagcttcttgatagcagatacactctaaggttttagccccagtagaggtgaaatgaacatccctcactgccttccccagatcctcaactctccattgttaaggagaccagagataattaatgccaccaaccctggcttagaaagggtacgtcatacactgtgtagcaagagggcattacagagcctaacgctggcgtgaaaatcatgtacttagccagcaagtgagtctgcgagggtggcgtagtctggacagggtgttcagcatcgggaactgtgctctcaggtccataagctccacatagtgttggggtttgggtttgggtttctggttgaatttgagtatttgttctttttttatagagtgtaaaccaagttttatattctgtaatgcaaacaggtacctgtcgttttttgaataaaactgtttacatccaaaaaaaaaaaaaaaaaaaaaaaaaa

SEQ ID NO: 1398 - DNA, 1342 bp, Rattus norvegicus
  Genbank Accession No. AJ005424
ccgacaataccaaagcagccctcaaagctgctctgctcaagtccctgaggagccggcttcgagatgggcccagtgcacccttggaggcccctgaacctcgaaagcctgtgacagctcaggaacgtcagcgagagcgagaagagaagcgcaggaggcgacaagagagagccaaggagagggagaagcgacgacaagagcgggagcgcaaggagaggggggctggcaccttggggggcccctctactgaccctttggctggattggtgctcagtgacaatgaccgaagcctgctagagcggtggactcgcatggctaggcctcctgtccctgcaccagcaccagcaccagcaccagcaccaacaccaacaccaacaccaacaccaacaccaacacagtcctctgctcaacccactagtcctcccaatggccctgtatctcagactactgctcctctacagcctgcaggctctattcctggtcctgcctcccagcctgcttgcccaccccctgggcctgttccccagcctgctggccctgtccctgcccctctccagactgccccttccactagccttttggcctcccagtcacttgtgccacctagtgggttgcctggttctggtgccccagaagttctgccttacttcccatctggcccaccacctccagatcctgggctcacccctcagccttctacatcagagtcacctgatgtcaacctggtgacccagcaactgtccaagtctcaggtggaggaccccctgcctcccgtgttctcaggcactccaaagggcagtggggctggctacggtgttggctttgacctggaggaattcttaaaccaatcttttgacatgggtgtggctgatgggccacaggatagccaggcagactcagcctcactctcagcctccctccttgctgactggcttgagggccacggcatgaaccccgctgacattgagtctctgcagcgtgagatccagatggactccccaatgttgctgtctgacctgcctgacctccaagaaccctgagacccacagcttgtgccttgctgccaggacgggcccagcttcaaggtccaggggtgcagtccagagggctgcagccttgagcctggcaggtgaggctcagcttgagttactctgcaggttcatctcagacccaccgttcagccttaagcagccgcctgagccaccaccgagccataacaggatgggaggctctactccttcctgcgcagtcttctccagtgttgtatttttattactgttgtaatatgcatttgttttgccatcgaaatgaggcctgtgaaatacaaggtttcctttaaaaaaaa

SEQ ID NO: 1399 - DNA, 730 bp, Rattus norvegicus
  Genbank Accession No. AJ011116
gagagatccacctcactgtagctgtgctggcatacagaacccaggatgggctgggccctctgcactatggggtctgttccacatggatgagccaactcaaggcaggagacccggtgccctgcttcatcaggggggctccctccttccggctgccacctgatcctaacttgccttgcatcctggtgggcccagggactggtattgcacccttccggggattctggcaagaccgattacacgacattgagatcaaaggactgcagcctgcccccatgactttggtgtttggctgccgatgctcccaactggaccatctctaccgggacgaggtactggacgcccagcagcgtggagtgtttggacaagtcctcaccgccttttccagggatcctggcagccctaagacctatgtgcaagaccttctgaggacagagctggccgcggaggttcaccgcgtgttgtgcctcgagcaaggacacatgtttgtctgcggtgatgtcactatggcaaccagcgtcctgcaaaccgtgcagcgaattctggcaacagagggcagcatggagctggatgaagccggtgacgtcatcggcgtgctgcgggatcagcaacgctaccacgaggacattttcggactcacattgcgcacccaggaggtgacgagccgcatccgcacccagagtttttctttgcaggagcgacagttgcggggcgcagtgccctggtcctttga

SEQ ID NO: 1400 - DNA, 754 bp, Rattus norvegicus
  Genbank Accession No. AJ011811
gctgatagcgagcactgctatcccacagtggcagatgagctcctatgcaggcgacaacatcatcacagcccaggccatgtacaaggggctctggatggagtgcgtcacgcagagtaccggcatgatgagctgcaaaatgtacgactcggtgcttgccctgccagcggccacgcaggccactcgagccttaatgattgtgtccttggtgttgggcttcttggccatgtttgtcgccacgatgggcatgaaatgcacacgctgtgggggagatgacaaagtgaagaaggcccgcatagctatgactggaggcattattttcatcgtggcaggtcttgctgctttggtagcatgctcctggattggtcatcagattgtcacagacttttataaccccttgacgcccatgaatattaagtacgagtttggtcctgccatctttatcggctgggcagggtctgctctggtccttctgggaggggccctgctctcttgctcctgccccggcagtgaaagcaaagctgcataccgtgcaccccgctcctaccctaagtccaactcctctaaggaatacgtgtgagctggggaccccagcctgtgggcaaggtgtgaggcaaaggcctcctggtcactccaccgccaaacaccatgtatagttccctgtgggaggggggggagggccgaggggggtgggtgggagaggaagacaaaacatggggagggtgtgcttttgtacagtaataaaattaagttttgg

SEQ ID NO: 1401 - DNA, 2363 bp, Rattus norvegicus
  Genbank Accession No. AJ011969
gatctgagggggggggtctgggatcagcagggggtggattctggggtcagcccgggcttctacctcctgtccagtgagcaccaggacagagggacagaagggatggccggccgggtgaagacttaccatgcacctacctggccttcacagggggacatggagccccatagtcagtcataacttggagtcaccccacaggtcagaggccacccagcagtacgtagatattgggagggaaccctaggtgctccagatcccagcaggagaacttggtgacacctggtgccctagatgctcactctggtctcactcagaagtcccggctacagccactacccttcggaggctcaggctgactgtggacagggctcctgggcacttcgtcctcatctatcttcctttggagcctgagaccaactgccctcaccctccagccacctaccgactcccgactggaaggagacccatgggcagatttcctcttgcctctctccccaatagagacccctggtctggggatactgaggcaggcacagggcaggcgtgtgtgagcacccagtcatcctggaaatctagtgaaggttcctgaagcaggagctgttcacacagggttttgaagcattagtaggagttccgaagagaaccttgaatgggtgcagtactccctggtttgctcttctgtcccagcccatttagacagggttgtaaagtctactcctgggacactgagacgtagggtgacttgcctgaacttgccttttctagatcttccttggcttctttaccttcgatgggggtggagaaggggagggagggagagaggaagaaagggagagagagccctggtcccaaggggaaggaagaagccacttgaacttcagtctggactacatcacatgttctgtggggacagtcagcactcactcaggtcacagtccccgcattttccctcgtgagctgagaggttccgcccccgcccccctgcggagccttgggattcccgcccggattagcctggtcacccgagttggcatcgcacaaggggggcggggcggacagagtccagtgggtataaaggcagctgcgaaggcttaacgcaaagtcacactcaggacacaagcgacatggccctgcgcgcgctccatgcccagcctacaggcggtcctcagctgaggttcctgctgttcctgctgctcttgctgcttctgctgtcatggccatctcagggggacgccctggcattgcctgagcagcgacgctccctctctgagtcccaactcaacccggacgagctacggggtcgcttccaggacctgctgagccgactgcatgccaaccagagccgggaggactcgaactcagaaccaacccctgacccagctgtccggatactcagtccagagggtaagtggcagctggggacccacttcagcaacaccctctccaagctctaaccaacacactcaagtccacgagacccagtcagtccagcttccgagcctcagtttcccctgctgtgacctctggagttgccagcagtcccccgtgcagtgggctcagccagagtaggaaggacgaccgtcctcagaccggagctggacaaatgatgtccagagaggtcgaggtctttcctggagatgcacagcactctagtgggagaggacacgggggatggttagagggtactggagaggggaggtaggaaagagagccaggttgagagccagagggaaaagaacctgcgggaactggatctctaaggtctgccctgtggagtacttctcaaacctttccccaaacctctgaataaagtgttttaacaaacaaaagttgattttctttaaagcagtgtttggtggccaccttttcacacttgggaaatggaggcagaaggattgccctgagtttgcagtcaacctgagctacaaagtccctatctcaaaaagaaagaaagagagagagagagagagagagagagagagagagagagagagagagagaaagaaagaaagaaagggggctagagagatggctcagaggttaagagcactgtctgttcttccagaggtcctgacttcaattcccagcaaccacacatgatagttcacaaccatctgtaatgggatctgatgccctcttctggcctgcagacaaacatgcaggcagaaagctgtatgatgtatacataatgttagaaagaaaggaaggaagaaatggaaaaagaaaaagaggaaaacaatgaatgggacgggggctgcagaaatagcgcagcgattaagagaacgcactcttcttccagaggacctgagttcaaatcccagcaaacacacggtggctcacaaccgtctgtaatggatccccgg

SEQ ID NO: 1402 - DNA, 1946 bp, Rattus norvegicus
  Genbank Accession No. AJ223355
ccggggtcgggccaggtcgctgctgctctggccatggctgaggcacgcacgtctcgctggtactttggagggctggcttcctgcggagctgcctgctgcacgcaccctctagacctgctcaaggtgcatttgcagacccaacaggaggtgaagcttcgaatgactggaatggcactgcaggtggtgcgaaccgatggcttcctggcactctacaatggcctgagtgcctcgctgtgcaggcagatgacctactccctgacccggttcgctatctacgagaccatgcgggactacatgaccaaggacagccaggggcctctccccttctacagcaaggtgttgctgggcggcatcagtggtttaactggaggcttcgtggggaccccagcagatttggtcaatgtcaggatgcagaatgacatgaagctgcctctgagccagcgccgcaactactctcacgccctggatggtctgtaccgtgtagcccgtgaagaaggcctgaagaagctcttctctggagcaactatggcatccagccgtggggccctcgtcactgtgggccagctgtcctgctacgaccaggccaagcagctggttctcagtactgggtacctgagtgacaacattttcacccacttcctctccagtttcattgcgggcggatgtgccacatttctctgccagcccctggacgtgctgaagactcgcttgatgaactccaagggcgagtatcagggtgttttccattgtgccgtggagacagcaaagcttggaccacaggcctttttcaagggtctcgttcctgcgggcgtccgtctcgtcccccacaccgtgcttaccttcatgttcctggagcagctgcggaagcacttcggtatcaaagtggcaacctgacaccgccagggacacctgggctgcgctcagtcgctgtgctgagccccttggaagagtaggaagggagtgggctcccttcctccttggcctgggcccgtgctgatccccagaagattcctgttcttcccacccttgggctgctggctacgccttccgaccctgccttggccccactgaagtggcacctctgccctactggctcccaggctctccccactgggacgtcccatcttcctacccgatgattcactcagaagaggtctggcctggctggtgtcactgtccccacctccctggctgctaccctgccctgcctgtcaagcccggagaagctgagtacacttcctgctcttgctggcccactgaacagcttccacccaggacttgggtagtgtggcagggtacagcccctggcagcttctgcttaccaaatgactagagcacgcacgcacacacatacacacatgcacttacgtcacaagagggaccaccgtgcagtgttctggaaggtagtgccttcaggagagggaacagggcagcagcacagatcaccagcaaacgccatgaccgcggagtccggagaaagtacctggggttccctgtgcacctcccgtgctcagccttggctgctttaagagtcagtttttgcggaaccctcctactcagcagccactaccatcatcaggaactggctgtgtccctcatacacctgtgccctcccttgcctggcttcccccagggccaggggctcatgctggagctggggctatgatggattcattttatgtgtcctcctaggacctgttttcccgtatggcaggggtcacccctcaccatccctcagggttcaaagcagcctgttttccctcaaattggggttgtgtgtatatcaacgtgaggttgggccctgtgcccgtttgcctcccctcagcaccaggccctcacccaggaggtgcgggaggtggcagtgggcccaggggcactgcctacatctctcttcaggatctaataaaccaagtggccaaaaaaaaaaaaaaaaaaaaaaaaaaaaa

SEQ ID NO: 1403 - DNA, 1083 bp, Rattus norvegicus
  Genbank Accession No. D00729
acacaactctcaatcatccagtgaactgggctgactgtggcaggacctgggcggtgaggaaacccttggggacaccgatgtggcttgagcctgctcctcttcttggcgctggcctctcccgtcgcgttctgctgcaggccggatcccgcctcgccgcaggggggcctggacgagcccgtcgcttctctaacaaggcggtgttggtggagaaggagggcgaggcaggaatcgcagtgatgaagttcaagaaccctccagtgaattcctcagcttggagtttccgacagagttttcgtcatcagcctgagaagctggaaaatgaaaagagcatccgaggtgtcatcctcacttcggagcgcccgggaacctccccgccgccccacgacatgaagaagaaggacgaccagcccactatgctgagtactggaaggctcgtgccaggagctgtggctgaggctctacttgtccaacctgacttgatatctgccatcaatggcgcctttccagctggaggctgcctcatggctctcacctgtgactacaggataatggcggacaactccaagtataccataggattgaatgagagcctgctgggcattgttgcccccttctggttaaaagacaactacgtgaacacatcgggcaccgagcagccgagcgtgcccttcaactggggacgttttcccactaacatgacagcagctgctctactgacgcttcacagaagcctcaatgaggtggtacctgaggatcaggtacacagcaaggctcgctcagtgatggccaagtggtttaccattccggaccattctcggttgctgacgaagagcatgatgcgcaaggccacggcggacaacctgatcaagcagcgagaggctgacatccagaacttcaccagtttcacctccagagactccatccagaagtccctgcacgtgtacttggaaaagctcaagcaaaagaagggctgacctaagggtgccacacggtgtttagttacacgtgccttctagggacccatggtcccaaggattatcaataaggtatttttcaatttaaaaaaaaaaaaaaaggaattcc

SEQ ID NO: 1404 - DNA, 2266 bp, Rattus norvegicus
  Genbank Accession No. D10655
cctacaatgcaggcaggcaccatagcccgctgggaaaaaaaagaaggggaaaaaatcagtgagggtgatctaattgcagaggttgaaactgataaagccactgttggatttgagagcttggaggagtgctatatggcaaagatccttgttcctgaggggaccagagatgttccgataggatgtatcatttgtatcacagttgaaaagcctcaggatattgaggcctttaaaaattatacattggattcagcaacagctgccacacaggcagccccagccccagctgcagctccagctgctgccccagctgcaccttctgcaagtgctccaggtagctcctatcccgttcacatgcagattgttcttcctgccctctccccaaccatgaccatgggcaccgtccagaggtgggaaaagaaagtgggagagaagctgagtgaaggagacttgctggcagagatagagaccgacaaggccaccataggctttgaagtacaagaagaaggttatctggcaaaaatcctggtccctgaaggcacaagggatgttcctctgggaaccccgctatgtatcatagtagaaaaacaggaagatatagcagcatttgcagactacaggccaacagaagtgaccagcttaaagccacaggcaccaccacctgtcccacccccagtggcagctgttcctcccatcccccagcctttagcacctaccccctcagccgctcctgctggaccaaagggaagggtgttcgttagccctcttgcaaagaaattggcagcagagaaagggattgacctcacccaagttaaagggacgggaccagaaggcagaatcatcaagaaggacattgactcttttgtgcctactaaggctgctcctgccgctgcagcagctgctcccccgggtccaagagtggcaccaactcctgcaggtgtcttcatagacatccccatcagcaacattcgtcgagtgattgcgcagaggctcatgcagtcgaagcagactatacctcattattacctttctgttgatgtaaatatgggagaggtgctgttggtgcggaaggaacttaataagatgcttgaaggtaaaggaaaaatctccgtcaatgacttcatcataaaagcttcagctttggcctgcctgaaagttcctgaagcaaactcatcttggatggacacagttatacgacaaaatcatgtggttgatgtcagcgttgctgtcagtacccctgcaggacttatcacccctattgtgtttaatgcacacataaaaggactggaaaccattgctagtgatgttgtttctttagcctccaaagcaagagagggtaaacttcagcctcacgagttccagggtgggacatttacaatctccaacttagggatgttcggaattaagaatttctctgcgattattaacccacctcaggcatgtattttggcaattggtgcttccgaggataaactgatccctgcagataatgagaaaggctttgacgtggctagtgtgatgtctgtcacactcagctgtgatcatcgagttgtggatggagcagttggagcccagtggcttgctgaattcaaaaagtaccttgaaaagcctgtaactatgttgttataatttccctgcgaacttctattcttcctctgctgacattatatttatatgttattaaacaggtggttcttttaaagtttcactagttaattttattattgagtcagtccagataaattatttgtaacagacataaatgaatcttttgtaaatgccagttacacccaaatgttttacccctttaataattacacatcggtttaaagctgtgtactcctagtgaaggggacatgtgggcctaactctttggtagaaggagccttcctgggagtgatagatggcaggattgtggcttcctgcagacaagtcactaaaagtacctggatgagatacttggagttagattaatgatcacttatttaagtgtgagggaacagtcgtgaaaattacgtcttatggaggagtttgaatttacgttggaatctaacagttaaagtctcctgtcacatgaccttagtttatcactcagtaagtgaaacttttaagagtcagcattttcttagacctcttcaaaccaactattatttttatatgaatctctaaataaaatagctttccccacaagataaagatataaaccagcttcttggtataaatgaaattttatgtatttatttataaacaatttcaatgtataacttga

SEQ ID NO: 1405 - DNA, 2842 bp, Rattus norvegicus
  Genbank Accession No. D13623
tcgcggaaggtgacgtggacacggaagtggtcgtcgtcgcggcggcaccggtgggagcggggccctgcacttggagtgcggcgggcaagcggacgggtggcggaggcctctcagcggcggcggcggcgacttaaggcgcaggcgtggtccgttgggtgcgaatccgctgagcccacgagcggcctcttagccctctctcctgcccgtcggaaaccgggagcagggacccgcttagccggcgtcatcatgaccaagaccggtagcaagggcgggaacctccgcgacaagctggacggcaatgagctggacctgagtctcagcgacctgaatgaggtccccgtcaaggagctggctgcacttccaaaggccaccgtgttggatctgtcctgcaataaactgagcactcttccgtcggatttctgtggcctcacgcacctggtaaagctggacctcagcaagaacaagctgcagcagctgcccgcagactttggtcgcctggttaaccttcagcatttggatctcctcaacaacaggctggtcaccctgcctgtcagctttgctcagctcaagaatctgaagtggctggatctgaaggacaatcccttggatcctgtcctggccaaggtggcaggtgattgcttggatgagaagcaatgtaagcagtgtgcaaacaaggtgttacagcacatgaaggccgtgcaggcagatcaggaacgagagcggcagcgccggctggaagtggagcgagaggcagagaagaagcgtgaggccaagcagcaagctaaggaagcaaaggagcgcgagctgaggaagcgggagaaggcggaggagaaggagcgtcggcgaaaggagtatgatgctcagaaagcttccaagcgggagcaagagaagaagcctaagaaggaaacaaatcaggccccaaaatcgaagtctggctctcgccctcgcaagccaccaccccgaaaacacaatcgctcctgggctgtgctgaaggggttgttgctgctgctgctgctatgtgtagcaggagggctggttgtatgccgggtgacagggctgcaacagcagcccctctgcaccagcgtgaacgccatctacgacaatgccgtccagggcctgcgccatcatgagatcctccagtgggtcctccagaccgactcccagcagtgagctcatcctcagcaccgctgcctcccagcctcggagcttggattcctatggaattgggttctgctggacacaacttctttttagcgtcagacctacctgccatcatcaaatggctgctgagtggtacttgagatctcccctttgtaggacttctctgttccttagtcagggttccctggtggaatgaggagaaatggagaggggggaggaagagttacctgcatgcctaaaggaataggcttaggggtggggagagagaaggcataggcttttctagttatgcaaagctgtgtaaggcaaggttcctttctactaaatggtcagctgtcactacatttatacttttgtatgtcacaaaccctttctttcattcctccctgggtaaccaggacggattggagggcagtgtgttactgggactaggggactaggaatacttgggtaaattcagcctaagctgggagggtaaagtaatacatttccttaaagatctcagacagtcaagcattttagcaatgtccaaaatgtctggctatgaacacatgttcactgccattggtccagtgtaacactttgaggcaggaggtgccgtccatgacttacttgcctacagtgttcaagctagtccaaggcacaacccagctttcactccagttttcttcctttcctttatgtcatttggcctcctttataatactcaaggggatgaactcacaccagagttgtcttagctaaagtgaatctttcataatagacggtcttaccacccacaaatagatctcatcagggtcctgggaaactaatcctgtggaattttgcctcagcttaaatggcttccacaaaatggcagcaggctgggctccttgcctcccttttagagcattaaactccctgatggcctggaagcacaggggcagatctctgcagcggcactgtgactgccctactagcacttggtatgatgaaatacctcaaaggcaacctagaaacttgatctcacagaagcaggtgcagagttgcttctggacctgtaacagaagggaaggaatagaacagtgggagccaaagggaaacaaagtcacacggtggcgctgcaagtgatacataagtaaacattagcacaaaccagggcagcagcacccacctccctgctgctaccagaaagcattctccccgcttccctgtctcttcacaacagctgcaggaagggatcggaaacctgtctcggtgcttatttgctaaaactcccaactgcaagctctccctagaggagcaggacctgtcggagttcagacagtgtagccccagtggcccatgtgcttaggtcagccactcaagactgtcctgacacgggaagaaaggcctttgtttttccctcccccagatagttctgccgtgtaggtccacaccttactcagaatcactacacattcctttagtcttcctccaagctccagagccatcggtacaaatgctttattgagacaaaatacatactacatatggtgacatcatgaaaacagaagtcagcctcatagatccctggctggttgaggcagctcagtggctgggcgtagtcaagccaacccgcaggcaagagttcactctgacttcgagatttgatgcttattctttggatttctacaattattaaatccgtgtctgagtggtc

SEQ ID NO: 1406 - DNA, 3751 bp, Rattus norvegicus
  Genbank Accession No. D14014
agaaagagagctacagactccgcgcgctccggaagaccgggtcgtagagctcgagacaactcccgccagcagcaagacacgggagacccaaccaggatgacaaccctccccaggccgcccgctccatggaacaccagctcctgtgctgcgaagtggagaccatccgccgcgcgtaccctgacaccaatctcctcaaccgaccgggtctgcgagccatgcttaagactgaggagacctgcgcgccctccgtttcttacttcaagtgcgtgcagagggagattgtgccatccatgcggaaaatcgtggccacctggatgctagaggtctgcgaggagcagaagtgcgaagaggaggtcttcccgctggccatgaactacctggaccgtttcttgtctctggagcccctgaagaagagccgcctgcagcttctgggggccacctgcatgttcgtggcctctaagatgaaggagaccattcccctgactgccgagaagttgtgcatctacactgacaactctatccgccccgaggagttgctgcaaatggaactgcttctggtgaacaagctcaaatggaacctggccgccatgactccccacgatttcatcgaacacttcctctccaaaatgccagaggcggatgagaacaagcagatcatccgcaaacatgcacagacctttgtggccctctgtgccacagatgtgaagttcatttccaacccaccctccatggtggctgctgggagtgtggtggccgcgatgcagggcctgaacctgggcagccccaacaacttcctctcctgctaccgcacaacgcactttctttccagagtcatcaagtgtgacccggactgcctccgtgcctgccaggaacagattgaagcccttctggagtcaagcctgcgccaggcccagcagaacatcgatcccaaggccaccgaggaggaaggggaagtggaggaagaagctggtctggcttgcacacccaccgacgtccgagatgtggacatctgagggcccaccgggcaggcgggagtcaccaagtagtggcatccgcgaagagaaaggagccagcccgggtgctcctgacgaggtcccccttggggatgtgttgttaccagaaggggaagttttgttctctttgttggttgtttttccttaatctttctcctttctatctgatttaagcaaaagagaaaaaaatacctgaaagctgtcttaaagagagagagagagatagaattcgcatcaccctgagtatagggagacgggggggtgcctacaaaaatagaattctgtaccccagtaatcaactagttttctattaatgtgcttgtctgttctaagaataggattaacacacaggaagtcttgagaaggatttttgattcttttatgtgtttaagaaaaaaaagcttaagaaacattgctttaaaaaaagaaggaaaaaaaatacagcaaaccattgttaaagtagaagggttttaggtagagaaatgtactctgctttggtgaaaaggcacagatttgggaaggtcctcaacctcactcccctgcttgttcagtgcctacagacctgttacctgatgatacctgtgctttatcccaggagtggggcagacctcttaaccttactgatggtcgattcgacctctagcgggctcgtgggtgtggcaacctccagggctcatgttatgggccctctgccccccacaacctgcaggttcacagagcgccagccagcacgcaggggtagggatgaaatagtgacataatatattctatttttggggaaccttcctgttttgggggttcctgtttagagagatgctggtttttggctggtggccctgcagcccactcaacatcaggttgaacccacagcttttcttttgtgtgtggtttgttttgttatgtttttccttctccatgttcccaaaaccattccatttcaaagcacttttggtcagctagctggaggcagtgttgctgggtgtgtgtgtgtgtgtgtgtgtgtgtgtgtgtgtgtgtgtgtgtcggtgggggagggggtctagtggaatggttggggatgtccacacactcaattctgatggctgcacagcaggtgtgtagggctggtagcatgaggtgcttgggaagttgtgttgggtcgagaagagaaagctctgttctcgtaccaccgggatcttcctgcaaagtcggagggatcttttggtgccagctggcgtttggaagtagggaccgtgatggcattacctggacaaggggattcaggacgactcttaagtctttcacacaggaggcttttaaacactaaaatctctaatttatacgtaaggctacagaagagtatttattgggaaggttgcccatgacccgtgtgactcaaagcaatgtgatcttcccttgattcaaacgcacaccttcttccctgctggcgaaggttttaggccattgtctgagagactggtcttttattggccaagtggggtgtcctccaaaaaaaccaaaccacaaagacggagatgtgggtctccttgactttcccaacccaattgcccccattggagagccatccaaacctgaggaaaattaggggaccccaaaagagtcttgagtctggcacattcttgccgccgctcccaagttagcaacagtaggtaatttgcacacctctggctctgtgcctttctgttcaggatgtgttggtgggaggtggagagcgggtggctggagaggggatgtgagagaagaagtatggagggtagggaccacacgggacagaccgcggctcctttcacagcgctgctaccaatgactcccaggatccccggcgttcggaaccagattcacgttgctttgtatctttcatgttgttttcgctgctattggagggtcagttttattttgttgttgttggtttgtttgtttttttttacaatgtcataaactgccatgttcaagttttaatttcctcgtagaagagtgtatttacagatgccctctccgggactttttctatttattgtgattcaattttggattaatgtgattaccgctgtattcccaacaaaaggtgttttccacacacacacacacacacacacacacacacacacacacacacaggttcctgtacacaatacctcatgtatcacctaacaatacataggcctgccaggcgggtggggcggtctgcctccagggaccctgggaccctgctggggatcatcctgtcatgctgggccttcatttgatctgggacatagcatcacagcagtcaggccaactgtgttctgttagttatcaatattgttacttgtagcggcctgttgtgcatgccaccatgctgctggacccggagagatttgttctgagtctctggtgcatcatataatctgttaggttctagtgttctgtcttgttttgtgttactcacagcattgtgctaatgtaaagccagccgcaatgctgtaggccccaggttccctagcaagctgccaaaccaaaagggtcaccaccagcttagctgaggcgtcccaaccaggcaggacccttgagggctgctgtgtccatggtgatggggtgaagttttggccaaagggccaaaggctggtggatccacacagtctgccctgtgacatgaatggctttgaggggctctggctggtggtcaggttggctttgtgtattctggttgacacaccatggcgcttcccagcacagacatgtgaccagcatggtccagg

SEQ ID NO: 1407 - DNA, 2905 bp, Rattus norvegicus
  Genbank Accession No. D14076
gacacggtgccgggactcagcggtgtgagccccgcgcataataaaccggacaagtgctgcgaggcccgggctgcctgccaggtcgctgagtcgcgcagggacctgtggggcagttggccgcacaggcaagatggggaaccgggagatggaagaactgatccctctggtgaaccgtctgcaggacgctttctcggctctgggacagagctgtctgctggagctgccacagatcgccgtggtgggcggccagagcgccggcaagagctcagtgctcgagaacttcgtgggcagggactttcttcctcgaggctcgggcattgtgaccagacgacctcttgtactccagcttgtcacctctaaagcagaatatgccgagtttctacattgcaaaggaaaaaaatttacagattttgatgaagttcgccacgagatcgaagcagaaacggaccgagtaacaggaatgaataaaggcatctcctctgtacccattaacctgcgagtctactctccccacgtgttaaacctaacgctaatcgacctacctggaataacgaaagtgcccgtgggagaccagccgccagatattgagtatcagatcagagatatgattatgcagttcatcaccagggagaactgtctgattttggctgtcacaccagccaacaccgatcttgcgaactcagatgccctgaagctagccaaagaagtcgatcctcaaggcctgaggaccattggcgttatcaccaagctggatctcatggatgaagggacggatgccagggatgtactagagaacaagctgctacctctccgcaggggctatgtgggggtggtcaaccgaagccagaaggacatagatggaaagaaggacattaaggcagctatgctggcagaaaggaaattttttctctctcatccagcatatagacacattgctgatcggatggggaccccacacctccagaaggtcctgaatcagcaacttaccaaccatatccgagataccctgcccaacttcaggaacaagctacaggggcagctgctctccatagaacatgaagtagaagccttcaaaaacttcaaaccggaagaccccacaaggaagaccaaagcactgctacagatggtccaacagttcgctgtggactttgagaagagaatcgaagggtcgggggatcaagtagacacgttagagctctctggcggtgctaagatcaatcgcattttccacgagcgctttccttttgagatagtgaagatggagttcaatgagaaagaactgagaagagaaataagctatgcaatcaaaaacatacacgggatcaggacagggttgtttactccagacatggcgtttgaggcaatagtcaaaaaacagatagtaaaactgaaagggccttctttgaagagtgtggacctggtgatgcaggaactgatcaacacggtgaagaagtgcaccaagaggctggccaacttccccagactttgtgaagaaacagaaaggattgttgctaaccacatccgtgagcgagaaggaaagaccaaggaccaggtcctgctactgattgacattcaagtctcttacattaacaccaaccatgaggacttcatcggctttgcaaatgctcagcagagaagcagtcaggttcacaagaaaagcacaattggaaatcaggtgattcggaagggctggctgaccgtcagcaacattggcatcatgaaaggaggctcgaagggctactggtttgtcctcacggcagaaagcttgtcctggtataaagacgatgaggagaaagaaaagaagtatatgcttccactggacaacctgaaagtccgggacgtggagaaaggcttcatgtccagcaagcacgtcttcgcactcttcaacacagaacaaaggaatgtctacaaagactatcgttccctggagctggcctgtgattcccaggaggatgtggacagctggaaggcgtctctgctcagagctggcgtctatccagacaagtcttttactgaaaatgatgaaaatggacaagcagaaaacttctccatggacccgcagttggagaggcaagtggagactattcgcaacctcgtagactcctacatgtcgataatcaacaaatgcatccgagacctaattccaaaaacaataatgcaccttatgatcaataatgttaaagacttcatcaactctgaactcctagcacagctctactcctctgaggaccagaacacactaatggaagaatccgtggagcaggctcagcgccgggatgagatgctccggatgtaccaagccctgaaagaagccctcgcgatcattggcgacatcaacacggtcactgtgtccaccccagccccacctccagtagatgactcctggctccagcattccagaaggtcacctcctccaagccccaccacccaaagaaggctgactctaagtgctcccctcccgaggcccgcatctagccgtggaccagctcctgccattccctctccaggcccccactctggggctcccccagtcccattccgtccaggcccattacctccttttcccaacagcagtgactcctacggagcccctccacaggttccatccaggcccacaagggcaccccccagtgttccaaggtttggtgctgtgaaggaggaagctgttgagccttgaagtcgctgggctcagagttcatggaaactgagcagcccgtgtgactagcctgggtgtcactccctgcggtcacccacggaaacatcctgacttaccctctcctctcctgacagccctctcaaactgtggtgtctttagcagccgagtgtcactgggacaaacggtgaaatcaccttgtgatttgtgatgtcagctgctgcgagcactctgtttctcctgactagccag

SEQ ID NO: 1408 - DNA, 1928 bp, Rattus norvegicus
  Genbank Accession No. D16479
cagtccagactctaagatttcagaatgactaccatcttgacttccacttttagaaacctttctactacatcaaaatgggccctcagattttctgtaagacctctgagctgttcttcacaagtacagtctgccccagctgtccagaccaagtcaaagaagactttagcaaaacctaatctaaagaacattgtggtggtggaaggtgtccgaattccatttctgctgtcaggcacttcgtataaagacctaatgccacatgatttggctagagccgcactttcgggtttgttgtatcggaccaatattccaaaggatgttgttgattatatcatttttggtacagttattcaggaagtaaaaacaagcaatgtggctagagaggctgccctgggagctggcttctctgataagactccagctcacactgtcaccatggcttgtatctcttcaaaccaagccatgaccacagctgttggtctgatagcttctggccagtgtgatgtcgtcgtggctggtggtgttgagttaatgtctgacgtccctattcgtcattcaagaaatatgaggaaaatgatgcttgatctcaataaagccaagactctggcccagcgcctgtccttactcactaaattcagattgaattttctgtcccctgagctccctgcagtggctgagttctccactaacgagacaatgggccactctgccgaccgtctggctgctgcctttgctgtttctcgaatggaacaggataaatatgcactgcgttctcacagtctggccaagaaggcacaggatgaaggacatctttctgatattgtacccttcaaagtaccaggaaaagacacagttagcaaagataacgggatccgtccttcctcactggagcaaatggccaaactaaagcctgcattcatcaaaccctatggcacagtgacagcagcgaattcttctttcctgactgatggcgcttctgcgatgctaatcatgtcagaggacagagctctggccatgggttataagccaaaggcatatttgagggattttatatatgtgtctcaggatccaaaagatcagcttttacttggaccaacatatgctactccaaaagttctagaaaaggcaggattaaccatgaatgatattgacgcttttgaatttcatgaagccttctcaggtcagattttggctaactttaaagctatggattctgattggtttgcacaaaactacatgggtaggaaaaccaaggttggagcacctcctctggagaagtttaatatctggggcggatcactctctctgggacacccttttggagccactggctgtcggttggtcatggcagctgccaacagactgaggaaggatggaggccagtatgctttagtggctgcctgtgcagctggaggacagggtcatgctatgattgtggaagcctacccaaaatgactgctctggaaggaggcaactgatctctgcagcactcgcactgggcaatgccatttcaatgcactaccaagtgatacctgcagttcctagctcttcttaggaaacaacatttgtggccttctcttaaatattttgcggtcaagccttgccagtgttcgagctttccgataatcacagcttctgctctctaagttccagactatcacagatgtgtacacagttcttgttatctcttgtctctaagactaatgactgccagctgcttggagagaggttagctgaggtttagaaccatctttgtaacatttgcagaatctcctccttcctgtcagtgtcctacagagaattattttttctaaaatacaatccaatgtgcctacattaagttactatagaaaaaaataatctaaacatctcctaaaactgacttgcttagagacatgtttgttgaccttaataaagtagacatgtattag

SEQ ID NO: 1409 - DNA, 1115 bp, Rattus norvegicus
  Genbank Accession No. D16554
ctgtgagggtgtttcgacgcgctgggcggtttgttccttcatcgcattcgttaacaggtcaaaatgcaaatcttcgtgaagaccctgaccggcaagaccatcaccctagaggtggagcccagtgacaccatcgagaacgtgaaggccaagatccaggataaagagggcatcccccctgaccagcagaggctcatctttgccggcaagcagctggaagatggccgcaccctctctgactacaacatccagaaagagtcaaccctgcacctggtcctccgcctgaggggcggcatgcagatcttcgtgaagaccctgaccggcaagaccatcaccctggaggtggagcccagtgacaccatcgagaacgtgaaggccaagatccaggataaagagggcatcccccctgaccagcagaggctcatctttgccggcaagcagctggaagatggccgcaccctctctgattacaacatccagaaagagtcaaccctgcaccttgtcctccgcctgaggggcggcatgcagatcttcgtgaagaccctgaccggcaagaccatcaccctagaggtggagcccagtgacaccatcgagaacgtgaaggccaagatccaggataaagagggcatcccccctgaccagcagaggctcatctttgccggcaagcagctggaagatggccgcaccctctctgattacaacatccagaaggagtcaaccctgcacctggtcctccgcctgaggggcggcatgcagatcttcgtgaagaccctgaccggcaagaccatcaccctggaggtggagcccagtgacaccatcgagaacgtgaaggccaagatccaggataaagagggcatcccccctgaccagcagaggctcatctttgccggcaagcagctggaagatggccgcaccctctctgattacaacatccagaaagagtcaaccctgcacctggtcctccgcctgaggggtggctattaattcttcagtctgcattcccggcgggcactgatggcattactctgcactctagccatttgccccaatttaagtttagaaattacaagtttcagtaatagctgaacctctgttaaaaatgttaataaaggttttgt

SEQ ID NO: 1410 - DNA, 2357 bp, Rattus norvegicus
  Genbank Accession No. D26111
ggagctacaaacaaagaagctgtgttggaggagggcctgttggggtttcggcagggcacgctgacagagaaaccatggaggaaatagtggggcttcgagagggctcccccaggaagccagtgcctctgcaagaactctggaggccgtgcccacgaatccgcagaaacatccaggggagcctagagtggctgaaagagcggctgttccgtgtgggtgaggactggtacttcctggtggctctcggggtgctcatggctctgatcagctatgccatgaactttgctattggacgtgtggtcagagcacataagtggctgtacagggagattggggacggccacctgctccggtacctctcttggaccgtgtaccccgtggctcttctgtccttctcctccggcttctcacagagcatcacaccatcctctggagggtctgggatccccgaggtgaaaaccatcttgacaggtgtgatcctggaggactacctagacattaagaacttcggggccaaggtggtgggcctctcctgcaccctggcaacaggcagtaccatcttcctgggaaaactgggcccctttgtgcacctgagcgtgatgatcgctgcttacctgggccgcgtgcgcaccaagaccgtcggggaacctgagaacaagaccaaagaaatggaattgttggctgcaggagcagcagtgggtgtggccacggtcttcgccgccccaatcagtggtgttctgttcagcatcgaggtcatgtcctctcacttctccgtctgggattactggaggggcttcttcgctgccacctgcggggccttcatgtttcacctcctggcggtcttcaacagtgaacaggagaccatcacctccatttacaagaccagcttcccagtggacataccctttgacttaccagagatcttcttttttgtggccttgggggccatctgtggcatcctgagttgcgggtacaactactgccagcggacttccttatttttcctcaagtccaatgggttcacctccaaactgctggctaccagcaagcccttgtactcagctctggctgctgtggtcctggcctccatcacctatccacctggtgtgggtcgcttcatggcttcccggctgtctatgtcagagtacttggagacactgtttgacaacaactcttgggcactgatgaccaagaactcgtccccaccctggtcagcggagcctgatccccagaacctgtggttggaatggtgtcatccacagatgactgtctttgggacactagtcttcttcctggtcatgaagttctggatgctgattttggccaccaccatccccatccccgcaggatactttttgcccatctttgtctacggagctgccatcgggcgcctctttggggaggttctatctttggccttcccagagggcattgtggctggaggcaaggtcagtcccatcatgcccggggcctatgctctggcaggtgctgctgccttctcaggggcggtgacccacaccctctccacagcattgctggcctttgaggtatccggccagatcgttcatgcactgcctgtgctgatggccgtgctggcggccaatgccatctgtcagagctaccagccctctttctacgacggcaccatcattgtcaagaaactgccgtacctgccgtggatccgtggtcgtaagattggttcccaccttgtgactgtgggtcacttcatgaactgtaccctcaccacgctggccaaggacatgcccctggaggaagtgatcaaagttgtgatctccacggatgtgactcagtaccccctggtggagacgacagagtctcaggtcctggtgggcattgtcaaaaggacccacttggtgcagtccctccataccgattcagcttcctgggctccaggccagcagccctgtctccaggatatcttggctaacggctgccccacccagccagtgacacttcagctgtccacggagacctccctgcatgagacgcacaacctctttgagctgctgaaccttcagctgctgttcgtgacgtcacgaggcagagctgtgggctctgtgtcctgggtggagctgaagaaagcaatttcaaccctgaccaatccgcccgctcccaagtgagtcagcctgggagtcggcagcctggcgcccagtcgctctcagctgctgcagggcatctccactttgcagaggagaggactccacattcacctctccccaccctgaaggagctggttgtaaatgaagacaccaatgcgttctgtcacatcggacccttggtccttctagggttgtctgctgctaaccaagacttctgagaaaaataaaactgatttctgg

SEQ ID NO: 1411 - DNA, 486 bp, Rattus norvegicus
  Genbank Accession No. D26496
gagaccaccaaggacatgggccggtgtcttgggaagtacgttgtagttttcaactgctcagaccagatggatttccggggacttgggcggatattcaaagggctggcacagtctgggtcctggggttgttttgatgaattcaaccgtatcgatctaccagtcctgtcggttgcagcccagcaaatctccattattctcacgtgtaaaaaggagcataagaaatcttttatttttactgatggagataatgtgaccatgaacccagaattcggactttttctaaccatgaaccctggctatgctggacgccaggagctccctgagaacttgaagatcaacttccgctctgtggctatgatggtccctgaccggcagattatcatcagggtgaagttggccagctgtggcttcattgacaatgtagttctggcccgaaagttcttcacgctctaccagctgtgtgaggagcagctctcaaagcaggag

SEQ ID NO: 1412 - DNA, 1310 bp, Rattus norvegicus
  Genbank Accession No. D29960
gcaggatggagatccgggtgcctgtgcagccttcttggctgcgccgtgcttcagctcctttaccgggtttttccactccgggacgcctctttgaccagcgtttcggcgaagggctgcttgaggcagagctggcttcactgtgccctgctgcgatcgcgccctactatctgcgcgcccccagtgtggcgttacccacagcccaggtgcccacggaccctgggtatttttctgtgctgctggatgtgaagcacttctcgccagaggaaatctctgtcaaggtggttggtgaccatgtggaggtccatgctcggcatgaggagcgcccagatgaacatggattcattgctcgagagttccaccgccgataccgcctgcctcctggcgtggaccctgctgcagtgacctctgcactgtctcctgagggtgttctgtctatccaggccacaccagcgtcggcccaggcctcacttccgtcaccacctgctgccaagtaggggtcccagcattacaggaccgaaccgggaagcctctttaggctcccttttaaaatgccgatctgactccactgcccagccagatgtcccaatcgctgtcaagacagcctttcccaaccacaactagatgtcctcccctgagaccttcccaacccaaaccctacctgagccttagtgacctagacacccttcctaagccctctcccagctttcaggccccacccatgacatctctctagaggcaacacaaacactactgtcaggagccaaggctcccatcagactgaccccactttgggcttctctcacactcaggctgcatttgtgagctgtagaacaccccaccgtgacagcagagtacaatgtagtcagcgctcccctccttccaatcctgtcacctaattccccacagtgatgtagactgcataggctttccacaccagaacgctcaagcctggtccaccagactccagtctctgtaacctaacactcctctgccccagcccactgtctgacttaaaactccaggcaccgaaattcttgaatactattctgacctccaattcttgggactcctattcctgacaaaccaggaaccccaaactcaaattgtatggacactccaccttctccagatgtgctagaccaatgaacaagaacctgtgagctctctgtcctggctccccatctgcagtcagatgtcttagggagcccgctccacatctgccatcctctaaggttgcaccttcactctgaacatttcctgtctccccaggccttcctgccattagttcccaataaatgcacttgagattt

SEQ ID NO: 1413 - DNA, 900 bp, Rattus norvegicus
  Genbank Accession No. D30804
tggagcggcggcggcttgagctcgcgcgtccgcagtgatgagctacgaccgcgccatcaccgtcttctcgcccgacggccacctcttccaagtggagtacgcgcaggaggcggtcaagaagggctccaccgcggttggtgttcgaggaagggacattgttgttcttggtgtggaaaagaagtcggtggccaagctacaagatgaaagaacggtccggaaaatctgtgctctggacgataatgtctgcatggcctttgcagttgtagcctctgtctcaggtctcactgccgatgcaaggatagtcatcaacagagccagggtagagtgccagagccaccggctgaccgtgggggacccagtgactgtggagtacatcacccgctacattgccagtctgaagcagcgttacacacagagcaatgggcgcaggccatttggtatctctgccctaattgtgggtttcgacttcgatggcacccccagactctatcagactgacccctcaggcacataccatgcttggaaggccaatgccataggccggggtgccaagtcggtgcgtgaatttctggagaagaactacacagatgatgccattgaaacagacgatctgaccatcaaactggtgatcaaggcgctgctggaagtggtccagtcaggtggcaaaaacattgaacttgctgtcatgaggcgggatcagcccctcaagattctaagtcctgaagaaattgagaagtatgttgctgaaatcgagaaggagaaagaagaaaatgaaaagaagaaacaaaagaaagcatcatgagggcagcggtcagagcagctttgagcctccatccgagcaaacgggtgctgtgggccttgtggccatttgtcggagtccaataaactactacgtttttt

SEQ ID NO: 1414 - DNA, 3477 bp, Rattus norvegicus
  Genbank Accession No. D38222
cgagagctcagagccgggaaggatgaggcgcccgcggcggcccggaggtcccgcgggctgcgggggctccgagggttccgggggccttcggctgctggtctgcctgctgttgttgagcggcccgccccgggggctgcagcgccatcagtgcccacggctgtctctttgaccgcagactttgttcgcatctggaagtctgtattcaggatggcttgtttggacagtgccaggcaggagtggggcaggcacggcccctgttacaagtcacttccccagttctccagcgcttacaaggtgtgctccggcaactcatgtcccaaggcttgttcctggcatgatgacctcacccagtatgtgatctcccaggagatggaacgaatccccaggcttcgtcccccagaacctcatccaagggacagatctggatcggtgcccaggagagcaggcccagcaggggaattgctttctcagggcaatcccactggctcctctcctgctgtccaggggctctctcggcctccaggggatgggaatggagctggggtgggctccccactgtcctctctgcaggctgagctgttaccccctctcttggagcatctgctaatgcccccgcagcctccacacccgtctctgacctatgaacctgcattgctacaaccttacttgttccagcagtttggttcccgagatggctcccggggctcagagagcgcctctggggtagttggccatctggccaaggctgaagatcctgtactcttcagcagaagcctctccaaggccattttggggactcactctggacactcctttggtgaccttacaggtccctcacctgctcagcttttccaggattcagggctgctctacatggcccaagagttgccagtgcctggcagagcccgggcgccaaggttgccagaggaagggggcagcagccgggcagaggactcttcagagggccatgaggaggaagtactagggggtcatggggagaagtcccctccccaagcagtacaagcagatgtaagtctgcagagattggctgctgtgctggcaggctacggagtagagctgcgtcagctgaccccggaacagctttctaccctcttaaccctgctgcagttactgcccaagggcacaggaagacatcttggaggggctgtgaacggaggagccgatgtcaagaaaacaatagaagaacaaatgcagagaggggacacagcagacgctcggccccccacacccttgcttcctggacaccccactgccagctccacctccatcaaagttcggcaggtgctgagccctggtttccctgaacctcccaagacatccagtcctctgggcatctcggctgtcctgctggagaagaaaagtcccttgggccagagccagcccacagtggtgggacagccttcagctcgaccgtccgctgaggagtatggctatatagtcactgatcagaaacccctgagtctggtggctggagtgaagttgctggagatcctggctgaacatgtgcacatgacttcaggcagcttcatcaacatcagtgtggtaggaccagctgtcaccttccgaatccggcacaatgagcagaacttgtctttggcagatgtgacccagcaagctgggctggtgaagtctgaactggaagcgcagacagggctccagattttgcagacaggggtgggacagagggaggaatccgccgcagtccttccccgacaagcccatcggatatctcccatgcgctcattgctgcttactctggtggccctggcaggtgtcgctgggctactagtagctttggcggtggccctgtgtatgcgccatcattcgaaacaacgggataaggagcgcctggccgcgctggggccggagggggcccacggtgacactacttttgaataccaggacctgtgtcgccagcacatggccacaaagtcgctgtttaaccgggcagagggtcagccagagccttctcgggtgagcagtgtgtcctcccagttcagtgacgcggcccaggccagccccagttcccacagcagcacaccgtcctggtgcgaggagcctgcccaggccaacatggacatctccacaggacacatgattctggcatacatggaggatcacctccggaaccgggaccggttggccaaggagtggcaggccctgtgcgcctaccaagcggagccaaacacctgtgccaccgcacaaggtgaaggcaacatcaagaagaaccgccatcctgacttcttaccctatgaccatgcccgaatcaagctgaaagtggagagcagcccctctcggagtgattacatcaacgccagtcccatcatcgagcatgaccctcggatgccggcctacatagccacacagggacccctgtcccacaccatcgcagacttctggcagatggtgtgggagagtggctgcactgtcatcgttatgctgacccctttggtggaggatggtgtcaaacagtgtgaccgctactggccggatgaagggtcctccctctaccacgtctatgaggtgaacctggtgtctgagcacatctggtgcgaggacttcctggtgcggagcttctacctgaagaacgtgcagacccaggagacgcgcacgctcactcagttccacttcctcagctggccggcagagggcactccggcctccacccggccgctgctggacttccgcaggaaagtgaacaagtgctacagaggccgctcctgtcccatcatagtgcactgcagtgatggtgcagggaggacaggcacctacatccttattgacatggtactgaatcgcatggcgaaaggagtgaaggagattgatatcgctgccaccctggagcatgtccgtgaccagcgacctggccttgtccgttctaaggaccagtttgagtttgcgctgacagccgtggcggaggaggtgaatgccatcctcaaggccctgccccagtgagccccctgggtacctcagtgggcatcctggcctctgctccttctgcctgtgtgtgagcatttgtgcacccactcttcagcccctacccatctgccaccttggtccgtccgacttgggcatgatagccctttccaacccagtgtggaaggaagtcgggagggaaggggcaggtccaccctgctttattcacgctagaaccaagatctcctgtgggaaacagacagcaggcaaggggaggagtggacaccagcagcaagtgtgcccgagccccatccttcctgagtctctgtctccctctgtgtgtgtacctccccactcccaccagcctatcgtgtatagacaaagcagaatgagaaggccccagctccccccagtcctgctaccactggcctgccaccttgaccctgctcaaccttctccctctagcacaagcaaacatttctagaaaaatctacttttgtatcaatgtgaataaagttagtgtgttgtctgtgcagctgc

SEQ ID NO: 1415 - DNA, 846 bp, Rattus norvegicus
  Genbank Accession No. D45247
cgttgctgtcgggcgctggccagcgtgttgcagcggccgatgccggtgaatcagcacgggttttttggactcggaggtcgtgcagatctgctggacttgggtccggggagtcctggtgatgggctgagcctagccgcgccgagctggggtgtcccggaggagccacgaatcgaaatgcttcatggaaccaccaccctggccttcaagtttcagcatggagtcattgttgcagcggattcccgggccaccgcaggtccctacattgcttcccagacagtgaagaaagtgatagagatcaacccttaccttctgggcaccatggctgggggtgcagcggattgcagcttctgggagcggttgttggctcgacagtgtcgaatctatgagcttcgcaacaaggaacgcatctcggtcgcggcggcctccaaactgcttgccaacatggtgtatcagtacaaaggcatggggctgtccatgggcaccatgatctgtggctgggataagagaggcccgggcctctactatgtagacagtgaggggaacaggatctctggaaccgccttctcagtgggatctggctccgtgtatgcgtttggagtcatggatcgaggctactcctatgacctacaagtggaggaggcctatgacctggcccgccgagccatctaccaagccacctacagagatgcctactccggaggagcagtcaacctctaccatgtgcgggaggatggctggatccgtgtctccagtgacaatgtagctgacttacatgacaagtatacttcatctatcccctgagggaaggtggagtgccctggttataataaataatagtacccgttc

SEQ ID NO: 1416 - DNA, 1304 bp, Rattus norvegicus
  Genbank Accession No. D50564
gaattccgtctggcctccttccctcccctgggtaccctcttactgtctgccacctctcggctacctccactgagtgcccaggagtcactgaaactcctggtctctgggatatcaccttaaacaccacctgagttgtctgaggaaggactcttggcaaagcagggtcagagtgactttgctggccctgcaatccgagcgtcccctaggccatggctgccccacagcttttccgagctctggtatctgctcagtgggtggcggaggctctgaaatcccctcgcgcctctcagccgctgaagttactggatgcgtcctggtacctacccaagctgggccgcgatgcgcgacgcgagtttgaggagcgccacatcccgggcgccgccttctttgacatcgatcgttgcagcgaccacacatcgccctacgaccacatgctgcctagtgccacgcatttcgccgactacgcgggcagcttgggcgtgagtgccgctacacacgtcgtgatctacgacggcagcgaccagggcctctattccgctccgagggtctggtggatgttccgcgccttcggccaccactctgtgtcgttgctggacggcggcttccgctattggctgagccagaacctgccaattagctctggcaaaagcccctcggaacctgcggagttctgcgcgcagctcgatccctccttcatcaagacccacgaggatatcctggagaacttggatgcccggcgcttccaggtagtggacgcccgcgcagctggccgtttccaaggcacacagccagaaccccgagatggcatcgaacctggacacatccctggctcagtaaacatcccattcactgaattcctgaccagtgaaggtctggagaagagcccagaggagatccaacgcctgttccaggagaagaaggtggacctgtccaagcccttggtagccacatgcggctccggtgtcacagcctgccacgtggtcctgggggccttcctctgtggcaaacccgatgtgcctgtctacgatggctcctgggtggagtggtacatgcgtgcccaaccggagcacgtcatctctcagggccgggggaagaccctgtgaaggacacagtgcagcttgggtgacaccgaaccatcctagtgccagcctggtcactctgaccctgctttgccaagagtccttcctcagacaactcaggtggtgtttaaggtgatatcccagagaccaggagtttcagtgactcctgggcactcagtggaggtagccgagaggtggcagacagtaagagggctgccggaattc

SEQ ID NO: 1417 - DNA, 1397 bp, Rattus norvegicus
  Genbank Accession No. D50695
ggcttggtcactatggaggagataggcattttggtggagaaaattcaggatgagatcccagcactgtccgtgtctcggccgcagaccggcctgtcctttctgggacccgaacctgaggacctggaggacctatacagccgctacaagaagctacagcaagagctggagttcctggaggtgcaggaggagtatatcaaggatgagcagaagaacctgaagaaggagttcctccatgcgcaggaggaggtaaagcgaatccagagcattccgttggtcattggtcagtttttggaagctgtggatcagaacacagccattgtgggctctaccacaggctctaactactatgtgcgcatcctgagtaccattgatcgggagctgctcaaacccaatgcctcagtggccctgcacaagcacagcaacgcactggtggatgtgctgcctcccgaggccgacagcagcatcatgatgctcacctcagaccagaagcccgacgtgatgtacgccgatattggaggcatggacatccagaagcaggaggtgcgggaggctgtggaactaccactgacgcacttcgagctctacaagcagattggcatcgatcctccccgaggtgtcctcatgtatggcccacctggctgtggaaagaccatgttagcgaaggctgtggcacatcacacgacagctgcatttatccgtgtggtgggctcagagtttgttcagaagtacctgggtgagggcccccgaatggtccgggatgtgttccgcctggccaaggagaatgcacctgccatcatcttcatagatgaaattgatgccattgccaccaagagattcgatgcccagacaggagctgacagggaggttcagaggatcctgctggagctactgaatcaaatggatggatttgaccaaaacgtcaatgtgaaggtaatcatggccacaaacagagcagacaccttggatccagctctacttcggccaggacgcctggaccgcaaaattgaattcccactccctgatcgtcgccagaagaggttgattttctccaccatcaccagcaagatgaacctttctgaggaggtcgacctagaagactatgtggcccgcccagataagatttcaggagccgatatcaactccatctgtcaggagagtggaatgttggctgtccgtgagaaccgctacattgtcctggccaaggacttcgagaaagcatacaagaccgtgatcaagaaagatgagcaggaacatgagttttacaagtgacccctccccacactccccaggcacctgtcccaaaggctagttttctctttacccaggattggtttcgtcaataaatggacgtgattggaaaaaaagcggccgcgaattctagaactagtggatccccc

SEQ ID NO: 1418 - DNA, 3775 bp, Rattus norvegicus
  Genbank Accession No. D63772
ggtccccagcggcagtggcagctctgacagcggcccgtgcgctgtgtctccaccgtgccctgcatccctcatcccacatccgccgcgctccccgattcctcacaaacgccggtgcccatcatggggaagcccacgagctcgggatgcgactggcgccgcttcctgcggaatcactggctgctgctctccaccgtggccgccgtggtactgggcatcgtggtaggagtcttggttcgaggacacagtgagctctcgaatctggataaattctactttgcgtttcctggagaaattctgatgcggatgctgaagctcgtaattatgccactgattatatccagcatgatcacaggtgtcgctgcactggattccaacgtatctgggaaaattggtctttgtgctgtagtatattatttctccaccaccgtcattgctgtaatcctaggtattgtgttagttgtgagcatcaagcctggtgtcactcagaaagtgaatgaaatcaacaggacaggcaaaacccctgaagtcagcactgtggacgccatgttggatctgatcaggaacatgttccctgagaacctggtccaagcctgttttcagcagtacaaaaccaagcgtgaagaagtgaagcctgccagtgatcctggggggaaccagacagaggtgtctgtcaccacggccatgacaacaatgtctgagaacaagacaaaggaatacaaaatcgtgggcctgtactcagacggcatcaacgtcctgggcctgattatcttctgcctcgtctttggacttgtcattggaaaaatgggagaaaaagggcagattctggtggatttcttcaatgcgttgagtgacgccaccatgaaaatcgttcagatcatcatgtgttacatgccgatcggtattttgttcctaatcgctgggaagatcatagaagttgaagactgggaaatattccgcaagttgggcctttatatggccactgtcctgagtgggcttgcaatccactccctcgtagtgctgccactgatctatttcatagtcgtgcggaagaaccctttccgctttgccttgggcatggcgcaggctctcctgacagctctcatgatctcatctagctcggcaacccttccagttacattccgctgtgcggaagaaaagaaccacgtggacaagaggatcacaagatttgtgctgcccgtcggcgccaccatcaacatggacggcactgcgctctatgaagccgtggcagctgtgttcattgcgcaagtgaacggcatggacctgagcattgggcagatcatcacgatcagcatcacagccaccgctgctagcattggagctgccggtgtgccccaggctggcctggtgaccatggtgatcgtgttgagtgccgtggggctgcctgctgaggacgtcaccctcatcattgccgtcgactggctcctggaccggttcaggaccatggtgaacgttctgggtgatgcgtttgggacgggcatcgtggagaagctgtccaagaaggagctggagcaggtggatgtctcctctgaagtcaacattgtgaacccctttgccttggagcccacaatcctggataatgaagactcagatacgaagaagtcttacgtcaatgggggcttctcggtagacaaatctgacaccatctcgttcactcagacctcgcagttctagatgcctggccttagatgcctgggactgtgaagggcatctccgagggagccatctcttagccaactccagcgttaaggagcgagaaggacacaaagaatcaactgtacatttagtttgataaacagacctccagattattttctatatttggctctatagcctttgttctctgggtttgggaacgtggggtgggatgaaccgaaggaaattaagaaagctgtgttatctggactttctaattctgtaaaacaaagtttagaagtatatgacgtagtaactgttaggattaggtcatgggtctgggagaaaaattgctttctcaagcacagaccaatatttggggtttttaaacaatattattggctacaaatttttactcaggctttctattggcggggcttcctttgccttctcactttttatagattataattcagctcaaaagccccacccagtcaactagtgcccaattttccattttgcctcattccagcactctcaactactagtgccaaattttccattttgacctcatctccagcaactctcaaactacttttgggaaaaaaaaaaaagcaaaaaggatcagcatagtctgcaataacagtttcaagatattgtggggcttaggggaagggaagggttttttattcaatgtactgtattgggacgctggatgtcagtgttcggtatagaactatatgtatatgtgtgtatatttattattttcatgtaattttcaagacagagatcagtaatgaactatcaatgtgaacgagacgttttccttgtacttgaatcagggctctagctccagccttgctgtgcttcagagctcacgaggacgctctcaggcgctctggggtgagaaatcaagttgctgggttactgtggttcaagccctaaagcagaaactctagggtggcccagccatccattgacaacatctaaggtcaagctccctggagggtgggaaacccttgtcgggcatggaataagtacatttacaaagggaccgtagaggcaagatgtgctccgatagcaacagaaggcttcattcttcaagtacacttcaaggcccacttcacaaggctgtcacctttctgcccttggttttctctgaccaccagggccaaaccagcagtggcgagccatcacctaagctgtttcaaaatgggctgcataaattgaataagcttcatcggaaggtgaccaagctattctaatactgtagtctttttattttagcttttgttattttatttttttagttttttgagacagagtttgtctacatagccctggctatcctggaactcactatgtagactagactggcctcaaactcacagagatcctcctgcctctgcctccttagtgctggcctgaaaggcaagtgccaccatgcccagctctatgctgaattcttacagaataaaaaccataaaagccgggccacaagctactgataccagtggttcaggggaaatgcttcagtctgtctctggagaagactgttctgaaaatctcggccttgtggcttagaatcctctgcctgtctttctcctgctaatttctgaagatggactattaaaattctacacttctgtccccatcctgtaaataaaacccaacaaaaactcgttcttaatgtggacggattcagaacagccatgtttctgtagtgcccttaactcatcttaaacccgtgcttttatatttgagaagccagaaatcgtgccaaagataacagaaaggtaaacgagtgttgaccatggccacctgaagctacagcctgaccctcacagtgaccagtgactccgaactttgaagtacaaatatccctattctttataggaagcaaatctaaatctaaatgaggttggatgaatactttatgtaggaatggctggttctgtccccttatcaggtggttcttgtctgtggcactgaattaattggcagagctgtccacgagttcactggggtcatccttgtaaccagctgcttaacacactgtgctgttatctcaagaggacgcgttccatttttctcaataaacatctcccacactttctccctt

SEQ ID NO: 1419 - DNA, 1621 bp, Rattus norvegicus
  Genbank Accession No. D82928
gtggatcgcccgggagaactgggcccagggctcaggtggagctgccgatgccccgggctgaaaggtgagaccacgctggtgaggctgggacaagaccttgcacctccagacctgggccgagaccacaaggggagccgccaagatgccagaggaaaatatcttcctgttcgtgcctaatcttattggttatgcccggattgttttcgccatcatttccttctactttatgccctgctgccccttcacggcctcctccttctatctactcagcggacttctagacgctttcgatggacacgcagctcgagcccttaatcaaggaacccgatttggggccatgctcgacatgctgacggaccgttgcgccaccatgtgtctcttggtcaacctggccctgctctaccctcgggccactcttctgttccagctcagcatgagcctggacgtggccagtcactggctgcatctgcacagttctgtggtgcgaggcagtgagagccacaagatgattgacctgtctgggaaccctgtgcttcgaatctactatacttccaggcctgctctgttcaccctgtgtgctggaaatgaactcttctactgcctcctgtacctgttcaatttctccgagggaccactagtcggctctgtggggcttttccgaatgggcctctggatcacagctcccattgccctgctcaagtccatcattagtgtcatccacctcgtcacggctgcaaggaacatggctgccctcgatgcagcagaccgcgccaagaagaaatgatcctctcccatccccagctgcccacctgccctgggtatctactgtgccacatggctcctctcctcctaagaggtcccagtgtcatgtctttctcatgtgttctctaacctgctgggattgggggtcaccctctgtttggtgttgtcactgtctttttactcctgataactagacccaacccgtgaccccaaggacctggcactgcaaagcaggaagggtgctcaggaggcccactcatccagccggtgctccaggaggcctgtctgaagactgggtgttgccacatatcctgctggatcagcctggggtctggcctgagactttgggaacttatacgggcaaaggagtcaggctgatgggccaagaaggctggggtaccaggccagggagggaaggggccaagggccaactagatctttcccttaggcaagctcctctatcctgtcctgctctggaaacctccataataaaggggggcaccttcactctttttggatttgtttactttgggacactcttagatgatggcctagggttcaaaggagctgggtaaaaaaaaaagaaatccacctggatgcttttcccacaaaggtggttggctcctccctgtcattccagtgacctcagagaggcctcgaggttcacaagcgttgtcctgcccacctgctctatgtcctggctggccactttcactgtaaccttgatgtttttgaccctcatgagaatgtaagcttcacaagagcagatttagatctttctcgtctctgcctggagtgaaaagtagcctggcatgtggtaactgcttaataaatattcatggaaagatgaaaaaaatac

SEQ ID NO: 1420 - DNA, 433 bp, Rattus norvegicus
  Genbank Accession No. D84485
  misc_feature (1)..(433): n = a or c or g or t
acaaaaaactgtttattgctgtgacagccaccagaagctgtcaaggagcccattgctgtgaggggccaggcagccagtggatgggctgaacgccagtctcacgagtcaaccaacctgctgctggccccgcccacccagcaataggctgtcacactgattaaaacccaaccaggagataggaaacccccataggttcaccttcctaggtctcatgacctagacgaagaagagtgccccaaatacccctccaaaataagacctgccctggtccctcatatttctgaggatcctggggtgtcatacagccctgcagcaagccagagttgcagccccaaggaagtaccagctcctctctgttccacaggctgtcccaagantccagcccaaggtattcagctgcctctagaatgcagggggggaatcactaggaata

SEQ ID NO: 1421 - DNA, 2908 bp, Rattus norvegicus
  Genbank Accession No. D88250
ggaggtatcgaggaagagagaacagggaggtggggcggaggttcctcgcagagcctctggagccgcaggggcttcacggcatgaccagaagcaggagaggaggctgacccacttgttcccatcagctcctgaaggtgacactgagccctgggtggcccctcactgccaaagcagtcacctgtatttgtcagataaagacggccagcccggctgccctttacctccaagtcagagatccagagagccatgggcaaatcgccagagatgtggtgctttgtcttcttttctcttttggcatcgttttctgctgagcctaccatgtatggggagatcctgtcccctaattatccccaggcgtaccccaatgaggtcgtgaaaacttgggacatagaagtcccagaggggtttgggattcacctttacttcacccatctggacatggagctgtcagagaactgtgcatacgactcagtgcagataatctcaggaggtatcgaggaagagagactctgtggccagaggtccagcaagagtcccaactcccccactgtagaagagtttcaattcccatacaataggctccaggtggtctttacgtcagacttctccaacgaggaacggtttactggctttgcagcgtattactcagccgtagatgtaaatgaatgcacagactttacagatgtcccttgcagccacttctgcaataacttcattggtggatacttctgctcctgccccccagaatacttcctccacgatgacatgaggacttgtggggtcaactgtagtggggatgtattcactgccttgattggggagatcgcaagtcccaattatcccaacccatacccggagaactcaaggtgtgaataccagattcggctgcaggagggcttccgactggtgttgactatccggagagaagattttgatgtggaaccagcggactcagaggggaactgccacgacagtttgacttttgctgcaaaaaaccaacagtttggtccttactgtggcaatggattccctggacctctaactattaaaacccagagcaatactcttgatattgtctttcaaactgacctaacggggcaaaataaaggctggaagcttcgttaccatggagatcccatcccctgtcccaaagaaatcagtgctaattctatctgggagcccgaaaaggcaaaatacgtgttcaaagatgtcgtgaagataacctgtgtggatggattcgaagttgtggagggaaatgttggctcaacatcattctattccacttgtcaaagcaacggacagtggagcaattccaggctagagtgtcaacctgtggactgtggtgttccagaacccattgagaatggtaaagttgaagacccagaagacactgtattcggctccgtcatccactacacgtgcgaagagccatattactacatggaacaggaagaaggcggagagtatcactgtgctgctaatgggagctgggtgaatgaccagctgggtgtcgagcttccaaaatgtattccagtctgtggagtacccaccgagccctttaaagtacagcagaggatatttggaggatactctacaaagattcaaagttttccttggcaggtctactttgagtccccccgaggtggcggggctcttatcgatgagtactgggtgctgacggccgctcacgttgtggagggaaactctgacccagtgatgtatgtcgggtccacacttctgaaaatagagcggttgagaaatgcccagaggctcatcactgaacgtgtgattattcatcccagctggaaacaagaggacgacctgaatacacggacaaattttgacaatgacattgccctggtgcagctcaaagaccctgtgaaaatgggacccactgttgcccccatctgcctgccagaaaccttctcagactacaacccctcagaggttgacctggggctgatctctgggtggggccgaacagagattagaaccaatgttattcaactcagaggggcgaagttacccataacatctttagaaaagtgccagcaggtgaaagtggaaaacccgaaagcgaggtcaaacgactatgttttcactgacaacatgatctgtgctggggaaaagggtgtggacagctgtgaaggtgacagcggaggggcttttgctctgccggtccccaatgtcaaggaccccaaattctatgtggctggcctggtgtcctgggggaaaaagtgtgggacctatgggatctacacaaaggtaaagaactacgtggactggatcctgaaaactatgcaggagaatagtgggcccaagaaggactgatccgtagtaacaacacccctccaggactagcaaggtcatttttctcagatcctgggacggtcccattatttcaaaatgatggagagagggtgtgggagcatggttaacgttgaacatgattgtcaagaagcctgcttggaggcagagttgatcactgagccgtgttggttattcagttgctattgctaacaacatgcggaagcctttctgtcttgcttcatcccacagggatatcttaaacgatttccccctcatttaacccgcttgaaatccttattgcttacagtaaagcatgtttccaatctggttctggctgctcgagagcccagaaggagagggaaatttgagggtattttgtcatggaattcaggcatcgacaggttgtctgaaacactatgcagtcagggaacacagccttttttctaagtgagatttacccaatagctggaagtcagaattgactaccttagctttcctttgtgagttgtttcaatatgttccctagaaattagttttcttataatcctcctttgtatcatacaatgtaatgacttaataaaagagaaattgaacattg

SEQ ID NO: 1422 - DNA, 1743 bp, Rattus norvegicus
  Genbank Accession No. D88666
ctccagcccagcgatgtgtcctggcctctgggggacatgcttctggttgtggggatcacttttatggctcagcattggaagatcagggaacgtaccccctaccacccaaccgaagtgcactgacttccagagtgccaacctcctcagaggcaccaacctcaaagtccagtttctcctctttaccccctcggaccccggctgtggacaactagtagaagaggacagtgacatccggaactctgagttcaatgccagtctgggaaccaaactaattattcatggattcagggcattaggaacaaaaccttcttggatcaacaagtttatcagagctctcctgcgggcagcggatgctaatgtgattgcagtggactgggtttatggttccacgggcatgtacttctcagctgtggagaatgtggtcaagttgagcctggagatctcccgtttcctcagcaaacttttggagctgggtgtgtcagagtcctcaatccacatcattggtgtcagtctgggggctcatgttggaggcatggtggggcatttctacaaaggccagttgggacggatcacaggtctggatcctgctggaccagagtacaccagagccagcctggaggaacgcttggattctggagatgccctgtttgtggaagccatccacacagacactgacaatttgggtatccggattcctgtcggacatgtggactactttgtcaatggaggccaagaccagcctggatgccctgcattcattcacgcaggttacagttacttgatctgtgatcacatgagggctgtacatctctatatcagtgccttggagaacacttgcccactgatggcctttccctgtgccagctacaaggccttccttgcaggagactgtctggactgctttaaccctttcctgctctcctgtccgaggattggactggtggaacgaggtggtgtcaagattgagccgctccccaaggaagtgagggtctatctccagactacatccagtgccccatactgtgtgcaccacagcctcgtggagtttaatttgaaggagaagagaaaaaaggataccagcatcgaggtcacctttcttggcaacaatgtaacgtcctcggtcaagatcaccatacctaaagatcaccttgaagggagagggatcatcgcccatcaaaacccacactgccagataaaccaggtgaagctcaagttccacatttctagccgggtttggagaaaagacaggactcccattgttgggactttctgtaccgctcctctgccagtcaatgacagcaagaagacggtctgcatccctgagccagtgcgtctgcaagtgagcatggctgttctccgggacctgaaaatggcctgtgtgtagcctgagcctactcttgaggcagaggccggaatttttcgagggcagtgtggcaagggctgtttgcaagcgccatattctaccctgtttctactaagggggggaaggccaaattcttggtggttttctccataagtagttactgtggaagggacaggtgactcatattacagaacttgatctccgtcaccgacttacaaagctttatacagatgccatttcagcttctctatttcaacacaactgtgattgcctcacagccttaagtatctatacttaggattcaatggaaaatgtactcggagaaatgttttaaataaattgtcatggaatatctgaaaaaaaaaaaaaaagaaaaaaaa

SEQ ID NO: 1423 - DNA, 405 bp, Rattus norvegicus
  Genbank Accession No. H31117
  misc_feature (1)..(405): n = a or c or g or t
ttgaccacttggctttagatgagatcaagaaacgcgggatccgggtgggctacacgccaggtgtcctgacagacgccacggcagaacttgctgtctccctcctgctcaccacctgccgccggttgccggaagccatagaggaagtaaagaacggtggctggagctcctggagccccttgtggatgtncggttatggactctccgagagcactgttggcattgtggggctggggcgcataggtcaggccattgctcgacggactgaaaccatttggtgtccagagatttctctacacggggcgccagccagggccttcaggaagcagcagagttttcaggcagagtttgtgcctattgcttcagctggctgccgagttcagacttcattgtagtgttcctgcttcc

SEQ ID NO: 1424 - DNA, 356 bp, Rattus norvegicus
  Genbank Accession No. H31456
agtctacatacacttttacttattcataaatactgatttacatataataacccacacaattttatcttcaaaaacaccatccaaaacttcaagttaaatatactgcaggattaggttgagtttttatttatttttgaagtttagtttttaaccatgtcttccttcaggtatacgtcatcagaacagcacacaggaaggacactttggggcatgtctagcccaccagcagatccatttctaggcatacaggctactacacttggcatggtcgtgtcacccaacttctctgggactgccctttcctttggaagggacctagctcaactgtgattttttgtggttcagatggtgtcaaa

SEQ ID NO: 1425 - DNA, 357 bp, Rattus norvegicus
  Genbank Accession No. H31489
  misc_feature (1)..(357): n = a or c or g or t
ctgagacagggttctctgtgtagcgcaggctgccctgcaacttgttctgtagaccaggctgcccttgaactcacagagatccacctgcctctgtcttccgagtgctgggattaaaggtgtgcgccacctctgccaggctccccaggagtcattcatgccatcaggttagttgaggcttatgggcctccccttgtgtctcttcgtactcctcccacggtttcagctgaggaccaggaatcatcaaggtcttgagaattggttgcttagggggtgcccacgggggcacaatcttggcatgcattctccagctnccatacgggttcatcaagtgcctttcaaacaccacatattccaggg

SEQ ID NO: 1426 - DNA, 471 bp, Rattus norvegicus
  Genbank Accession No. H31610
  misc_feature (1)..(471): n = a or c or g or t
cttgagtcttgaggcaacttttttcaatgcaatgcagttgtcaatcacaacaaatcgaggacagcccaggaggaacgacttcagccctcctgccttctccagtatctggcgagtttcttcagggaagaactcatattcctcagagaacatcctatcactcatatccaaggggccgtgctcttccagcaactgagagaagtaatcatacagagttgaacatttctgtttggggttaatatcccacagcttcttatttcggacaacatactcgctgctgtgctggtcgtaaagagcttcgaactcttccacatcttgccgaagtgggtcaggcactgcaaatggtcctgcagaatctgaattgcgcctgttatggtcttctggagtgacagtctcactacttggngttactgatgctgttccagatcccactaacatcgggntttgaatcttttggnttctttttcctgcctt

SEQ ID NO: 1427 - DNA, 438 bp, Rattus norvegicus
  Genbank Accession No. H31813
  misc_feature (1)..(438): n = a or c or g or t
ggcttcaatggattttattagccttctttcatgtactgactgggtataggaggccttccagaggaagaggcctgcaagtnagaggctcaggagaagccaaatcactgacacccagagctggttagggtgggatggacaagatctgagcgattcctcttctggaggagggaacgaacagtgctgctgaggcatgtnacccacccagccagacactcttcacagaacagttctggagggtgtggtgaaggatgtcctgctccatgcagggatgggtgtcannngaggaagggaggagtttatcagaaggcaagaggaagtaacaaactgagaggagcggaggaggaggaaagcagttaagctgccttcgtctgcaagcctccaggatggcacggaagatggctgcagccgcgacttctccaggatctggctgatctagtt

SEQ ID NO: 1428 - DNA, 325 bp, Rattus norvegicus
  Genbank Accession No. H32169
  misc_feature (1)..(325): n = a or c or g or t
aataattgtagaggaagcaaagcagatcttggtgggtgacattggtgatactgtagaggacccctacacatcttttgtgaagttgctacctctgaatgattgccgatatgctttgtacgatgccacatacgaaacaaaagagtctaagaaagaagacctagtatttatattctgggctcctgaaagtgcaccgntaaaaagcaagatgatttatgctagctctaaagatgccattaaaaaagaaatttacaggtattaaacatgagtggcaagtaaatggcttggacgntattaaggnccgntcgacactgggagagaaactggg

SEQ ID NO: 1429 - DNA, 376 bp, Rattus norvegicus
  Genbank Accession No. H33093
  misc_feature (1)..(376): n = a or c or g or t
ctttgataaacaagtgtttatttctaactcaatatggtacaatgtatatgatattgtgagcacacagtatgcatatagatatataatattcacttttacaaacatacatacatatagacaaaagccattacccatgagtgttagtatccnctgttgggacaaaacacttgatacaactgaaatgagtgangatttattttggttcatggctttggttcatggttctttggcctgaggcaaaactgaacatcatagaaagaaacacttggcaaagaagagtgcttccctcatgacagaaaggagactgggttgagggcaagatatagcccttcagtctttcacttcctgcaaataggcctgatcggctaactgttca

SEQ ID NO: 1430 - DNA, 411 bp, Rattus norvegicus
  Genbank Accession No. H33636
  misc_feature (1)..(411): n = a or c or g or t
cactgcattgtctttattgcatccggagcaagttggccagaccattccacatttggagaaggtttaaaaaaaaagcccaacaatcttctcatcttaccttccccccccccaccccttccccacaactgcacagcaatgtctgaacacatttggtgacaagaacaatttgcaaaagtggtctagaaattacattatgaattgttccaacacaagacacagttggcttccttctgagtcagttatttttacataaactacatggattttttttattacatcaaagacaacagantagattcttcacaagaaacaacaggagtaccaaggttacatgcgaggatttgtaaggaaacaagggtggttgtcacaaatggctagagctaagtcaagagtgagcagttggcagcaaag

SEQ ID NO: 1431 - DNA, 419 bp, Rattus norvegicus
  Genbank Accession No. H34186
  misc_feature (1)..(419): n = a or c or g or t
tggctgtggaccttccaaggtcgtcttctccagaagaacaacaaggaccgcttctnccagctgctctggagaccaaggcccccaacactcctcantcaggntcagataaagcaaattaaaaaggntctgaagaaatactctaagatctttgagcagaaggttcgcttgagccagtccaaagcttcaaaggaactggtggaaagaaggcggaccatgatggaggacttcaggcaataccgaaaaatggcccaggaactctatatgaagcagaagancgagcgtctagagctacggggaggggtggacactgacgagctggacagcaacgtgngatgactggtgaggaagagaccatttganttttttnttcactgaagaggtcattcctctgggaagttcaggagtgacctcagcactgt

SEQ ID NO: 1432 - DNA, 312 bp, Rattus norvegicus
  Genbank Accession No. J00797
gggagagattacctcataccatgtcgcttgcaccaatcaccactctcctgtcgcggcttctctgggcagacggaggggtctggaccaacaggaaaggccttggcccatccccatggtgaccggagctgtatataaggggcgcatccggcccaagtgccggcaggttctcttacatcgaccgcttaagagtcgcgctgtaagaagcaacacctcctcctcgcctccgccatccacccggcagccgcgaagcagcaaccatggtgagcaaaccttcccgagttctcaggagcgggtgggtgtcagcccggctca

SEQ ID NO: 1433 - DNA, 1195 bp, Rattus norvegicus
  Genbank Accession No. J01878
attcttagtatatgactatataagtacacattcagatctttatttccataacctaagtttttatttttttttgttgcagcgcttggcagttttatatacattcatacatacatacatacatacatataatatttgcaataacagaataataaagaattatacaatcaagtatatagttgatgtttgatgtctgtagcaaatatgaccaattctgtaacgactcagatgaaactggaaattatttttcctgtactttctgagtacaagaaggtttacattcatcaacattctgttagtaatgatgcaggaaactacatgaataccaaataaaactgttgaataaacgattcgtatcatgctgtatttaaaacaaatacttcagaaattgccagttttaggctgctggtgtagtgtgttctggatattttaaatgtgtagtcgctgactcacttggcctcctgagatggtttataaatataacaagtgtggaggagagagcgattctagagcacagtttagaaagccttgtgtcaggggcttgttgctcacgcactggttgctttcccatagtcacttccggctagtacagagattaacttccattcaggattccacgaatctactggctgtgttttcagacagtgcccttttcatgataagatcttcttcctccaactcccaccccctacatacgcctctgctttcttcatttcaaatcaaagtattttttcctcttcgacatcgtgaagccgtgctgccttcagagctctgagtcatgggcagagagtggctcccccagcattctgcgttgggtcccacatacttccaaatgtgcacatttgcggggtgaatcaatgctgtggaggaggattccagtaactctggcccttcccactgcctgcacaggctgcccatgatttcctcccaccccatctgtcaagcattgaaagtgaagagaaattctgtccaatatgttgtttgaagggataccaaagggaggaaaaagctcccacccaaaataatgggctttttctttcacataatgtaaacatgtaaaatattgatgggtatcaaatcttcatttaaagatctggtacagggggctggggatttagctcagtggtagagcgcttacctaggaagcgcaaggccctgggttcggtccccagctccgaaaaaaagaaccaaaaaaaaa

SEQ ID NO: 1434 - DNA, 1639 bp, Rattus norvegicus
  Genbank Accession No. J02827
tccgcggccaagatctggaggccgagccgtggcctgcgccaggctgccctcttgctgttggggcgacctggggctcggggcttggctagattccaccccagcaggcagcagcaacagcagttcccatccctggatgacaagccccagttcccaggggcctctgcagagtttgtagacaagcttgagttcatccagcccaatgtcatctccggcatccccatctaccgcgtcatggaccgacagggccagatcatcaaccccagtgaagatccccacctgccccaggaggaggtcctgaagttgtacaggagcatgacgctgctcaacaccatggaccgcattctctatgagtcccagcgacagggccggatctccttctacatgaccaactatggcgaggaggggacacatgtggggagtgccgctgccctggagcgaacggacctggtgtttggccagtaccgggaggcaggtgtgctcatgtaccgggactacccgctggagctgttcatggcccagtgctacggcaacgtgagtgacccaggcaagggacgccagatgcccgttcactacggctgcaaggagcgtcacttcgtcaccatttcctctccactggctacgcagatccctcaggcggtaggggcagcctatgctgccaagcgggccaatgccaatcagatcgtgatctgttactttggcgagggggcagccagtgaaggggatgcccacgccggtttcaattttgctgccaccttggagtgtcctatcatcttcttctgccggaacaatggctatgccatctccacaccaacctctgagcagtaccgtggggatggcatagcggctcggggccctgggtatggcatcatgtcaatccgtgtggacggcaacgatgtgtttgcggtgtacaatgccactaaggaggcccgacggcgggctgtggctgagaaccagcccttcctcattgaggccatgacctacaggatcgggcaccacagcaccagtgacgacagctctgcgtaccgttcggtggatgaggtcaattactgggacaagcaggaccacccgatctcgagactgaggcagtacctgctgaaccagggttggtgggatgaggaacaggagaaggcctggcggaagcagtcacgaaagaaggtgatggaggcctttgaacaggctgagcggaagctaaagcccaacccaagcctcctcttctccgatgtgtaccaggagatgcctgcccagctgcgcaggcagcaggagtccctggctcggcacctgcagacctacggggagcactaccccctggaccactttgacaagtgaggccctaaccaccacaaggtgtcctgctctgagtggagctggggggcggcaggacgctgccccccgctgctaaccagtgctgctgacgtgctgagcagccagtgtggcacgcactgcggctcccccaggctacttcactggggcaccacatttgcagccattgctgcagctccatcactcccttcacctgttacagtgccttttaggggtggggaggaaccagggccagggcagaccctttggcagggtggccctggatttgctcagagaaatagctgattggcagagtaagtaaaccacagctctgcctttg

SEQ ID NO: 1435 - DNA, 883 bp, Rattus norvegicus
  Genbank Accession No. J03752
gctagctgtcctcctgggattcagtcatttaaagattgagaccaagattgaaagcatggctgacctcaagcagctcatggacaacgaggtgttgatggcctttacctcctatgcaacgatcattcttgccaagatgatgttcctgagctccgcgactgcattccagaggctaaccaacaaggtttttgccaacccggaagactgtgctggcttcggcaagggggagaatgccaagaagttccttcggactgacgagaaggtggaacgcgtgcgaagagcccacctgaatgaccttgaaaacatcgttccctttctcggtatcggcctcctgtactccctgagcggaccggatctctctacagccctcattcacttcagaatctttgtgggcgctcggatctaccacaccattgcttacttgactccccttcctcagccaaacaggggcttggcattttttgttggctacggagttactttgtcaatggcttacaggctgctcaggagcagactgtacttgtaaagagatttgtgaccgtcaccctctgattgatttaaaaaaataaaggattctatatttctagtgtattaaaaaactttctaaggttttatgtatgaaaggagcagagaaatcaggaatcagggaaaattctgtttgaagactaccatccacaggctctacccttttgtacctgggttagacatttaacatgaccggccttagctatgctgtctaactcctaaagtactttgtcctaagtcttgagtgccttataaattgtaacattccttctacatttcctgtggtgcatctataaaagagtgctcacacctgtgtgaagcctgggtttcattggcacctgaattaaaaacattacaaatg

SEQ ID NO: 1436 - DNA, 4535 bp, Rattus norvegicus
  Genbank Accession No. J03819
caccggctgctcggccgcagctcgcccgcgcgccgcctcggggccaccgccaggctccagcgctccggttcaagaggagccacactggggagtcccaaggaagcagccaggcagatggggagcccaggatccgtggtttccctctccttagtctgctggaggacgcgcgtggtggtaccaagttccacacatgacttaatgaataagggaatgccagagctgaagaggacccagcatgactactaacctatgactcctaacagtatgacagaaaaatgccttccagcctgggacaaacagaagccccatccagaccgaggccaggactggaagctggtaggaatgtccgaagcctgcctgcacaggaagagccatgtggagaggcgtggtgcattgaagaatgagcaaacatcctcacacctcatccaggccacttgggcgagctctatattccatctggatccagacgatgtgaacgatcagagcgtctcaagcgcccagactttccagaccgaagagaagaaatgtaaagggtatatccccagctatctagacaaggatgagctctgcgtagtgtgcggggacaaagccacggggtaccactatcgctgcatcacctgtgaaggctgcaagggtttctttagaagaaccattcagaaaagtctccatccatcttactcctgtaaatatgaagggaagtgcatcatagacaaagtcacccgtaaccagtgccaggaatgtcgctttaagaaatgcatctatgttggcatggcaacagacctggtgctggatgacagcaagaggctagccaagaggaagctgatagaagagaaccgtgagaagaggcggcgggaagagctacagaaatccattgggcataagccagagcccacggatgaggaatgggagctcatcaagacagtcaccgaggcccacgtggccaccaatgcccagggcagccactggaagcagaagcggaaatttctgcctgaagacattggacaagcacccattgtgaacgccccggaaggtggcaaggttgatctggaagccttcagccattttacaaaaatcatcacaccagcaatcaccagagtggtggatttcgccaaaaagttgcccatgttttgtgagctgccctgtgaagaccagatcatcctcctcaaaggctgctgcatggagatcatgtccctccgagctgctgtgcgctatgacccagacagcgagactctaaccttgaatggggaaatggcagtgacacggggccagctgaaaaacggaggtcttggggtggtgtcagatgcgatctttgacctgggcatgtctctgtcgtctttcaacctggatgacacggaggttgccctgcttcaagccgtcctgctgatgtcttcagatcgcccagggctagcttgtgttgagagaattgagaaataccaagacagtttcctgttggcctttgaacactatatcaattaccggaagcaccatgtgacacacttttggcccaaactcctgatgaaggtgacggacctgcggatgattggagcgtgccacgccagccgcttcctgcacatgaaggtggagtgccccaccgagctcttcccgcctctcttcttggaagtctttgaggactgaacggactggacaggttcttgtcattcctgcagcacgactgggtgtcgctgcattccacctgtagctctttctgttgtcgtttcttcgtttctttgtgtcaagtgagctcatcagtgggtcagcgggtcatcagtggcatagacttggatgaagtggtcctttgaatgtgggtctttgtaaccattgcgtttcgttctccagtccttagtgtgacggctttgaggggttcacagcagtgcaggccgagtgggggcgatcatctcaccagcaccacgtcgtcaccagctcccatctgtccctgggcagactcaagcaagccaaatggcattacagaagactaaagaagccttaaaaccgagacgacagtcatcttgatccaatgcgatccagttctgttgtttgtaaggtgaagctggcagagctcaggccacctcaggttgggcgtggcttttggcgcgtgaggggaggagccgttccagcttcaggaactcacagctactcaggagcttaccgcttccagcacccttactctccaagcaggctgacttggaatgtgcaggatacccacaccataacaaatcgacgttactttccatggccttctgtaaccttgtgatttacttcaagttgcgcaagagtagaacttggagacttgactggtttgaggccacaaggaaagtctccttttcaggatgcccatagagcttggaaatcatccatgttacagcatagtttccaaaaatggtgttacctcaagcaggaaggcacctttgcagcttagatagattcacaagccattcccacagagctcaaacctgtttacagagtgccgtccctcttccgatggcctatgaaccagccctctccccagcctgtggctgttgagctggtgatgtttccctgtacattgaatcttccaatcagagagagacgtgttgaaactccagtcttgttttggaaaaatccctggaaaagatcaatgcaggaacaatcagattcaaaggaaaagaactactcatgctgtaggctgtccaattagggagaatgctccccgtggatcggcaaggcgctttacccattcacaaatgtctcccagtcccatcccgtctctgctcccaaacccacctcctcagattctgagacactaaatagcttctcttctcttctcttctcttctcttctcttctcttctcttctcttctcttctcttcccttctcttctctctctcaacactaactcttctgtagcttatacactattaccttggcaaatagtcctcataaaatataggagaccatgcataggaaacaccattacgctgccccatccccagtgaccgtgtagagtagatgtctctaagcaaccagtagtgacaacttacccaaaaatgggcagactgtacccatgcaactgaatgtacgactcttcactgatgtcacagatgtgaactacttcttgtctgcctttcactgccttagcctggaaatgctgggaaaaacaagccatatcagtgagaattacctaaaagcaaaggaagtcactgtgaaaagcaagggaactcacttcttcccaccgggctcggtagagcatctttggcctcacagcaagtcagggtgcctgcggcctgggtcatttaggaccttatcagtgttagttttcttacctcctagtaaatgagttgatctccagaaacccctcttcccttctctagtgtttgacttttcagactaaggagggggcgtctttgaaagattccttttctattcaaacttctagcttcggaaacggaatgcatgtgggtgctcatggagtgagaatgaggatttgattcagaggaaggcagaatgacctcggaagcagagaggtacagccctgaaagtctttggaaataactgaggaaaagggaacagtctgtgcagggaactaaagatttagcctgatgttttagcagataaaaacatcgctgtagacttggtgtggagattaaatagaaacaagaagcccccagagagtcaagttcaagcatctgtctgagatttgctttcccaggcaacctgtacccagcctcctccctcaggaatttcattaaaacatctgtcccctctgtcagctctcctggaatgcctctgtccagacaattaaaacacacttgctgtgagaccagttctccgtccaaagagggagagagggaggtgacaggtaggtgagtcccacacaggcatacaaacttctggggcaccagagtttctgaggaagtttcctgatgctgacagttttcaaatggcatcggaaaccctggcattagtgcagggtttgacccagggtcattcagagcgctgtaaagattaagcgctgggcactagcccggtcctcacaatccagccagccacagcacagtgaccctccctctgtagaggctcacctttcagggacgaaccaggctgtagcaaccgtggagactgagtactgaacaagacaagcaagcttcagtcttctggcgggaaggaacaagaacggtaggcattcagaatggccttcgagaaactcattttatgcactagattgtgagggatttgctcccaatgtttttttttttcttcttcttcttcttctttttcaaagtcattcccttctaatcttgtccagactttcaattcaagtgtggacgcggtgacaagaacctttacacctgctccaccgtggggagactttccagtcaaggagaacacgctcatcctgctggggcactcactgacaaatggtattcatgaacgagaaggctgtgcacatgcaaccgacatgtgcgtgtgcacacatgtgcgtacatccggtcgttgcctcaagtgtactttgcacttcagttaaaatgtgcagaacttccagaaactggaagaagaag

SEQ ID NO: 1437 - DNA, 5224 bp, Rattus norvegicus
  Genbank Accession No. J03914
aaggcagggagttgacggtgaagaaggaacaatgccaggaagataatgaacagggttgcactttgcccatcaaaagtctctaactgcacatctggtggaaacagcacaccagagcaagaacagggagctgccgacacaggtgctagcccattcctgtctttgattactgactgcttagactggttcctgagccagtatagatatatttttttccctgtccctggatccatagctccttcccccaacaatccctcccgtggaatgtctgaaatttgaaacactgtaggccaatggtccaatagaaagccataaccaggtcccgcctcctccttgcctaagacattatcaggaagctcagacttgcaagacccaggtttgtctgctctgtacaccctaccagcacgatgcctatgacactgggttactgggacatccgtggggtgagtgagagcctcttctgctgggtgggacatgtgtggggtgaggagtagctaggatgtgatttccaggagacagattgagtgctgaagttgttggaaagttttgcctctcagggcaagttcaaacacaggggggcttgtgcttatgtggcctgtgtgtgagcttgtgtcgtgactgttcagtgtaaggtgtaggctcaccaagagattgcacagtcagactgtcaggcttttccaatctgtgacttgtgatatgtcatcttcccagctggctcacgccattcgcctgttcctggagtatacagacacaagctatgaggacaagaagtacagcatgggggatggtgattacacctgcttctcagacccctgctcccctgaccctggtgctcagcaactctgctctgaccccctgttgctcagctctacacagctcctggagttgggtttagaaactgtcccttctagaaaccttgaattttggagggctgacttttgaaaatcttagtgatatacagaagcattctctgtccttggggtgtgtgaagtaggtgaaattgcagatcttggggtgttctcatgactcactccttggagggatccctagagaaggaagctgggatactggggtgatttcttttgacatcctcttgtccaccacagctcccgactatgacagaagccagtggctgagtgagaagttcaaactgggcctggacttccccaatgtaggtggagggaaggggaggtgtggggaaggcctagtgctctcacctcatctcctggcctggctgaggggttggcatcagtgtttctgcttgcctgtttcatccctgctggctgcacagtgtttctgtgttgggctgtgtcctggctctcccactcagtcgacaccgtgctcatggagggtttcctggggcagcacactgagtgccagggccatgtctatcctcacccagggaagggattcagctaccccataacccatctgaccatccctgattgtctatccagctgccctacttaattgatgggtcacacaagatcacccagagcaatgccatcctgcgctaccttggccggaagcacaacctttgtgagtggggctgactgcagggtggggacagaagccatccctcttggcttggctggagcaggatgctgagagtgggtctgtgttgtgtgtgctgcaggtggggagacagaggaggagaggattcgtgtggacgttttggagaaccaggctatggacacccgcctacagttggccatggtctgctacagccctgactttgtgagttccaccagccctgagttgaagctggccctgcactcttgctcttgtatcagctctagccccgtttgccaccacagcctctcagtgctactcatggtacagtgtttgaaattgccgacagagtaacccccaagctcagtttgccaaatgaaaacttctagtcatttgctctaagatcgtatccagactctccacagcgacatttagtccctgctaggacagacagagtgtgatccctccagttctagctgctggttctgtcctgagctgtgtctttctgttgccctggggtcttgccatgtctgcagccctcatactcacactatgagaagacactggggctagggaacacttcctcccaaatggcttcccagagctgtgtccttgacacccacagagagaagcagatgctcccaataggcaactcagtcagtcaaaggccttggatcctcggctcctgtttcattttgtcctctcaaattcccctcatttctttggaacctgtactgaagtcctcactgccccagtaggcagaacactacctgtttcctgggccgtttcagttgtttgcttctgcctcatgtgaggtcagagttcagagtcaggtgcctacaactgtctcatgcaaggtggttctgataatgatggtggagtccagggaacagagctgtatcttgttgggctgtttccaaagaacagtctaatcatggtgttgctctaactaaacacgtgggcctcaacccagactgaatctcacgaaggtgactgcttctctgcacgctggggcctgtacagccctgtgaggccagcctctgccagggagcctgtgtctgaaggtagtgatggttgttctctgcttcaggagagaaagaagccagagtacttagagggtctccctgagaagatgaagctttactccgaattcctgggcaagcagccatggtttgcagggaacaaggtaaaggcagcgggtggggagaaggatttgccatttcttcccaggtgtcaaattctagcactcacccttggcttcctgcagattacgtatgtggattttcttgtttacgatgtccttgatcaacaccgtatatttgaacccaagtgcctggacgccttcccaaacctgaaggacttcgtggctcggtttgaggtgatgtcctgaccccgcttcctcttgacctacttcccttccccccttccagaatgcctttctactccttgaaatggagatgaaaatggctagcttctgttgagcatagaactgtgttctgctctttcgtcccttgcatggagtttcccagcacaccctgcatgttgtgtaggattatcagctccttaggatcattttggaagcggattgtaaagactcagttcctcagggagtcagtaccattggaaggggacgtggtttttttccagtgtgcttctagcttccaagaacagggggcaatagatctaccggataccaaaggaaaaaagccataggttgcaatagagcctggattttccagccctgaagcctatggaaattcaggacatgcccggaatgtatagggagcactattcaggattgatgcacagtaccaagatacagtatccatatctggcctatacaattctttgctcagtcagacccctgagtggggaagcactgggacccagggctacagttagtgtgagtagacagctcactgctgttggaggattttatcctccaacatcctgtttctttcctttccttttcctccttggtgacatcttgatgtttgactgtagaatcattacagtgagactgtactgccatcgtcatcttctctagtgtggcctccgtgtggcacagttctgagctcagtacgatgtggaaacctgcgtctctgtccaggcatgcagagtggcaggcacgcctgactatgatgtacatgtgatccccacaagccccactttattagagatttgggggatcgaggccatagtccaatgggaatcttagcgtggggtcttctcctctgtccctgctgcacacgtgatgcgtttttccttagttttcattggcttgccttctggtccagcctgctcggctctggagattgtgtgagaactgttgaacagtgtggtgggagagtgtgggaggctgcagtccaaggccagccaagcctggcttcttgggtaaggctgccctggaactttgaattcatcacagtttatctgggcaccgtactggaaagatagcacacagcacagtgccattctgtagaatgttctctagcagggctgagtctaggcaggatggacacactaagtatgcatttagctcccagtgttctgagtgtagatttttctgcatcaggagaatggccaaggccactccattggccttgctgtgtcacctatccctctgctcattcagtcaggatttcctgaggtactgggtgagatctttgctctcttccaaagtacactggcatgttactggtccctttgacctgtttggtcctttcccaatgtggaaacgcagggcaagaaggagcctgcaggtaaaaaagaaaagaaaagaaagcgagaattgcgtaaccgggtagcaacaaggtagcttagggagtgaaccgagggaatcagaatggaggctgctgagcccctccctgtgtagaccgggatgcagactctcgctgttcctgctgagcctgtgtgcctggcttcctcctggcaggagcacagcactgttttgcgggattctgtggagagctccctcttcttctatacctgcaccacagctgcagatggacgcagctgaacgcagtgccagtttcccctacatcagaggacattaaagcatccccttaccagagttgtgcccctgagcaacccgggctgtgttggggttcttagagatgtcccagatcctcaattctcgctttctcctcctcctcccttcagggcctgaagaagatatctgactacatgaagagcggccgcttcctctccaagccaatctttgcaaagatggccttttggaacccaaagtagcaccacaaagtccagacctggggatactcatgagtgccctgctggctgtgggcctagagcatggctctggcgcccaccacatgcagctttctcctcctttccattccctgttcctccatctcctcttcccagcccttgcctcagtcaagcctcagttccctggtctctccatttcttcattagtcccctcccttgtctctgccctgcatccaacccttccctcactgattttcggaggactgtaccagacccctgaatccccagcctggcctgagagattagatctcactgtgctgccctggtccccaggaaggacccatttgatttgcaataaagtgtgaaccacatttgtccagtgtcctgttttgctgtctgtgacactcagggctgactgtgttgacttggttgattttgttttgttgctcgcaggaggagctagagggatggactctgggctatttga

SEQ ID NO: 1438 - DNA, 2470 bp, Rattus norvegicus
  Genbank Accession No. J05035
acctcagctatggagttggatgagctgtgcctgctcgacatgctggtctacttggaaggtttcatggccttcgtgtccattgtggggctccggtcggttggctctccgtacggccgctactcgccgcagtggcccggcatccgagtgcccgcgcgacctgcctggttcatacaggagctgccctcgatggcctggccgctgtacgagtacattcgtcctgcagccgcgcgactgggcaacctgcctaaccgcgtcctgctggctatgtttctgatccactacgtgcaaaggacgctggttttcccggttctgatcaggggagggaagcccaccctcctggtcacctttgtcttggccttcctgttctgcaccttcaacggctatgtacagagcagatacttgagccagtttgcggtttatgctgaagactgggtgacccatccctgtttcctgacaggctttgccctgtggttagtgggcatggtgataaatatccactcagaccacatcctgaggaatctgagaaaaccaggggaaactggatacaagatacccaggggaggcctgtttgaatacgtatctgcagccaactattttggggagctcgtggagtggtgtggctttgcactggccagctggtccctccagggtgtagtgtttgcactgttcacactcagcacactgctcaccagagcgaagcagcaccatcagtggtaccatgagaagtttgaagattaccccaagtcaagaaaaatactgattccatttgtgctttagtgctctgttagcgctgttgcctcccatgagctgagtctgtctgtctccctggtgactttgctctgagcacttacgaatgaattgttttccttaattctcctgcagcccctttctcaggaaaggctgggggtgggggggtgtcgtcccctggtaaaggacaaagccaatgataaactaatccaccacatgcagttaggggctacactgcctgctggatccgaagcaggtagccctgagtcattatggcgctctctgacttcagcaatcagcagcccttacaatcctgcaagattccacccaagtcagcagcagtcacgggcctccttcactgatgtgtgttctgcctgctcagcccctgccacagaggcctggaggtgtgggagtgtggcctaagcacagtctgccatccttgaccgcagacctcttggacccacccccactccctccagacactggtaagagaagccttcctgcaacatgtcctgtcctcaggaggtgagacagcagagtgcttccattcactcgatgaccccatttttgctcttcctttgggctagaattcattaaggtccttaaaaacaaaacaaaactttttcttaatagtacaaaacaaaatatcaaaacaaaatttgttattttgaatgcacccaaggaccaatcatgtcacacaaagaaagctcagggctagcctgggctgtgtagggagaccctgtttgggaaaaaaaaaatgaagataacaaccagctaactgtccaaagaagtgaccgcagtaataaaagacgccgcccacacaggcaccagcttgggagaaagatgtgcgcctgggattgtaaacccactgttgctctgggcaggctgaggcccactggtgaagagccattcccaccggacccatgcacactgcctcggggcagcgtctgcactcacctctcacccgctgccaccacagctaaagaacagaacggatagaactgtgtgctctgaacccagtgaagatgctgcatgaagacctgcaggcacacctgatggcgtgcacggtgcccaccactcgcctgactcggaccatctctgtgtgcccgctgccacctctgtgtgccctttccagctggctttcccatcagggcttcctcagctcttctgctctcagacagaaactattctctgttcctctggttcgcagaatgtctagatttgacccagaaaacttcatgacacagctacttcattttaacaaagagcagtgtttaatggggaactacccttcaatcctttaccctccccttttctggccaagtaactgcttgaaaacctaaagcactaaacattgtaggtctcctctcaaaacctcaggcctgtctggtgtgttctgaaacgtttgtgtggaaggagatattcagctgagaccctgggaatgtttgctgtgaacttgacctcccttggagggcatggtgctagataaacttggaacctaggactccaggttgctaggcggatgccctgacactaagccacatcacacattagctctgtgatgcctctttctttatgaaggaccaagctgcccacatactaagtgagattaatttaagaggaatcctgtcctaacactgtatacttcattccctacaactcaacttacttgtatgaaccatgattgttaaggaaattaataaactacatttataagtaaaaa

SEQ ID NO: 1439 - DNA, 2178 bp, Rattus norvegicus
  Genbank Accession No. J05181
cagagcggagctgcggccaggaggaggacgcggccatggggctgctgtcccaaggctcgccactgagctgggaagagacccagcgccacgccgaccacgtgcggagacacggcatcctccagttcctgcacatctaccacgcagtcaaggaccggcacaaggacgtgctcaagtggggtgacgaggtggagtacatgttggtgtcctttgatcatgaaaataggaaagtccagttgttactgaatggcggcgatgttcttgaaactctgcaagagaagggggagaggacaaaccccaaccacccaaccctctggagaccagagtatgggagttacatgattgaagggacacctggccagccgtacggaggaacgatgtccgagttcaacacagtggaggacaacatgaggaaacgccggaaggaggctacttctgtattaggagaacatcaggctctttgcacgataacttcatttcccaggctaggctgccctggattcacactgccagagcacagacccaacccagaggaaggaggtgcatctaagtccctcttctttccagacgaagccataaacaagcacccccgctttggtactctaacaagaaacatccggcatcggagaggagaaaaggttgtcatcaatgtgccaatattcaaggacaagaacacaccatctccgtttgtagaaacatttcctgaggatgaggaggcatcaaaggcctctaagccagaccacatctacatggatgccatgggatttgggatgggcaactgctgtcttcaggtgacattccaagcctgcagtatatctgaggcaagatacctttatgaccagttggccactatctgcccaattgttatggctttgagtgctgcatcgccattttaccgaggctacgtgtcagacattgattgtcgctggggagtgatttctgcatctgtagatgatagaacacgggaggagagaggactggagcccctgaagaacaatcgctttaaaatcagtaagtctcggtatgactcaatagatagctacctgtccaagtgtggagagaagtacaatgacatcgacctgaccatcgacacggagatctacgagcagctcttagaggaaggcatcgatcaccttctggcacagcacgttgctcatctctttattagagacccactgaccctttttgaagagaaaattcatctggatgatgccaacgagtctgaccattttgagaatattcagtccacaaactggcagacaatgaggtttaagcctcctcctccaaactcagatattggatggagagtagagttccgaccaatggaggtacagttgacagactttgagaactctgcctatgtggtatttgtggtactgctgaccagggtgatcctctcatacaaactagacttcctcattccactgtccaaggttgacgagaacatgaaagtggcacaggagcgagatgccgtcttacaggggatgttttatttcaggaaagacatttgcaaaggtggcaacgccgtggtggatgggtgtagcaaggcccagaccagctccgagccatctgcagaggagtacacgctcatgagcatagacaccatcatcaatgggaaggaaggcgtgtttcctggactcatccccattctgaactcctaccttgaaaacatggaagtcgacgtggacacccgatgcagtattctgaactacctgaagctaattaagaagagagcatctggagaactaatgactgttgccaggtggatgagagagtttattgcaaaccatcctgactacaagcaagacagtgtaataactgatgagatcaactatagcctcattttgaaatgcaatcaaattgcaaatgaattgtgtgaatgtccagagttacttggatcaggctttagaaaagcgaagtacagtggaggtaaaagcgacccttcagactagacatccagcaaagtggatggcagctgcagccctgaccccgagcccactcagacgctgtgaagaccaagatggcctacagtgttccagttgcccacaagtgactagaagcttccttcagtaggtgaatctgagtttgtatatgtatatactaaagtatttttatgattattaacaatgtattttaataacactgtatctacagtcatggtgaactggcttgtacattttt

SEQ ID NO: 1440 - DNA, 9852 bp, Rattus norvegicus
  Genbank Accession No. J05510
tggggtcacttccttcacacaggactttggcggaaatctctacacccgtgtctcgtcatccccttcgagagcattaactatttaaaaccaggagagaaagcgcacgccgagaggaggtgtgggtgttccgctcccatcctaacggaacgagctccctcttcgcggacatgggattgcccagcggctgctaacccctgtcctggtcctgatccctcaaaccggcgtggctccccggtcaccaaggagctgactacaaaggatttgcatccttggctgggagtccattggctacagagtgcctgacctgggtcaggcttttcaacaaggacatgtctgacaaaatgtctagtttcctacatatcggagacatttgttctctgtatgcagagggatctacgaatggatttatcagcaccttgggcttggttgatgaccgttgcgttgtacagccagaagctggggaccttaacaatccacccaagaaattcagagactgcctctttaagctatgtcctatgaatcgatattctgcacagaagcagttctggaaagctgctaagcccggggccaacagtacaacagatgcggtgctgctcaacaaattgcatcatgctgcagacttggaaaagaagcagaatgagacagaaaacaggaaattgctggggacggtcatccagtatggcaacgtgatccagctcctacatttgaaaagcaataaatacttaactgtgaataagaggcttcctgccctactggagaagaacgccatgagagtgacgttggatgaggctggaaatgaagggtcttggttttacattcagccgttctacaagctccgctccatcggagacagtgtggtcataggtgacaaggtagttttgaaccctgtcaatgctgggcagccgctacatgccagcagccatcagctggtggataacccgggctgcaatgaggtcaactccgtcaactgtaacacaagctggaaaatagtgcttttcatgaaatggagtgataacaaagatgacattctaaaaggaggtgatgtggtaagactcttccatgctgagcaagagaagtttctcacgtgcgatgagcacaggaagaagcagcacgtcttcctgaggacaaccggcagacagtcagccacgtcggccaccagctccaaagccctgtgggaagtggaggtagtccagcatgacccatgtcggggtggagctgggtactggaatagcctcttccggttcaagcacctggctacagggcattacttggcagcagaggtagaccctgactttgaggaagaatgcctggagtttcagccctcagtggaccctgatcaggacgcatctcggagcaggttgagaaatgcccaagaaaaaatggtgtactctctggtctctgtgcctgagggcaacgacatctcctccatctttgagctagaccccacaactctacgtggaggtgacagccttgtcccaaggaactcctatgtccggctcagacacctgtgtacaaacacctgggttcacagcacaaacatccccattgacaaggaagaggaaaaacctgtcatgctgaagattggtacctctcccctgaaggaggacaaggaagcttttgccatagtccccgtttctcctgctgaggttcgggacctggactttgccaatgatgccagcaaggtgctgggctccatcgctgggaagttggaaaagggcaccatcacccagaatgagagaaggtctgtcaccaagctgctggaagacttggtttactttgtcacgggtggaacgaactctggccaagacgtgcttgaagtagtcttctctaagcccaaccgagagcggcagaagctgatgagggaacagaatattctcaagcagatcttcaagcttttgcaggcccccttcacggactgcggggatggcccaatgcttcggctggaggagctgggggaccagcggcacgctcctttcagacacatttgccgactctgctacagggtcctgagacactcacagcaagactacaggaagaaccaggagtacatagccaagcagtttggcttcatgcagaagcagattggctatgatgtgctggccgaagacaccatcactgccctgctccacaacaaccgaaagctcctggaaaagcacatcaccgcagcagagattgacacgtttgtcagcctggtgcgaaagaacagggagcccaggttcttggattacctctctgacctctgtgtatccatgaataagtcaatccctgtgacccaggagctcatttgtaaagctgtgctgaatcccaccaatgctgacatcctgattgagaccaagttggttctttctcgttttgagtttgaaggcgtttccaccggagagaatgctctggaagctggggaagatgaggaagaggtgtggctgttctggagggacagcaacaaagagatccgtagcaagagtgttagggaattggcacaagatgctaaagagggacagaaggaagacagggatgtcctcagctactacaggtatcagctgaacctctttgcaaggatgtgtctggaccgccagtacctggccatcaatgaaatatccgggcagctggatgttgacctcatcctccgctgcatgtccgatgagaacctcccctatgacctcagagcatccttttgccgcctcatgcttcacatgcatgtggaccgagatccccaggagcaggtgacccctgtgaaatacgcccgtctgtggtcagaaattccctccgagatcgccattgacgactatgacagcagtggagcatcgaaggatgaaatcaaggagaggtttgctcagacgatggagtttgtggaggagtacctgagagatgtggtttgtcaaagattccccttttctgataaggagaaaaataagctcacatttgaggttgtgaacttagccaggaacctcatatactttggcttctacaacttttctgaccttctccgattaaccaagatcctcttggcaatcttagactgtgttcatgtgacaaccatcttccccattagcaagatgacgaaaggcgaagagaataaaggcagcaacgtgatgagatctatccatggagttggggagctcatgacccaggtggtgcttcggggaggaggctttttgcccatgactcctatggctgctgcccctgaaggaaatgtgaagcaggcagagccagagaaagaggatatcatggtcatggacaccaagttaaagatcattgaaatactccagtttattttgaatgtgagattggattataggatctcctgcctcctgtgtatatttaagcgggagtttgatgaaagcaattcccagtcatcagaaacatcctccggaaacagcagccaagaagggccaagtaatgtaccaggtgctcttgactttgaacacattgaagagcaagcagaaggcatctttgggggaagtgaggagaacacacctctggacttggatgatcatggtggcagaaccttcctcagggtcctgctccacttgacaatgcatgattacccacccctggtgtctggggccctgcagctcctcttccggcatttcagccagaggcaggaggtccttcaggccttcaaacaggttcaactgctggttactagccaagatgtggacaactacaaacagatcaagcaagacttggaccagctaagatccatcgtggagaagtctgagctctgggtatacaaaggccagggtcccgatgagcctatggacggagcctctggtgaaaacgaacataagaaaactgaggaggggaccagtaagccactgaagcacgaaagcaccagcagctacaactaccgagtggtgaaagagattctgattcgacttagcaagctctgtgttcaagagagcgcgtcggtgaggaagagcaggaagcagcagcagcgactgctgaggaacatgggtgcccatgctgtggtgctggagctgctgcagatcccctatgagaaggccgaagataccaagatgcaggagatcatgaggctggctcacgaatttctgcagaatttctgcgcaggcaaccagcagaaccaagctttgctacataaacacataaacctgtttctcaacccagggatcctggaagcagtgaccatgcagcacatcttcatgaacaacttccagctgtgcagtgagatcaacgagagagtggtccagcatttcgttcactgcatagagacccacggtcgaaatgtccagtatatcaagtttctccagactattgtcaaggccgaagggaaattcattaaaaagtgccaagacatggtcatggctgagcttgtcaattctggagaggacgtcctcgtgttctacaatgacagagcctctttccagactctgatccagatgatgcggtccgagcgtgaccggatggatgagaacagccctctcttcatgtaccacatccatctggtggagctcttggctgtgtgcacagagggcaagaatgtgtacacagagatcaagtgcaactccctgctcccgctcgatgacatcgttcgtgtggtcactcatgaagactgtatccccgaggttaagattgcttacatcaacttcctgaatcactgctatgtggacactgaggtggagatgaaggagatttacacaagtaatcacatgtggaagttgtttgagaatttcctcgtggacatctgcagggcctgtaacaacacaagtgacaggaagcatgcagactcggttctggagaagtacgtcactgaaatcgtgatgagcattgtcaccaccttcttcagctctcccttctcagaccagagtaccactctgcagactcgccagcctgtctttgtgcagctcctgcaaggcgtgttccgagtttaccactgcaactggttgatgccgagccagaaagcctcggtggagagctgtatccgcgtgctctctgacgtagccaagagccgggccatagccattcctgttgacctagacagccaagtcaacaacctcttcctgaagtcccacaacattgtgcagaaaacagccatgaactggcggttatcagcccgcaacgctgctcgtagagactctgtcctggcagcttccagagactaccgaaatattattgagaggttacaggacatcgtgtctgccctggaggaccgactcaggcccctggtccaggccgagctgtctgtgctcgtggatgttctacacagaccggaactgcttttccctgagaacacggatgccaggaggaaatgcgaaagtggaggtttcatctgcaagctcataaaacacaccaagcagctgctagaggagaatgaagagaaactgtgcattaaagtcttacagaccctcagggaaatgatgaccaaagatagaggctatggagaaaagcaaatttccattgatgaattggaaaatgccgagctgccacagccaccggaagctgagaactccacagaggagcttgaaccaagtccacccctgaggcaactggaagaccataaaaggggtgaggcactccggcaaattttggtcaaccgttactatggaaacatcagaccttcaggaagaagagagagccttaccagctttggcaatggtccactatcaccaggaggacccagcaagcctgggggaggagggggaggtcctgggtccggctccacaagccggggtgagatgagcctggctgaggttcaatgtcatctcgacaaggaaggcgcctccaatctggtcatcgacctcataatgaatgcatccagcgaccgagtattccacgaaagcattctcctggccatcgcacttctggaaggaggcaacaccactatccagcactcatttttctgccggctgacggaagataagaaatcagagaagttcttcaaggtcttttacgatcgaatgaaggtggcccagcaggaaatcaaggcgacagtgaccgtgaacaccagcgatttgggaaacaaaaagaaagatgatgaagtggaccgggatgccccatcccgaaagaaagccaaagagcccacaacacagataacagaagaggtccgggatcagctcttggaagcatctgctgccaccagaaaagcctttaccaccttccggagggaggccgaccctgatgaccattaccaatctggggagggcacccaggctacaacggacaaagccaaggatgacctagagatgagtgcagtcatcaccatcatgcagcctatcctgcgcttcctgcagctcctgtgtgaaaaccacaaccgcgatctgcagaatttccttcgttgccaaaataataagaccaactacaacttggtgtgtgagacactgcagtttctggactgtatctgtgggagcacaactggaggccttggtcttctcggactgtacataaatgaaaagaatgtagctcttatcaaccaaaccctggagagtctgactgagtactgtcaagggccttgccatgaaaaccagaactgcatcgccacccacgagtccaatggcatcgatatcatcacagccctcatccttaacgatatcaaccctctggggaagaaacggatggacctggtgttagaactgaagaacaatgcttcaaagctactcctggccatcatggaaagcagacacgatagtgaaaatgcagagaggatcctgtacaacatgaggcccaaggagctggtggaagtgatcaagaaggcctacatgcaaggcgaagtggagtttgaggatggggagaacggtgaggatggagcagcctcccccaggaacgtgggccataacatctacatcctcgctcaccagttggctcggcataacaaagaacttcaaaccatgctgaaacctggaggccaggtggatggcgatgaagctctggagttctatgcgaagcacacagcacaaattgagattgtcagactggaccgaactatggaacagattgtcttccctgtgcccagcatctgtgaatttctgactaaggaatcgaaacttcgaatatattacaccacagagagggatgagcaaggcagcaagatcaatgacttcttcctgcgctccgaggacctctttaatgagatgaactggcagaagaaacttcgagcccagcctgtcttgtactggtgcgcccgaaacatgtctttctggagcagcatctccttcaacctggccgtcctgatgaacctgctggtggcgtttttctacccatttaaaggagtgagaggaggaacactagagccgcactggtccggcctcctgtggacagccatgctcatctctctggcaattgtcattgcgctgcccaagccccatggcatccgggccttaattgcttctacaatcctacgactgatattttcagttggattacagcccacactgtttctgctgggagctttcaatgtctgcaataaaatcatcttcctgatgagctttgtgggcaactgtgggaccttcaccagaggctaccgagccatggttctggacgttgagttcctctatcatttgctgtatctactgatctgtgccatgggcctcttcgtacatgagtttttctatagtttgctgctttttgatttagtgtacagagaggagactttgcttaatgtcattaaaagtgtcacccgcaatggacggcccatcatcttgacagcggccctggctctgattctggtttacctgttctcaattgtgggctacctgttcttcaaggatgactttatcttggaagtagacaggttgcccaatgagacagctggtccagaaactggtgagagtttggccaacgatttcctgtactctgatgtgtgccgggtagagacgggggagaactgcacctctccggcacccaaagaagagctgctccctgtggaagaaacggaacaggataaggagcacacgtgtgagacactgctcatgtgcatcgtcaccgttctgagtcacgggctgcggagtgggggcggagtaggagatgtgctcaggaagccatccaaagaggagcctctgtttgctgcaagggtgatctatgacctcctcttcttcttcatggtcatcatcattgtcctgaacctcatttttggggtcatcatcgacacctttgctgacctgaggagtgagaagcagaagaaggaagagatcttaaaaaccacgtgcttcatttgtggcttggaaagggacaagtttgacaataagaccgtcacctttgaagagcacattaaggaagaacacaacatgtggcactatctgtgcttcatcgtgctggtgaaagtgaaggactccaccgagtacaccgggcccgagagctacgtggcagagatgatcagggaaagaaaccttgattggttccccaggatgagagccatgtccctggtcagcagtgactctgaaggggaacagaacgagctgaggaacctgcaggagaagctggagtccaccatgaagctggtcaccaatctttctggccagctgtcagaactaaaggaccagatgacagaacaaaggaagcagaaacaaagaattggccttctaggacatcctcctcacatgaatgtcaacccacagcagccagcctaagcaaatgagacggagggactgtactcaaccctttttaaattattgtcagcgtgggtctggctcttggttctgatctgccctctaaggttacatgtgcgcttagtacatttgtaaatactcggttttgtattgtatgtatatgattgcaattctcagaggtttggactttcgtattgtaattagctctgttggcatggtgacttgtcactcctgccaaaaatattaaaaatgccttttttggaaggactacagaaagtacctgatttgcacttgaaccagattatagatttaaaaagtatttgacatgtattttgttatttaaaactagaatagccagtatttatgttttttataaaactgtgcaatacaaattatgcaatcaccataactctgtaactcctgagtgtcttaagggagtgcgcatctttgaagctgatctgttaatacttatgtaataaatggttaaatatcaaatgatgatgctgctgccaaaattatattaatagcaagtttctggcccctgggcaattttgtaccttgtaattatcctatggtgatgctgtttctcgttgctaatggcattagtgcctcgtatcctagtgataactccaggtctgtgaaccattcaaacaacattcatttttgagacaaagcaactttagtttcaagggtaattttaagcttcaaaattaatcatttaaagtatttctttaagagagccatgttagaggctcacacgttagcttgaaaggagtcgatgaaataatttttttaaagggaactttttacacgacgtttggaataacagcatattgctgaccagtcagtgtcatctcccaggtgaattttgatgtcacgttatagtcaaatgagctagcttatggtttctagattctcttcatctgaaccaacatgatgcagtaggtgagaagttattatgcatatatacacatatacatccatataaggcaaagtaggagctgtccccttaggatgcatagctgcccccttagggtgcagagctcaacactgacagtgctgttctgagagagccacgtttgggttttatttctttgtcacatgatttcttttctggatgtgtgcaagtataacaggaagtgttttctacctgttgcttgttttgtacctgggtctcgttttactagaccatctctgcacaaaagtttaaaaaatgaaccgtaagcagagttctgaagcaagtcaagtttgtaagtgcatacctgaaattatttaataaatgacgcagaatact

SEQ ID NO: 1441 - DNA, 2639 bp, Rattus norvegicus
  Genbank Accession No. K03243
gaatgctggcagtgtgggtgctatgtaaaagtatttacatagctttgtagagtgagccaagcccagtctgtttgggatgactcttcacagtgcctcgaatctgtcacacgtcttagtaagcagagtcacagagtttctgtcacatcatcctcctgcctacagggaagtaggccatgtccctgccccctactctgagcccagctgtgggagccagccctgcccaatgggctctctctgattgacttctcactcacttctaaactccagtgagcaacttctctcggctcgttcaattggcgtgaaggtctgtgtcttgcagagaaggttcttcacaactgggataaaggtctcgctgctcaagtgtagcccagtagaactgccaagccccttcccctcctctccctagactcttggatgcaagaagaatccaggcagctccaagggtgattgtgtccaacctagaatgtcttgaaaaagacattaaggggactagagaagacaggggatccaacggttctctgcagcccagcctgactgacatgtaactcttctggttctcaccagccagctggacctgcttagtattctttctgcctcagtttcccagcctgtacccagggctgtcatagttccatttcaggcagtagtaatgaatgagctgacataaaacatttagagcaggggtcagtatgtatatagagtgattattctatatcaggcattgcctcctcggaatgaagcttacaatcacccctccctctgcagttcatcttggggtggccagaggatccagcagacacctagtggggtaacacaccccagccaactcggctgttgcagactttgtctagaagtttcacgtctcagagctgaattcccttctcatgacctttggccgtgggagtgacacctcacagctgtggtgttttgacaaccagcagccactggcacacaaaatgtgcagccagcagcatatgaagtccaagaggcgtcccggccagccctgtccttgacccccacctgacaattaaggcaagagcctatagtttgcatcagcaacagtcacggtcaaagtttagtcaatcaaacgttgtgtaaggactcaactatggctgacacgggggcctgaggcctcccaacattcattaacaacagcaagttcaatcattatctccccaaagtttattgtgttaggtcagttccaaaccgtgctgaccatggctatgatccaaaggccggccccttacgtcagaggcgagcctccaggtccagctgaggggcagggctgtcctcccttctgtatactatttaaagcgaggagggctagctaccaagcacggttggccttccctctgggaacacacccttggccaacaggggaaatccggcgagacgctctgagatctctgatccagaccttccaaaaggaggaagaaaggtaggcagggccattccactctcctctccaaaagtaccactgaggggtccactcacagtctttgccctgacaaccaaggccctctagccatgtgcaactcatgcaaagtctacagaaggaacgggaagggcccatgggtgccggtgttcaagagcctctctttttgtttcaggtggcaccagagtccctgcctctctccacaccattgcaagaatgcctcctcagctgcataatggtctggacttctctgccaaggtcatccagggcagcctcgacagcctgccccaggaagtgaggaagtttgtggaaggcaatgcccagctgtgccagccagagtatattcacatctgcgacggctccgaggaggagtacgggcggctgctggcccacatgcaggaggagggtgtcatccgcaagctgaagaaatatgacaactggtgagtcccttcagcccaaagtctctgcctacaggctccccagctctaccttctcggagtctggagaataaagacccttgcagtagcaaacgcctgagaagcttaggagatcagtcagaatccagacaccctgtgaggttagcatagccagcttctagattccagatagccatgcaaggcggcccctttccctagggccagctcatggcttagcaaatgtctacctggtcaagttcccgttggcttggcttccatacctaagtaacacggtcaacgtccttgtgtctgcaaggccgggaagagcctgaggtaggcaagagaggtacatccccaagggtaccttgctgaaggcatccctgtgactttttcagttggctggctctcactgaccccagggatgtggccaggatcgaaagcaagacggtcatcattacccaagagcagagagacaccgtgcccatccccaaaagtgggcagagccagctgggccgctggatgtcagaagaggacttcgagaaagcattcaacgccaggttcccggggtgcatgaaaggtgggtgaggccagaccccaggcctgacagtgtgctgtgtgcacgttcacgctcccggtagtagcttaagctgcaaagggtggcccgcgtgcgaagctccgcgtctggttctgtctcacggaatatcaaattgttctctgagagtacgggtggctccgacctgtcatctcagacatggaagctgaggcaggggcattcaaagtttaaggcc

SEQ ID NO: 1442 - DNA, 3097 bp, Rattus norvegicus
  Genbank Accession No. K03249
ggtgcaggataccttgagaaaatggctgagtatctgaggctgccccactccctggcgatgatccgcctctgcaacccgccagtcaacgccgtcagtccaactgtaatcagggaagtaagaaatggactccagaaagctggatcagaccacacggttaaagccattgtgatctgtggcgcaaacggaaacttctgtgcaggtgctgatatccatggctttagtgcttttacccctggccttgcattaggaagcttggtagatgaaatacagagataccagaagccggtgttggccgctatccaaggtgtggctctcggaggaggactggagctggccttgggctgtcactatcggattgccaatgcaaaggctcgtgtcggcttgccagaagtcacactggggattcttcctggtgcaagaggaacccagcttctccccagggtcgttggagttcctgttgctcttgacctaattacctcaggaaaatatctttcagcagatgaagcactcaggcttggaattctggatgcagtcgtgaagtcagacccagttgaagaagccatcaaatttgctcagaagattatagataaacccatagaaccccgcaggatctttaacaagccagttccaagcttgcccaacatggacagtgtttttgcagaagccatcgccaaggtacgaaaacagtaccctggtgtcctggctccggagacgtgtgtccgctcaatccaggcctctgtgaagcatccctacgaagtaggcatcaaggaagaggaaaagctgtttatgtacctccgggcatccgggcaggctaaagccctacagtatgccttctttgctgaaaagtctgcaaataagtggtcaactccctcaggagcgtcttggaaaacagcctctgctcaacccgtctcctcagttggcgttcttggcttgggaacgatgggccgaggcatcgccatttcttttgcgagagtggggatctctgtggttgctgtggagtcagacccaaagcagctagatgctgcaaagaagataatcactttcaccttggagaaggaagcatccagagcgcatcagaacggccaagcttcggcaaaaccaaaactcaggttctcctcatccacaaaggaactttcaactgtggatttggtggttgaagcagtgttcgaagacatgaacctgaagaaaaaggtctttgctgagctgtcagccctgtgcaagccaggagcctttctgtgcaccaatacctcggcgctgaacgtggacgacattgcttcttccacagatcgccctcagctggtgattggcacccacttcttctcaccagcccatgtcatgaggttgctagaggtcattcctagccgatactcttcccctactaccatcgccacggttatgagcttgtccaaaaagatcggaaagattggagtagtggttggcaactgctatggatttgttgggaatcggatgttggctccctattacaaccaggggtttttcttgttagaggaaggtagcaagccagaggatgtagacggggtcttggaagagtttggttttaaaatgggacccttcagagtgtcagacctcgcagggctagatgtgggttggaaaattcgcaaggggcaaggccttactggaccatcattgccaccagggacccccgtccgaaagaggggcaacagcaggtactccccacttggcgatatgctctgtgaagctgggcggtttggtcagaagacaggtaaaggctggtatcagtatgacaagccactgggtcgcatccacaaacctgatccctggctttctacgttcctgtcacaatatagagaggttcaccacatcgagcagcgcaccatcagcaaggaggagatcctggagcgttgcttatattccctcatcaatgaggcgttccgcatcttggaggaggggatggctgctcgcccagagcacattgatgtcatctacttgcacgggtacgggtggccaaggcacaagggcgggcccatgttctatgctgcctcagttgggttgcccacagttctagagaaactgcagaaatattacaggcagaaccctgacatcccccagctggagcccagtgactacctcagaaggctggtagcccagggaagccctcctctgaaggaatggcaaagcttggcagggccccacggcagcaaactgtgattcagccttctgcgttttgccacgtatgttggcacctaatttcagtatgattccttcctaaaatccaaacagatcgctctgaagtacaaatcatgattgctgctgctgctgctgctgatagctggtcagtaaaagctcctctccgtatctttctacctcataattccaatggtcagacttcaggaatgtctacagttagtctatacctctgactgcacttctatcggaaaaattcaacgaatgtatgtttactactacaagcattcttctcttttgactgtttgcccactctaacaaaaacgtatacaaaatgttgctaatagaataattcacacctccagttgacaacccaaatggccttagcagatcaacacaggtggcatatacacgcacttgacacattccagctgtgtgaagttactgccacctgttgtaacatggtgctgggttagagcactgttctgagtgaggggaggcaggcagagaaggcaggcagataaggccacacatcatatggatgtggatataaaattccaggatatgcaggtctgtggacaacatagatgagtagcccaaggctgtaactgttcatacatgcatatattttttggtccttttttttttcggagctggggaccgaacccagggccttgcgcttcctaggtaagcgctctaaccactgagctaaatccccagccccgaggctgtaactgttagaggttaaaaatcactactgattagtacagagtatctttgggagctgataaaattttctaaaattactctagtggtggatctgtaacacattgagttcaatggttcaaagtgaattatattttatatatatatatatatatatatatatatacatatatatatagtctatctcaataaagttaataaaatt

SEQ ID NO: 1443 - DNA, 395 bp, Rattus norvegicus
  Genbank Accession No. L00124
cgggcctgacgcccaagcaggactctgggccaagacccttcttgacaggaggggaaaactgcgaccgcacctcttggccctgagaagtcactgaactcagtgctcagccctcagcttaacgtcactctcctgtgtgtcctgcaggtgattgcaaagaactaagcaaaggcatctctgtgactgtcaccttgggaacgcacggaagggacacagtaataaagtgacttacgaattacaccatgggatgcgtctgtcttattaacccgacaccctaaccagggccctggaagcaacacctgtggcccaacctgcggcagtgacaagctatcatccctgtactcgggagcagtgggatggagactttgaggctagcctgggctacaaagtcagagccc

SEQ ID NO: 1444 - DNA, 168 bp, Rattus norvegicus
  Genbank Accession No. L00382
tgcttcccctcacagagactttggctagtgccaaggaagagaacgtggagattcaccagaccttggaccagacccttctggaactcaacaacctgtaagggtggccctgctacctgccgaccagactacatagatgcctcctcaggccaataaacggatgtctctggc

SEQ ID NO: 1445 - DNA, 1329 bp, Rattus norvegicus
  Genbank Accession No. L04619
tctaattgattttacaggtttattttcaccccaatcaagaccagcaatcttcccctttctgcaagaaagctgcttatggcttcagtattcctaagacggcgaacttcaaggaccagagcatgggacaacctgcgaaacacggcgcacacagccttctgcagaatgattctgacaatgatgtttactaagcccattactcagggaagcacatggggggcggaaatgccaggcaccgcccactacactttaccacgtgtttacattagccaatcagagcccctaagagcctgcgatcgctccatctttgtgacgtcaacggaggctgctggtcagccactttagtaaaggttattaagtgtttctgatgcaaaacccaaagcggcagcgttaattcccgtttacatttcatgaagaaagacctactatgctttaattgtctcagtgggactgacaaaacgtttattatactcggtttcgttcaatatttgaggaaacgcctgctgtaaaccgagctaaacattaggctctcgtaaagctatttttcctgcttacaaggggaaacattgttggaaattagagagtgtctattttaagaagttctacagtgaagccagctccttgcttatgaatgcctcgttggtgcggtcagtggactctaatctcttatttcattggtacctttctctgtggtttcagggtgtggagatagacgaatcaaaagtttctaagttgtgcgtgtgtcggcgcatgcatgggaatggctgtgggcctgagggtactttgcttcagtcatgtttttatataaagacatgaggtacccaatttagtatggaacttgtcctgaaatgtaatcatagggctttctgtgccttaacttcatctattcaaatcgaggactgtaatgtatgcgctctacccatgctgcctgtaatgtacagtgggacttgaaccccttggaaaagcacaatttcgtaagcgcaaaacagttatgcactactgacaaaattttaaaatgtttacatataacgtgcatttttttcaaccagtactgtttttctatagaggtttactgattatttctatatatttgataaagatttcccttttaggttatggttttagaatagtctgaaatatatgtacatttgaatgaatatgtgtgtgtggatgacaggtatatacttcgcctttcttataaaattatatttagagttataaatccagaaactaaagatgtagttttgtggtaaagagttttggcctggtctatgttggctcctgggttcaatcctcagcactactaaacaataaaaaataaaataaagaatt

SEQ ID NO: 1446 - DNA, 126 bp, Rattus norvegicus
  Genbank Accession No. L14001
gagcccaagaggtgtctctgagagacgagggttcagagcaggggctcatttcaggaggaagagccatttgaagcctctttatacacatatgctaggatgtcaggatagctcttctcctccatctct

SEQ ID NO: 1447 - DNA, 209 bp, Rattus norvegicus
  Genbank Accession No. L14002
cagatactctcgacctcttacatttggagagttttgagcagacaggaagaagacggagcctgggagcagctgttctccaatagtcaaattaagactgttcctctctgagctctgtacttcaaccagcacctttaggcagaagccatcaaatcagaaatgtctgttaataattaaagtctatgattgccaccaaaaaaaaaaaaaaaaaa

SEQ ID NO: 1448 - DNA, 115 bp, Rattus norvegicus
  Genbank Accession No. L14003
aatcccaatattaagaggttaaaaaataggaccagaagtttaaagtaatccttggctacctagtgagtgtaaggccagcctggaatcaataagagttggtttcaaagaagcagga

SEQ ID NO: 1449 - DNA, 242 bp, Rattus norvegicus
  Genbank Accession No. L14004
tcctgtcactcatgtggacctcagataagagcacagatactctcgacctcttacatttggagagttttgagcagacaggaagaagacggagcctgggagcagctgttctccaatagtcaaattaagactgttcctctctgagctctgtacttcaaccagcacctttaggcagaagccatcaaatcagaaatgtctgttaataattaaagtctatgattgccaccaaaaaaaaaaaaaaaaaa

SEQ ID NO: 1450 - DNA, 7204 bp, Rattus norvegicus
  Genbank Accession No. L14323
cgcaaagttgggcagggagctgggggaggaggaccgcgagcgagggtggcggagcaggggcgggaggagcggagggaggaggggaccggagcgtgtcactcgcgcgctccctctgtgcacagaggatgtgctgaatggtgcgcttccaggcggcggccgagcaggatcaggcggcgggcggctcgcactgccgggctctgctccttcttgtctcccgaggctctacaatcaccgcgggctccagaccctgcgtcccgcccggggcatggcaggctgctgtgccttgcggtgtagtcccgcttactaagcggcgcgggccagaggtgcggaggccaagaggccgggaggtcggcgggcagcggaggcaagagcctgctgaaccgagagccaagcccgcttgcgcccggagctccgtgtcccgtctccactgcgctcgcccgggccgcccggagccccgatgagcccagatggctggggctcagcccggagtgcacgccttgcaactcaagcccgtgtgcgtgtccgacagcctcaagaagggcaccaaattcgtcaagtgggatgatgactccactatagttactccaattattttgaggaccgatcctcagggatttttcttttactggacagatcagaataaggagacggagctgttagatctcagcctcgtcaaggatgccaggtgtgggaagcacgccaaagctcccaaggaccccaagttacgtgaacttctggatgttgggaacatcggacacttggaacagcgcatgataactgtggtgtatgggccagacctggtgaatatctcccacctgaatcttgtggcttttcaagaggaagtggccaaggaatggacaaatgaggttttcagtttggcaacaaacctgctggctcagaacatgtccagggacgcatttctggagaaagcatatactaagctcaagcttcaggtgaccccagaagggcgcattcctcttaaaaacatctatcgactgttttcggcagaccggaagcgagtggaaactgcgctagaggcttgtagtcttccatcgtcaaggaacgattccatccctcaagaggactttactccagatgtatacagagttttcctgaacaatctttgtccccgacctgaaattgataacatcttctctgaatttggtgccaaaagcaaaccgtaccttactgttgatcagatgatggattttatcaaccttaagcagagagatccccggctgaatgaaatactttacccacctctgaagcaagagcaggtccaagtgttgattgagaagtacgagcccaacagcagcctcgccaagaaagggcagatgtcagtggatggattcatgcgctacctgagcggagaagaaaatggagtcgtttcacctgagaaactggatttgaacgaagacatgtctcagcccctgtctcactatttcatcaattcctcacacaacacctacctcacagctggccagttggctgggaactcgtctgtagagatgtatcgccaggtgcttctgtctggatgtcgctgtgtggagctggactgctggaagggcaggaccgctgaggaagagcctgtcatcacccatggattcaccatgacaacagaaatatccttcaaggaagtcatagaagccatcgcagagtgtgcgttcaagacttctccttttcccatcctcctttcctttgagaaccatgtggattccccgaagcaacaagccaagatggccgagtattgccgattaatctttggtgatgccctccttatggagccactggaaaaatacccactggaatctggggtacctcttccaagccctatggatttaatgtataaaatcttggtgaaaaacaagaagaagtcacacaagtcgtcagagggaagtggtaaaaagaagctctctgagcaagcttccaacacgtacagcgactcttccagcgtgttcgagccttcgtctccgggagctggggaagcagatacggagagtgatgacgatgacgacgatgatgactgtaaaaagtcttccatggatgaggggactgctggcagcgaggccatggccacagaagagatgtctaacctggtgaactatattcagcctgtcaagtttgagtcctttgaaacttcaaaaaaaagaaataaaagctttgaaatgtcttccttcgtggaaaccaaaggactcgaacaactcacgaagtctccagttgaatttgtcgaatacaacaagatgcagcttagcaggatatatcccaaaggaacacgcgtggactcatccaactacatgcctcagctcttctggaatgctggctgtcagatggtggcgctcaacttccagacagtggatctagctatgcagataaacatgggcatgtacgaatacaatgggaagagtggctacaggctgaagccagagttcatgaggaggccagacaagcattttgatccatttactgaaggaatcgtagatgggatagtggccaacactttatctgttaagattatttcaggtcagtttctctctgataagaaagttgggacttatgtggaagtggatatgtttggtttgcctgtggacacaagaaggaaggcatttaaaaccaagacatcccaaggaaatgctgtaaatcctgtctgggaagaagagccaattgtattcaaaaaggtagttctgccttctctggcctgtttaaggatagcagcatatgaggaaggaggcaaatttattggccaccggatcttgcctgtgcaagcaattcggccaggctatcactacatctgcctgcggaatgagaggaaccagcccctgatgctgccagctgtctttgtctacatagaagtcaaagactatgtcccagacacgtatgcagatgtaattgaagcattatcaaacccaatccgatatgtcaatctgatggaacagagagctaagcagttggctgcattgacactggaggatgaagaggaagtcaagaaggaggctgaccccggggaaacgtcatccgaggctccaagtgaaaccaggacaactccagcagagaatggggtgaatcacaccgcaacccttgcacccaagccaccttcccaggctccacacagccagcctgctccagggtctgtgaaggcacccgccaaaacagaggatctgattcagagcgtgttaacagaagtagaggcgcagaccattgaagagctcaagcaacagaaatcgttcgtgaaacttcaaaagaagcactacaaagaaatgaaagacctggtcaagagacaccacaagaaaaccaccgagctcatcaaggagcataccaccaagtacaatgagattcagaatgactacttgagaaggagggcagccttggaaaagtccgccaaaaaggatagcaagaagaaatctgaacccagcagcccagatcatggctcatccgccattgagcaagacctcgcggccctggatgcagaaatgactcagaagttgatagacttgaaagacaagcaacaacagcagctgcttaatcttcggcaagagcagtattacagtgagaagtaccagaagcgggagcacattaaattgctcattcagaagttgacagatgttgctgaagagtgtcagaacaatcagttgaagaagctgaaggaaatctgcgagaaagagaagaaggaattaaagaagaaaatggataagaagaggcaggagaagataacagaagccaagtccaaagacaaaagccagatggaagaggagaagacagagatgatccgatcatacatccaggaggtggtgcagtacatcaagaggttagaggaagcacaaagtaaaagacaagaaaaacttgtggaaaaacacaaggagatccgccagcagatcctggatgagaagcccaagggggaaggctcctcctcagtcttgtcggaaagttgccatgaggatccctctgttccccccaactttactccccccaaccctcaagctctcaagtggtgagcaccgtccttctagccagctgcagatggagctggagcaagaataccaagacaagttcaaaagactgcccctggagattctggagtttgtacaggaagccatgaaagggaaggttagtgaggacagcaatcacggctctgcccctccctcgctggcctcagaccctgctaaggtgaacctcaagtctccctccagtgaggaggtacaaggagagaacgcgggaagagagtttgatactcctctgtgatgtccctgccgggcctaccagacatgcacggctgcttgaactccatcggactctaaagacaaagatcactgcccgggccatcttcctgagaaacatcccttagcctgaaatccacaccaaagggagagttccagaaggatccgtgtgaaggtcccatacccttgtcccttgtgtcatgtggaaactattgtggtcttagagagaagggtgcatgtatgcaggatttttcttttcgttccaatagtaaattaaaagcaggcagctccaggctccatggactatgtaatgaaggacaatgtcttctttgaagaaaactagagctcgtgtcttcgtttgaagccctggtgtacagtatttccaagtaaaagagagagtttgagaagtgcgcggcaccatttaacactctggaacattccactctgagcattgtttccctgactgccccgcaaacccatgttttcaagttaacgtgtatagtgcattgtttcaccctttgctttgcaggcactggtggcttgccatttgctaatttatttatcccagaggcatctgtatttgctattgacatggctttattagataccatagtgactcatataagctggtttcttttataaaaaaaaatcacatgactgtatcatttcccagtgaagccattttacgattagcaatatgggttgtatatttggctgcacgtctttggatatctatcggttgttgacctgaggctatcaaacagctgcaatgggtttgttctgttgagtcagggtttccgccagactgaacaggatccagtgggctattttattgtcagatattttttcgtggttcatttatttttactgtagaaaggaagatagaatatttatctaaatgcacatgtataaatgatatacattatctccatgtatatagtacatgtatgcacccagccatataagtgcacacacatacatacgcatgagtgtacatgtgtgtttattaattggcagtgacccaaatctcttccataagatttaaaagcaagttcagggatacatggacagagaagaaatgggtcgaatatatgttatgtggataattaaattatacggaaatgctaagaatcagtttatggagtcaatgatgcaacttgaggtaatcttagaatttagaaaatgagtttactaaaaaaattggaggatcaaaaattggattttaagtatcagattttgagcttgttttaatggtcagtgtatgcaaaaatgcataggaaatagagtgcaaatgtattactactatcttcaataaattttaactgaataatttcaattttatactgatagaaataaagctctggttgtattttagtttgtatatttacttcacttagttatgtcttttttaattcttattttattctaaagtgaataagagaaacaaattatatcatgctaacgctaataaaatcataattaaaaggtcttaagaaataatattatatagaaaaaatatggtttagagagtgggacaaagaacattaaaacccagcaatgacaatgcccatggcttcattttattttaaagtgaacctgtctgcttataatttagcaaagcaaaaaacagttgtgtcctgaagtttgtgtttcaagaatttagtatttttctggaaataattttatttaactttaagcaataactaggaccataattaagtgttaatcaaaatgaaggcttgtttcaaacaccatgaaagtgtttgatcacacacatacaccacacacacacacacacacacacacacacacacacacacacacacacacctattgagacacaaggggaaaaaaatcacatccccttcagagatgattgtattttatctgaaggatcaagagtgttaattagtcacttactaaagcttaccttccactgaagagagatctcttgtgaaccatacaacttttgcactttgaaggaaaggcattactcagaaggaagtgaggacagtccaaatggaatgctgcattttacacacacagttacagactgttgaaaattggggaagagtgaatggataacaggattcgaaaccaaacttagtggtggttgttgcggaacattggatttcaacatactccatacagcgactgaggttgaataaccttgactttcaaatcctgttttggtagttggacttcattatcttggtgattctagtcattttacaatgttttgtatttggtcatttactgtaatcacatttttatatctgtacagtgacactttttgcagttgtggggtagtgtgtaacactgtgcatcttgcatcatcgaaactactaccgtgatactatccattgataatattaatattacttgaaaaatgacaaaggtaaagaaaaggggtctgtatgatgtgcagttttgtgcctttatgtatttgccttgttcttcgttgaatgtgtgaaattctgtactgtggtttttccaatagtagaaagtagagtcatgcattaaattagactgtatccctgacacctttaaactactgagaataacgtggttggccgtgtaattcagtgttcaaagttctaatgacatgccatgtgctttggtttttaacatttcatgaccaccatacattaattaatactcctgtaatagataagcagtcattaattaagttccaaaagaaagggccattgcttgcattcctttgaatttaatgttgcccttgtacactgtgttaatactgtatgtaatggattgaacattgtgattctcgccttttaagaagagaaagagagagaaggaaaagtatttgatgctcttaaaatgtacatatttgggttcttctatctcaaattatttaaaatgcataattcacatttttttgtaatcattctatgcaattttgtggcatgacgtttcttccacttgtaattttctgtgctttcatcacaagtccaaaggaaacaataaaaatt

SEQ ID NO: 1451 - DNA, 2458 bp, Rattus norvegicus
  Genbank Accession No. L14937
atgcggccctcccagacagcgctgtggctgggtctggttttgtctttggccctcctggctgtggggtgggcctcagcccgaccacccatctatgtcagcagctgggcagtgcgggtgaccaaaggttaccaggaggctgagcgcctggcacgtaaatttggcttcgtcaacctgggacagatctttcctgatgaccagtatttccatctgaggcaccggggtgtggcccagcagtccctgactccgcactggggccaccgtctgcgcctgaagaaagagcccaaggtgcggtggtttgagcagcagactttgaggcggcgggtgaagcgctccctggtggtacccacagacccctggttttccaagcagtggtacatgaacaaggagatagaacaagatctcaacatcctaaaggtttggaaccagggactgactggccggggagtggtggtctccatcttggatgatggcattgagaaggaccatccggacctctgggctaattatgaccccctggccagctatgacttcaatgattacgacccagatccccagcctcgatacacacccaacgatgagaaccggcatggaacacgctgcgctggggaggtgtctgccacagcaaacaacggtttctgtggtgccggtgtggccttcaatgccagaattggaggcgtgcgcatgttggatggagccatcactgacatcgtggaggctcagtccctcagcctgcagccgcaacacatacacatctatagcgccagttggggccccgaggatgatgggcgcacagtggacggacccggcctcctcacgcaggaggccttcaggcgtggtgtaaccaagggccgccaagggctgggcacgctgttcatctgggcctcgggaaacggtggcctccactacgacaactgcaattgtgacggctacaccaacagcatccacacgctgtcagtgggcagtaccacgcggcagggccgagtgccctggtacagcgaggcctgcgcctccacgttcaccaccaccttcagcagcggtgtggtcaccgacccacagatcgtcaccacggacctacaccatcaatgcaccgacaagcacacgggcacctcggcctccgccccgctggccgctggcatgatcgccctggcgctggaggccaacccgctgctgacctggagggacctgcagcacctggtggtccgcgcgtccaggccggcgcagctgcaggcggaggactggaggatcaacggcgtggggcgccaagtgagccaccactatggctatgggctgctggacgcggggctgctggtagacctggctcgcgtgtggctccctactaagcctcagaagaaatgcaccattcgggtggtgcacaccccaacccccatcctgcctcggatgctggtgccaaagaacgtgactgtatgctgcgatggctcgcgccgccgcctcatccgctcgctagagcatgttcaggtccagctgtcgctctcctacagccgccgcggggacctggagatcttcctcaccagccccatgggcacgcgctccacgcttgtggccatcagacccttggatatcagcggccaaggctacaacaactggatcttcatgtctactcactactgggatgaggacccgcagggcctgtggaccctggggctggagaataagggctactattataacacaggaactctgtactactgcacgctgctgctgtatgggacggcagaggacatgacagcgcggccccagaccccccaggtgaccagctgcgcgcacgcatgtgcagagggacacagaggggctgtgccaggaaagtcattgtcccctctccattgtggcagaactctgcctcatctccagcaagcagtggtggtggctctacagccacacacagcagccagtgaccaagggacaggacagctgtcaccctcctaccacacctgctcggcagcttgaccagcgactacactgcctgttccctgcccctcatgctgggagtgcttcagagcccctccaaggcttgtcacctctggcagccatcctggctatcagtcttgggccatggtgctgtccctgctaaccagggcctttggaaggcccctcatcttgaggaaggcccacctctccccaggctggatacccctggggagccagagatgccccactctcaggacagaaggccggtaccccaaggccctgctcccaggccgggataggaatatgccccagaaggccacggcagagagctgcatgggtcacgtgacagcccgcagctcagcctcagctgctcccagtggaagagacgtttcctcattctttttggagcaggtatggcagacaagaggtcagaccacagccaccaaccacctgccccttccctgtctccaaaccatccccatgtctaacctcatagttggcaaataaagttaaacagaaaaaaaaaaaaaaa

SEQ ID NO: 1452 - DNA, 2301 bp, Rattus norvegicus
  Genbank Accession No. L16532
ccccgtgtccctcgcgcaggcgggcggccccggagacatagtgcccgcaaaggcggtgacggcggtgcgcccactcatcatgagcacaagctttgcccgaaaaagccacacattcctgcccaagatcttcttcagaaaaatgtcatcctcaggagctaaggacaagccagagctgcagttccctttccttcaagatgaggacacggtggctacgctgcacgagtgcaagacgctgttcatcctgcgtggcctgccgggcagcggcaagtccactctggctcggctcatcgtggagaagtaccacaacggcaccaagatggtgtctgctgatgcttacaagatcattcctggctctcgggcagacttctccgaggagtacaagcgtctggacgaggacctggctggctactgccgccgggacatcagggttcttgtgctcgatgacaccaaccatgagcgggaacggctggaccagctttttgaaatggcagaccagtaccagtaccaggtggtgctggtggagcccaagacggcgtggcgactagactgtgcccagctcaaggagaagaaccaatggcagctgtcgctcgatgacctgaagaagctgaagcccgggctggagaaggacttcctgccactttactttggctggttcctgaccaaaaagagttccgagaccctccgaaaagccggccaggtctttctggaggagctgggaaatcacaaggctttcaagaaagagcttcgacacttcatttctggggatgaacccaaggagaagcttgacctggtcagctactttggcaagagacctccaggcgtgctgcactgtacaaccaaattctgtgactacgggaaggccaccggggcagaagaatatgcccaacaggatgtggtgaggagatcttacggcaaggccttcaaactgtccatctctgccctctttgtgacacccaagacagctggggcccaggtggtgcttaatgagcaggagctgcagttgtggccaagtgacctggacaagccctcatcctccgagagcctgcccccagggagccgagctcacgtcaccctaggctgtgcagccgacgtgcagccagtgcagacaggccttgacctcttagagattttacagcaggtgaaggggggcagccaaggtgaggaggtgggtgagctcccccggggcaagctctattccttgggcaaagggcgttggatgctgagcttggcgaagaagatggaagtcaaggccatcttcacggggtactatgggaagggcaaacctgtacccgtacacggcagccggaaggggggtgccatgcagatctgcaccatcatctgagggttcacgccactgtgccaccgctgtggacacagcaacatgccttccacttgatttttaagattttttttttttactcaaagctaatctacctataactttttagaagtctgtaaaataaccatcagttccttcacccaccctcttccccttaacactcagctcaacacaggcaggtgggcagaggaagacaccattcaggaacctggaccagaggtggtaattaaagggctgggtcattggcctggagcggccacctagatgcacccaggaccttgttaaccctcccttagccgctgcccatgcagagctgggcacacacacctcagagccaccacacatcatgcaagggacaaatgctactgccacaggaaaacagtggtagctttgagaggggacagacccctgggtgccaatcttaatcactgtagccccaaggaaggcttgggctacttactgggctgtaaaaggggcttacctctcaccgttggtcattcccaactccctctctccttcactggcactaggttaatggtgtgaccactaggggagaaaatggcattaccggaagccacatctctggttccggtctggctatctagccttaacagctgtctctgctaaggtcagagagatgctttaagaaactccagctttgctttctgcccagcccatcttgcctccgtggtgcctctgggcctcctctaaaggatggtggtgggtaccaagagccaacggagggggccctgagccagcaagagtaagccccatctgctctggggaagtctgaacacgcgcgtgtgctgtggttcctggagtacctcactctgctcagtaacaggaccttgctaattgggttgtcacccaagcatctgggatttatgttcctaccctcaccctgtgttgcccacctcagcaacaactaagactgatactgaaataaatcgtgttaatcccaa

SEQ ID NO: 1453 - DNA, 2643 bp, Rattus norvegicus
  Genbank Accession No. L25387
gtgaccaggactcttcgacgtccagcacctcctttccgaagtacctggagcacctctctggggatggcaaagcatggtgtcctgaccagcggcggggagtcccaaggcatgaatgctgctgtccgtgctgtggtgcgcatgggaatgtacacgggggcccaagtgtactttatatacgagggttaccaaggcatggtggatggaggctccaatattgtggaagccaagtgggagtgtgtctccagcattctacaagtgggtgggaccatcatcggcagtgcccgttgccaagccttccgcagccgtgaagggcgtctgaaagccacctgtaacctggtacgcttgggcataaccaacctgtgcgtgatcggtggggacggaagtctcacgggagccaacctcttccggaaggagtggagcggtcttctggaagagctggctaagaatggtgagatcgattcggacacagtgaagaagcacgcctacctcaacgtggtgggcatggtgggctccattgacaatgacttctgtggcacagacatgaccatcggtacagattcagctctgcaccgaattattgaagttgttgatgccatcatgaccactgcccagagccaccagagaaccttcgtcttggaggtgatggggagatactgtggttacttggccttggtgagcgccttggcttgcggtgccgactgggtgttccttccagagtctccgccagaggaaggttgggaggaagaaatgtgcctcaaactctccgagaaccgtgcccgaaagaaaaggctgaatatcatcattgtgtctgaaggagcaatcgacacccaaaataagccaatcacctctgagaaaatcaaggagcttgtggtgacaaatttgggctttgacacccgggtcaccattcttggacatgtccagagaggagggaccccttctgcatttgacaggattttggccagccgtatgggagtggaggctgtccttgccttgctggaagctacccctgagaccccagcctgtgtcgtgtcactgagaggaaatcaagctgtacgcctgcctctgatggagtgcgtgcaaatgacccaggatgtacagaaagcaatggatgaaaggagatttgatgaagccgtaaaactccgaggaaggagttttgagggcaacctgaacacctacaagcgtcttgccattaaggagcctgatgacaagatccccaagagcaattgcaatgtagccatcatcaatgtaggggcacctgccgcgggaatgaatgcagccgtccggtccgctgttcgggttgggattgcagagggccacaagatgttcgcaatctatgacggctttgatggcctcgccaatggccaaatcaaagaaatcggctggggagatgtcggaggttggacaggacaaggagggtccattcttgggacgaaacgcaccctacccggaaagtacttggagaagatcgcagaacagatgcactcgaaaaatatcaatgcccttctgatcattggcggattcgaggcctacctgggactcctagagctggcagctgcccggaacaaacatgaggcattctgtgtccctatggttatggttcctgctactgtctccaacaatgtgccaggttctgatttcagcatcggggcagacacggctctgaacactatcacagacacgtgcgaccgcataaaacagtcagccagtgggaccaagcgccgggtgttcatcattgagaccatgggcggatactgtggctacctggccaacatggggggacttgcagcgggacgcgatgctgcctacatctttgaagaacaatttgatatccgagatttgcagtccaacgtcatgcacttgacggagaaaatgaagaccagcatccagaggggccttgtcctcagaaatgaaaactgcagtgtaaattacaccacggacttcatctaccagctctactcagaggaagggaaaggagtgtttgactgcaggaagaacgtgctaggccacatgcagcaggggggagcaccttctccattcgacagaaactttggaaccaaaatatctgccaaagctatggagtggatctcggccaaactgaagggctcccacggcacagggaaaaaatttgttagtgatgattccatttgtgtcctgggaattcagaagagagacctcctgtttaaaccagtggcagagctaaggaaggctactgactttgagcaccgtatccccaaacaacagtggtggctgaaactgctaccaatctcgaagatcttggcaaagtatgaggcaagctatgacatgtcagacgtaggcaagctggagccggtgcataaccacggagaactatcagccatctgattgaatatgccgtctcctgacctgcacacttacctagggaagcctgtaatgttctccagggaccacccctttttgtaacatagttatttatcagcactctatgcaagaattgttggccgagtattgtcagcagtaataatcagagagcatcacttgctataaccattgacgcaacagaccctaagacatgaaacccagcctcgcgcgattgatcacgtgtcagttttctactgtaccgggtactactgtcttgtgctttaccatgtgtgtatcttgtgggat

SEQ ID NO: 1454 - DNA, 1368 bp, Rattus norvegicus
  Genbank Accession No. L25866
atggttcactccagcatgggggctccagaaataagaatgtctaagcccctggaggccgagaagcaaagtctggactccccgtcagagcacacagacactgaaagaaatggacccgacattaaccatcagaacccccagaacaaagcgtccccattctctgtgtccccaactggccccagcaccaaggacatacagcaactcctccagctccaacagctggtgcttgtccccggccaccacctccagccacctgctcagttcctgctgccacaagcgcagcagagtcagccagggctgctaccaacgccaaatctattccagctacctcagcaaacccagggagctctcctgacctcccagccccgggctgggcttcctacactccatccgggtcctcgatcctgcatcccatccacctgcccaccttaccaggctatgactcgccccacgctgcccgacccgcacctctcacacccgcagccctcgaaatgcttggagccaccatcccacccggaggagcccagtgatctggaggagctggaacagttcgctcgcaccttcaagcaacgccgcatcaagctgggcttcacacagggtgatgtgggcctggccatgggcaagctctatggcaacgacttcagccaaacgaccatttcccgcttcgaggcccttaacctgagcttcaagaacatgtgtaaactcaagcccctcctggagaagtggctcaacgacgcagagactatgtctgtggattcaagcctacccagcccaaaccagctgagcagccccagcctgggtttcgacgggctgccggggcggagacgcaagaagaggaccagcatcgagacgaatgtccgcttcgccttagagaagagtttcctagcgaaccagaagcctacctcagaggagatcctgctgattgcagagcagctgcacatggaaaaggaagtgatccgcgtctggttctgcaaccggcgccagaaggagaaacgcatcaacccttgcagtgcggcccccatgctgcccagcccgggaaagccgaccagttacagcccgcacctggtcacaccccaagggggcgcaggaaccttaccattgtcccaagcttctagcagtctgagcacaacagttactaccttatcctcagctgtggggacactccaccccagccggacagcaggagggggtggcggtgggggcggagccgcgccccccctcaattccatcccctctgtcactcccccacccccggccaccaccaacagcacaaacccgagccctcaaggcagccactcggctatcggcttgacgggcctgaaccccagcgcaggccctggcctctggtggaaccctgccccttaccagcca

SEQ ID NO: 1455 - DNA, 640 bp, Rattus norvegicus
  Genbank Accession No. L35558
gaggcgtgttttcagcagtacaaaaccaagcgtgaagaagtgaagcctgccagtgatcctggggggaaccagacagaggtgtctgtcaccacggccatgacaacaatgtctgagaacaagacaaaggaatacaaaatcgtttgcctgtactcagacggcatcaacgtcctgggcctgattatcttcttcctcgtctttggacttgtcattggaaaaatgggagaaaagggacagattctggtggatttcttcaatgcgttgagtgacgccaccatgaaaatcgttcagatcatcatgtgttacatgccgatcggtattttgttcctaatcgctgggaagatcatagaagttgaagactgggaaatattccgcaagttgggcctttatatggccactgtcctgagtgggcttgcaatccactccctcgtagtgctgccactgatctatttcatagtcgttacgaagaaccctttccgctttgccttgggcatggcgcaggctctcctgacagctctcatgatctcatctagctcggcaacccttccagttacattccgctgtgcggaagaaaagaaccacgtggacaagaggatcacaagatttgtgctgcccgtcggcgccaccatcaacatggacggca

SEQ ID NO: 1456 - DNA, 3645 bp, Rattus norvegicus
  Genbank Accession No. L37203
cgtcagagagtgctcagaaagtgtgacctctgaggaccctggtgtgagaccctcacggctgacaaagatccagtgccaactctgagaggccaccatggcaggtctgcagcagggctgtcaccccgaaggccaggactggacagcgccacactggaagacctgccgggccctgccagggccacggggactcacggtcagacatctgaggacagtctcttccatatcggtcttctctgtggtattttggggtgtcttgctgtgggctgactctctttccctgccagcatgggcaagagagaccttcacccttggggtgctgggtccctgggactgtgaccctatctttgcccaggcactccctagcatggctacccagttggctgtagatcgagtcaatcaggacgcctcactgctgctgggctcacagttggatttcaagatcctccctacaggctgtgacacccctcatgccctggccacatttgtggcccacaggaacacagtggctgcttttataggccctgtcaatcctgggtattgtccagcagcagctctgctggcccaaggctggggcaagtccctcttctcctgggcctgtggagctccagagggaggaggtgccttagtgcccactttgccttctatggccgacgtgctactgtctgtcatgagacactttggctgggctcgcttggccatcgtgtcctctcaccaggacatctgggtaaccacagcccagcagctagccacagctttcagggcccatgggctgcctatcggactgatcacctccttgggacctggagagaagggggccacggaggtttgcaagcagctccacagtgtgcatggtctgaaaatcgtggttctgtgcatgcactcagcgctgcttggaggcctagagcagacagtcctgctgcgctgcgcgagggaggagggcctgacagatggcagactggtcttcttgccctacgacacgctgctctttgccctgccctatcgtaaccgctcttacctggtcctggatgatgatgggccccttcaggaggcctacgatgcagtactcaccatcagtctggacaccagtcctgagagccatgccttcactgctaccaagatgagaggaggggcagctgccaacttggggcccgagcaggtgtccccactctttggaactatctacgatgccgtcatcctgttggcccatgccctgaaccactctgagacccatggaacggggctctcaggggctcacttagggaaccatataagagctcttgatgtggctggttttagccagagaatccggatagatgggaaaggcagaaggctaccccaatacgtcatcctggacacaaatggtgaaggaagccagttggttcccacccacatcctggacgtgagcacacagcaggtgcagcccctgggaacggcggtacacttccctggagggagccctccagcccatgatgccagctgctggttcgaccccaacacactatgcatacgaggtgtgcagcccctgggcagcctcctgactctgacgataacctgtgtcctggctctggttggtggattccttgcttactttatcaggttaggcctccagcagctgcggctgctgcggggcccccatcggatcctgctgacacctcaagagctcaccttcctccagcgaacccccagccggcggaggccacatgtggacagtggcagcgagtcaagaagtgtggtagatggtgggagtccacagtcagtgatccaggggtcaacaaggagcgtaccagccttcctggagcacaccaacgtggccctgtaccagggagagtgggtgtggctgaagaagtttgaggcaggcacggctcctgatctgcggcccagcagcctcagcctcctgagaaagatgcgggagatgcggcatgagaatgtcaccgccttcctgggtctctttgtgggccctgaggttagtgcgatggtgctggagcactgtgcccgtggcagcctggaggacctgctacggaatgaggacctgaggctagactggaccttcaaggcctccttactgttggatctgatccgaggtttgcggtatctgcaccatcgacatttcccccatgggcgcctcaagtccaggaactgtgtggtggacactcgctttgtgctcaagatcactgaccatggttatgcagagttcctggagtctcactgctctttcaggccccagccggccccagaagagcttctgtggacggctcctgagctgttgcgggggcctcgggggccttgggggcctgggaaggccaccttcaaaggtgatgttttcagcctgggcatcatcctgcaggaggtactgacccgagacccaccctactgctcctggggactctcagcagaagagatcatccggaaggtggcatctccccctcctctgtgccggcctctggtgtcccctgaccagggtcccctggagtgcatccagttgatgcagctgtgctgggaggaagctccagatgacaggccaagcttggaccagatctacacacagttcaaaagcatcaaccaaggcaagaagacaagtgttgctgactccatgctgcggatgctggagaagtattcccaaagcctggaaggtctggtccaggagcggactgaggagctggaactggagaggcggaagacagagaggctgctctcacagatgctccccccgtctgtcgcccatgctctaaagatgggaacaactgtggagcccgagtactttgaccaagtcaccatctatttcagtgacatcgtgggctttaccaccatctcagccttgagtgagcccattgaggtggtgggcttcctcaatgatctctacacgatgtttgatgctgttctagacagccatgatgtgtataaggtagaaaccataggggatgcctacatggtggcatctgggctccctcggcgcaacggaaatcggcatgctgctgagattgccaacatggctctggagatccttagctacgcaggcaacttccggatgaggcatgcacctgatgtgcccatccgtgtcagggccggtctgcattcagggccctgtgtggcaggtgttgtgggtctcaccatgcctcggtactgcctctttggggacaccgtgaacactgcttccaggatggaatccactggactgccatacagaatccacgtcagccgaaacactgtccaggccctgcttagccttgacgaaggctacaaaattgatgtcagaggtcagaccgaactgaaggggaagggcttggaggagacttactggctgacagggaagacaggattttgcagatccctccctacacctctgtccatccagcctggagacccatggcaggaccatataaaccaagaaatccggactggctttgcaaagctcgccagagtctgctgagccaggagttcaggggacactgggccaggtcctgatagcaagtcggtgggaggtgccaaggcagccaagatgccccatcacccctgcctcctacgaatgtctgcctgccaccatgagtggtatgaggagctgctgtcttccctagtgactctgggggtgtccttgcctcctgtcaggaaaacaataaaaatggaaatactcccttccaaaaaaaaaaa

SEQ ID NO: 1457 - DNA, 409 bp, Rattus norvegicus
  Genbank Accession No. L37970
ccatgctcgtggcgctcctcccagtgctggggataaactttctcctgagagttgcccaagctcagtcagtgactcaacctgacgctcatgtcactgtctctgaagaaggctctctgcagctgagatgcaagtattccacacctggggcaccttccctgttctggtatgtccagtacccacagcacgggctgctgctgctcctcaagtactattcaggaaaccccatggttcaaggattgaatgactttaaggctgaattcaacaagagtgactcttccttccacctgcgggaagcctctgtgcactggagcgactcggctgtgtacttctgtgctctggtctccgggggacaggtgctgggccagctcactttcgggagtggaacaagactccaagtctatgcaaatgt

SEQ ID NO: 1458 - DNA, 3974 bp, Rattus norvegicus
  Genbank Accession No. L38482
tcgactacccatattccccaccagccaaccggttcctcaccaagatgtggcacccaaacatctatgaggtaagacactagaggcctgcttcaggcacactccaccacacacttctctgcctcccttgcacatgctccacccctcctctaaccctggtcactcttgcagacaggggacgtatgcatctccatccaccatcccccagttgatgacccacagagtgggagctaccctcagagcggtggaaccccacgcagaatgtcaggtgagaattgccatggaactgcaccgtgggcacccgcaaacaccctgtaccctaagatccacccttccctgctccagtcaggggttcccagagtctggggagctgagcttgcacctacggccctacaggaccatcctcctgagtgtgatctccctgctgaatgagcccaacaccttctcgcctgccaacgtggacgcctcggtgatgtacagaaaatggaaggagagcaaggggaaggaccgcgagtacacggacatcatccggtgagtgcttcctactgtgaagagtgatctggggtgtgggtggggtggggacttgttgtatgtttccattttttgcatcccgggctggatgtgtggaggactctggggcccccagagcacggagttgaccacccagggtggccaagatcccctctgccttgttgttgacttaactccatgagcaactgggctctctgggccacaccctcactgtctgacagagagcatcaatcacttgcatttcgtgcttctgaaacttagagcttttttttttttttttgcaaagtgggaagggggctgagcccactgtgagtctgtcctcagttagggaccagggctgcgacctgttgctgtctatgagtggcagtgtccacacctatcatcgcttcttagcaggagctcctggcctgtctggggccaggcagtctcccctacacccctcacgttgggtatgaagttgcacttgaggggttcagtctttgtcgcttagcttctgtgttttctgagacaggctttcatataactccgtatctccttgtggtccctctgatgtcaggatgacaacacacattcctcggaagtgaccccagtgcttgtctacacagtgacccaaacacagggcctgtcctgtccccaagcctgccctctcagagttggtacaggccgcagctcggtaggcagtgctggtctagcatgtgcacacacacagggttagtctctgtcttaggcaaggtggatgtagccagcatggtccttcatggaggtataagttactcaggaaggtctgagcgctgcactacggaggtgtccccttcaccatggtcaggtcagcaacggtcccggtcactggaagtccctgcagactgtcccctttgttttctgttcagactggctgaacagaactttgttcctcctgctcttcctcagctgagaggaaggctggctgccctagctgttctatatagttctggctgtcctggaagaggagaccctgggtctggccctgtcactgcactctccaccctcctggcagcctttaatccacttctggctgcttcctccctggatccctggcccagagcaggagcccaggctatttttaccattctgactccaggagccacttgctctgaccaggaggcctgtaccactcctggaactcaacctgagccagtatctagtcatgtccctgcctgagcacaaggacaggatagctaggagcctgtgagaaggaccttgagatggatctaggctattgggtgtgctgctgtcccacgtgcccctccaccatagccttgtccccattcccctattccttctgggcagctgaaaacagtgtctgctctgcttgactgcactgggacctgtgccccaagactctggcctgacggtggcctggcctctcaggcacctagttaattgctgcctgccctgtgcaaggaagcccttacatgttgcttcacccatggcctgtgggacctggaacctcagttgttccggaactgcccttcatcatggtgccctcaggtcaggctgcaatttgttgttggtgtgaggaggtgcatgttacctagcccacaactagggtagtgccccccacagtctgggattacagctgtttctgtggtgctgggagctggacatgggtccttatgcttacagaaggagcactctggctgcccctgttgtcggttatagccgaggtcagcctgaatctcatagtagttctcctgcctccgcctccaaggactgggtgacagaccgtctcccacagctggctgtggttacatttctgctggagttggtcactgagccactccttgtcgcctggccctctcctcccacctgctccctgcccccattcatctcatcgtcctgggccgtggcctcacccgccctgtctccccaggaagcaggtcctggggaccaaggtggacgcagagcgcgatggcgtgaagtgcccaccacgctggccgagtactgcgtgaagaccaagcgccggcgcccgacgagggctcagacctcttctacgacgactactatgaggacggtgaagtggaggaggccgacagctgctttggggatgaagaggatgactctggcaccgaggagtcctgacccacgtccctgaaataaacttacaaattttacctcagcaggacccgtgtgggcctcaggcgacagactacctcaccgaggttcaatgtgggctcccatcccatgatccttaggtcctcttaccctgtattccccatgggttttcctcggctttggagaagagctgtggtgcagggcagacaccccactcagccttcagaggatgacaagcctgggaggctgggaaccgactgcccaggggagccagagactccagcccaaagagggccagccccacagtctcctctctgcttttggtgtgtgtgaaatccaaataaaatagctttctgagaagctgagagaagcagccaggacgccggtggcactgggtactgagggctacctgggtacccaggcagggctgtgggatgggcaggaagaggtagcgatggtggcctgtttgttggggctcagtagcatacaggagccccaggcccagaagaaacttgctgcctgcaaatcccacccgcctgcatcgggcactgtggttgcgtccaccccaagcctgtgttcaggaggcctgggtcctgaggcctacaggggattggtattcccaacagtccttgtgttctgggcacttcctcagccctggaaactagtgctgcctgaggagtccctctgatacctgagctgcagcctggtgactccacagcaggggcaggctgagtgaattctctgaccacaccatgctgtgcagggcacctgcagtgaccccgtgctgagatagcagatctgctctgccacctgcatgtttacgggtgctgtggaaagaaagtgtcacttcctcttatgcgggcctgttaatgtccaaagttccagtcaacccatgccagtcagaactgatcagagaaggacacatcggaaaaaggtgttcaggcgatcctctgcccatacaatttgctgccagcctgatctacagttgcaaaaccagcgggaaggctcagtgggcaaaggcctgcaccaagcctagcagaggacccacttggctccaggtggtccctgtgggggttgaggtcagttgagacaaatcccccccccccccccggagttcaccccagtgctaaaaggagcagtgtgccaggagagggagcatcgcttggctgtagttgctgcccccagacacagggcaactttgacagcagagttgctttctaaaaccacacagcagggtgtgaaggaggaggagctgacacgtgggtaaggtgggtggtgcttggaaggccacttgtctccaccggaagagaaagtgtggggccccttcccccagggaccaccagtcctgtgccagg

SEQ ID NO: 1459 - DNA, 1882 bp, Rattus norvegicus
  Genbank Accession No. L38615
tggagtttgagcttggcgagcagctggacaacgagcgagttgggatggccaccagctggggaagcatcttgcaggatgagaagcagctggaagagttggcacagcaggccatagaccgggccctggctgagggggtgttgctgaggtccgcaaagaaccccagctcctctgacgtggtgacgtatgccccattcacgctcttcccctcaccagtgcccagcactctgctggagcaggcctatgctgtgcagatggacttcaacatcctggtagatgctgtcagccagaactccgccttcctggagcaaacactgtctagcaccatcaaaaaggatgagtatactgcccgtctctttgatatctacaagcaagtcctgaaagagggcatagcccagactgtgttcctgggcctcaatcgttcagattacatgttccagtgcagcgcagacggctccaaagccctgaaacagattgagatcaacactatctctgccagctttgggggcctggcctcccggactccggctgtgcaccgacatgttctcaatgtcctgaataagaccaacgaagcttccaagatcctgtccaacaaccccagcaagggactggccctggggatcgccaaagcctgggagctctatggctcagccaatgccgtggtgctactgattgctcaggagaaggaaaggaacatatttgaccagcgtgccatagagaacgagctgctagacaggaagatccatgtaatccgccgaagatttgaagatgtctctgaaaggggttctctagaccaaaaccgaaggctgtttatggaggaccaggaagttgctgtggtttacttccgagatggctacatgcccagtcagtataacgcacagaactgggaagctcgcctgctgctagagagatcatgtgctgccaagtgtcccgacattgccacacagctggctggcactaagaaggtgcagcaggaactgagcagggtgggcctgctggaagcgctgctcccgggccagcccgaggctgtggcccgcctccgtgccacctttgctggcctctattcactggacatgggtgaagaaggggaccaggctgtcgctgaggcccttgctgcccctagccactttgtgctgaagccccaaagagagggcggaggtaataacttctatggggaggaaatggtacacgctctggagcagctgaaagacagcgaggagagagcctcctacatcctcatggagaagattgaacctgagccttttaggaattgcttactacggcctggcagccctgcccaagtggtccagtgcatctcggagctgggtatttttggagtctatgtcagacagggaacaacacttgtgatgaacaagcatgtggggcatctgcttcgaaccaaagccattgaacatgcagatggaggtgtggcagcaggagtggcagtcctggacaacccctaccctgtgtgaagacatgttctgggcttcactcaagagaccttctatcctctgtacttggcactcctctcctgaggggctacccctgtacctgtgttaggggagggagcttgtctctttcatagacctccaggggctttagggaagggaaaatcccgggtcccttctctcagccttccatccaaggaccagaaaagctatgattccattggaagagttctggagctccccagatttggagtgggaatggaagctcctttgaggcaaaggcccacaaaccccacacatcttcattgccctctcgccagcctttccagcaggttctagtgccttgacctggggtaggaccaagtgacaggaggaagagggtagatgggcatagacttccccagctctgccctaaataaaacaatgctgattcaatg

SEQ ID NO: 1460 - DNA, 760 bp, Rattus norvegicus
  Genbank Accession No. M11596
acaccatggacttctggaagttctttccttttctggctctcagcagcatgtgggtcctgtgcctggccagcagcctccaggcagcccctttcaggtcagctttggagagcagcctagacctgggcaccctcagcgaccaggaaaaacacctcttgcttgctgcattgatacaggactatgaacagaaggccaggaagctggaacaggaggagcaagagactgagggctccaggaaaggctcctcctccagtgtcatttcccagaagagatcctgcaacaccgccacctgtgtgacccatcggctggcaggcttgctgcgcaggtcgggaggtgtggtgaaggacaactttgtgcccaccaatgtgggctccaaagcctttggccggcgccgcagggaccttcgggtctgaggaactaacgctccaggaagaaggttacataaagttgaactcaccacgcctattaatttttattaacaacaaccctattgagaaggccccatggacgatgtgtatgtttgcatcctgaaagatactgagggaaaacaccattgtcacttgagagaaatgaaaccaagtataaatgagttaattctgtgttcgtttgcatcatttttatactgagtctatggccagtcaaatatgatggtgtctcctgctggcatcctttgcagcaaaccaaataggttctccaagagccgtccagacggtggtagcagctctggtgaacctcagggagacgtgatatcactgcctcttgt

SEQ ID NO: 1461 - DNA, 8351 bp, Rattus norvegicus
  Genbank Accession No. M11794
gaattccatcagaatttgcctttctggtggcttctctttccctgcccttgtggtgtttttccttcagtgagtgacaaatttcacaaccctggctgggactcccgaggtgctaagattacaggcctgggtcacaccacccaaacctgactttctttttcattgttgcttgtatttttctgtttgtaaccaaagctggacgactggaactcactgtgtagactaggctggccttgaactcatagaactctacttgcctctgcctcctgagtgctctgattaacggcactgaccaatacatccaacctacctactttcattttctaaatctaagtcctaacaggaagtgggaactgggcaggaataacagtacggtgggttaactccatgagtttaccggactttgcgagcctcgactgccaacgacatcctggcttgaggctggaagtcacagcccaacaggggcaaagattgctctgtgaccagtctggaaagggagcactggagcacagaaatcaatccggttcaagttcatacccagggcaaccacggaaagtgccaggaaaggaaagaacaggatgttttccacacattccatgggcagccatggggatccaggagaaagtgatgcttggctgagccaagaagcagtgccccagtttacagtaagggctgagaggacagcctgtcctgagcttccggtaacacatttcctgccttctcaaatgacagacattccatctacgactttgagtctgatttcagcagtcttatgcaagaggggaaacaccatatgcctccagggaaagaaaatttggctgccgtctccaccctttccctcagcatccaccgtgggtgggggtggggagggttagtggggctttccatccctgtctttcagaacactacgatctggccctttctgcttggccaacacctgcgcagagtcctagttcatatcctcccagaatggcctgctctccacctccagcagagacccccatcattttttcctgttcactctctgccccccaccccccaccaagaataagtatccttagcacaaggcttgtgtctttatggtctctagtctctgacaactggctggagtctcagtggattcgaaccctccattcatcttgggctaatgactatgtgattgcgcctccgtttccacttttctactgtgaaaataatgaacaccccaagctatgttgtaaggaaaaatgagagccctaacagtgcccccagcacgtgacacgcagggggtacgtgacacgcagggggtacgtaaccaaggccggtaaagtctgggctagggctggtttttgttacctgttcacactgtcagctaggttttcctgtatgcggggtctccaagccccgctttcacctaagttagcactcaagacgtgctgtggggactgtgtccccgtggacgctgcagggggttcgatgtcccgcaactcctctgcacccggccacttgggcccagggcacgtgagcaggtttcctggaaccggtccccaccggatcgcagaccctttgcgctcagccctttgctctcagtccctgcgccaggagaaagggggtgtgactcagcgcgggggcgtgtgcaggctctgtacccacgtgcaaaaggagggatgcttgcagacttcgggtcgtgcgcaggctcccgggcgtgtgcgggccatttcccttgagccagaagaagggcgtgtgcaggcagtggggaggagggcaggtggcgccccgccacccgggcggagcttttgcgcgcgacccaatactctgggctataaaggtcgcgctccgcgtgcttctctccatcacgctcctagaactctacagcgatctctcgttgatctccaactgccgcctccattcgccatggaccccaactgctcctgtgccacaggtaaggggggctgctgacgggcctctgtaaccggagcttctgggagagcaggacggacttttgggcccctactctggtaactacttttagggtactactggctgctgccttccgaacgaattctggaacactcccgccccttttaaactagtccttgagataatggctcgcccaagctggctggcttgcacccgagttctttggagaactgtgttcagttatgcccgggtccgctcaccgcgctccctgccttcttcctctagatggatcctgctcctgcgctggctcctgcaaatgcaaacaatgcaaatgcacctcctgcaagaaaagtgagttggatttattttctctaccctttcccttcgcgcccctgcggtccctagcccgccgcaccttcccagagcgtccaggctgcctctaactcggtttctcgctcacgctcaacttttttcccccaggctgctgttcctgctgccccgtgggctgtgcgaagtgctcccagggctgcatctgcaaagaggcttcggacaagtgcagctgctgcgcctgaagtgggggcgtcctcacaatggtgtaaataaaacaacgtaaggaacctagcctttttttgtacaaccctgaccggttctccacacttttttctataaagcatgtaactgacaataaaataaaaaaacttgacttgattaacccagctttgtctgtgttcattggaaataaggggctggcagaggcgttgaaatgggattggtgcaccttgatttgggataagtggattgatgacccctctggactttgatagtctcgaacatggtgggcagaaacatgtactggtcacaaatgtgggcatgtgtatattggggattaaacccaaagcttcctgcttataaaccagggtgctctaatgagccacactcctacccctagatgcataatgattctggtttaattttggattattaggcttaaagcagtatgaagtacctgttcataagctttggtaaataaaataaaagttggagtgagtctcatacgactcctctttgtagtcccaatatttgggagcctgaggcagaaggatcggtgcaactccgaagccaacttggtctcaaattctgttaacctttgattttgagaccatcttactgtgtaacctaaaatggtccttgaacttgcagtcctgcctcagacttctaggtactgggattacaggctcagcttaaaatcagggctggagagatggctcagcggttaagagcacccgactgctcttccagaggtcatgagttcaattcccagcaaccacatggtgctcacaccatctgtaatgagatcttacgcgttctggcgtaatgcaagcagaaaagacatcagtaacgtgaacaaaaccatgaaaagtactgtaaacactataaatatccaagggtgtgccttgcagtttggagactaaatggcacatgtccaacctagagctcccatgaggaactgcccatctctggtatacagggacacggacaggattttttttttcctcttccagagagccctgtgataggacttggctgtcagtctggaagttcttctcaaggtcaggcagaaatctacctacccctcactccataccaacccctggcaatttaagcaaagtaactagaaatttggaaggaattgactagcatcttcccaggagctaggcatccaggttgagtctgcaatttggagggcggggtggagtttcctactctataggaaggaggtgaatacatgcaattaaaaccagccgttaatgccccctggctatttgttgaggtaatgcgatttggtcttcaatcaaagggaaagtttcttggctagaagtaaggaccaagcttgccgtaggctttctctgtgaagagtaaatttacaagacagcctctgtttcttgctgtcaggaagtcctagttcacagcccactttctctcttattggtcatgtagcctgggcaagtcactgaacccctcaaatgctgatatcctgccctcctagatgctgataaccacctgtccccaaagaacacacgggcaaccaagcacagatctgatttttaaggaatttgttttgtaagtgcagtttgggaatctggcctcatttgtctcttgtgtgcccttgctgacaccattcattcagccctggccttgatttaggtgacaccgaactcgggctgtaccctcagagatttccctctttgtctacaaacaaacaaacaaagcaaatatcctaattaagactcttgtgtgtcaagtagggcatctaggaatgagtgctgggaccactcttagtcccagaatgccttgaaaccaagtgaatgacaattatacatttagcttctcaattaaaatggaagacattgggccgggaattggctcacagtggagagcctaccaggcttttgtgaagctctgaggttcatccctagaaccattaaaaaaaggtccgtgggcctgggaatgtagctccctggtacagtgcttacctaacatgcacggacccctgggtttgctccacagcatggagtaagcagtctgatggcacacacctgtaattctaacacgcaggaggcagaggcaaggaggatcaaacgttcaaggaccacggcaagtttgaggtgtgggccacatgtaaagccgtctccaaaaagacatcacacacaaaacacaacagtattgtgatacacacgtatacctgtatcctagcaacctgggaaactgaagcaggagactgtcttgagttcaaggccagactgggctgttcggtgatcgacaggccattctgagttacagagtgaggcccttggaaaaggagaggaaggagaggaggagagactgggcctggcaacatgcatctatcatcttagctactcaggagactgaggcagggggaggatttccagctcaaagtctagctacagagcacgtctaaagccagcctggacagcttagtgagaccctgtttcaaaataaaaagaatctaaaagactggaggtaaagctccagtgtagaatgcttgcctggtaaccaggaagccttgggttcaatccttactgtaaaaaaaggaaaaaaaatcatattatgcaagaggtctaaaggcccaagaatctgttacagatctcagttttggtaatagacaataaaatataacaagttggtaaaaacaagcaagagtaccaactacaaacatacttcatgtggttcagcagaagcatctcagtatgcatccagaaaacagcagacagacagaattgggcatccttgggctagggcacacctcagcctgacttctacccgagaagccagcagtcttagccagtgcagaaccactggtgtctctgacttgggatctctgcttaggatgcgcccttgagtgcttagaatttgtctctagtcaggctgaatcctctctctttccaaacccagtccttagctatttaaaaccagtaaactcatgagatttggagtcatccaacgttatccaggcaaggattctgtttttttcttaatttttatatttaattgcttattaatttttgaaataggatctcatttgtgtggccctggctggccttgaactcaagaagaccatctgcctctgacttctaatagctgagattaaagaggtagcctcaggcaagaacttaactatagaccaagactcagttccacgtgaagttttttggatcttcccacacagagggtataactgtgtcatctccaagatgaggtatcccgaggaaggagaaatggcctgggtcattgtcaccaaaccagtgggtaataggttaatggaaagacacatgtgtctaaaccaccaaggaggaggaggaagagggcaaagaggggaaagaaggaggagggggaggagtgtcatagcccaggactaggtgccttctttgcctacacacggacctacgtacagaaggacagcatcagagaacttgggacccgtacaggaacattggtgtcaagctgtactgcttcacagcccgttttactactgactggttgtatggcccacccggcaggtcattgaatcctctgtccttgtgtgtaaatagaatttgcatctctatataggtattaggtgagagatcggtttgactcctggttctggcataatcatcatatcgcacagtggctggtggaggtcctataacagttaagcaaaacctgcccaaggtctcatagctctgagtacgcgtgaaccaatggcatagctgatctcttgccctagtctcaagggctgacagaatctaacgttactctaaagtcagaaacattgaaaatataaacagctgcccgtattggttttggtttttgttttttgttttttttttttgtttatttgttttgttttgttttatctaatgcagtccctggatatcacctaaaatgatccctctgcctcggtttttttttttttttttttttttttttttttttttggttctttttttcggagctggggaccgaacccagggccttgcgcttcctaggtaagcgctctaccactgagctaaatcctctgcctcggtttttaaaaccggcctggagtagagccgatggctaaaggtttgtgacccccagcccggaacgtgcctacatatgcccgctcatgagtggggaatatgttgcgatgagtgtccgttggctctgttgctgtgtccagaaggaaggggctcaaccaaagaccatgatgggacagagacagacaataaggacccggaaagttcgtaatcaaggctagtctttataaaactgtctccttcgcctctgctagcttcgattcagagagacgtgggcggagccggtcgctgcccaggaactccaggaaaggagaagctgaggatagcgcgctacgattgtgtttacagagacagttgggcttcctgaggtgtgttctcgtaatgcactggatcagtgatggcctgtaatatcccggaaagcactacagaaacatgatgttccacacgtcacacgggtcctcctacccgggccctcctactcgggcctgtggcaccaaagggggcggtcccgttgtgcacaccggcgcccgagggagctctgcactccgcccgaagagtgcgctcggctctgccaaggacgctgcgctcgtgactgagcgcgggctggagcaaccgccaactgagtgcaaaccctttgcgcccggacccgtccaacgactataaagagagcagactgtccgctaagcctcatcccgacttcagcagcctgactgccttcttgtcgcttacaccgttgctccagattcaccagatctcggaatggaccccaactgctcctgctccaccggtaagacgcccggtccttggtctttagaatacccagttgtaggggtttggcgggaataggcacctttagttgacaattcgtcctagttctttctagaacccgctcttggaatcgccttcacctgttcttggagtattattattgtccgaacggctccttgtcggggtttggggtaggatttagacgcgcaaataaatgtcccgatcacccacgtagtgggacatctgagttgagacccagttgttactaaccttattgtgaattgcctgatctacaagagaggtgagagaccgttgtgtcttgagatcaaagacccaagccttaccctaccctgtgaggagagaagaggggctaggctccctggagttctgaatagcactttgaattgagcagggcacatggtgttggccactgctgtaatcctgcctcttactgaccgctgtcttccttctcctccacaggcggctcctgcacctgctccagctcctgcggctgcaagaactgcaaatgcacctcctgcaagaagagtgagttgggaccctcgggtggtggtgggggaactcctacagagctggctctgagaaacgtctgaggccattcggtttggggcaagaagcaggtcttctgccagacctgtgcgaccggaggactaggaagcctactctgacatcttcctctatctttctttccaggctgctgctcctgctgccccgtgggctgctccaaatgtgcccagggctgtgtctgcaaaggtgcctcggacaagtgcacgtgctgtgcctgaagtgacgaacagtgctgctgccctcaggtgtaaataatttccggaccaactcagagtcttgccgtacacctccacccagtttactaaaccccgttttctaccgagcatgtgaataataaaagcctgtttattctaactctggttttcttggtgtcgtttagaaataagaaactggggcgacacgggttaacttgatagtctggggatctggttttggactcgcccgtgccttttaactcccgcctctggctcccaaagaggggtaataatgtctttgggtaaagccaagttatcccataagctt

SEQ ID NO: 1462 - DNA, 2169 bp, Rattus norvegicus
  Genbank Accession No. M13011
ggatccggaattcggccactggcttgcttgcctactcagtgctggagagagcccttgggttaggcatctattagcagtctcaagtggctagggctggctaagtgtgattctcattggcaggtggggcaggagctcctggtttggcaacccctgtagaagcgatgacagaatacaagcttgtggtggtgggcgctggaggcgtgggaaagagtgccctgaccatccagctgatccagaaccattttgtggacgagtatgatcccactatagaggtgagctctgactacctgccagaggtgggctctggcagtggtcatgggttagagtcccaaacaactaggtcttgaagttggtatgggcctgattcctacctgatcctgatccatcagggtatgagaggtgcaagggtaggcggattctctgtctaagaagaggtaggacccttaagctgtgttcttttgcaggactcctaccggaaacaggtagtcattgatggggagacgtgtttactggacatcttagacacagcaggtcaagaagagtatagtgccatgcgggaccagtacatgcgcacaggggagggcttcctctgtgtatttgccatcaacaacaccaagtcctttgaagacatccatcagtacaggtgaccacctatggctagcccgtggcccatggcatatgtgaggaaggttctgtgtgcacactgaggctttatgtctttttttgaatgtcatggacacgtcaggcctgcagtctgctagctggctcatatacaaccccatccccctccagggagcagatcaagcgggtgaaagattcagatgatgtgccaatggtgctggtgggcaacaagtgtgacctggctgctcgcactgttgagtctcggcaggcccaggaccttgctcgcagctatggcatcccctacattgaaacatcagccaagacccggcaggtgtgagcttgttcccctctccacaagctagtcagggattcaccataccccaccccagccggagcgagctcatcgccctctccctcaacacagggcagccgctctggctctggctccagctctggaccctctgggacccccccgggacccatgtgacccatgtgacccagcggccctcatgctgtaagtcttccgcaggccgcaggctggagggaggcaagggccagggtctgggcttatgccaaagttctgggttgacacatagctccagggcaggatggggtccatggagagagctgccctgagcaggccggagcggtgacccaggggcctagttcttcttgtctccagtgtcctatggagatttgctattttaagcccttaagtgttgttaggttgttaaccttgagacatactgggggtctgggagagtctgagctaagtggctctgatttttcagtggtatttaggagtgaacctacttaaagagagtggcctgtactttttagatggccagagcccagctccctattattttggttttgcagctgaggaagggagcctccagcatggggtgttacctgatccagtcagggagtttcttacccagagagcagagcacccctttcctcctcagagtcctctctgatccagtccctctgtccccagggtgtggaggatgccttctacacactagtacgtgagattcggcagcataaactgcggaaactgaacccgcctgatgagagtggccttggctgcatgagctgcaagtgtgtgctgtcctgacactaggtgaggcagggaccagcaagacatctggggcagtggcctcagctagccagatgaacttcatatccactttgatgtccctgctcccccaattctgccaatccccctgcctgcaggcatcagtcatgtcctttgtgcccgtcccgcaggctcaaggacgaggaggtgccggatgcagggaggaggaggtgctgtcggaaggaaggaaagaggagggaaggaaggaaacgatgctggagccagttcaaggatggtggacagatgtgccaagccttcgcatggacaatttgaacagactgtcatgaactatcccgttgccacgccacccaagtcctccgccccctctcagctcccttgggcgcctatgagggcacatgttgaatcacagtaaattatttgatggacttgacttgtctctgggctgg

SEQ ID NO: 1463 - DNA, 1312 bp, Rattus norvegicus
  Genbank Accession No. M15358
gcttggctgcagcagagacagatccctctaacttacccagagatcagaccttccgtattccttgggagggtggtggcttctcttccacttcccacacattagtgtcctgggaggccctgtgccccctccttagctgctctcacctttgcacaggtggtggggaggtggtggcgttggccagaacattggccatctttgtctaactctgtgggattcagaggagtctggtatctccatgacattccagtgactgacccctctctctctcctgtgaccacccctcctctcccccacagggctcctacagtgacacaggagagtgttttggttgtgtttgaagagacaggggaaacctgcccccatttctcagcatcaaatcctgcaattcttctgtccctacagagctagagcagttatcaaccctccccaccacctccctgggcagatgctggccttgggaacaggcaaaaggcagccttctccaacctcagcatcacatcagaacccatactccctcccctgattagcaaccacagcatttctccaatgcagatggctcctgcccttaaaggaggcgggagccaatatccttgaagtgatgaaagcccactctcggactatgggaaagaggcaattaagtgtcaagtgtgccagacagctgtgacagttgtgaaataccctagcttctgataacagaatgagttacttcttcccagtcaggaaggtaggccctttccagctgtgcagttctgccccactgtctgaacaggtttgtctcagggttggaaggatggcactcctttaccccctccccagtcacataccaccaaagctcgagaaacccagcttacgcatattcctatatatgtcacaagccccttgatgtgagcgtagcagggaaggcttgcaattagactcgtttaataaagactctctttgttcttgcattggactcacaattcctggcagtctcctggggttcccgtgaactgggcataacatgttgactgcctcagactgtaaggcctgtgtatccctgctccgaattcctgtctgccagcctgccactctgtggttcagagtctctgtggtgccagtgaaaccaccagctcagctcttgtgatctcgagtccccaggtcttgtctgtagctctgcctctgggtaattccagaggctccatctgtgtacggcagcaccccagcacctcaggcttcctatctccactctgtagtacaaccagtttaagagtattcctgttatagtaaaataataaaaaaataaaaacagtacattgtcttttattccactagg

SEQ ID NO: 1464 - DNA, 1346 bp, Rattus norvegicus
  Genbank Accession No. M15481
gaattccgggagacaaccttgtcaagcacctaattgtgccatccgtgcgatgccagccagctccatccaccttacaggagtgaagtcagcgttcatatacgctgtgtggtctggcagctgagatagtgtttcccaaagggactgtggaatgttacctcagcaggcattcatttcgcgtttggaaaatcgtctccaaatgaactttctttccgtgctgggtctgcagaacatttcagaagcggagctagcaatctgcttcaactttttttcccccggtgcttgcagcaggagatgcctgaagggagctgctgcgtggtggtctgaaacatagttcaaggaatagaggtcaactgcctagagcggtgcaggcagggcacaggctggctttgtactctgagtctcaaggtatttcccagtgcctgagccagggggaaggtggggggaggaagggaaggagctgccacttggatcgctattctgggtagccaagacagatagccatacaatggaaattagtggcttcaacttgggggaaaggatggactctaacttcgagctgtgcagttcgcccattgtttgaatggacaaaaggcagtttacccaggctcctagcatacctgcctgggtgtccaaatgtaactagatgctttcacaaaccccacccacaaaacaacacatgttcttaagtcctgggctttgttttcacttcggcctcataatacccactctgacctgctgtgtaaacgacccgggacgtaccaaaatgagcgcacctccaataaagatacacatcatgtcgtcttcacatctcttctacctggcactctgcttgctcacctttaccagctcggccacagccggaccagagaccctttgcggggctgagctggtggacgctcttcagttcgtgtgtggaccaaggggcttttacttcaacaagcccacaggctatggctccagcattcggagggcaccacagacgggcattgtggatgagtgttgcttccggagctgtgatctgaggaggctggagatgtactgtgtccgctgcaagcctacaaagtcagctcgttccatccgggcccagcgccacactgacatgcccaagactcagaaggaagtacacttgaagaacacaagtagaggaagtgcaggaaacaagacctacagaatgtaggaggagcctcccgaggaacagaaaatgccacgtcaccgcaagatcctttgctgcttgagcaacctgcaaaacatcggaacacctgccaaatatcaataatgagttcaataccatttcagagatgggcatttccctcaatgaaatacacaagtaaacattcccggaattc

SEQ ID NO: 1465 - DNA, 2909 bp, Rattus norvegicus
  Genbank Accession No. M18330
gaattccggggcggcggccgcggggatcccgcgagcggcccctgaacatctacccttcttgccgggacccgggaggtccccactggcctccgggcccgtcctgatcagactcgtgtcgacctccccgtccacgcgcatccgggagagccgcgccacgagacggacccgggcccgccgggacccctggtgtctggccctgcgtcgagaggctggtgactgccacccataagctccagcttcagcctcggcttactcccctcaggggcttgcaggctgaggcctgccctcggacgcggctgaccagcctctccctctcttccacactttggacttctctttggacctcctaaaaaggctccatcatggcaccgttcctgcgcatctccttcaattcctatgagctgggctccctgcaggcggaggacgacgcaagccagcctttctgtgccgtgaagatgaaggaggcactcaccacagaccgagggaagactctggtacagaagaagcccaccatgtaccctgagtggaagtcaacattcgacgcccacatctatgaaggccgtgtcatccagatcgtgctgatgcgggcagctgaagaccccatgtcggaggtgaccgtgggcgtgtcagtgctggctgagcgctgcaagaagaacaacggcaaggctgagttctggctggacctgcagcctcaggccaaggtgctgatgtgtgtgcagtatttcctggaggatggggattgcaaacagtccatgcgtagtgaggaggaggccatgttcccaactatgaaccgccgtggagccattaaacaggccaagattcactacatcaagaaccacgagttcatcgccaccttctttgggcagcccaccttctgttctgtgtgcaaagagtttgtctggggcctcaacaagcaaggctacaaatgcaggcaatgcaacgctgccatccataagaaatgcatcgacaagattatcggccgctgcactggcactgctaccaatagccgggacaccatcttccagaaagaacgcttcaacatcgacatgcctcaccgattcaaggtctataactacatgagccccaccttctgtgaccactgtggcactttgctctggggattggtgaaacagggattaaagtgtgaagactgcggcatgaatgtgcaccacaaatgccgggagaaggtggccaacctgtgtggtatcaaccaaaagctcttggctgaggccttgaaccaagtgacccagaaagcttcccggaagccagagacaccagagactgtcggaatataccagggattcgagaagaagacagctgtctctgggaatgacatcccagacaacaacgggacctatggcaagatctgggaggggagcaaccggtgccgccttgagaacttcaccttccagaaagtacttggcaaaggcagctttggcaaggtactgcttgcagaactgaagggcaaggaaaggtactttgcaatcaagtacctgaagaaggacgtggtgttgatcgacgatgacgtggagtgcaccatggtggagaagcgggtgctggcgctcgcctgggagaatcccttcctcacccatctcatctgtaccttccagaccaaggaccacctcttctttgtgatggagttcctcaatgggggcgatctgatgttccacattcaggacaaaggccgcttcgaactctaccgggctacgttttatgcagctgagatcatctgcggactgcagtttctacatggcaaaggcatcatttacagggacctcaagctagacaatgtaatgctggacaaggatggccacatcaagattgctgacttcgggatgtgcaaagagaatatatttggggagaaccgggccagcacattctgcggcactcctgactacatcgcccctgagatcctgcagggcctgaagtactcattttccgtggactggtggtcttttggggtcctcctctatgagatgctcattggccagtcccccttccatggtgatgatgaggacgagctctttgagtccatccgggtggacacaccacactacccgcgctggatcaccaaggagtccaaggacatcatggagaagctcttcgagagggaccctgccaagaggctgggagtaacaggaaacatcaggcttcacccctttttcaagactatcaactggaacctgctggagaagcggaaggtggagccgccctttaagcccaaagtgaaatccccttcagactacagcaactttgacccagagttcctgaatgagaaaccccaactttccttcagtgacaagaacctcatcgactctatggaccagacagccttcaagggcttctcctttgtgaaccccaaatatgagcaattcctggaatagtgagctcccagacctgcttttaatgccccggcagagtaggcccatctgccctggtttgcatcctcactgcccatgaagaagagtgggtgactggtgattcctgctgctgccccctcttcctcggagagtctggctcctgttggctgggctcacagtacttcctctgtgaactgtttgtgaatttgccttccttttgccatcggagggaaactgtaaatcctgtgtgtcattacttgaatgtagttattgaaatatatattatatatatgcacatatatataataggctgtatatattgctcagtatagaaagcatgtaggagactggtgatgtgttgacctttttttaaaaaaaaccatatgtatacgtgtgtatgtatacatctacacacgtatacatatatgtatgtatgtatgtatgtatgtatgtatatatgaccaaaagaaaagagagcacaagctacctgaaccacaggattgtttatgtgtgtataaataaacactgaatggtaaaaaaccggaattc

SEQ ID NO: 1466 - DNA, 2176 bp, Rattus norvegicus
  Genbank Accession No. M19648
atgctgctcctcctggccagtctcgggttgttggaggatataaatgtgagaagaattcccaaccctggcaagtggctgtcatcaacagatacctctgcgggggtgtcctgatagaccccagctgggtgatcacggctgcccactgctatagccagtgagtaagggaggggacaggaatgactccaggacaggctgtggtactgaatggcaggagagtgggacgggctcaaagtctaaagaggtccagcggggctaactggcctatccatgacctcctgggtctctttgctcctctctccaggcttgtgttcatgttctggttctttcttttctgccttgttgttcatatgtctcctgccttcattcacatctgaatgtctctgtggccatctgtcactctgtgtctcctcccccggtcttggtccatctcagtctgggtctgggtctcatgtgttctcttttattactactgacaatactggagaacaggcctaaaggacactaggatacaaagtcatgtccctgaatgtagggtgtccctgaatgtagggtgtgagagaagtcctcactctcatcagagaagcttgcctttaggatcttctgtccattcacaggacacagggaagggctggtcagagctggatctgggtgaggtaactgagtacagagggagagcaggatgtggcagtggggtaggggagttagggaaggggagctcagacttgggctgtgggccaggccttccccactggagaagttcagcccagttccatctgcacctgaacagctctcaagtcctcctcctcctccctgtcccctcttcccttgtctttgtatctgtctctctgtctctaaatgtgtttgtatgtgtgtgtgtgactgtctctgtgtgtgtatgagactttctgtgtgcatgtgtgtgtgtgtgtgtgtgtgtgtgtgagtttctgtctgactctcttctttcctccctccctccccaccccctttccctgtactctgcccaatctccctggttgcctcttctcattcaatccatctccttcactgccctcagcaattaccatgttttgctgggccgaaacaacctatttaaagatgaaccctttgcacagtaccgggttgtcaaccaaagcttccctcaccctgactacaacccattcttcatgaagaaccacaccctatttcctggggatgaccacagcaatgacctgatgctgctgcacctcagtgagcctgcggacatcacagatggggtgaaggtcatcgatctgcccactgaggagcccaaggtggggagcacctgccttgcctcaggttggagcagtaccaaaccccttgagtgtaagtctaatctaggaaacacagctgggtgtgagggggaggcagaaaggacctggctggggtctgctcaccaccctcttgtctcctggtccacaggggaattccctgatgatctccagtgtgtgaacatcaatattctctctaatgagaagtgcatcaaagcccacacacagatggtgacagatgtcatgctgtgtgcaggagagttggaaggaggcaaagacacttgcaatgtgagacagcccctccctgcagagaggtgaagggatgagagagggaattgagattctcgattcccacttccacaccctgtctaagcagatgcttcacttccttccttatggaagtgatgtgagttgggaggggaggagctgcagctggtactattcctccttttgacttggattcagggactggcctgtccaccctttactcccctgaagagatggcctcccaagagctgggttcccttccctactggccagagctgcctcttagagtctccctgtgtcttccccctgaagtcagttccaggttttcaagtagaacccaactgccaactccttcttattcctgtccctctccttctttcagggtgactcaggaggccccctcctctgtgatggtgtgcttcaaggcatcacgtcctggagctctgtcccatgtggcgaaaccaataggccagctatctacaccaaacttattaagttcacctcctggataaaagaagttatgaaggaaaactcctgagtgtcatactgtgccctggtctcaataaaacccaccatgcagcacacatgttcaagttctgattctctctcgacttctggag

SEQ ID NO: 1467 - DNA, 5217 bp, Rattus norvegicus
  Genbank Accession No. M20636
tgcgttcccgcttgtgtcgctgacccagcgcgcaaagttgggcagggagctgggggaggaggaccgcgagcgagggtggcggagcaggggcgggaggagcggagggaggaggggaccggagcgtgtcactcgcgcgctccctctgtgcacagaggatgtgctgaatggtgcgcttccaggcggcggccgcccggagccccgatgagcccagatggctggggctcagcccggagtgcacgccttgcaactcaagcccgtgtgcgtgtccgacagcctcaagaagggcaccaaattcgtcaagtgggatgatgactccactatagttactccaattattttgaggaccgatcctcagggatttttcttttactggacagatcagaataaggagacggagctgttagatctcagcctcgtcaaggatgccaggtgtgggaagcacgccaaagctcccaaggaccccaagttacgtgaacttctggatgttgggaacatcggacacttggaacagcgcatgataactgtggtgtatgggccagacctggtgaatatctcccacctgaatcttgtggcttttcaagaggaagtggccaaggaatggacaaatgaggttttcagtttggcaacaaacctgctggctcagaacatgtccagggacgcatttctggagaaagcatatactaagctcaagcttcaggtgaccccagaagggcgcattcctcttaaaaacatctatcgactgttttcggcagaccggaagcgagtggaaactgcgctagaggcttgtagtcttccatcgtcaaggaacgattccatccctcaagaggactttactccagatgtatacagagttttcctgaacaatctttgtccccgacctgaaattgataacatcttctctgaatttggtgccaaaagcaaaccgtaccttactgttgatcagatgatggattttatcaaccttaagcagagagatccccggctgaatgaaatactttacccacctctgaagcaagagcaggtccaagtgttgattgagaagtacgagcccaacagcagcctcgccaagaaagggcagatgtcagtggatggattcatgcgctacctgagcggagaagaaaatggagtcgtttcacctgagaaactggatttgaacgaagacatgtctcagcccctgtctcactatttcatcaattcctcacacaacacctacctcacagctggccagttggctgggaactcgtctgtagagatgtatcgccaggtgcttctgtctggatgtcgctgtgtggagctggactgctggaagggcaggaccgctgaggaagagcctgtcatcacccatggattcaccatgacaacagaaatatccttcaaggaagtcatagaagccatcgcagagtgtgcgttcaagacttctccttttcccatcctcctttcctttgagaaccatgtggattccccgaagcaacaagccaagatggccgagtattgccgattaatctttggtgatgccctccttatggagccactggaaaaatacccactggaatctggggtacctcttccaagccctatggatttaatgtataaaatcttggtgaaaaacaagaagaagtcacacaagtcgtcagagggaagtggtaaaaagaagctctctgagcaagcttccaacacgtacagcgactcttccagcgtgttcgagccttcgtctccgggagctggggaagcagatacggagagtgatgacgatgacgacgatgatgactgtaaaaagtcttccatggatgaggggactgctggcagcgaggccatggccacagaagagatgtctaacctggtgaactatattcagcctgtcaagtttgagtcctttgaaacttcaaaaaaaagaaataaaagctttgaaatgtcttccttcgtggaaaccaaaggactcgaacaactcacgaagtctccagttgaatttgtcgaatacaacaagatgcagcttagcaggatatatcccaaaggaacacgcgtggactcatccaactacatgcctcagctcttctggaatgctggctgtcagatggtggcgctcaacttccagacagtggatctagctatgcagataaacatgggcatgtacgaatacaatgggaagagtggctacaggctgaagccagagttcatgaggaggccagacaagcattttgatccatttactgaaggaatcgtagatgggatagtggccaacactttatctgttaagattatttcaggtcagtttctctctgataagaaagttgggacttatgtggaagtggatatgtttggtttgcctgtggacacaagaaggaaggcatttaaaaccaagacatcccaaggaaatgctgtaaatcctgtctgggaagaagagccaattgtattcaaaaaggtagttctgccttctctggcctgtttaaggatagcagcatatgaggaaggaggcaaatttattggccaccggatcttgcctgtgcaagcaattcggccaggctatcactacatctgcctgcggaatgagaggaaccagcccctgatgctgccagctgtctttgtctacatagaagtcaaagactatgtcccagacacgtatgcagatgtaattgaagcattatcaaacccaatccgatatgtcaatctgatggaacagagagctaagcagttggctgcattgacactggaggatgaagaggaagtcaagaaggaggctgaccccggggaaacgtcatccgaggctccaagtgaaaccaggacaactccagcagagaatggggtgaatcacaccgcaacccttgcacccaagccaccttcccaggctccacacagccagcctgctccagggtctgtgaaggcacccgccaaaacagaggatctgattcagagcgtgttaacagaagtagaggcgcagaccattgaagagctcaagcaacagaaatcgttcgtgaaacttcaaaagaagcactacaaagaaatgaaagacctggtcaagagacaccacaagaaaaccaccgagctcatcaaggagcataccaccaagtacaatgagattcagaatgactacttgagaaggagggcagccttggaaaagtccgccaaaaaggatagcaagaagaaatctgaacccagcagcccagatcatggctcatccgccattgagcaagacctcgcggccctggatgcagaaatgactcagaagttgatagacttgaaagacaagcaacaacagcagctgcttaatcttcggcaagagcagtattacagtgagaagtaccagaagcgggagcacattaaattgctcattcagaagttgacagatgttgctgaagagtgtcagaacaatcagttgaagaagctgaaggaaatctgcgagaaagagaagaaggaattaaagaagaaaatggataagaagaggcaggagaagataacagaagccaagtccaaagacaaaagccagatggaagaggagaagacagagatgatccgatcatacatccaggaggtggtgcagtacatcaagaggttagaggaagcacaaagtaaaagacaagaaaaacttgtggaaaaacacaaggagatccgccagcagatcctggatgagaagcccaagctgcagatggagctggagcaagaataccaagacaagttcaaaagactgcccctggagattctggagtttgtacaggaagccatgaaagggaaggttagtgaggacagcaatcacggctctgcccctccctcgctggcctcagaccctgctaaggtgaacctcaagtctccctccagtgaggaggtacaaggagagaacgcgggaagagagtttgatactcctctgtgatgtccctgccgggcctaccagacatgcacggctgcttgaactccatcggactctaaagacaaagatcactgcccgggccatcttcctgagaaacatcccttagcctgaaatccacaccaaagggagagttccagaaggatccgtgtgaaggtcccataccctggtcccttgtgtcatgtggaaactattgtggtcttagagagaagggtgcatgtatgcaggatttttcttttcgttccaatagtaaattaaaagcaggcagctccaggctccatggactatgtaatgaaggacaatgtcttctttgaagaaaactagagctcgtgtcttcgtttgaagccctggtgtacagtatttccaagtaaaagagagagtttgagaagtgcgcggcaccatttaacactctggaacattccactctgagcattgtttccctgactgccccgcaaacccatgttttcaagttaacgtgtatagtgcattgtttcaccctttgctttgcaggcactggtggcttgccatttgctaatttatttatcccagaggcatctgtatttgctattgacatggctttattagataccatagtgactcatataagctggtttcttttataaaaaaaatcacatgactgtatcatttcccagtgaagccattttacgattagcaatatgggttgtatatttggctgcacgtctttggatatctatcggttgttgacctgaggctatcaaacagctgcaatgggtttgttctgttgagtcagggtttccgccagactgaacaggatccagtgggctattttattgtcagatattttttcgtggttcatttatttttactgtagaaaggaagatagaatatttatctaaatgcacatgtataaatgatatacattatctccatgtatatagtacatgtatgcacccagccatataagtgcacacacatacatacgcatgagtgtacatgtgtgtttattaattggcagtgacccaaatctcttccataagatttaaaagcaagttcagggatacatggacagagaagaaatgggtcgaatatatgttatgtggataattaaattatacggaaatgctaagaatcagtttatggagtcaatgatgcaacttgaggtaatcttagaatttagaaaatgagtttactaaaaaaattggaggatcaaaaattggattttaagtatcagattttgagcttgttttaatggtcagtgtatgcaaaaatgcataggaaatagagtgcaaatgtattactactatcttcaataaattttaactgaataatttcaattttatactgatagaaataaagctctggttgtatttaaaaaaaaa

SEQ ID NO: 1468 - DNA, 2481 bp, Rattus norvegicus
  Genbank Accession No. M22366
gatctattagacacaaaacctaaccagagaaggaaatatgcggacctgaacctttgcagacaaagcttcctccctctgctcagttgtaagctacttggtctgagccgtctgtgtaccaaagagtggacaaggcagtcaggatagcagaaatcaaacacatggcatcccaccattgtgcggcgcgtgtcacagagggaaagacaggagtgtaacccacactgagagtggtagggagacgcgggtggtggaaatgcatcaaaaacaatgatgttcacggtactcgtcagagcattttctacccgtttgttttaaaacattcttttcctcttcctgttttccactttcccaccatccacctaaattcctcagccgaccacgtaggctcctatggtataactgtgtatcagtatcatgaatccaaaggccagtacacacatgaatttgatggtgacgagagattctatgtggacttggataagaaggagaccatctggaggatccccgagtttggacaactgataagctttgacccccaaggtgcacttcgaaatatagctataataaaacacaatttggaaatcttgatgaagaggtcaaattcaaccccagctgtcaacggtacgtgctcaccaccctgctcccccctcccttccctggggggttaggggatgtgatcaggacattaatggtccaataaaatcctctcctttccaaggagaccccggatctcttcatcactggagactcatcccctctcttcttgtttttaaagatttatttatttattatatctaagtacacggtagctgtcttcggacacaccagagagagggcatcagatcccattacagatggttgtgagccaccatgtggttgctgggaattgaactcaggacctctggaagagcagtcagtgctcttaaccactgagccatctctccggcccatcccttctcttcttaaaaatcacacatttcatgtaatatacagctcactattccacaatgctctcctcgaatcttttggaaaagccccgacagacatcctacctgaactccctagacgagaggggcacagggatcaagtggagggcacattagctccaagcagaggaatcgggctctttgactttcatatgtgtaagacttgtcaagaaggctctctcactagacagtgcagggcttcagggagagaagctcccatcagcctctgacatccagaccatttcctttgcagaggttcctgaggcgaccgtgttttccaagtcccctgtgctgctgggtcagcccaacaccctcatctgctttgtagacaacatctttcctcctgtgatcaatatcacatggttgagaaacagcaagccactcacagaaggcgtttatgagaccagcttccttatcaacagtgactattccttccacaagatggcttacctcaccttcatcccttccaacgacgacatttatgactgcaaggtggagcactggagcctggacgagccggttctaagacactggggtgtgtatgagctctgccacttctggcactttctcgttcactgtcacttctggaacagcatggcttctggcttcaagtgaccaaaactcactttccactcttaaagtttctaaggctagagttcgtgtcatcccattagcccagcctcagagaccagtaggttaactcctcctcacctggtcctgtcttacacatacatgagtcccttctgactcaaagcttctctctctcagaacctgagattccagcccccatgtcagagctgacagagactgtggtctgtgccctggggttgtctgtgggtctcgtgggcatcgtggtgggcaccatcttcatcattcaaggcctgcgatcagtggctccctccagacacccagggcccttgtgagtcacaccctgggaaagaaggtaagggtttgtgtttgtgggaaacaaaggcacgcatggggaggggaaggaaggggagacatgaaagtttgttgttggaactttgctggagcctctgaacccatctttcctgtgtgttttgttgtaggtgcgtggccctctacagggaagatgtagtgtgtgggggtgacctggcacagtgtgttttctggcccaattcatcgtgttctctctcttctcctggtgtctcccatcttgctcttcccttggcccccaggctgtccacctcatggctctcacgcccttggaattctcccctgacctgagtttcatttttggcatcttccaagtcgaatctactatagattccgagaccctgattaatgctccaccaaaccaataaacctcttataagttgtcttctttgtttttctgtctcccattttggagcttactggagccaggcccatgtaatcctgtgtccagtgtcacaggaataaccaatgcagcccagaatggtttggtatcttagccaaggttgactttcaaatttttttgttcagctgacatctcacg

SEQ ID NO: 1469 - DNA, 3327 bp, Rattus norvegicus
  Genbank Accession No. M22631
aacggcgggatataacatgagctgtcttcggtatcgtcgtatcccactaccgagatatccgcaccaacgcgcagcccggactcggtaatggcgcattggccccagcgccatctgatcgttggcaaccagcatcgcagtgggaacgatgccctcattcagcaatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgccccgtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcagtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtcggaattccgggcggtcctcccagcaactgctgtggacgctgaagcgtgctccagtctattcacagcaatgcctagtggtgtcccgaagtctcagttctgtggaatatgagcctaaagaaaaaacttttgataaaattcttattgctaacagaggagaaattgcttgtagggtcattaagacttgcaggaagatgggcatcaggacagttgccatccacagtgatgttgatgccagctcggttcatgtgaaaatggcggatgaggctgtctgtgttggcccagctcccaccagtaaaagctacctcaacatggatgccatcatggaggccattaagaaaaccggggcccaagctgtacacccaggttatggattcctgtcagaaaacaaagagtttgcaaagtgtttggcagcagaagatgtcactttcattggacctgatactcatgctattcaagccatgggtgacaagatagaaagcaaactgttagccaagagagcaaaggtcaacacaatccctggttttgatggggtactaaaggatgcagatgaagccgtcagaattgcaagggaaattggctaccctgtgatgatcaaggcctcagcaggcggtggtgggaaaggcatgcgcatcccgtgggatgacgaagagaccagggatggctttagattttcatcccaggaagctgcttctagttttggtgatgatagactactaatagaaaaatttatcgataaccctcgtcatatagaaatccaggttttaggggataaacatggcaatgctctgtggctcaatgagagggagtgctcgatccagagaagaaaccagaaggtggtagaggaggcgccgagcatttttctggatcctgagacgcgccgagccatgggagagcaggccgtggcttggccaaaagcggtgaagtattcttctgctggaactgtggaatttcttgtggactcccagaagaatttttacttcttggagatgaatacaagactccaggttgaacatcctgtcacagagtgcattactggcctggacttagtccaagaaatgatcctggttgctaagggttacccactcaggcacaagcaagaggatattcccatcagtggctgggcagttgaatgtcgggtttatgctgaggacccctacaagtctttcggtttaccgtctattgggagactgtctcagtaccaagagcctatacatctacctggtgtccgagttgacagtggcatccaaccaggaagtgacatcagcatctatcatgaccctatgatttcaaaactagtcacatatggatctgacagagcagaagccctgaagaggatggaagatgcattggacagttatgttatccggggtgttacacacaacatcccactgcttcgggaggtgataatcaacacgcgttttgtgaaaggggacatcagcactaagtttctctctgatgtgtatcctgatggcttcaaagggcacatgttaacacccagtgagagagaccagttattggctattgcatcatccttgtttgtggcatcccagctacgagcacagcgctttcaagaacattcaagagttccagttataaggccagatgtggctaagtgggagctctcagtaaaattacatgatgaagaccatactgttgtggcatccaacaacgggccaacatttaacgtggaagttgatggctcgaaactaaatgtgaccagtacgtggaacctggcctcacccttattgtctgtcaacgttgatggcactcagaggactgtgcagtgtctttctccggacgcaggtggaaacatgagcatccagtttcttggcacagtgtacaaagtgcacattttaaccaaacttgctgcagaactgaacaaattcatgcttgaaaaagtacccaaggacactagcagcgttctgcgttccccgaagcctggagtggtggtggccgtttccgtcaagcctggagacatggtagcagaaggtcaggaaatctgtgtgattgaagctatgaaaatgcagaacagtatgacagctggtaaaatgggcaaggtgaaactggtgcactgcaaagctggagacacagttggtgaaggagacctgctcgtggagctggaataagtacttgtagcccttcagtcaccactgctcactgctttaattagcatttccattattctctaaccctcaatttgctcaggcgtttacaggagcactctgcagcaggttctacagcatcgtatttattccttagaagagggcaaaaccgacactctgccaaaaaaatcaccaatgggaatttttattgatataaatacttgtacatatgatttgtacttctgctgagatttcccagtgtcaaaattaaatcaataaaaccaacggaa

SEQ ID NO: 1470 - DNA, 428 bp, Rattus norvegicus
  Genbank Accession No. M23885
tgtgaagtcaacattgaagatgttgctgcttctgctacttctggggcctggctatgggcttggagctctcgtccaccaatctcccagaaggaccatctgtaagagtagaacttccctgagaatggagtgtcacactgagggtgttcaggccacttctgtagcctggtatcgtcaattgcctcaagagacctttgacctgatagcactttctactgtgaactctgcaatcaaatatgaaaaaaattttaccaaagagaagttttccatcagtcatccaaatttatccttttcatctatgacaattttaaatgcacatcctgatgacggaggcttatatttctgtggtggtaataacaccgggcagctatactttggtgaaggctcaaagctgacagtgctggaggatctgaaaacggtgactccaccca

SEQ ID NO: 1471 - DNA, 912 bp, Rattus norvegicus
  Genbank Accession No. M24542
tcccgcggggtggcgggagcgctgcggcccctgctgcaaagcgcggtgcccgccacctcggaaccaccggttctggacgtgaagcgacccttcctgtgccgtgagtcgctgagtggccaggccgcgacccgtcctttggtggccacagtgggcctgaatgttcctgcttctgttcgttattcccacacagacatcaaggtgcccgacttctctgactatcgccgtgctgaagttctagatagcacaaagtcttctaaagagagcagtgaggctagaaaaggcttctcttacttggtaactgcaactactactgtgggtgttgcatacgctgcgaaaaatgcagtctcccagtttgtttccagcatgagtgcttctgcggatgtactggccatgtcgaagatcgagatcaagttgtctgatattccagaggggaagaacatggcttttaaatggagaggcaaacctctgtttgtgcgccatagaaccaagaaggagattgaccaggaagctgcagttgaagtgtcccagttaagggacccacagcatgatttagagcgtgtaaagaagcctgaatgggttattctgatcggtgtctgtactcatcttggttgtgtacccattgcaaacgcaggagattttggtggctactattgcccctgccatgggtcacactatgatgcttctggcaggatcaggaagggccctgcacctctcaacctggaagtacctacctatgagttcaccagtggtgatgtagttgttgtgggttagacacttggactgagggcctaggtttctttcggtcttcatgtcccctcagaagagttgagagtaagccttgtacttctaggttggttgatttaaaatatttaagaattgttaataactattggcaaacattaatgtgaagta

SEQ ID NO: 1472 - DNA, 1920 bp, Rattus norvegicus
  Genbank Accession No. M29853
ccatggtcctcaatttcctctccccgagcctttcccggctcggcttgtgggcttctgtagtgatcctgatggtaatcgttctcaagctcttcagcctgctgcttcggaggcagaagctggccagggctatggacagtttcccagggccccccacacactggctttttggtcatgcccttgagatccagaagttagggagcctggacaaggtggtatcctgggcccaacagttcccccatgcccacccactttggtttggacaattcgttggtttcctgaacatctatgagcccgactatgcgaaagctgtatacagccgcggggatccgaaggctgcagatgtgtatgacttcttcctccagtggatcgggaaaggcctactagttctggatgggccaaaatggttccagcaccgcaagctgctcacacctggcttccattatgatgtgctgaagccctatgtggccatatttgctgagtccacacgtatgatgctggacaagtgggagaaaaaggctagtgaaaataagagctttgacatcttctgtgacgtaggccacatggccctggacaccctcatgaagtgcaccttcggcaaaggagacagcggcctaggccacagagacaacagctactacctggcggtcagtgacctcacactgctgatgcagcagcgcatcgactccttccagtaccataatgacttcatttactggctcactccacatggccgccgcttcctgcgggcctgcaagatagcccatgaccatacagatgaggtcatcaggcagcggaaggcagcactgcaggatgagaaagagcggaaaaagattcagcagcggaggcacctggacttcctggacattctcctgggtgtccgggatgaaagtgggatcaagctgtcagatgcagagctccgggctgaagtggacacattcatgtttgaaggccatgacaccaccactagtggtatctcttggtttctctactgcatggccctttaccctgagcaccagcagctatgtagggaggaggtccgtgggatcctaggagaccaagactccttccaatgggatgatctggccaagatgacctacctgaccatgtgcatgaaggagtgcttccgcctctacccacctgtaccccaagtataccgccagctcaacaagccagtcaccttcgtggatggccgctctctacctgcaggcagcctgatctctctgcacatctacgccctccacaggaacagtactgtgtggcctgatccagaggtctttgacccactgcgcttttctcctgagaatgctgcaggacggcatccctttgccttcatgcctttttctgcagggcccaggaattgcatcgggcagcagtttgccatgaacgagatgaaggtggtcacagccctttgtttactgcgctttgagttctccctggatccctcaaagatgcccattaaggtcccccagctgatcttgcgctccaaaaatggtatccacctctacctgaagccgctggcttctaggtctggaaagtaggtcttcagagaactaggcctgggcagcacaagccgtgactcttcctgggatgttgccctcctagatagaatgtggagtcatcatggatccctgcctgtgggaggctttggaggcaaaagcatggacactgacagtctcctggaagacattctcttgtaaacatgtgtgtggaatgattcaacgcccaggctccagaacttatttcttcactccacaacatttgctgaacgttttgctgccttgagaaactccattgatttcacatagctacatttatttaaccatcttggtgtgtatttggaatacgatggacatgaggaaaattgctcaaactaaaactgtacaaaataaataatactttaaaaagcaaactcccaccacc

SEQ ID NO: 1473 - DNA, 575 bp, Rattus norvegicus
  Genbank Accession No. M31931
gtgtctacaggaaagcgcatctgtgtcggggaggccctggcccgtatggagctcttcctctacttcacctccatccttcagaggttctccttacgttctctggtgcctcctgctgatatcgacatcgctcacaaaatctcaggctttggcaacattcccccaacatatgagctctgcttcatggcccgctgagtgcccacttcgagaccaaccaagagtcaattgagagaggagctctgctggagttcacgcacacccgatctccctccaaccctccctactcatctaagagaagtcgctctcattgctgtgctgagaccacgggtcaggagaggtgtctgcaaaaacatggctggatggtatcaagcagggttctagccacagtctcggtttcggagagccctgaatttctcaaccttggtctcggtgggcagcaaacttacagatgctgtgggtttacataatctattgactttgccctgatattgaccagaatgtactccgcaattctttcctgtttgcttttatttctcctccccaataaagaactcaagactattgaccatagcaagctt

SEQ ID NO: 1474 - DNA, 1994 bp, Rattus norvegicus
  Genbank Accession No. M33648
atctctcccaggggctgtggactgctggctttctgttgataccttagagatgcagcggcttttggctccagcaaggcgggtcctgcaagtgaagagagtcatgcaggaatcttcgctctcacccgctcacctgctccccgcagcccagcagaggttttctacaatccctcctgctcccctggccaaaactgatacatggccaaaagatgtgggcatccttgccctggaggtctactttccagcccaatatgtggaccaaactgacctggagaagttcaacaatgtggaagcagggaagtacacagtgggcttgggccagacccgtatgggcttctgttcggtccaggaggacatcaactccttgtgcctcacagtggtgcagaggctgatggaacgcacaaagctgccatgggatgccgtaggccgcctggaagtgggcacggaaaccatcattgacaagtccaaggctgtcaagacagtgctcatggagctcttccaggattcaggcaacactgacatcgagggcatagataccaccaacgcctgctatggtggcactgcctccctcttcaacgctgccaactggatggagtccagctactgggatggtcgctatgccctggtggtctgtggtgatatcgcagtctacccaagtggtaacccccgccccacaggtggtgccggggctgtggcaatgctgattgggcccaaggccccgctagtcctggaacaagggctgaggggaacccacatggagaacgcctatgacttctacaaaccaaacttggcctcagagtatccactggtggatgggaagctgtctatccagtgctacctgcgggccttggaccgatgctatgcagcttaccgcaggaaaatccagaatcagtggaagcaagctggaaacaaccagcctttcaccctcgatgacgtgcaatatatgatcttccacacacccttttgcaagatggtccagaaatccctagctcggctgatgttcaatgacttcctgtcatctagcagtgacaagcagaacaacttatacaagggtctagaggccttcaagggtctaaagctggaagaaacctacaccaacaaggatgttgacaaggctctgctgaaggcctccctggacatgttcaacaagaaaaccaaggcctccctttacctctccacaaacaatgggaacatgtacacctcgtccctctacgggtgcctggcctcacttctctcccaccactctgcccaagaattggccggctccaggattggagccttctcctacggctcaggcttagcagcaagtttcttctcatttcgagtgtccaaggacgcttccccaggttcccctctggagaagctggtgtctagtgtgtcagatctgcccaaacgtctagactcccggagacgcatgtcccctgaggaattcacagaaataatgaatcagagagagcaattttaccacaaggtgaacttctctccccctggtgacacaagcaacctcttcccaggcacttggtaccttgaacgagtggatgagatgcaccgcagaaaatatgcccggcgtcccgtctaaggagaccaatccatacaaccattccccggggaaagaatgtgagcagagccgttacccaaacggcttccacttaaaattccacccacagcagtgaacggtgaatagacacagcgaccccataggatctgctccgcggtgaagggcctccctctgtggatcctgggtgaccctccctgaagcagtgagcaccacaggttctgctgtggaccagagcccccctgtggagagggagaaagaaaggggagccgctgacctgcagggatacagaccttccccacagcctggcagccgcccgtttgttgcagcttattatcagactgtgggctatcatagttcatgctcgtttcttaaagtttcccgagaatttctaaaattttgtatctaaacttttaatatggcgattaaaaggagagaagga

SEQ ID NO: 1475 - DNA, 451 bp, Rattus norvegicus
  Genbank Accession No. M34331
tcctctttctctcgaaccgggcggcctcatccgcgaacagcgcagcaatggccaagattaaggctcgggacctgcgcggcaagaagaaggaggagctgttgaaacaactggatgatctgaaggtggaactgtcccagcttcgcgtggccaaagtgacaggcggcgccgcgtccaagctctccaagatacgagtcgtacgcaaatccatcgcccgtgtcctcactgtcattaatcagactcaaaaggaaaacctcaggaaattctacaagggaaagaagtacaagcccctggacctgcgacccaagaagacaagagccatgcgccgccggctcaccaagcatgaagagaagctgaagaccaagaagcagcagcggaaggagcggctgtacccactgcgcaagtacgcagtcaaggcctgagacgacgacaataacaataaagtccaaaactg

SEQ ID NO: 1476 - DNA, 511 bp, Rattus norvegicus
  Genbank Accession No. M35601
  misc_feature (1)..(511): n = a or c or g or t
cctgaacttggttccttttatgacagccgctttggttcactcacaaagaacttcaaagaatttggcagtaagacctctgattctgacatcttcacagacatcgagaaccctagctcccatgtacctgagttttcttncagtagtaaaacctcaactgtcaggaaacaagtaaccaagagctataaaatggcagatgaggcagcaagtgaagctcaccaagaaggagacactcgaaccaccaagaggggccgagctcgcacaatgagaggtatccacgcttaactctgggaagttgccctgaccccctagactaagttaaccatttctgcaaagtgcttaccaggcgcgctctttcttaacctcttctagtgctttggtggaatctcattttttttcatgctagactgtacgttccttgggggcagggactttgccatgtgtctatttctctaattccccaatgcataacagtgcagtcatttctcaataaatatattttaaataaatgaac

SEQ ID NO: 1477 - DNA, 562 bp, Rattus norvegicus
  Genbank Accession No. M36151
agagactccccaagggatttcgtgtaccagttcgagggccagtgctactacaccaccgggacgcagcgcatgcggctcgtgaccagacacatctacaaccgggaggagtacgtgcgcttcgacagcgacctgggcgagtaccgcgcgctgaccgagctggggcggccctcagccgagtactggaataagcagtacctcgagcagacgcgggccgagctggacagggtctgcagatacaactacgaggggccgggggctctcacctccctgagacggcttgagcagcccaatgtggccatctccctgtccaggacagaggcccttaaccaccacaacctgctggtctgctcagtgacagatttctacccagcccagatcaaagtgcgctggttccggaatggccaggaggagacgacgggggtcgtgtccacacagcttattaggaatggggactggaccttccagatcctggtcatgctggagatcacgcctcagcggggagatgtgtacacctgccatgttgaccaccccagccttcagagccctgtcacagtggagtggc

SEQ ID NO: 1478 - DNA, 231 bp, Rattus norvegicus
  Genbank Accession No. M37567
ctggtggtgatgctggaatcccgattccctggtccggcccgtggcgtcgcgaattgccggcagcaggtcctggaattagagaaagagtttcattacaaccgctacctgacccgaaggagaaggatcgagatcgcccactcgctgtgcctctctgagaggcagatcaaaatctggttccaaaaccgtcgcatgaaatggaagaaggaccacgactccccaacaccaaagtga

SEQ ID NO: 1479 - DNA, 1712 bp, Rattus norvegicus
  Genbank Accession No. M57728
atggcgacggcagtgtgggcggctgcgcggctacttcggggttctgcggcgctgtgcgcgcggcccaagttcggttctcctgcacacagacggttcagcagtggcgccacctaccccaacatccctctctcttctcccttgcccggagtgcccaagcctatttttgctacagttgatggacaggaaaagtttgaaaccaaagtcaccactctggacaatgggcttcgtgtggcatctcaaaataagtttggacagttctgtaccttaggaattcttattaattcaggatcacgatatgaagcgaaatatcttagtggaattgctcattttctggaaaaattggcattttcgtctaccgctcgatttgacagcaaagatgaaattctgcttaccctggaaaaacatggtggtatctgtgactgccagacctcgagagacaccaccatgtatgctgtgtctgctgacagcaaaggcttggacactgtggtgggcctgctggctgatgtggttctgcacccccgcctgacagatgaggaaattgagatgacgaggatggctgttcagtttgaacttgaggacctgaacatgagacctgacccagagccactgctcaccgagatgattcatgaagctgcttttagggagaacacggtgggcctgcaccggttttgtcctgtggagaatatcgggaagattgaccgagaagtgctgcattcctacctgaagaactactacacccccgaccgcatggtgcttgctggagtgggcgtggagcatgagcacctggtcgaatgtgccagaaagtacctcctgggagtgcagcctgcctggggagctccgggagctgtgtggatgttgacagctcagtggcacagtacacgggggggatcatcaaggtggagagagacatgtcaaatgtcagccttgcgcccaccccgattccagagctcacacatatatggtggggctagagagctgctccttctggaggaggatttcatcccctttgctgtgttgaatatgatgatgggaggcgggggctccttctcggccggagggcctggcaaaggcatgttctccaggctctacctcaacgtgctcaatcggcaccactggatgtataatgcaacctcctaccaccacagctatgaagacacaggcctcctgtgcatccatgccagcgcagaccctcgacaggttcgagaaatggtagaaatcatcacaaaggagtttattttgatgggccgaacggtggatttggtggagctggagcgggccaagacacagctgatgtccatgctcatgatgaacttggagtccaggcctgtgatctttgaggatgtggggaggcaggtgttggctacacattcaagaaagctgccccatgagctgtgcacactcattcgcaatgtgaagccggaagatatcaagagggttgcttccaagatgctccgaggcaagcctgctgtggcggctctgggtgatttgactgacctgcccacgtatgaacacatccaggcagcgctgtccagcagagatgggcgcctgcccagaacataccggctgttccggtagagccctccagcggaggctgcagagtgcttctgtgcatgttactgttggtgtggacactgcataagaatagctagctctgtgaacagtgccaacagggaagctctggaaacttgaatgaaagttactgttgccactgc

SEQ ID NO: 1480 - DNA, 3413 bp, Rattus norvegicus
  Genbank Accession No. M58040
catagagttcactgacatcatcaagcagctgagccagaatacatatactcctcgtgaggctggatctcagaaagacgagaatcttgcctattatattgaaaatctgttccatgactttaaattcagcaaagtctggcgagatgaacattatgtgaagattcaagtgaaaaacagtgtttctcaaaacttggtgaccataaattcaggtagtaacattgacccagtggaggctcctgagggttatgtggcatttagtaaagctggagaagttactggtaaactggtccatgctaattttggcactaaaaaggactttgaagaattaaattattctgtgaatggatctttagtgattgttagagcagggaaaattacttttgcagaaaaggttgcaaatgcccaaagctttaatgcaattggtgtcctcatctacatggacaggaatacgttccccgttgttgaggcagaccttcaattctttggacatgctcatctaggaactggggatccatatacacctggctttccttctttcaaccatactcagtttccgccatctcagtcatctggattgccttctatacctgtgcagacgatctcaagagctcctgcagaaaagctattcaaaaacatggaaggaaactgtcctcctagttggaatatagattcctcatgtaagctggaactttcacagaatcaaaatgtgaagctcactgtgaacaatgtactgaaagaaacaagaatacttaacatctttggcgttattaaaggctatgaggaaccagaccgctacattgtagtaggagcccagagagacgcttggggccctggtgttgcgaagtccagtgtgggaacaggtcttctgttgaaacttgcccaagtattctcagatatgatttcaaaagatggatttagacccagcaggagtattatctttgccagctggactgcaggagactatggagctgttggtccgactgagtggctggaggggtacctttcatctttgcatctaaaggctttcacttacattaatctggataaagtcgtcctgggtactagcaacttcaaggtttctgccagccccctattatatacacttatggggaagataatgcaggacgtaaagcatccgattgatggaaaatatctatatcgaaacagtaattggattagcaaaattgaggaactttccttggacaatgctgcattcccttttcttgcatattcaggaatcccagcagtttctttctgtttttgtgaggatgaggactatccttatttgggcactaaactagatacctatgagatattaattcagaaagttcctcagctcaaccaaatggttcgtacagcagcagaggtggccggtcagttcattattaaacttacccatgacattgagttgaccctggactatgagatgtacaacagcaaactactgtcatttatgaaggatctgaaccagttcaaagcagatataaaagatatgggtctaagtctacaatggctgtattctgctcgtggagactacttccgtgctacttctagactaacaactgattttcataatgctgagaaaacaaacagattcgtcatgagggaaatcaatgatcgtattatgaaagtggagtatcacttcctgtcaccctatgtatctccaagagagtctcctttccgacacatcttctggggctctggctctcacaccctctcagctttagtggagaacctgagacttcgtcagaaaaatatcactgctttcaatgaaacgctcttcagaaaccagttggccctggctacgtggactattcagggagttgcaaatgccctctctggtgacatttggaatattgacaatgagttttaaatgtaatgtgcataattaagtgagagagggtagtctgtttctagacttgagctggttgtgctaaattttcattagagctcgaattaatgttaaaaattctacccaatcatctaatgtgtttaggcagcagcttttagtgcagggttggacccacacttcaagttacagtggacaacactttccatgttcatgataccttcttagattatctttagaattttgagtcttttgtaataccttgctctttgcttcatggtcatgaaaatgtcagaaccagttgtaagaacattgctataagtcctgagggcactactagtatcttgaggtgggaggaagagggtgtatgtgaggggcagagtggtcgctgggtgtgattccccatctccatctgaccctcactgggattctccaattgagctgtatgcctgaaggatttagctggcttccattcccctaaagtagacagttacttttcagaagaggtgcaacttgttttcttgccagcaaggttgaactaggtccttctgctggataaaagaaaggaagtttgtctgtttacaggaataaggccttattggtttaacctttgtgttatttaggatgagaccagaagccaaagacttcaagttttctctccactgtcatctacccagtagtctttagttctttgggttgttttgtttttgttttgtttttcttttccaacactttctgaaaaagaacaggtttagactcagtctgtcagcagaacacactgccgagctcggtacccggggatcctctagagtcgacctgcaggcatgcaagctttccctatagtgagtcgtattagagcttggtgcatgcctgcaggtcgactctagaggatccccgggtaccgagctctggccaaagtgctggtcttcagggaagctctgtcgtttttggcactgagatatttattgtttatttatcagtgacagagttcactataaatagtgtttttttaatagaagataattatcggaagcagtgccttccataattatgacagttatactgtcgttttcttttaataaaagcagcatctgctaatgagacccacagatactggaagttttgcacttacggtcagcacttgcgggctttagaaaggagaaagccacaagccaaacaatatccgatgagctagaagaggattgggttaaataagagattcctagttgagttggaaaaaaatgataattctaagtccagtgagttgtggccaagttaaatgtcatttaaaggctatgatagtacatcaacaaaattctatagctcagtttattcaagatgtaactcaaatccaattttgcaaaatttccagtacctttgtcacaaacttaactcacattatcgggagcagtgtcttccataatgtataaagaacaaggtagtttttgcctaccacagtgtctatatcggagacagtgacctccatatgttacactaagggtgtacgtaattatcgggaacagtgtttcccataattttcttcatgcgatgacatcttcaaagcttg

SEQ ID NO: 1481 - DNA, 1164 bp, Rattus norvegicus
  Genbank Accession No. M58495
tggaggtcagatgaggatgctggatcccctgtagctgagttacaagtggttgtgggcagccccattaggtgctgggaactaaaaagggtcctctggaaaagcagtcagttactctaacagctcccccttccacttcctgacaaggccctacaagttctgtaggataactttaccatttttgttttgttttgggaaaggttcttaccatgtagccttaactatcctagaaattactacattgaccaggctagtcttcaactcacaagttccgtttgccggctcactcctgactgctgggattaaaggcatgggccaccatgccccacaaacataatttttatttaaggacatttaaaacctttttgtccagttctatattctgatgtaaatttcgtgtaaagttattaagttccacctgtggctacacaaatatttccctatggctgctgtctcccccgccagttttgctctggttcctggagggccacacagatgagttcgggggggggggggtggaggggtggggccacgacaccaaagctgaagagacccaagcgtgtacacccaagggccaccttttgcagtttctaagagcagaatcagaacgctgaaaagaagaaacgaattcactcacactagagacaagtctctcagagatttcagtctagagtcacagtgacttggcaaaatctgagccggtcctttagctgccccacccttccccttgcgtgcaaaggcgatttcccacatctgaccaaggactaacccacacaggcaggtcccacgaagctcgaaaattttctgttggaactttccattttgttcccagaagatcttggacagggagcagttgaatttacccaatatgtaaccatatcctcaaaacctctctcactctcaagctcccagaaacccttttgacttccatatacagaagtcctaggccagccctaaactgcttctccctgccaataacttggtatcctccccccagcgcctctgggctcggcaatccagccccgccctcgctggctgccctgcacagtgggctgggccggaaaagcaagatataaagcctgaaagtgctcagtacagctcgcactagcctaggctgtggcacgcaggatctttcctgaagcatttcagggtctgcctggcaaccag

SEQ ID NO: 1482 - DNA, 1675 bp, Rattus norvegicus
  Genbank Accession No. M60666
cgcgctcggtctcctctggctcctctgcctaagggcccctcgccaccgccaccatggacgccatcaagaagaagatgcagatgctgaagctcgacaaagagaacgccttggatcgagcagagcaggcggaggctgacaagaaggctgcggaagaccggagcaagcagctggaagatgagctggtgtcactgcaaaagaaactcaagggcactgaagatgaactggacaaatactccgaggctctcaaagatgcccaggagaaactggagctggcggagaaaaaggccacagatgctgaagctgacgtagcatctctgaacagacgcatccagctggttgaggaggagttggatcgcgctcaggagcgtctggccacagctctacagaagctggaggaggctgagaaggctgcagatgagagtgagagaggcatgaaagtcattgaaagccgagcccaaaaagatgaagaaaagatggagattcaggagatccagctgaaagaggccaagcacattgctgaagatgctgaccgaaagtatgaagaggtggcccgtaagctggtcatcatcgagagcgatctggagcgtgcggaggagagggctgagctctcggaaggcaaatgtgccgagcttgaagaagagttgaaaacggtgacgaacaacttgaagtcactggaggctcaggctgagaagtactctcagaaagaagacaagtatgaagaggagatcaaggttctctctgacaagctgaaggaggctgagacccgggctgagtttgcagagagatcagtaaccaaattggagaaaagcattgatgacttagaagagaaagtggcacatgccaaagaagaaaaccttagtatgcaccagatgctggaccagactttactggagctaaacaacatgtgaaaccctccttagctgcggccacattctctcgtttccccctgttgttttattttgtctttaaacacatgcttaccatgaaaccccttcaatgctttttttttttatatatatatatacctttaccactgtcactgcaacatctgcagagagccagctagggcagggggtggggaaagacacacagaaagcaggtgtacttgttatttaaatgtgccatttcccaggttgacattgccacacttcacagagtttaggcatgcagtttgcttagccagtgtaggaagcctcacgaaaacaaaaggattaacagcctaagtgccaatggtggggtcatcaggaagactgatgttggagacaatcaggtgcagattggtgctaatttaaacaaaagaacccctggtgtcttttgttcagtctaatacaatttagacttctgtccaacactaatttatttttgtcttgagtagcactgcgagaggatatgggttccatgtgcccgtgttcctcacagccaagggtttgaaagccacgctggtcttgtaagattcccattccttcccagctgacatgcttgtggtcccttccaactcagtggggagagggctcagtgctgttcgccccccccccccccaattctccatgtcagggtaagagatctaggcactacatatgtaattggtaaagaaaaggcattttctcgagagttataactatgtaaacattgtataatgatatgaaataaaatgcacattgtaggacattttcta

SEQ ID NO: 1483 - DNA, 5563 bp, Rattus norvegicus
  Genbank Accession No. M75281
cctatctaattcctctcaagttaaataaacaaatgtcaaagggcagatagtttttcctatctttgccctctgtccaaagagtaagccataaagccacctttaagtagcttccttcactgtacgcaatgactggtattaatatttgtggaaaaattcacttccctttggctaagttaaaggttgtttcagaagttttgcttcagaataggacattatgaatgatcccatatctcctgaaatacaacccctcgaattgtttatcttgaccttcgatgatactactctgttaggatgcaaaaacgaaagaatttctggaacaccaagggttcaacttggatgttgaaggaatttgaaggtcagagaaagttggtattttcagttaagcaagaataccaacctatgagagccaacatatgaagactaagacttgtggagaaagttagggtgaagagatcacctggagctgaggaaaaatacgaaataagggagatacagaagatatgggcatttggggaatgtgatgatgtggcccacaaagagacagagaggatgaagatctggcaaccagtttgagaaatgagaagagagcaaatatagagtgcagaaatagaaaaaggaggggaaagggtaaaaaaatatggtactgggaaggagccaatgcaaaccaagagtacaggataaaaggctaactcacttgcaagctgtactcgctgcctaatccaggtttactgcagttcctctccttgtcttggatcctagtccatttctaagaagatcatggcctacctgctccatgctcaactatttctactgactacctttatattagttttgaacatgagactttgtcctgttctaggtcactttctgggtggcatagagaagtctagcatggaggaggaaggagcctcagaagcattgaactatgctgtcaatgagtataatgaaaagaacagtgacttgtacctgagccgtgtggtggaagtgaaggatgtccaaaagcaggtatgtcactatttattgagagaccctgacttatagagggacacctatatctccttagtccatctaacattctctccaacctattgctctctgactctcttttagtctgttttgtaagtagtgattttaggtggacatattggcagtatttgcatgttatttacttcagtatgtcttttccttagatattttctgtcctgtaaaagtgcatgtaggtgagcttacccaaactgcaataacctctgcttcactcctttgaaatgtaagaatatgctttcagtgttggcatgcctgtttcttgataaacttctcagccacaccagaacagaggttctccaacaggtcttctgagaaaatctttttagcatttgccgtcttcagcccagagacattgccaacagattattgtgtgaccaaaaaagtaaattctcaacacaactactatttgttcttgaaatttttagtgtcttttatataattcttattttgttaatggacaaatatcaagagaattcacaactatagcacaagggctctctgtcaatccatcctatgttctttactactatatttgattgtctttgatccaacttccaccattgacccaagaatatgcatctctgggtgagcaatttttaaatgtttggttagcaaactgtgcagtgaatattttccatcaggtaaaatgcaatttttatatattttaaaatatttttacaaataaatcaaacgtttatttatacacagatttctcatatacaggatgactcaatttgcatgaatcccttagtagccactctcagaatggcttcatgtgcctcagaacttccttttgcctgagtttcctttgtttaaatatttgcagaacctttgtgtaaatcacttgaacccatcaatgaggataagcctatatttcccagcgtatgaagggcttggtccctaaagtgatatcactgaagtatgatgtagcctattacaagtattaagaaatgatgatgcctatgtaaaaaacacatttttcgaacaggggttacacctatcatcacctatcatagcaaatatctatatagacaaaatatatttcttttgactctaagctacttcaggttgaatgccaattatgaccttttgtagtagaaatacaaccactctagaggtccttaccttctttttgcatgcttacctttgattgtccaaggaatcaacttgaaaaattgcttctacttccactagatctgatctttggatcatagtctggatgatcctctcaaaacttgtgtagaggaccatggggaactctacttaaacatagcagcatagagagcacctaaaggagaattttgcaaagaaaataaggggccaaaagtccatattattggctgctaaaccagaggatcaacattgaagcaatgagaaatatatactatcagttccttcatcatattaaaacctccaaatataaccatctaaccgagaccatctcacaagcacatggtcagtgttactaatatgaatacaaacacagtaatgtgtcataatgttagaggagaaaactctatccttctaaccctgaatatcaaagatataaagaataactgagttcttcctgtttacaggattttcacatgatcagaagttgtactgtgcattactcaattatggtacaagtgtaaaaggaaaccactgtgtggtcctctagattgccaacataattttaatgagaaacagataagtgattattaaggaaattttccatgctttatgtaataacgttgcagtctgagtggatctgagtctcttgagagtgctctcacataatctatccatgaatctttaaaatgatgtaactaatgagtagtcatgagagttacgtagtggagatacttaaacaaaatgtcactgatatccttttttcacttcatgtgtttgcctgacactttcttctatgtcctgctcttgtttctttgtcaacatgattgtatttcttggctctctagacttatttttgcgtagtgaattatcatctgaaaaataggacccttaaataaaaacatttctagatcaacatcttcattgaagcatattatgagaaaactactagagaatcatagaccattgcacacttaatagtatagatgaacctcatttagttgatatactagaaaatgcatgggattcatttaaggtctcaagggtcttttttttttttctttttttgtcggagctggggaccgaacccagggccttgtcttgctaggcaagagctctaccactgagctaaatccccaaacctcacagggttcttaatacttttttttgctctaacaactttcttctctagagatctatctggatgagtctagtattccctgtagtaaaaatagctaaaaggtattaaaataaaaattaaaaaaacatatctgacaatttcacactcaaaaatattcctcttaatatttgtatttaaagtggagacaatataaaagtgtatttcgtttgtgttgaacctttctttaagttaagcatcccatgtgttcatgtccatgcatggatgagttggaatataaggaaagaacggattttctcctctcacaaggatttagttaaaattaatagtgaattttcacacatcactcaacggaagagaatttcgtcttcatttgtggctagacccaaaagttagtcctgtgctttaggtccagacaacactggccctatgatcagccttgcattgattaatacaaaatctatattgcatacatgccagctgactcctcaaagctatgtacttttccaaagtattggaaccactcttttctctgtgtcctgtctcacttactggaatgtaaaagagctcatgtgaagttcagattaatgttaaaagtgaatcattcatttctccttaggtggtggctggaaccaaatttttctttgatgtgattctaggcaaaacaatatgtttgaagacacagggtgacttgaccaactgtcccttaaatgaagaggctgatcagcaggaggtatggatataacacatgccaaagacattttgttcaagtagagggatgtgcaagcttgtaagtttgtgaaagtatatttgtggtaatattcatacacaattacaatatttacaaacagggaagaaagtgtgtgtgtgtgtgtgtgtgtctgtgtgtgtgtgtgtgtgtttgtgtgtaagtaatttaaagtgtgtttggactattcttgggaagaattggaaatagtatataagtgacactgggagaaatgtgtatgtgtaagtaggttgaacttaattaagaatgcattcattaagaattgacagtatatgtagcagacaaggggaacaatatatctagacataaaaaattagagaactgtgaattctgtactctgagatgactgtagttttgcttggttgaaatggaagaggcaataatagtttgcatttttgagaagagatgtttacacctataagggaagcttttgtccacattacccctaaaggaaacgagtccttcagtgctgctctttacactcaatgctggcttatcccctgatagtggcacactggagatacagtgaatttgtgtaaagtggcaattcctcttcatatcactttccctactatgaagctttcagggatttctgtatcccatgagcctgaaggtcccctgtgtgggagtgagagggtcctatgtacagaatgtatgctatattcttgacttctgagatcctagaatgagtcatagggtattctaaaagggatgttttgacaaaaaggaaaagtctgttgcccttaaaggtagacagatatcatatggtggatggacataattatgttgtagatcatcagacactacgtaagaaggctgagtgttgttatactgggcagagggttgttttacattccccagtcaaattttgtcaaacagctctagcttcaaatttcttcctaaatttttccagcactgaacaaccttgtttgtttacttttctagcatgaattctgctctttcgtggttcatgatatcccatgggagaattatattgtcttgctgagctccagctgtcatagtatatgaattagtgtcaagtgttactgtgtaggatgcagatgtctctggcaatgcctcatcactccagtggatgatctttccttgatggatgcttaccagcatggatattagcaatggaatagactgctgtgcacttagagttagacccaagcacctctccctttattcttcctctacaaatgcccatatttgcttgctcattccttgctcaataaaatgtccaacagctcctttgtgtgactcgaatttcagtctatctaacattgtggtattgaaaacacctaatgagggctcacatccatatgtgtacagcaagcaaaaggccttatgacactgatattctctaaaatgaagagtagataaagaatgtaaagtgaataaaacaaaacaattttttgacacagtgggtcttagcagagagacggtataaaaggggactgtgggaagtcctcatgtagattgcctgtgtgctttggtcc

SEQ ID NO: 1484 - DNA, 4254 bp, Rattus norvegicus
  Genbank Accession No. M81855
gctcccatcttcgaggctcagctcaactcagagctacttcttccaaattctacatcttggcggacttcgcgaaggaaacccggagtgttacgtgaggtcctgatggagtttgaagagggccttaacggaagagcagacaagaacttctcaaagatgggcaaaaagagtaaaaaggagaaggagaagaaacctgctgttggcatattcgggatgtttcgctatgcagattggcttgacaagctgtgcatggctctgggaactctcgctgctatcatccacggaaccctgcttcccctcctgatgctggtgttcggatacatgacagatagttttaccccaagcagagacccgcattctgaccgagcgattactaatcaaagtgaaatcaacagtacacataccgtcagcgacacgagtctggaggaggacatggccatgtatgcctactattacacgggcattggtgccggtgtgctcatcgttgcctacatccaggtttcactttggtgcctggcagctgggagacaaatacacaagattaggcagaagtttttccatgccatcatgaatcaggagataggctggtttgacgtgaatgacgctggggagctcaacacccgtctcacagatgacgtctccaaaattaatgacggaattggtgacaaacttggaatgttctttcagtccataacgacattttcagccggttttataataggatttataagtggttggaagctaacccttgtaattttggccgtcagccctcttattgggttgtcatctgccatgtgggcaaaggtactgacttcatttactaataaggaactccaggcttatgcgaaagctggagcagttgccgaagaagtcttagcagccatcagaactgtgattgcgtttggaggacaaaagaaggaacttgaaaggtacaataaaaatttagaagaagctaaaagagttggcataaagaaagccatcacggccaacatttccataggtattgcctacctgttggtctatgcgtcttatgcactggcattctggtatgggacctccttggtcctctcaaatgaatattctattggacaagtgcttaccgtcttcttctctattttattggggactttcagtattggacatttagccccaaacatagaagcctttgcaaatgcaagaggggcagcctatgaaatcttcaagataattgataatgagccaagcatcgacagcttctcaaccaagggacacaaaccagacagtataatgggaaatttggaatttaaaaatgtttacttcaactacccatcacgaagtgaagttaagatcttgaagggcctcaacctgaaggtgaagagcgggcagacggtagccctggttggcaacagtggctgtgggaaaagcacaactgtccagctgctgcagaggctctacgaccccatagagggcgaggtcagtattgacggacaggacatcaggaccatcaatgtgaggtatctgcgggaaatcattggggtggtgagtcaggaacccgtgctgtttgccaccacgattgccgaaaacattcgctatggccgagaaaacgtcaccatggatgagatagagaaagctgtcaaggaagccaatgcctatgacttcatcatgaaactgccccacaaatttgacaccctggttggtgagagaggggcgcagctgagtgggggacagaaacagaggatcgccattgcccgggccctggtccgcaaccccaagatccttttgttggatgaggccacgtcagccttggacacagaaagcgaagccgtggttcaggccgctctggataaggctagagaaggccggaccaccattgtgatagctcaccgcttgtctacagtgcgcaatgctgacgtcattgctggttttgatggtggtgtcattgtggagcaaggaaatcatgaagagctcatgaaagagaagggcatttacttcaaacttgtcatgacacagactagaggaaatgaaattgaaccaggaaataatgcttatgaatcccaaagtgacactggtgcctctgagttgacttcagaagaatcaaaatctcctttaataaggagatcaattcgcagaagtatccacagaagacaagaccaggagagaagacttagttcgaaagaggatgtggatgaagatgtgcctatggtttccttttggcagatcctaaagctaaatattagtgaatggccctatttagttgtgggtgtactttgtgctgttataaatgggtgcatacaaccagtgtttgccatagtgttttcaaagattgtaggggttttttcaagagacgacgaccatgaaaccaaacaacggaattgtaacttgttttcccttctctttctggtcatgggaatgatttcttttgttacgtacttctttcaaggcttcacatttggcaaagctggagagatcctcaccaagcgactccgatacatggtcttcaaatccatgctgcgacaggatataagctggtttgatgaccataaaaacaccactggctcgctgactaccaggctcgctagtgacgcttctaatgttaaaggggctatgggctccaggcttgctgtagttacccagaatgtagcaaaccttggcacaggaattatcttatccttagtcttagtctatggctggcagcttacacttttacttgtagtaattataccactcattgtcttgggtggaattattgaaatgaaactgttgtctggtcaagccttgaaggacaagaaagagctagagatctctgggaagatcgctacagaagcaattgaaaacttccgcactgttgtctctttgactcgggagcagaagtttgaaactatgtatgcccagagcttgcagataccatacagaaatgctttgaagaaagcacacgtctttgggatcaccttcgccttcacccaggccatgatttatttttcctatgctgcttgtttccggttcggtgcctacttggtggcacgagaactcatgacgtttgaaaatgttatgttggtattttctgctgttgtctttggtgccatggcagcagggaataccagttcattcgctcctgactacgcgaaggccaaagtctcggcatcccacatcattgggatcattgagaaaatccccgagattgacagctacagcacggagggcttgaagcctaattggttagaaggaaatgtgaaatttaatggagtcaagttcaactatcccacccgacccaacatcccagtgcttcagggactgagcttcgaggtgaagaaggggcagacgctccgcctggtgggcagcagtggctgcgggaagagcacggtggtccagctgctcgagcgcttctacaaccccatggctggaacagtgtttctagatggcaaagaaataaagcaactcaatgtccagtgcgtccgcgcactgggcattgtgtcccaggagcccatcctgtttgactgcagcatcgccgagaacatcgcctacggagacaacagccgtgtcgtgtctcatgaggagatcgtgagggccgccagggaggccaacatccaccagttcatcgactcactgcctgagaaatacaacaccagagtgggagacaaagggactcagctgtcgggcgggcagaagcagcgcatcgccatcgcgcgcgccctcgtcagacagcctcacatcttacttctggatgaagcgacatcagctctggatacggagagtgaaaaggtcgtccaggaagcgctggacaaagccagggaaggccgcacctgcgttgtgatcgcgcaccgcctgtccaccatccagaacgcagacttgatcgtggtgattcagaacggccaggtcaaggagcacggcacccaccagcagctgctggcccagaaaggcatctatttctcgatggttcaggctggagcaaagcgctcatgagctgggagtatttgaggtgctaagtatttctaatattggtgttcaaacatggcacgtaaccaaagttaaaaggttaaaagcactgttaaaggtaatttcatcaagacgagaagccttcagagacttcataattaaatgaaccgaaattgaaaaaaaaatcattaaacagggccacattttttaattgtattatgtgattcaagagaacatatagtttttttaaaaagaaatgtgtagttttgtttcagtttttttaatttctaccctattcccttaaatgatcataaaggctgtaaaaagcactatttttttgcggcc

SEQ ID NO: 1485 - DNA, 3224 bp, Rattus norvegicus
  Genbank Accession No. M83143
ctcaaggggcctctgggttctatttccaaagttctcggtgtgttccgtaatacttacgttacatctctcgggtgtggagctaggaatctccagtaagagagaacatgcgatatttgttgttctggtatggattgcctcactcgtattctcagtgtgtctgtcattggaccccagccagtggcatctttgaaaatgagccattattatctttattgcttctggtcctgggcaagttagtcaccacagaaaagcgcttcctcaaggacagtttgtacaccgaaggaatcctaattgtatgggacccatccgtgtatcatgcagatatcccaaagtggtatcagaaaccagactacaatttcttcgaaacctataagagttaccgaaggctgaaccccagccagccattttatatcctcaagccccagatgccatgggaactgtgggacatcattcaggaaatctctgcagatctgattcagccaaatcccccatcctccggcatgctgggtatcatcatcatgatgacgctgtgtgaccaggtagatatttacgagttcctcccatccaagcgcaagacggacgtgtgctattatcaccaaaagttctttgacagcgcttgcacgatgggtgcctaccacccgctcctcttcgagaagaatatggtgaagcatctcaatgagggaacagatgaagacatttatttgtttgggaaagccaccctttctggcttccggaacattcgttgttgagtacctagccaggcacccttatccttctccatacgtcattttatggctactctcctggttaccgctgcttgaaggagtgtttttattcaacaggcccagcctgcttcctgcgctctagggaattttgttggcaagagttctggggcctccagcctgcctccctggggccaccgaggatgggagtccagattcttgccacactcattcctcctagacagcgtcctcctctccttctgcatgggtagggaaagatccacatttctcaccagggttgcgaaaactagactttgttttctccaactggatgatgtcatcctcgcaaggcagcacgtcctctgtggcttgaactctccctaggtattgatttcacatccgaaagaaattctcccagatcatgatttgtgtttcacagatgcagggtggcgggaggggagaaaaataattggggcaggatggggaagcctactcagttactccagaagggcgtcaaggtgctcccaactcccttgggacatagtcctgttgtcaccctgtctggctaggctgatccttaatgcaaaggaccctgggtgcttatgatttgggtagcccacttccaactccctgtggagatgaaaggtacaaaacctcctgatcacctgaccatctgtctccagcatggacgagagagacacccaacaggcagctaaaatgcaaacattccgtagcctgttgtctgtgtgctcctccctaagacacccaggaggggccagctctactgtgttcttgtagagctgcggcacggaggaagaagggatactggggaagctcttacaccttctgcgtcagaagatctcttttcattttcccctttatgaacactgtatggcctgttacattgatgttatatttggaggcccaaggagtttttgttaggaagtccctaccaccgtcagatgtagacagcaggttaaagtgctgccccacaagactggggttcttattttattttttttaaatgtctacctctcccctactaattgctattgttatcccaaaccttctccagcaggctcccctctcgaattttaatctttttctttaggggcaccccatcaactttccctgaccgtttgacaaatacccgaaaggtctctcagggcatggggagtatgtaataaatgattcttcccttagaatcttaatcattcctgggacttaggggggtgaagtgtgtgatcacagattgccaagcatacccaccctgtttggctctgggcaggaagcactgctcttcctggttccctcacaaggattttctgagatgtggagtggtttacctagcctctgatgaagccacagtgggcttctctaccaggtggcaataacctatggtcaaaactcaaggctggcacaatctgttcgattcaaggctactaagacttaatgctattgaacctgtgttctcacaggcttctgtttactgctgacctagagctcagaaactcagaccccactgtctcagtgtttcaagctgcttgccttattcgggcaatagaaagcccggagtgaaaagccctgggtttccaggttgacctctcacttcctcactgtgccactttgtttctgtatctgtaaaatgggggtgacaatcctacctcacagggctgtgtggggacaacaggaaaacatggctgcgatgtatgagaaccactggaaagcgcgtggctgggctgtgaccacagtgtataggaagtaggtaccctgctgtccttcctgtttccttatgaagaacctaccaggtgatcacacccgtgctgggccttgctacaagggagggcagtggagaggaacaggacattctttctgttgtgagacaactgcatcatttgcaatatgcaggggcctactatcttgttgcctgcaccccaggtctatttgtgctggggttgggggtgcacagagcattgagctgcttggccgctgtgtggaataaatctagagaattcctggctcacttcttctgatctcacacgctcattataaggcattaggactgtggatggagtggccaggaagttgatgttccttctgtcagcaagaggtacattagagatggagactacactgggtagattctagtttttaattcttattaatgtggggggaataaattaataagtataatatgattctgatgtctattagactttctctgtgctctttgtgagtaaggtgggccacggaggtatgagggcatcactgttagtttggtgaggtggttagtgactgatgtacaggaagtgtcttctacgtgggcactgacgtcagtagccatctatgcatcctaaatgcaggatcctcttgattctttctgccaatcaaatatatcgttgctcttggttcaggtttgtgtcagaaactttaaaaacatacctattaattctaaattatccaaagattatgtacaaattttaaaataaatgtctttttcag

SEQ ID NO: 1486 - DNA, 857 bp, Rattus norvegicus
  Genbank Accession No. M83678
accatcggaattgatttcaagatccgaactgtggaaatagaggggaagagaatcaaactgcaagtctgggacacagctggccaagaacgattcaagacaataaccacctcctattaccgtggagccatgggcattatcctagtatatgacatcacagatgagaaatccttcgagaatattcagaactggatgaaaagcatcaaagagaacgcgtctgctgaagtggagcgccttctgctggggaacaaatgtgacatggaagccaagcggaaggtgcagagagagcaggctgagaggttggcccgagagcacagaatccgattttttgagacaagtgccaaatccagtgtgaatgtggatgaggctttcagttccctggcccgtgacatcttgctcaagacaggaggccggagatcgggaaacagcagcaagccctcaagcactgacctgaaagtatctgacaagaagaacagcaacaagtgctccttgggctgagggacatttcttgcctcctattcaccctgaacctggaggctagacctgagggaggtggactgaggtagactgatggaaaacagaggggaggagctgtggtggtgcctggaggggtggatgacaggggaggaaggaaagatgaaatgggcagggaaaggagggcgaggaaccaaggacgtgaaaagtgaagagaaggggtttgagaagagaaaaagaagaaggtctcaggtctcggaccgtccaacattaatgtcagtatgctgatctctccattcctggttcagggttcgggtcccgagaggctggctcggccctactctgagggtctctcactccacagatgtttgttagtattaaaggcc

SEQ ID NO: 1487 - DNA, 1314 bp, Rattus norvegicus
  Genbank Accession No. M84648
gaattccactctgcttcctcatgtgtctggattccgtactggagtcactgtgaggttaaaatataaataagggaagcattttctagaataccccaatgcttggagagcttccttttctttctttcctccaaatattcttaaagggatctggattctcctcggtgtcatgcagattctctctcaggtcccagttctgacagtgtaaatctttgggtccaagcccactcccaccgccttccctgtccccactgtggaacacagaccactccataccctagcctgtggcaactacctctgctgacagccattttgtcttcaactgcctagacccagtcctttcccaggttacccatacgcaatctcacactgactctgttcttcgtccccactggtccaaattggcagccttcctccaaagcaagcgcttagtgctctgagggtttttcccttgtgccttctcaatgatacttccttggctctcctttatgctccaatgaaaatgtcagccttggatttcccgaagttaatcaaaatcgcattcactattttgtctccggtatcacaagtgtcaatgggttgggaatgaaggctagcaggtgggctctgcccattgtctggctctagagaccccatgaaatgctggcaatttaaaggctctggacagagggaaggttcttcaataggacagcctttttcttttttttttttttttttttttcttcttttttttttttcggggctggggatcgaacccaggaccttgtgcttcctaggcaagcgctctaccactgagccaaatccccaaccccaggacagcctttttctgatacaggggttggagttatgaatcacttagtggggctaacaacatgaaactgggactatgtgtgaaagcatagatggtagggctatacggtaagaaaaagccgtgatggcttgttgtgaatcagtctcactgggtgagctttcttaagagcccaaagaagggcttcatgccaacccccatgtgtgtgtgccttctctggacttccttgacctttataccatcagaaattaatgtttaaccagaaaacaaggtttaaatgcaaggacagagaaatgcatcagttccaagctgtagtttgcagagctggactgagtggacctgtgaagaatccaaattccaaacaagtaagtagtatgttttgtcagacgataattgctgaaaaggcaccatttctattgtgtctcttgtgccctccatattactgaatgtgtgctgaaaggacgctctcctgagaatggggattattgatgacaaattatttcctctgt

SEQ ID NO: 1488 - DNA, 507 bp, Rattus norvegicus
  Genbank Accession No. M93297
tttagatttatttgtttactttgagtgttttgcctacctgtatgtatgcaccatgtgggtgctgggagtcaaacgcagagctctgggaaagcagcaagtattccagactgctaagccgtctctcccacccctcataattaattctcaacaggcagttgccaaacaaatagaaagaagctattaaaactcctgtttcttttgtagcgtgctcttcaggatcccaatgttgctgctttcatggtggagcccatccagggtgaagcgggtgttatcgttccagatccaggatacctgacgggagttcgagaactttgcacccggcaccaggttgtcccactcactttgcagtgacgccaggctcgcctgcacttgtttggactctgctgacaggctagatgatggattccaaggcttgaggaacatgctaatgcttgcaccttctgaggaacacgctaatgcttgcaccctctgaggaacatgctaaatgcttgcaccttctgaggaaca

SEQ ID NO: 1489 - DNA, 2028 bp, Rattus norvegicus
  Genbank Accession No. M95762
ggcagcgaacacaagcgcatccggtagaacggaaagaacaggaattgcagagtgacttcaagtctccatacgatttactacccgggtgacggcagtgactcgacagagtagcggctgcaggtgggatggataacagggtctcgggaacgaccagtaatggagagacaaagccagtgtgtccagtcatggagaaggtggaggaagacggtaccttggaacgggagcaatggaccaacaagatggagttcgtactgtcagtggcgggagagatcattggcttaggcaacgtctggaggtttccctatctctgctacaagaacgggggaggtgccttctttattccctacctcatcttcctatttacctgtggcattcctgtcttcttcctggagacagcgcttggccagtacaccaaccagggaggcatcacagcctggaggaaaatctgtcccatcttcgagggcatcggctatgcctcacagatgatcgtcagccttctcaatgtctactacatcgttgtcctggcctgggccctcttctacctcttcagcagcttcaccactgacctcccctggggtagctgcagccacgagtggaatacagaaaactgtgtggagttccagaaaaccaacaattccctgaatgtgacttctgagaatgccacatcccctgtcatcgagttctgggagaggcgagtcctgaagatctcagatggcatccagcacctggggtccctgcgctgggagctggtcctgtgcctcctgcttgcctggatcatctgctatttctgcatctggaaaggggtcaagtccacaggcaaggtggtgtacttcacagctactttcccttacctcatgctggtggtcctgttgatccgaggagtaacactgcctggagcagcccagggaattcagttttacctgtaccccaacatcacacgtctgtgggatccccaggtgtggatggatgcgggcacccagatcttcttctcctttgccatctgcctggggtgcctcacggccctgggcagctacaacaagtaccacaacaactgctacagggactgcgtcgccctttgcattctcaacagcagcaccagcttcgtggccgggtttgccatcttctccatcctgggcttcatgtctcaggagcagggcgtacccatatctgaggttgctgaatcaggccctggcctggcattcatcgcctaccctcgagctgtggtgatgttacctttctcgcctttgtgggcctgctgtttcttcttcatggtggttctcctgggactagacagccagtttgtgtgtgtagaaagcctcgtgacagcgctggtggacatgtatccccgggtgttccgtaagaagaaccggagggagattctcatcctcatcgtgtctgtcgtctctttcttcatcgggctcattatgctcacagagggcggcatgtacgtgttccagctcttcgactactatgcggccagtggcatgtgtcttctctttgtggccatctttgagtccctctgtgtggcttgggtttacggagccagccgcttctatgacaacattgaagatatgattgggtacaagccgtggcctcttatcaaatactgttggctctttttcacgccagctgtgtgcctggcaaccttcctgttctccctgatcaaatacacgccactgacctacaacaagaagtacacatatccatggtggggggatgccctggggtggctcctagctctgtcctccatggtctgcattcctgcctggagcatctacaagctcaggactctcaagggcccactcagagagagacttcgccagctcgtgtgcccggctgaagaccttccccagaagagccaaccagagctgacttctccagcgacaccgatgacgtccctcctcaggctcacagaactggagtctaactgctagggacgaggcctttgacacacctgcgagtctgtctgtggggacagctacagacacagagggcagaaccacccctccgtgctggggcagagagaca

SEQ ID NO: 1490 - DNA, 1619 bp, Rattus norvegicus
  Genbank Accession No. NM_012489
actttcaggcctcgtgaggtagagggctggcctgcgcctgcgcctgccatcattttggtttgttaagcaaggcagagcatgagcgagtcggtgggacgcacctccgcgatgcatcggctgcaggtagtgctgggccacctggccggccgacccgagtcgagctccgcgctgcaagccgcgccctgctccgctaccttcccgcaggcttcggcctccgacgtggtggtggtgcacggacggcgcacccccatcggccgcgcgggccgcggcggcttcaaggacaccacccccgacgagcttctgtcggccgtgttgaccgcggttctccaggacgtgaagctaaagcctgagtgtttgggagacatctctgtgggtaacgtacttgagccaggagccggagcagtcatggcgcgcattgcccaatttctgagtggcatcccagagaccgtgcctctgtcagcagtcaacagacagtgttcatcgggactgcaggcagtggccaacattgctggtggcatcagaaatgggtcttacgacattggcatggcctgtggggtggagtccatgtccctgtctaacagagggaaccctgggaatatttcctcccgcctgctggagagtgacaaagccagagactgcctgattcctatggggataacctcggagaatgtggctgagcggtttggcatctcacggcagaagcaagatgccttcgcgctggcctctcagcagaaggcagcaagtgcccagagcaaaggctgcttccgtgctgagatcgtacctgtgacaaccactgtcctcgatgacaagggtgacaggaaaaccatcaccgtgtctcaggatgagggtgtccgccccagcaccaccatggagggcctggccaagctgaagcctgccttcaaggatggaggctctaccacggctggaaactccagtcaggtgagtgatggagcagccgccgtcctgctggcccggaggtccaaggctgaagaactgggcctccccatccttggcgtcctgaggtcctatgcagtggtcggggtccctcctgacatcatgggcatcggacctgcctatgccatccctgcggccttgcagaaagcagggctgactgtgaatgacatagacatctttgagatcaatgaggcctttgcaagtcaggccctctactgtgtggagaagctgggaattcctgcagagaaggtgaaccccctggggggtgcaatagccctgggccaccccctgggctgcaccggagcaaggcaggtggtcacgctgctcaatgagctgaagcgccgaggcacacgggcttatggcgtggtgtccatgtgcattgggactgggatgggagccgctgctgtctttgaataccctgggaactgaggccctgactgcaggcactacccagagagtcctatagtagtgtctggagagggatggtacaggagccatcttcgtgggacactcagcagtggagggatttgtcacagcacttcaattcagaagatgtagtcgatgttggaacaggaggtggaactgccctgtcaagtaccccaagccatgctaaagtgagcatgggacacccaggttgcaaagccatctgtacctctgacggatgc

SEQ ID NO: 1491 - DNA, 1442 bp, Rattus norvegicus
  Genbank Accession No. NM_012495
gtcccccccaccccagctgaataggctgcgttctcttggaacgcgccgcagaacgaggttctgtgaccctagccgcgttccctccttagttcctttcgcctacccacccgcgtacccgacagacccaccccgtcctgtgccaggaaagcgctgccaccggcaccatgccccacccatacccagcactgaccccggagcagaagaaggagctggctgacatcgctcaccgaattgtagctccgggcaagggcatcctggctgcagacgagtccactggaagcattgccaagcgcctgcagtccattggcaccgagaacaccgaggagaacaggcgcttctaccgccaactgctgctgactgccgatgaccgtgtgaatccctgcattggaggggtgatccttttccacgagacactgtaccagaaggcagatgatggccgtcccttcccccaagttatcaagtccaagggtggtgttgtgggcattaaggtagataagggtgtagtgcccctggctggaaccaatggcgagaccactactcaagggctggacgggctgtctgagcgctgtgcccagtataagaaggatggagccgactttgccaagtggcgctgtgtgctaaagattggggagcatactccctcgtccctcgccatcatggaaaatgccaatgttctggcccgttacgctagcatctgccagcagaatggcattgtacccattgtggagcctgaaattctccctgatggggaccatgacttgaagcgctgccagtatgtaactgagaaggtactggcagctgtctacaaggctctgagtgaccaccatgtctatctggaaggcacactgctgaagcccaacatggtcacccctggccatgcttgcacccagaaattttccaatgaggaaattgccatggcaaccgtcacagcacttcgtcgaacagtgccccctgccgtccctggggtcactttcctgtctggagggcagagtgaggaagaggcatccatcaacctcaatgctatcaacaagtgtcccctgctgaagccatgggccttgactttctcctatggccgagccctgcaggcctctgctctaaaggcttggggtgggaagaaggagaacctgaaggcagcccaggaggagtacatcaagcgagccctggccaacagcctcgcttgtcaaggaaagtacactccaagtggccagtctggagccgcagccagtgaatctctcttcatctctaaccatgcctactaaccagagctgatctaaggctgctccatcgacactccaggcccctgcctacccacttgctattgaagaggggccttcaggctctttcccatcactcttgctgccctcgtgtgtgcagtgttgtctgtgaatgctaaatctgccatcccttccagcccactgccaataaacagctatttaaggggg

SEQ ID NO: 1492 - DNA, 1339 bp, Rattus norvegicus
  Genbank Accession No. NM_012498
gcactcttgcgggtcgttgtgcgtaacttgcagcaatcatggctagccatctggaactcaacaacggcaccaagatgcccaccctgggtctgggcacctggaagtctcctcctggccaggtgaccgaggctgtgaaggttgctatcgacatggggtatcgccacattgactgcgcccaggtgtaccagaatgagaaggaggtgggggtggccctccaggagaagctcaaggagcaggtggtgaagcgccaggatctcttcattgtcagcaagctgtggtgcacgttccacgaccagagcatggtgaaaggggcctgccagaagacgctgagcgacctgcagctggactacctggacctctaccttattcactggccaactggcttcaagcctgggcctgactatttccccctggatgcatcgggaaacgtgattcctagtgacaccgattttgtggacacttggacggctatggagcaactagtggatgaaggtttggtaaaagcaatcggagtctccaacttcaaccctcttcagattgagaggatcttgaacaaacctggcttaaagtataagcctgctgttaaccagatcgagtgccacccatacctaactcaggagaagctgattgagtactgccattgcaaaggcatcgtggtgactgcatacagtccccttggttctcctgacaggccctgggccaagcctgaggacccctctctcctggaggatcccaggatcaaggaaattgcagccaagtacaataaaactacagcccaggtgctgatccggttccccatccaaaggaacctggtcgtgatccccaagtctgtgacaccagcacgtattgctgagaactttaaggtctttgactttgagctgagcaatgaggacatggccactctactcagctacaacaggaactggagggtgtgcgccttgatgagctgtgccaaacacaaggattaccccttccacgcagaagtctgaagctgtggtggacgaatcctgctcctccccaagcgacttaacacatgttctttctgcctcatctgcccttgcaagtgtccctctgcactgggtggcaccttgcagaccagatggtgagagtttgttagtttgacgtagaatgtggagggcagtaccagtagctgaggagtttcttcggcctttcttggtcttcttcccacctggaggactttaacacgagtaccttttccaaccaaagagaaagcaagatttatagcccaagtcatgccactaacacttaaatttgagtgcttagaactccagtcctatgggggtcagactttttgcctcaaataaaaactgcttttgtg

SEQ ID NO: 1493 - DNA, 1085 bp, Rattus norvegicus
  Genbank Accession No. NM_012513
cgccttggacagagccagcggatttgtccgaggtggtagtacttcatccagttccaccaggtgagaagagtgatgaccatccttttccttactatggttatttcatacttcggttgcatgaaggctgcgcccatgaaagaagcaaacgtccacggacaaggcaacttggcctacccagctgtgcggacccatgggactctggagagcgtgaatgggcccagggcaggttcgagaggtctgacgacgacgtccctggctgacacttttgagcacgtgatcgaagagctgctggatgaggaccagaaggttcggcccaacgaagaaaaccataaggacgcggacttgtacacttcccgggtgatgctcagcagtcaagtgcctttggagcctcctctgctctttctgctggaggaatacaaaaattacctggatgccgcaaacatgtctatgagggttcggcgccactccgaccccgcccgccgtggggagctgagcgtgtgtgacagtattagcgagtgggtcacagcggcagataaaaagactgcagtggacatgtccggtgggacggtcacagtcctggagaaagtcccggtatcaaaaggccaactgaagcaatatttctacgagaccaagtgtaatcccatgggttacacgaaggaaggctgcaggggcatagacaaaaggcactggaactcgcaatgccgaactacccaatcgtatgttcgggcccttactatggatagcaaaaagagaattggctggcggttcataaggatagacacttcctgtgtatgtacactgaccattaaaaggggaagatagtggatttatgttgtatagattatattgagacaaaaattatctatttgtatatatacataacagggtaaattattcagttaagaaaaagataattttatgaactgcatgtataaatgaagtttatacagtacagtggttctacaatctatttattggacatatccatgaccagaaagaaacagtcatttgcgcacaactttaaaagtctgcattacattcctcgataatgttgtggtttgttgccgttgccaagaattgaaaac

SEQ ID NO: 1494 - DNA, 781 bp, Rattus norvegicus
  Genbank Accession No. NM_012515
tgtggatctttccagaacagcagttgcaatcactatgtctcaatcctgggtacccgccgtgggcctcactctggtgcccagcctggggggcttcatgggagcctactttgtgcgtggtgagggcctccgctggtatgctagcttgcagaaaccctcctggcatccgcctcgctggacactcgctcccatctggggcacactgtattcggccatggggtatggctcctacataatctggaaagagctgggaggtttcacagaggaggctatggttcccttgggtctctacactggtcagctggctctgaactgggcatggccccccatcttctttggtgcccggcagatgggctgggctttggtggacctcatgcttgtcagtggggtggcaaccgccactaccctggcttggcaccgagtgagcccaccggctgcccgcttgctgtatccttacctggcctggctggcctttgccaccatgctcaactactatgtatggcgtgataactctggtcggcgagggggctcccggctcacagagtgaggacacctagccatcaggaatgcagccctgccagccaggcatcatgggttgaggtcatcctgctttcatgaccattgggcctgctggtctacctggtcttagtccaggaagccaccaggtaggtcaaggtggtcagtgctaagtcccatgcggggacagttgtacctgcttttctgcactgctgcaggcgtgccctaggagcatggggcctttaaagctaaataaagtctttaactt

SEQ ID NO: 1495 - DNA, 3578 bp, Rattus norvegicus
  Genbank Accession No. NM_012527
agttggtgtgttcttccttggactatgtcagagagtcacaatgaccttgcacagtaacagtacaacctcgcctttgtttcccaacatcagctcttcctgggtgcacagtccctcggaggcagggctgcccttggggacagtcactcagttgggcagctacaacatttcacaagaaactgggaatttctcctcaaacgacacctccagcgaccctctcgggggtcacaccatctggcaagtggtcttcattgccttcttaactggcttcctggcattggtgaccatcattggcaacatccttgtcattgtggccttcaaggtcaacaaacagctgaagacagtcaacaactacttcctcttaagcctggcctgtgcagacctgatcatcggggtcatttccatgaacctgttcactacctacatcattatgaaccgttgggcactggggaacttagcctgcgacctctggctctccattgactatgtggccagcaatgcctctgtcatgaatctgctggtcatcagctttgacaggtacttttccatcactaggccactcacctaccgagccaaaagaacaacaaaacgacgtggtgtgatgattggtctggcttgggtcatctcctttgtcctatgggctcctgccatcttgttctggcaatactttgtagggaagagaactgtgcccccaggagaatgtttcattcagtttctgagtgagcccaccatcaccttcggcacggcgatcgctgccttttacatgcctgtcaccatcatgactattttatactggaggatctataaggaaactgagaagcgtaccaaagagctggctggcctacaggcctctgggacagaagcggaggcagaaaactttgtccaccccacaggcagttctcgaagctgtagcagctatgaactgcaacagcaaggcgtgaaacgatcatccaggaggaagtacggtcgctgtcacttctggttcaccaccaagagctggaagcccagtgccgagcagatggaccaagaccacagcagcagcgacagttggaacaacaacgatgctgctgcctccctggaaaactctgcttcctccgatgaagaggacattggctcagagaccagggccatctattccattgtcctcaagcttccaggccatagctccatcctcaactctaccaagctaccgtcctcagataacctgcaggtgtccaacgaggacctggggactgtggatgtggagagaaatgctcacaagcttcaggcccagaagagcatgggtgatggtgacaactgtcagaaggatttcaccaagcttcccatccagttagagtctgccgtggacacaggcaagacctctgacaccaactcctcggcagacaagaccacggctactctacctctgtccttcaaggaggccacgctggctaagaggtttgctctcaagaccagaagtcagatcaccaagcggaagaggatgtcgctcatcaaggagaagaaggccgcccagacgctcagtgccatcttgctagccttcatcatcacgtggaccccctacaacatcatggtcctggtgaacaccttctgtgacagctgcatacccaaaacctattggaatctgggctactggctgtgctatatcaacagcaccgtgaaccctgtgtgctatgccctgtgcaacaaaacattcagaaccaccttcaagacgctcctcttgtgccagtgtgacaaaaggaagaggcgcaaacagcagtaccagcagagacagtcggtcatttttcacaagcgagtgccggagcaggccttgtagaaaaggggtatgttgagagcagtgaccacgcaagcgcgtcagcccacacagcctagcaggagtctggcgcaggtggggggagccatccctgatggtgataaaatgggtttttatcgacctcacgggagagaagctacctgtttactgatccattgaataactgattttggtccaatgccaattcagcaggaaagaaggagaggcataccgctaaacatgaagagatgtgttctgaaacagacttttaagtggattttgtttcctctaagagaaaaagaaattattgtctcagagcaagtatcctcagaaattggtctgcctgggtctcttaattcctatcagctctggaatcactggtgagcctcaaggcactagatgccatgtgctctccctaagggtcccaaagtgtccatccagatcccatgtgaagcacggcaagcttgaaaaaaaaaatctgtggtcctgagttattttgtatattgcaaagctgacaccacttgtccccaatcagcttctgtcctctttcagtgtgttgtcaaactctattcgtggatttgactcttggttcttgcaacgtactgtttcgtgctgttcaagtttcacacaaataaaattgtacaggaacatgcatacctatacatgtgtgagtttccgcacgcacgcacattgtgtatataacgtgatggggaacactgaactgaaaggaagttcctaccatactttggtaactgaaactctctaggatcctcaaatgatatgaaactgaactaagcccagtttgacgttgtgttttggtctgggtttttgacactggagctatttcccacaaaccatcctgaagaataatatccagcacagagaatccagaccttctcagcaaacctgtgctagacagacagtcttgagggtcagtcggcaccgtgtcttgactggactcagtacgcactgtctcctgcactgttagctctctgtcgatggagctaaataaaccagggcccctttgagctcaaaagaacgaacttctgtacatgtttgaatttagtcgtccaaatctgaatgtttcaaaacaaaatttctgggatctgaactgctcgaaactcaatcctagagtcacctttgaatgtcacacacagcaatataatgtacatttacatagaaaaatcaaaggaaacgctgtgctcggagctgacggaggaaagtattgtattccacttcctgctacctggcaccttctgaaaggaaggtgggcttacctcctgtcacttagcaggagtcagaacccttctggtagtcactgtataaccttcacctaggagtggttggtgtctaggaagccatgcatcctctgaagaaagaatggcactagaaaaagtattacttcgaaatcgatttctttccattgtgacaaccgaatttcgcatcatcctttgaattgccccaagtgcaccgtgtttcctctgggggaggggtctgctgctctcattcttctggctgctgtattgttgggtttcttcttttccttctgctgggactgtgtggggagcgggtggggtggggggtgggagggctgtggagaacccttcccttgtgcagggcatccatccgtgttgtgaacccagagctgggggccaaagctgcttttgtattcagtgtgaggtggtgtttacagccgactttgacatcagtgggtgtgttctcagtggtgtgtctgtacctgaactatttaatgttgtgtcatgtttatataaagaatatttatgcatacttt

SEQ ID NO: 1496 - DNA, 1146 bp, Rattus norvegicus
  Genbank Accession No. NM_012529
atgcccttctccaacagccacaacacgcagaagctgcgcttcccggccgaggatgaattccctgatctgagcagccacaacaaccatatggccaaggtgctgacccccgagctgtacgcggagctccgtgccaagtgcacgccgagcggctttacgttggacgacgccatccagactggcgtagacaatccgggccacccgtacatcatgacagtgggtgcagtggcgggcgacgaggagagttacgacgtattcaaggaccttttcgaccccatcatcgaggaccggcacggcggctaccagcccagtgatgagcacaagactgacctcaacccagacaacctgcagggcggcgatgacctggaccccaactacgtgctgagctcgcgggtgcgcacaggccgaagcatccgcggcttctgcctcccccctcactgcagccgtggggagcgccgcgccatcgagaagctggcagtagaagccctgtccagcctagatggcgacctgtctggcaggtactatgcgctcaagagcatgaccgaggcggacgagcagcagctcattgacgaccacttcctcttcgacaagcctgtgtcgcctctgctgctggcctccgcgatggcccgcgactggccggatgctcgcggcatttggcacaatgacaataagacgttcctggtgtggatcaacgaggaggaccacctgcgggttatctccatgcagaaagggggcaacatgaaggaagttttcacgcgattctgcactggcctcactcagattgaaactctcttcaagtctaagaactatgagttcatgtggaaccctcacctgggctacatcctcacgtgcccatccaacctgggcactgggcttcgggcaggcgtgcacatcaagctgccccacctgggaaagcacgagaagttctcggaggtgctcaagcgactgcggcttcagaagcgaggcacaggtggtgtggacaccgctgctgtgggtggagtttttgatgtctccaacgctgaccgcctgggcttctcggaggtggagctggtgcagatggtggtggacggagtgaagctactcattgagatggagcagcggcttgagcagggtcagcccattgacgacctcatgcctgcccagaagtga

SEQ ID NO: 1497 - DNA, 3700 bp, Rattus norvegicus
  Genbank Accession No. NM_012532
ccaagaggaagaaacatgaagtttttgctgcttagtgcacttttatttttgcatagttccttagcttggacaagagaaaagcattattacatcggaattactgaagcagtttgggactatgcttctggcagtgaagaaaaggaacttatttcagttgacacggaacagtccaatttctatcttcgaaatggtccagatcgtattggaagaaagtataagaaggccctttattctgagtacacagatggcacctttacgaagactatagacaaaccagcctggctagggtttttaggccctgtcatcaaagctgaagttggagacaaagtttctgttcacgtaaagaactttgcctctaggccctacacttttcatgctcatggggtaacttacaccaaggcgaacgagggggccatctaccctgacaacaccactgattttcaaagagccgatgacaaactgtttcctggacagcagtatttgtacgtgctgcgtgccaatgagccaagtcctggcgagggagacagcaattgtgtgaccaggatttaccactctcatgtggatgctccaaaagatattgcatcaggactcataggaccgttgatactctgtaaaaaaggttctctgcataaggaaaaagaggaaaatattgaccaagaattcgtactgatgttctctgtggtggatgaaaatctcagctggtacctagaagataacatcaaaaccttctgctctgaaccagagaaagtcgataaagacaatgaagacttccaggaaagcaacaggatgtactctataaatggatatacatttggaagcctcccagggctctcgatgtgtgcagaagacagagtgaagtggtacctttttgggatggggaatgaagttgacgtgcattcagagctctttcatggtcaagccctgaccagcaagaactatcatactgatataatcaacctgttccctgccactctaattgatgtttctatggtggcccagaatcctggagtctggatgctcagttgccagaacctgaaccatctgaaagctggtttgcaggcctttttccaggttcgtgactgcaacaagccctcaccggacgacgatatccaagacagacatgtgagacattattacatcgctgccgaggagaccatttgggactatgctccgtctgggacagacaccttcactggagagaacttcaccagtctgggaagtgattcaagggtcttttttgagcaaggtgctacaagaattggtggctcttataaaaaattggtttatcgtgagtacacagatgattccttcacaaaccggaaggaaagaggccctgatgaggaacatcttggaatccttggtcctgtcatttgggcagaagtaggagacatcattagagtcacctttcataacaaaggacaatttcctctcagcattcagccaatgggggtaagattcaccaaggaaaatgagggaacatactatggcccagatggccgttcctcaaagcaagcctcccatgtggctcccaaagaaacctttacgtatgaatggactgtccccaaagaaatgggacccacttatgcagatcctgtgtgcctatctaagatgtattattctggagttgacctcaccaaagatatatttactgggcttattgggccaatgaaaatatgcaagaaaggcagcttacttgcagatgggagacagaaagatgtagacaaggagttctacttgtttgcaacagtgtttgatgagaatgagagtttactcttggatgataatatcagaatgttcacaactgcacctgagaatgtggacaaggaagatgaagactttcaggagtccaacaagatgcactccatgaatggattcatgtatggcaatctgcctggcctcaatatgtgcctaggagaatccatcgtgtggtatttgttcagcgctggaaatgaggcagacgtgcatgggatatacttttcaggaaatacctatctgtccaaaggagaaagaagagacactgcaaatctgtttcctcataaaagtctcacccttctcatgacacctgacacagaagggtcttttgatgttgagtgtcttacaacagatcactacaccggcggcatgaagcaaaagtacactgtgaaccagtgcaaggggcagtttgaagatgtcactctctaccagggagaaaggacctactatattgcagcagtggaggtggaatgggattattcaccaagcagggactgggaaatggagctgcaccatttgcaagagcaaaatgtttcaaatgcatttttggataaggaagagtttttcataggctcaaagtacaagaaggttgtgtatcgagagtttactgacagcacattcagagaacaggtgaagagaagagctgaagaggagcacttgggcatgctcggtccactgattcatgcagatgttggagccaaagttaaagttgtctttaaaaatatggcaacaaggccatattcaatacatgcccacggagtgaaaacaaagagttctacagttgctccaacgttgccaggtgaagttcgcacttatatatggcaaattccagaaagatcaggtgctggaacggaggattcaccttgtatcccatgggcttattactcaaccgtggatcgagttaaggatctctacagtgggctaataggcccattgattgtttgtcggaaatcttatgtgaaagtattcaatcctaaaaagaaaatggagttttcccttttgtttctagtttttgatgagaatgaatcttggtacttagatgataacatcaatacataccccgatcaccctgagaaagataacaaagacaacgaggaattcatagaaagcaataaaatgcatgctatcaatgggaaaatgttcggaaacctccaaggtctcacgatgcacgtgggagatgaggtcaactggtatgtgatggctatgggcaatgaaatagacctgcacactgtacacttccacggccacagcttccaatacaagcacaggggaattcatagttctgatgtctttgactttttccctggaacataccaaaccctagaaatgtttccccaaacgcctggaacctggttactccactgccatgtgactgaccatattcatgcggggatggtaactacctacactgttttaccaaatcaagagactaagtctggctgaaagaaataaattggtgataagtggaatacgagcacaatgacgttgttttaaacatttaaaaaaatcaaagccacacaaatgttcatttgtgagggaattggtaatgccgatggacagatgaacagactgtatcatgacatgtatttgtttgctgggtaacagaatcgctttacatagtccacttacacctgcactgaaaggactctgaaaagtggaaaaaaataagcaaaaccgtatgatcagatgctgtccttgactgtcctcacaggatcactataaagtccactaaactgtctccaactcttctcatcaagtcctctaacaaaccatggggtaagagggtatagaaaagaaggaaagatgaagataccaagatgcactttgtaaaaatctgaaaaacagttgaaggatgctctcggaaaatagagaaagtcaggatccaattatgttacattttgaaaaaatgaaatggagataataaagtaataaattttaaaatgccaat

SEQ ID NO: 1498 - DNA, 4142 bp, Rattus norvegicus
  Genbank Accession No. NM_012544
cgccgcaccgcgcgcaccgcgccatgggggccgcgtccggccagcgggggcggtggccgttgtcaccgccgctcttgatgctgtcgctgctgctgctgctgctgctgccgccgtcgcccgccccggcgcttgaccctggattgcagccgggcaacttttccgcggacgaggcaggggcgcagctcttcgctgacagctataactcgagtgccgaggtggtgatgttccagagcaccgcagccagctgggcgcacgacaccaacatcacggaggagaatgcgcggctccaggaggaagcggccctgatcaaccaggagtttgcagaggtctggggcaagaaggccaaggagctgtatgagtccatctggcagaacttcactgaccaaaagctgcgaaggatcatcggatccgtacagaccctaggacctgccaacctgcccctgacccagcggctgcagtacaactctctgctaagcaacatgagcagaatctactccaccggcaaggtctgcttccccaacaagactgccacctgctggtccctggacccagagctcaccaacatcctggcttcctcacgaaactatgccaaggtgctgtttgcctgggaaggctggcatgatgctgtgggtatcccactgaagcccctctatcaggactttactgccctcagtaatgaagcctacagacaagatggcttctcagacacaggagcctactggcgctcctggtatgagtccccctcctttgaagagagtttggagcatctctaccaccaagtcgagcccctctacctgaacctccatgcctttgtccgtcgcgcactgcaccgccgctatggggacaaatacatcaatctcagaggtcctattcccgctcatctgctgggagacatgtgggcgcagagctgggagaacatttacgacatggtagtgcctttcccggacaaacccaacctcgatgtcaccagtacaatggtacagaagggctggaatgccacgcacatgttccgggtcgcagaggaattctttacctcgctggggctctcccccatgcctccagagttctgggcggagtcgatgctggagaaaccagctgatggacgggaggtggtgtgccatgcctctgcgtgggacttctacaacaggaaggacttcaggattaagcagtgcacgcgggtcacgatggaccagctgtccacagtacaccacgagatgggccacgtgcagtactatctccagtacaaggacctgcacgtctctctgcgtcgaggtgccaaccctggcttccacgaggccatcggggatgtactcgctctctctgtctctaccccagcacatctgcacaaaattggcctgctagaccgtgttgccaatgacatagaaagtgacatcaattacttgctaaagatggccctagagaaaattgccttcttgccctttggttacctggtggaccagtggcgctggggggtcttcagtggacgtaccccaccctctcgctacaactacgactggtggtatcttcgaaccaagtatcaggggatctgcccaccagttgctcggaatgaaacccattttgacgctggggccaagtttcacatcccaagcgtgacaccatacatcaggtactttgtgagtttcgtgctacagttccagttccatcaagcgctgtgcaaggaggcaggccaccagggtccactacaccagtgtgacatctaccagtccaccaaggcaggggccaagctccaacaggtgctgcaggctggctgctccaggccctggcaggaggtgctgaaggacctggtgggttcagatgcgctggatgccagtgcgctaatggagtacttccaaccagtaagccagtggctgcaggagcagaatcagcggaatggcgaggtcctaggctggccggagtatcagtggcgtccaccgttaccagacaactatccagagggaattgacctagagactgatgaagccaaggctaacaggttcgtggaggagtatgaccggacagccaaggtgttgtggaacgaatacgcagaggccaactggcattataacaccaacattaccatagagggcagcaagatcctgcttcagaaaaacaaggaagtgtccaaccataccttgaaatatggcacctgggccaagacatttgacgtgagcaacttccagaactctaccatcaagcggatcataaagaaggttcagaacgtggaccgggcagtgctgcctcccaacgagttagaagagtacaaccagatcctgctagacatggagacgacttacagtgtagccaatgtttgctacacaaatggcacttgtctgtcactggagcctgatctgacaaatataatggccacgtcccggaaatacgaagaattgctttgggtgtggaagagctggcgagacaaggtggggagagccatccttccctttttcccaaagtacgtggacttctccaacaagatcgccaagctcaacggctactctgatgcaggggattcctggagatcctcatatgagtccgacgacttggagcaagacctggaaaaactataccaggagctgcagccgctctacctgaacctgcatgcctatgtgcgccgctccctgcaccgccattatgggtctgagtacatcaacctggatggtcccattcctgctcacctgctagggaacatgtgggcacagacttggtccaacatctatgacttggtggcacccttcccttccgcccccagtatagatgccacggaggccatgataaagcagggatggacacccagaaggatatttaaggaagctgacaatttttttacctccctggggctgttacctgtgccccctgagttctggaacaagtcaatgttagagaagccaaccgatgggagggaggtggtgtgccatgcctcagcctgggacttctacaacggcaaggacttcaggatcaagcagtgtacctctgtgaacatggaggaattggtgatagcccaccacgaaatgggccacatccagtatttcatgcagtacaaagacttgcctgtgacctttcgggagggcgccaaccccggttttcatgaggctattggagatgttttggctctgtctgtgtctacacccaagcatctacacagtctcaacctgctcagcagtgagggcagtggctacgagcatgacatcaactttctaatgaagatggcccttgacaagatcgccttcatccccttcagctacctcattgaccagtggcgctggagggtctttgacggaagcatcaccaaggagaactacaaccaggagtggtggagtctcagactgaagtaccagggtctctgccctccagtgcctagatcccaaggtgactttgacccagggtccaagttccacgttcctgcgaatgtgccatacatcaggtactttatcagcttcatcatccagttccagttccacgaggcactatgtcgcgcagccgggcacaccggccccctgtacaagtgtgatatctaccaatccaaggaagcagggaagctgctggcagatgccatgaagttgggctacagtaagcagtggccagaagccatgaagataatcacaggccaacctaacatgtcagcctctgccattatgaattacttcaagccactgactgaatggctcgtcacagagaacaggagacatggagagacactgggctggccggagtacacctggacaccaaacacggctcgtgcagaaggctccctcccagagtccagtcgcgtcaacttcctgggtatgtacctggaaccacagcaggcccgtgtgggccagtgggtgctgctcttcctaggcgtcgccctgctggtggccaccgtgggtctcgcccaccgactctacaacatccataaccatcacagcctccgccggccccaccgtgggccccagtttgggtccgaggtggagctcagacactcctgaggtgaccctgccgtcaaggccaacagaggagtgtcccattaaaaaaaaattagatgggggacatggtgtttgagtggaacatacccaagctgggccttcttcctttgctgttcccatccactctgccccccagcccagcccccattctctagatacccagcatctaacctggaattc

SEQ ID NO: 1499 - DNA, 1954 bp, Rattus norvegicus
  Genbank Accession No. NM_012545
ttaactgtcaccaaggagagagagagagagcaagagagcgaatagagaggaggcgactccagctgcctttttcaacatggattcccgtgaattccggagaagagggaaggagatggtggattatatagctgactatctggacggcattgagggacgtccagtgtaccctgacgtggagcctggctaccttcgggccctgatccccaccactgccccccaggagccagaaacatatgaggacataatcagagacattgaaaagataatcatgccaggggtcacacactggcacagcccctacttcttcgcttacttccccacggccagctcctacccagctatgcttgcggacatgctgtgcggggctatcggctgcattggcttctcctgggctgcaagcccagcatgcacagagctggagacagtgatgatggattggctggggaagatgcttgagctgccagaggcctttttggctggaagagctggggaagggggaggagtgatccagggaagtgccagcgaagccaccttggtggccctactggctgctcggactaaaatgatccgccagctgcaggcagcctccccagagctgacacaagctgctctcatggaaaagcttgtcgcttacacatctgatcaggcacattcctccgtagaaagagctggattaattggtggagtcaaaataaaagcaattccttcagatggcaactactccatgagagctgctgcccttcgggaggccctggagagagacaaggcggctggcctgattcctttcttcgtggttgtcaccctaggaaccacatcttgctgctcttttgacaatctcctagaagtgggtcccatctgcaaccaggagggtgtatggctgcacattgatgctgcatacgcaggcagtgcctttatctgtcctgagttccggtatcttctgaatggcgtggagtttgcagattcctttaactttaatccccacaagtggcttttggtgaattttgactgctctgccatgtgggtgaagaagagaactgacctaaccgaagcctttaatatggaccctgtttatctgaggcacagtcaccaggactcaggactcatcactgactacaggcactggcaaatcccactggggcgaagatttcgctccctgaaaatgtggtttgtttttagaatgtacggagtcaaggggctgcaggcttacattcgaaagcacgtgaagctgtctcatgagtttgagtccctggtacgccaggaccctcgctttgaaatttgcacggaagtcatcctcgggttggtctgcttccggctaaagggctccaaccagttgaacgaaactctcttacaaagaataaacagcgccaaaaaaatccacttggttccgtgtcgtctccgagacaagtttgtgctgcgctttgcggtgtgctcccgcactgtggagtctgcccacgtgcagctggcctgggagcacatccgagatctagcgagcagtgtgctgagggcagagaaagagtaaaagcagagccgcttcagagacccaaagttgaaaaaaagtttttccgaaaactgggaagagaaaaataaccacccctccgtcttcgtgaaatcatgcttgtatgtggcgtcatgtgtgtctccaaaattaaccagaaactgctgattgacttttcagtgacttctcaatgaagaaatactttctgcattatccagggaaagtattaatctgtgtggaaattaacaccagtggctctagcttctgttctttgtgtggccgtgatttttgttgataataagatgtctcagtgttcataaagccgtaggtggtagaaaaggcttatagaaatattttctagggtggtttttggtctttcttgccttcagatgatatctctggctgttaacttgtcctctgtgtggctaaatacttaataaacaacccgtgtgcaatact

SEQ ID NO: 1500 - DNA, 3112 bp, Rattus norvegicus
  Genbank Accession No. NM_012551
cgcagaacttggggagccgccgccgcgattcgccgccgccgccagcttccgccgccgcaagatcggcccctgccccagcctccgcggcagccctgcgtccaccacgggccgcggccaccgccagcctgggggcccacctacactccccgcagtgtgcccctgcaccccgcatgtaacccggccaacatccggcgagtgtgccctcagtagcttcggccccgggctgcgcccaccacccaacatcagctctccagctcgcacgtccgggatggcagcggccaaggccgagatgcaattgatgtctccgctgcagatctctgacccgttcggctcctttcctcactcacccaccatggacaactaccccaaactggaggagatgatgctgctgagcaacggggctccccagttcctcggtgctgccggaaccccagagggcagcggcggcaataacagcagcagcagcagcagcagcagcagcgggggcggtggtgggggcggcagcaacagcggcagcagcgctttcaatcctcaaggggagccgagcgaacaaccctacgagcacctgaccacagagtccttttctgacatcgctctgaataacgagaaggcgctggtggagacaagttatcccagccaaactacccggttgcctcccatcacctatactggccgcttctccctggagcctgcacccaacagtggcaacactttgtggcctgaaccccttttcagcctagtcagtggccttgtgagcatgaccaaccctccaacctcttcatcctcagcgccttctccagctgcttcatcgtcttcctctgcctcccagagcccacccctgagctgtgccgtgccgtccaacgacagcagtcccatttactcagctgcacccacctttcctactcccaacactgacatttttcctgagccccaaagccaggcctttcctggctctgcaggcacagccttgcagtacccgcctcctgcctaccctgccaccaagggtggtttccaggttcccatgatccctgactatctgtttccacaacaacagggagacctgagcctgggcaccccagaccagaagcccttccagggtctggagaaccgtacccagcagccttcgctcactccactatccactatcaaagccttcgccactcagtcgggctcccaggacttaaaggctcttaataacacctaccagtcccaactcatcaaacccagccgcatgcgcaagtaccccaaccggcccagcaagacacccccccatgaacgcccgtatgcttgccctgttgagtcctgcgatcgccgcttttctcgctcggatgagcttacacgccacatccgcatccatacaggccagaagcccttccagtgtcgaatctgcatgcgtaatttcagtcgtagtgaccaccttaccacccacatccgcacccacacaggcgagaagccttttgcctgtgacatttgtgggagaaagtttgccaggagtgatgaacgcaagaggcataccaaaatccacttaagacagaaggacaagaaagcagacaaaagtgtcgtggcctcctcagctgcctcttccctctcttcctacccatccccagtggctacctcctacccatcccccgccaccacctcatttccatccccagtgcccacctcttactcctctccgggctcctctacctacccgtctcctgcacacagtggcttcccatcgccctcggtggccaccacctatgcctccgtcccacctgctttccctgcccaggtcagcaccttccagtctgcaggggtcagcaactccttcagcacctcaacgggtctttcagacatgacagcaaccttttctcctaggacaattgaaatttgctaaagggaatgaaagagagcaaagggaggggagcgcgagagacaataaaggacaggagggaagaaatggcccgcaagaggggctgcctcttaggtcagatggaagatctcagagccaagtccttctagtcagtagaaggcccgttggccaccagccctttcacttagcgtccctgccctccccagtcccggtccttttgacttcagctgcctgaaacagccacgtccaagttcttcacctctatccaaaggacttgatttgcatggtattggataaaccatttcagcatcatctccaccacatgcctggcccttgctcccttcagcactagaacatcaagttggctgaaaaaaaaaatgggtctgggccctcagaaccctgccctgtatctttgtacagcatctgtgccatggattttgttttccttggggtattcttgatgtgaagataatttgcatactctattgtactatttggagttaaattctcactttgggggagggggagcaaagccaagcaaaccaatggtgatcctctattttgtgatgatcctgctgtgacattaggtttgaaacttttttttttttttgaagcagcagtcctaggtattaactggagcatgtgtcagagtgttgttccgttaattttgtaaatactgctcgactgtaactctcacatgtgacaaaatacggtttgtttggttgggttttttgttgtttttgaaaaaaaaattttttttttgcccgtccctttggtttcaaaagtttcacgtcttggtgcctttgtgtgacacaccttgccgatggctggacatgtgcaatcgtgaggggacacgctcacctctagccttaagggggtaggagtgatgtttcaggggaggctttagagcacgatgaggaagagggctgagctgagctttggttctccagaatgtaagaagaaaaatttaaaacaaaaatctgaactctcaaaagtctatttttttaactgaaaatgtagatttatccatgttcgggagttggaatgctgcggttacctactgagtaggcggtgacttttgtatgctatgaacatgaagttcattattttgtggttttattttacttcgtacttgtgtttgcttaaacaaagtgacttgtttggcttataaacacattgaatgcgctttactgcccatgggatatgtggtgtgtatccttcagaaaaattaaaaggaaaataaagaaactaactggt

SEQ ID NO: 1501 - DNA, 1725 bp, Rattus norvegicus
  Genbank Accession No. NM_012554
agtgctgctccggtaccgagtcgcgctcacgtttgtccttaagactcccttcggtgtctccaggaccctctttccttcctccgcagcgatcctactgccagaacttcaccatgtccattctcaagatccatgccagagagatctttgactcccgcgggaatcccaccgttgaggtggatctctacaccgcaaaaggtctcttccgtgctgcggtgcccagcggtgcgtccactggcatctacgaggccctagaactccgagacaatgataagacccgcttcatggggaagggtgtctcaaaggctgttgagcacatcaataaaactattgcacctgctctggttagcaagaaactgaatgttgtggagcaggagaagattgaccagctgatgatcgagatggacggcacagagaataaatctaagtttggtgcaaatgccatcctgggagtgtccctggctgtctgcaaggctggtgccgtggggaagggggtgcccctttaccgtcacattgccgacttggccggcaaccctgaagtcactctgccggtcccagctttcaatgtgatcaacggcggttctcatgctggcaacaagttggccatgcaagagttcatgatcctgcctgtgggggcatcctctttccgggaagccatgcgcattggagcagaggtttaccacaacctgaagaacgtcatcaaagagaagtacgggaaagacgccaccaatgtgggtgatgagggtggattcgcacctaacatcctggagaacaaagaagcactggagctgctcaagtctgccattgcaaaggccggctacactgaccaggttgtcatcggcatggatgtggctgcctccgagttctacagggctggcaagtatgacctggacttcaagtctccagatgatgccagccggtacatcacacccgaccagctggccgacctgtacaagtccttcatcaaggactacccagtggtgtccattgaagatccctttgaccaggacgactgggatgcttggcagaagttcacagctactgcaggcatccaggtggtgggggatgacctcacagtgaccaaccctaagcggatcgccaaggctgcaggcgaaaagtcctgcaactgcctcctgctcaaagtgaaccagattggctctgtgaccgagtctctgcaggcgtgtaagctggcccagtccaatggctggggtgtcatggtgtcccatcgatctgaggagactgaggacactttcattgccgacctggtggtggggctctgcactgggcagatcaagactggtgccccctgccgatctgagcgcctggccaagtacaatcagatccttagaatcgaggaggaactgggcagcaaagccaagtttgccggcaggtccttcaggaaccccctggccaagtaaggcatggaccggagatccctggagctaccagatcctctgtctccgtcatccaggcggctcaaggctggcccagtgcttgcccctcccatgtcactgcttccttagatgtccaccccgaccacctggagccctgctggagcccccagctttgtaatcatgtgatcagtctgaatcattgtttctgtcacctgactttccagctagtgtctggagccctctgaactccagcgtaatctctagagtgcccacaccatcaagactccccccagtggtttacttgcaaaaataaaagctgcagaagctcaaaaaa

SEQ ID NO: 1502 - DNA, 4991 bp, Rattus norvegicus
  Genbank Accession No. NM_012555
gaattcggcacgaggcgccggccagccgagagagtgagcgagcgcccgggacagaggagcgagcgggcgaggcgcgggcgaggctgggacccaagctcgctctctgctccgccaagtgccaacttcgcgccgactggctgggcgcgcacctttctgccgggcgatcagcgggaatttgagattttagggctgcgctctgtccccttcccctgagttcaaaatccctattaaaaagcaaaacaacagttacagcaaacttgctctcatcccgccggccccctcaactccggcaccatgaaggcggccgtcgatctcaagccgactctcaccatcatcaagacagaaaaagtggatttggagcttttcccatccccggatatggaatgcgcagatgtcccactgttaactccgagcagcaaagaaatgatgtcccaggcactgaaagctaccttcagtggtttcacaaaagagcagcagcgactgggaatccccaaagacccccggcagtggacagaaacccatgtccgggattgggtgatgtgggctgtgaatgagttcagcctgaagggtgtggacttccagaagttctgtatgaatggagcagcactgtgcgccctgggtaaagaatgcttcctcgagctggctccagactttgtgggggatatcctgtgggagcatctagagatcctgcagaaagaggatgtgaaaccgtatcaggttaatggagtcaaccctacctacccagaatcccgttacacctcggattacttcattagctatggtatcgagcatgctcagtgtgtccctccctcagagttctcagagcccagcttcatcacagagtcctatcagacgctgcatcccatcagctcggaagaactcctgtccctcaagtatgagaacgactacccttccgtcattctccgggaccctctccagacagacaccttgcagacagactactttgccatcaagcaagaagtgttaactccagacaacatgtgcatggggagagccagtcgtggtaaactcgggggccaggactcttttgagagcatagagagctacgatagttgtgaccgtctcacccagtcctggagcagccagtcatctttcaacagcctgcagcgtgtcccctcctatgacagcttcgactccgaggactatcccgctgccctgcccaaccacaagcccaagggcaccttcaaggactatgtgcgtgaccgtgctgacctcaacaaggacaagcctgtcattcctgctgctgccctggctggctacacaggaagtgggccgatccagctgtggcagtttcttctggaattactcactgataagtcttgtcagtcttttatcagctggacaggagacggctgggaattcaagctttccgacccagatgaggtggccaggagatggggaaagaggaaaaacaagcctaagatgaattatgagaaactgagccgcggccttcgctactattacgacaaaaatatcatccacaagacggcgggcaagcgctacgtgtaccgctttgtctgcgacctacagagcctgctgggatacaccccagaggagctgcatgccatgctggatgtgaagccggatgctgatgagtaacggacacggaaggggctgggggggaccgctgagacctttcaaagaacaacccgtgttggttggactcttaatttttaattgttattctatgttttattttccagaactcatttttcacattcaggggtgggagctaagggagttgcagccacattccattggccattggcaaggccggaaagggaaagtcaggacctgtggggtgggtggggcaagaagttcctgaggagatttttcaggagcgagagggtcttctcagaagccgagcgacttgacttacagaggaaaaggtttatgtgtccagtattctgtttgcaatcaaaggaaagagttcatcttgagttgtggatcgactagcaggaggaattgtcacgttaagatgaaagtcagtcagcgttggtgggtgggaggaaaacagtttcttcaggggatgactaaacgcaagaatttattaacctttctactttttttgaaacaaagatggactttaatggaagggatccaaaactgtttttattgttgaagtttattttattaaattctgtgccagtattttttttcttaaaaaaaatcgtcttaagctctaaggtggtctcagtattgcagtattgtgagttcgttgtaatttgctggctgaggagtctcccacaatgaaaggcagctgtttatatagaccccatggaaaaatccaagtctgtactgagaacagagacccccgaactcttacagctaaaggacgtgaatgctgatttggggaccagggaactgtgtgaattccacctgcggtttgtaaaacaacatttccagtccttttacttactgtcaggctgcgggcttagtgttagttaaggggcattaagtctttgcactgaatgtatttttgcagctctgctttggaactgttgtcagcataggtgcactgtttaagtcttggaaaagaaatcgaaggaggaagttgaacctggtttttggttaaatcgctacccgaaacatagaagactcaaactaaatgctgtttgcatgggcattacccctcggatcttaaggcctaaatgcatgccgttccaaactaacattgtacaatttctcctttatggcttatttccccagttcaccacattgctgcccctccccaccttactaatcagtagagtggaatgtaatgtttcctgataggtgaatgaaagtgtaatttcagacatcacagcacaaatcaaagagtacagactttctagggttcagagagcatggaaacgaggaggctatttcaggagcatgggacatggcctcctttgggaagaggctttcctttgaagaattggagcttgtcaggtaggatttcaggtgaggctgtttgcagatgaagtggtagagagcactgggacttcgagcttgacctgttgctacctcggcagagttaagcgaaagtcagctgcggatgagaggaaaacttgatggagggaatacaacggcaggagctaagaacggagaataaggtggcccgtgacagtgaggtatagttttactttcctcaaagtttaaattcaaagacttaatcgaggcagccatcttcctgccagttgagagaggagactggaaagtaaggcattgtgggtaaaaacaaagtaaggaaacatgcctggtatcattagaatccctcccactgtttaccacgcctagttgagacagcgactgtggacttccatgagagaaaagaggcagttggttgaggtggacctctccaggctcacccttcggggattgtaactacctggtatcatcttcatgagagttgatggctgactcccagattcccttgaagactctgaattcctgcgaacataacttgtccatgggtgttctgtactgaccgattggagcatccccaccggaagcaaaggcaaaacatcccagctctatgttttgatcttaacaaatgcaggtgccttaatgaagctctcaaagtatttaggagctgctcagggagtgttaggtgggatcatttggattatgttgtttttctcttatattatgtgatctttgttgggcactggcagtgtgtgtgtgtgtgtgtgggtgtgtgtgtgtacatttgtataagcctgcagctgaaatagtactgacttttctacttaagtctgtccacatttccataacggcgaaagagtacatacagccagggctgatttcatttctcgctctttgcaacagggcttaaataaaaaaaaaatcacttccccaagtcgtcgtccttgcccctattcagttcatgctgaaaacgcccctctcgagagcctaccgcctgcagccagtagcagataagacgtaagaaagtgcctcccacacggctcagcttgctgacttgcttctccccaggtccaccactttcaggatttgtagataggatattagtcagcttggtggtccatctggccagacgctctttcccatgctgtccaaaggccagagaccatcccaggaagagtggcgggtggtttatacactggaaatgtagcggcattgctgcattgatgctctacaaaaacacgttcacttcagaggaaggatgagcacatctgatccagctgggtggctccattgttttcccagagagatgctttaacctgtgcggttggcttttggctcagagctcaggggaataaggatgctccctgcatagagctctgaccgttgcgccatggaaaccagtggaagcactctagatcagagacactcttcctcactttggagatcaacactctgggttttaaagcattaaccttcatggtgaaatcacaccttctctcttctagccatgctgtgcatgccgctttctctgtcggggggtctctataaatttgttgaactcttacgtacattccaaagaagtttcaaggaaccacaagtatatgtatacaaatacatatatgaagtatatatgttaaaatgaaattatctctatcaggaatactgcctcagttaattgaattttttttaaggatacttttttttaagcggagaattattggggtgtaaaagatgttatattgtgtttgactattttccagcttgtattttcacataatttatattttttaaatgctgaaaatttaaaagcgagatttaaaaaggaaaagcaggtgctttttttttaaaaaaaagaatcagaactgaggtagcttagagatgtagccatgtaagtgtcttaaatgttttgtttttaaaaaaaaaacaaatgcaaaaaaattcttatgggggagttttttgtttgtttcttttagtagctgatgctggcacattttgctggaaagttttttatatactgtagcctgatttcatattgtattttaaactgtgctcgtgccgaattc

SEQ ID NO: 1503 - DNA, 1357 bp, Rattus norvegicus
  Genbank Accession No. NM_012558
gagcttctgcagacactgtatagcgttcagtcctcctgctgtgactatcacctgggggactcacctgcctgcacctttagccagcacctacagacagtacctgtgccagaccccagcaatggtggaccatgcgcccttcgaaacggatatcagcaccctgacccgcttcgtcctggaggagggcaggaaggctgggggcacgggcgagatgacccagctgctgaattcgctctgcaccgcgatcaaagccatctcgtcagcggtgcgccaggccggcatcgctcagctctatggcatcgctggctcaaccaatgtgactggggatcaagtgaagaagctggacatactttccaatgacctggtgatcaatatgctgaagtcgtcctatgctacctgtgtccttgtgtcggaagaagatacacacgccatcataatagagcccgagaagaggggcaaatatgttgtctgttttgatcccctcgatggctcatccaacatcgactgcctcgcgtccatcggaaccatctttggcatttacagaaagacatctgctaatgaggcttcggagaaagatgctctgcagccaggcaggaacctggtggcagcaggctatgcactctatggcagcgccaccatgttggtcctggccatgaattgtggcgtcaactgcttcatgctggacccgtccattggagaattcattttggtggacagggatgtgaagatcaagaagaaaggtaacatctacagcattaatgagggctatgctaaggactttgaccctgccatcaatgagtatatccagaggaaaaagttccctccggataattcagctccctatggtgcccggtatgtggggtccatggtggctgatgttcaccgcactctggtgtatggagggatcttcttataccctgccaacaagaaaaatccatctggaaagctgcggctgctgtacgagtgcaatcccatcgcttacgtcatggagaaggccggtggacttgccacgacggggaatgaagacatattagacatcgtccccactgagatccaccagaaggcaccagttatcatggggtccaccgaagacgtgcaggagttcctggagatctacaataaggacaaagccaaatcaaggccgtccctgcccctgccccagagcagagctcgtgagtcaccggtccattctatctgtgacgaacttttctagaaacaaacccaacagcgcggatagtttcagggccgaatgccttgcaatgcccaaggttgcctcgcctagatgctataatgccactgtatcaggtactatatatttcgaataggtgaaggagaaataaacatattcttccttcataaa

SEQ ID NO: 1504 - DNA, 1358 bp, Rattus norvegicus
  Genbank Accession No. NM_012559
agtgctggctgtaaggggctgggagcaccggtcacccagacactatgaattggtccttgcaactccggagtttcattctatgctgggcgcttttactactttctccaacgggcctggcacagtacactgctactagagataactgttgcatcctagatgagagattcggtagttactgcccaaccacttgtggcatctcagacttcctgaattcttaccaaaccgacgtggacactgacctccagactctggaaaacatcttacaacgagctgaaaacagaaccacagaagccaaggaactgattaaagccatccaggtttactacaacccggaccaacccccaaagccgggtatgatagagggtgccactcagaagtctaagaagatggtagaagaaatcttgaagtacgaagcactgttactaacccatgagtcgagtatccggtatttacaggacatctatacttcaaataagcagaagatcacgaacctgaaacagaaggtggcccagcttgaagctctgtgccaggagccttgcaaggactctgtgcgaatctatgacataaccggaaaagattgtcaggataccgccaacaagggtgccaaagaaagtggactttactccattcggcctttgaaagccacggagcagttcttagtgtactgtgaaaccgacggacctggaaatggctggaccgaattcaagaagaggcttgatggcagtgtggatttcttgaagaactggattcagtataaagaaggatttggacacctgtcacctactggcaccacagagttttggctgggcaatgagaagaatcatctgataagcatgcagtccaccatcccatacgcactgagaatacagctcaaagactggagtggcaggaccagcaccgcggactatgccatgttcagggtgggtcctgaatccgacaaataccgcctgacctatgcctacttcattggtggagatgccggggatgccttcgacggctacgattttggtgatgatcccagtgacaagtttttcacatcccacaacggcatgcacttcagtacctgggacaatgacaacgacaagttcgaaggcaactgtgctgagcaggatggatctggctggtggatgaacaagtgtcacgctggccacctcaatggagtttattaccaaggtggcacttactccaagtcatctactcctaacggttatgacaatggcattatttgggccacgtggaaaacccgctggtattccatgaaggaaaccaccatgaagataattcccttcaacagactctccattggagatgggcagcaacatcacatgggaggatccaaacaggttggagacatgtaa

SEQ ID NO: 1505 - DNA, 1035 bp, Rattus norvegicus
  Genbank Accession No. NM_012561
atggtctgcgccaggcaccagcccggcgggctctgcctcctgctgctgctactctgccaattcatggaagaccgcagcgcccaggctgggaattgctggctccgccaagccaagaacggccgctgccaggtcctgtataagacagaactgagcaaggaagagtgttgcagcaccggccggctgagcacctcgtggaccgaggaggatgtgaacgacaatactctcttcaagtggatgattttcaacgggggcgcccccaactgcatcccttgtaaagaaacgtgtgagaatgtggactgtggccccgggaaaaagtgccgaatgaacaagaagaacaaaccccgctgcgtctgtgccccagactgttccaacatcacctggaagggtccagtgtgtgggctcgatgggaaaacctaccgcaacgaatgtgcgctcctcaaggccagatgtaaagagcagccggaactggaagtccagtaccagggcaaatgtaaaaagacttgcagggatgttttctgtccaggcagctccacttgtgtggtggatcagaccaataatgcctactgtgtgacctgtaatcggatttgcccggaaccctcatcttcagagcagtccctttgcgggaacgatggtgtgacttactccagtgcctgccacctgagaaaggccacctgcttgctgggcagatccattggattagcctatgagggaaagtgtatcaaagcaaagtcttgtgaagacatccagtgcggtggtggaaaaaaatgcctatgggatttcaaggttggcagaggtcgctgctctctctgcgatgagctgtgcccggacagtaagtcggatgagcccgtctgtgccagcgacaatgccacgtacgccagcgagtgtgccatgaaggaagctgcctgctcctccggcgtactgcttgaagtgaagcactccggatcttgcaactccatctcggaagaaacggaggaagaggaggaagaggaagaccaggactacagcttccctatctcttccactctagagtggtaa

SEQ ID NO: 1506 - DNA, 1966 bp, Rattus norvegicus
  Genbank Accession No. NM_012563
gggcgtgcggggtcgagccgaagcagcttgcccgcagccactcggaggcgaccagcgccagactagcagaacccatggcatctccgggctctggcttttggtccttcggatctgaagatggctctggggatcctgagaacccgggaacagcgagagcctggtgccaggtggcccaaaagttcacgggcggcatcggaaacaagctatgcgctctgctctacggagactctgagaagccagcagagagcggcgggagcgtgacctcgcgggccgccactcggaaggtcgcctgcacctgtgaccaaaaaccctgcagctgccccaaaggagatgtcaattatgcacttctccacgcaacagacctgctgccagcctgtgaaggagaaaggcccactctcgcatttctgcaagatgtaatgaacattttgcttcagtacgtggtgaaaagttttgatagatcaactaaagtgattgatttccattaccccaatgagcttcttcaagagtataattgggaattggcagaccaaccgcaaaatctggaggaaattttgacgcactgccaaacaactctaaaatatgcgattaaaacagggcatccccgatattttaatcagctgtctaccggattggatatggttggattagcagcagattggttgacatcaacagcaaacacgaacatgtttacctatgagatcgcccctgtatttgtactactggaatatgtgacactaaagaaaatgagggaaatcattggctggccaggaggctctggcgatggaatcttttctcctggtggtgccatctccaacatgtacgccatgctcattgcccgctataagatgtttccagaagtcaaggaaaaggggatggcggcggtgcccaggctcatcgcattcacgtcagagcatagtcacttttctctcaagaagggagctgcagccttggggatcggaacagacagcgtgattctgattaaatgtgatgagagagggaaaatgatcccatctgaccttgaaagaagaatccttgaagtcaaacagaaaggatttgttcctttcctggtgagtgccacagctggaaccactgtgtacggggcttttgatcctctcttggctgtagctgacatctgcaaaaaatataagatctggatgcatgtggatgctgcttggggtggagggttactgatgtctcggaaacacaagtggaagctgaacggtgtggagagggccaactctgtgacatggaatccccacaagatgatgggtgtccccttgcaatgttcggctctcctggtcagagaggagggactgatgcagagctgcaaccagatgcatgcttcctacctctttcagcaagataagcactatgacctgtcctatgacacgggagacaaggccttgcagtgtggacgccacgtcgatgtctttaaattatggctcatgtggagagcaaaggggactactggatttgaagctcacattgataagtgtttggagctggcagagtatttatacaatatcattaaaaaccgagaaggatatgaaatggtgttcgatgggaagcctcagcacacaaatgtctgcttctggtttgtacctcctagtttgcgagttctggaagacaatgaagagagaatgagccgcctctcaaaggtggcgccagtgattaaagccagaatgatggagtatgggaccacaatggtcagctaccaacccttaggagataaggtcaacttcttccgcatggtcatctcaaaccctgcagcaactcaccaagacattgacttcctcattgaagaaatcgaacgcctgggacaagatttgtaatcactttgctcaccaaactttcagttctctaggtagacagctaagttgtcacaaactgtgtaaatgtatttgtagtttgttccagagtaattctatttctatatcgtggtgtcacagtagagtccagtttaaaa

SEQ ID NO: 1507 - DNA, 1676 bp, Rattus norvegicus
  Genbank Accession No. NM_012564
gcttccctttgcacggtgtcctgtgggtgagaggaggtgctgcaggactccctggacgcaaaatgaagagggttctggttctcctgctggccttagcctttgggcatgccctagagagaggccgagattatgagaaggataaagtttgccaggaactctccacgctggggaaagatgacttcagatctctatcactaatcctatacagcaggaagtttcccagtagcacctttgaacaggtcagtcagcttgtgaaggaagttgtctccttaactgaggaatgctgtgctgagggagcagatcccaactgctatgacaccaggacttcagagctgtctattaagtcctgtgaaagtgacgccccctttcctgttcaccccgggacttccgagtgttgcacgaaggaggggctagagcggaaactctgcatggctgccctcagtcaccagccacaggaatttcccgcctatgtggagccgacgaatgatgagatctgtgaggcgttcaggaaggatccaaagggatttgccgatcagtttctattcgaatattccagcaattacggacaagctcctctgccacttttagttggttacaccaagagttatctctctatggtcggctcctgctgtacttctgcaaaaccaactgtgtgctttttgaaggagagactccagatgaaacagttactacttctcaccactatgtcaaacagagtctgctcacaatatgctgcatatggaaaggaaaaatcaaggatgagccatctcataaaactagcccaaaaagtaccaactgctaacctggaggatgttctgccactcgctgaagaccttactgaaatcctgtccagatgttgtaagtctacctcagaggactgcatggccagagagctgcctgaacacacattaaaaatctgtggaaacttatccaaaaagaattcaaagtttgaagagtgctgttacgaaacaacacccatgggcatttttatgtgtagctacttcatgccaactgctgaaccacttcaattgccagccatcaagctgccaaccagcaaagacctctgtggtcagagtgccacacaagccatggaccagtatacatttgaactaagcagaaggacccaggttccagaagtgttcctcagcaaagttctggatacgaccctgaaaacccttagggaatgctgcgacactcaggactctgtctcctgtttcagcactcagagtcccctgatgaagaggcaactaacttctttcattgaaaaggggcaagaaatgtgtgcagattattccgagaacacatttactgagtacaagaaaaaattggcggaacgactgaggacaaaaatgcccaatgcctccccggaagagctggcagacatggtggccaagcactcagactttgcctccaagtgctgctccataaactctcctccacgctactgtagctcacagattgatgcagaaatgagagacatcctgcagtcctgatgcagggtatatgcaatgccttggacctagaactggaccactctggaaaattgccagataacaaaatcaagcaaataccacagagatggccttccaagaagaccaccaagataattccatttttcccatctacaatgttttttgatgaattataaaaataaattgaaatatagtgcaaactct

SEQ ID NO: 1508 - DNA, 1779 bp, Rattus norvegicus
  Genbank Accession No. NM_012578
ccggagcaggccggccaccatgaccgagaactccacctccaccccggcggcgaagcccaagcgggccaaggccgccaagaagtccacggaccaccccaagtattcagacatgatcgtggctgccatccaggcagagaagaaccgcgccggctcctcgcgccagtccatccaaaagtatatcaagagccactacaaggtgggtgagaacgccgactcccagatcaagttgtccatcaagcgcctagtgaccaccggtgttctcaagcaaaccaaaggggtgggcgcctcggggtccttcaggctggccaagggcgatgagcccaagaggtcggtggctttcaagaagaccaagaaggaagtcaagaaagtggccactccaaagaaggcagccaagcccaagaaggctgcttccaaagccccaagcaagaaacccaaagccaccccggtcaagaaggccaagaagaagccggctgccacgcccaagaaagccaaaaagcccaagattgtcaaagtcaagccagtcaaggcatccaaacccaagaaggccaaacccgtgaagcccaaagccaagtcgagtgccaagagagccagcaagaagaaatgacaatgaaggctttgcttggggacactccttcctccctcctgttttctgtaaatacatttctctcttgatcccatctgcaaccctttgcccattctatttggactctatatagaggacagagtttggcttcctcagacagactttgtggaatattttccttaacccattgttcaaggacagcaaacagacctcatctttataatgatggagatgtacttttttcttgatttgatattaaccttatggggttgtgggggggggcgttgtgtgtttccttcggtggtttgtttactatgaaggtaaatggaactggcaaagttctgggtaggtgaggacccaggaactaggttgcttgtccctagtgagcgtttcagaacctttgatgagcaggtgatacccatctacctggccaaggggggttgttggggagaagagaataaactccctgggctgccctaccaatggtggtaagttgggggacctgatttctttttctcttctgccctagtgcctctccaagtgacagctggttagagaagccatagcttctcacaaccgggatttagccattgggaaggaagggtcttctcagcagtctccggttaaatgggagtggacttaggggaggggtgcagagtcagccaagtgcctcagtgtgtctatggaaacttgggtctttccacacggttgatggattgtgtcctaggaggacgttgttcgtttcctttcccctcttcctgtgtaagatgtggcattgcttggtgccacttcagttctaccagcggccacttaaaacccctccaagcttttgagtcttttctaagtagccgaggagggggagaggcagggagtggactgtgggatatactcccgtggattcgaatttgcctaggtagctttagagaagcggattgtgtgcatgtgtgtatatgtatatatccatatctaagactagtacttagtctcacctcgggagctgggagaaaaactctgtacagttgtcctcttattttaataaagtaggaaactcgggtaccctaccccactttttaaacaagtgtaactagtgccgggaaaaaattactgtggttgtaattttaaaactttaaaataaaactggaaaggaaaaaaaaaaaaaaaaaaaaaaaaaaaaaaaaaaaaaaaaaaaaaaaaaa

SEQ ID NO: 1509 - DNA, 870 bp, Rattus norvegicus
  Genbank Accession No. NM_012580
atggagcgcccacagctcgacagcatgtcccaggatttgtccgaggccttgaaggaggccaccaaggaggtgcacatccgtgcagagaattctgagttcatgaggaactttcagaagggtcaggtgtccagggaaggctttaagctggtgatggcctccttgtaccatatctatacggccctggaagaggagatagagcgaaacaagcagaacccagtctatgccccgctctacttccctgaggagctgcaccgaagggctgccctagagcaggacatggccttctggtatgggccccactggcaggaggccatcccttacacaccagccacacagcactacgtaaagcgtctccacgaggtgggaggtactcatcctgagctgctggtggcccacgcatatacccgctacctgggtgacctctcagggggtcaggtcctgaagaagattgcgcagaaggccatggccttgccaagctctggggaaggcctggcttttttcaccttcccgagcatcgacaaccccaccaagttcaaacagctctatcgtgctcgcatgaacactctggagatgacccccgaggtcaagcacagggtgacagaagaggctaagaccgccttcctgctcaacattgagctgtttgaggagctgcaggcactgctgacagaggaacacaaagaccagagtccctcacagacagagtttcttcgccagaggcctgctagcctggttcaagatactacctctgcagagacgccccgaggaaaatcccagatcagcactagttcatcccagacaccgctcctgcgatgggtcctcacactcagtttcctgttggcgaccgtggcagtgggaatttatgccatgtaa

SEQ ID NO: 1510 - DNA, 2352 bp, Rattus norvegicus
  Genbank Accession No. NM_012588
gggagcagcgagcaagcaggtcctcagcgtccagtcaccgctctaagccaggcgccatgcatcccgcgcgccccgcgctctgggcggctgcgctcaccgccctcactctgctccgcggaccgccagtggcgcgggccggcgcgggcgcggtgggcgcgggccccgtggtgcgctgcgaaccgtgcgacgcgcgtgcgctggcccagtgcgcgcctccgcccaccgcgcccgcgtgcacggagctggtgcgagaacccggctgcggctgctgcctgacttgcgcgctgcgcgaaggcgacgcgtgcggcgtctacacggagcgctgtggcaccggcctccgctgccagccgcgaccggccgagcagtatcccctgaaggcgctgctgaatggccgcgggttctgcgccaacgccagcgccgccagcaacctgagtgcctacctcccctcccagccgtctcctggaaacaccactgagtctgaggaggaccacaatgctgggagtgtggaaagccaggttgtccccagcacacatcgcgtgactgattccaagttccatccactccattcaaagatggaggtcatcataaaaggccaggctagggacagccagcgctacaaagttgactatgagtcccagagcacagacacccagaacttctcctccgagtctaagcgggagacagaatatggtccctgccgcagagaaatggaggacacactgaatcatctgaagttcctcaatgtgctgagtcccaggggcgtccacatcccaaactgtgacaagaaggggttctataagaagaaacagtgtcgcccttccaaaggcagaaagcggggcttctgctggtgcgtggacaagtacgggcagccattgccaggctatgacaccaaggggaaagacgacgtgcattgcctcagcgtgcagagccagtagataccgctgtgccacttaacgtggagctcaaatacgccttattttgcacaaaagactgccaacaacgtgatcagcagctggctataccttgatttatatttctctctctctctctctctctctctctctctctctctctctcttttgtggtgaactgaataaaaacaaacaaaacacatacaaaaacaaaaacaaaaaaaaaagccaagtttagacagatttctgaaatgcctctggttgtttaaatagtgaacttggtcatctttgtatctcgcagtagtcaaccaaaagcagtttgaattttcttgttgcttcctatgaaaaccacacgtgtactccaggccacggatgccgtcgccccctaactcacccacccactgtgggcttcagtgctgctggccctctgccttcttgatttcagaggctctgttgctgatagagaaaaaccctctttccatcccctgtaagtaagtgcaggcactgtggagaatggggaagcctggaacccagtgacccggacgtctggaagcatcctcctgaggcctctggtccttattgtgccatctctgaatcaagggcctggccctgtatctgcaagtggcctgacctacttgggaactgtgggagagaaaaatgtgttgtctctcttactaaaaatgactaagaatgttctagggcgctccgagagcccataaagacaaggacaaggaccttcctttgtcaggcagcttcctgatgacttggcccagcagaaatatcaaactccatgtgcagagatgtcgcaaataacggtgcgcttagttctccggatgacttcaagaaaacagtgttttctggcccagcctctcaaaataaaatttgttgtggggtggggctgaggggaggcagctttcaaaagagagaaggttttcatcttccttgttggagaccctggtaagaacatggagagaatcacctgtttgttgatcttggggtccttctcaaactttctttataattcatgcgtatatgcagacaaaatatgttcttaattgttaacattgtatacaacatagcccaaatatattagaatctgtactagataatcctagataaaaggttagagatgctaggtgatgtaaccacagacacgcccgaggaaaggagcctgtgtctggaggctgggccgctttccccgaggccaaggccatggtggtctggcaatacagggtgtgaggagactgtactgcatcccacggggtggacatgcgctgtacagagctttccttgagagcacaaaggaatcttgagacattctgcctgcctgtcagcttttctttatttttttaattaagtttttgggggaaaaatgtatttttgaaaagtttgtcttgcaatgtatttataaatagtaaataaagtttttttactatttaag

SEQ ID NO: 1511 - DNA, 2104 bp, Rattus norvegicus
  Genbank Accession No. NM_012592
tggtatacagcggagatggcgactgcagtccggctgctggggcggcgagtttccagttggagactgcggcctttaccgtcgccccttgctgtcccgcagcgggcccactcgatgttgcctgtggatgatgatatcaacgggctaaacgaggagcagaagcagcttcgtcatacgatatctaagttcgttcaagagaacctggcccccaaggcccaagagattgatcaaagcaatgacttcaagaacctgagagagttctggaagcagctgggaagcctgggagtcctgggcatcacagcccccgttcagtatggtggctctggcctgggctacctagaacatgtgttggtgatggaagagatatcccgggcttcagcagctgtggggctcagctatggcgctcactccaacctctgcatcaaccagattgtccgcaatgggaatgaggcacagaaagagaaatatcttcccaagctcatcagtggtgagttcatcggagccctggccatgagtgagcccaacgctggctctgacgttgtctccatgaggctgaaagcagagaagaaaggagatcactacgttctgaatggcaacaagttctggatcaccaatggccctgacgctgatgtcctagttgtctatgccaagacagacttgactgctgtgcctgcgtctcggggcatcacagccttcattgtggaaaaggatatgcctggtttcagcacctcgaagaagctggacaagctaggcatgaggggctccaacacctgtgagctagtctttgaagactgcaaggttcctgctgctaacatcctgagccaagagagtaagggtgtctacgtactgatgagcgggctggacctagaacgcctggtgctggcaggtggaccccttgggatcatgcaggctgtcctggaccacaccattccctatttgcatgtgagggaagcctttggccagaagatcggccaattccagctgatgcagggaaagatggctgacatgtacacccgcctcatggcatgtcgacagtatgtctacaatgtcgccagggcctgtgacgagggccacatcactgccaaggactgtgctggtgtgattctgtatacagccgagtgtgccacacaagtagccctggatggcattcaatgtttaggtggaaatggctacatcaatgacttccccatgggccgctttcttcgagatgccaaactgtacgagatcggaggtgggaccagtgaggtgaggcggctagtcattggcagagctttcaacgcagacttccgctagcctggggccatcaccctgctcccagcagcaggaggcctttggaagcagagacgtggcagccctctgacttggctaaggaagctctgctgctcaactgccctcttgccagccctctgctcttcgtgaagtcggattctccagccgtgccagccagtcaatcaagaaagcctaaaattcggtccccagctccgaaaaaaaaaaaaaaaaaaaagaaccaaaagaaagcctaaaatggctgctaaaaggactttggcttttctggggtttgcagggagggtaacagtgtctgcgcccttgttctctacttctgaatgtagtaacctcaccctctggggtagcatatgacaggtacccaactccttttcgtgggcaagcctctggcaggggagctctttctgttgcaatgtaacagaggcattgcctctttcaattgtcagatacttgtggtctcttttcttgaggaaaaggcaaaaaccatgtccttcttagctgtttccccaagagctagctagacagttccagaatgcctgtgtggcagacccatgaagggcagagtccacagtctagccaagacaacttggagattggctccctggtgtggctgagtgtctacatcactccgtcacaggctagcactgggcctgctcacgtgaccttctgcagctgcctgactccggtggcccagcttaggttgcctggctcaactccagccttgctgtctatgtatatttctctagacgccctgtggctaattttgttacaaccacacaggctctgctgccattttgtattaaacatactgcaaagtaaaaaa

SEQ ID NO: 1512 - DNA, 786 bp, Rattus norvegicus
  Genbank Accession No. NM_012593
atgtggttcctgatcctattcctcgacctgtccctggggcagattgatgctgcacctcccggccagtctcgggttattggaggatataaatgtgagaagaattcccaaccctggcaagtggctctatacagcttcacgaaatacctctgcgggggtgtcctgatagaccccagctgggtgatcacggctgcccactgctctagcaacaattaccaggtttggctgggccgaaacaacctattagaagatgaaccatttgctcagcaccggcttgtcagtcaaagcttccctcaccctgactacaaaccattcctcatgaggaaccacacccgaaaacctggcgatgaccacagcaatgatctgatgctgctacatctcagccagcctgcggacatcacagatggggtgaaggtcatcgatctgcccactgaggagcccaaggtggggagcacctgccttgcctcaggctggggcagtaccaaaccccttatatgggaattccctgatgatctccagtgtgtgaacatccacctactgtctaatgagaagtgcatcaaagcctacaaagaaaaggtgacagatctgatgctgtgtgcaggagagttggaaggaggcaaagacacttgcacgggtgactcaggaggccccctcctctgtgatggtgtgctccagggcatcacatcatggggctctgtcccatgcgccaaaaccaacatgccagccatctacaccaaacttattaagttcacctcctggataaaagaagttatgaaggaaaacccctga

SEQ ID NO: 1513 - DNA, 1761 bp, Rattus norvegicus
  Genbank Accession No. NM_012600
atggatccccgagccccccgccgccgacacacccaccagcgcggctacctgctgacgcgggacccgcatctcaacaaggacttggcttttactctggaagagaggcaacagctgaagattcatggcttgttgccaccctgcattgtcaaccaggagatccaggtccttagagtaattaagaatttcgagcgtctgaactctgacttcgacaggtatcttctgttaatggatctgcaagataggaatgagaagctcttctacagtgtgcttatgtctaatgttgaaaagttcatgcctatcgtttacactcccaccgtgggtcttgcatgccagcaatacagtttggcattccggaagccaagaggcctctttatcagtatccacgacaaagggcatattgcttcagttcttaacgcatggccagaagatgttgtcaaggctattgtggtgactgatggagagcgaatcctcggcttgggcgaccttggttgtaacgggatgggcatccctgtgggtaaactggccctgtacacagcgtgcggaggggtgaatccacaacagtgtctacccatcactttggacgtcggcacagaaaatgaggagttacttaaagatcccttgtatattgggctgcggcacaggcgagtgagaggccctgaatatgatgcgtttttggatgaattcatggaggcagcgtcttccaaatatggcatgaattgccttattcagtttgaagattttgccaatctgaatgcatttcgtctcctgaacaagtatcgaaacaagtattgcacatttaacgatgatattcaaggaacagcgtctgtggcagttgccggccttcttgctgctcttcggataaccaagaacaagctctctgatcagacagtgctgttccagggagccggcgaggctgccttggggattgctcatctgattgttatggccatggagaaggaaggtttatcaaaggagaaagctagacaaaagatatggttggttgactcaaaaggattaatagttaaggggcgtgcttctctcacagaagagaaagaggtgtttgcccatgaacatgaagaaatgaagaacctagaagccattgttcagaagataaaaccaaccgctctcataggagttgctgcaattggtggtgctttcacagaacaaattctcaaggatatggctgccttcaacgagcggcccatcatctttgctttgagtaatccgaccagcaaagctgagtgttctgcagaggagtgctataaagtgaccaagggccgtgcgatctttgccagcggcagtccttttgatccagtcactcttccagatggacggactctgtttcctggccaaggcaacaactcctatgtgttccctggagttgctcttggggtagtggcctgtggactgagacacatcaatgattcggtcttcctcaccacggctgaggtcatatcccagcaagtgtcagataaacacctagaagaaggccggctctatcctcctttgaataccatccgagatgtttccttgaaaatcgcagtaaagattgtgcaagatgcatacaaagaaaagatggccactgtttatcctgaaccccaaaacaaagaagaatttgtctcctcccagatgtacagcactaattatgaccagatcctacctgattgttattcgtggcctgaagaagttccagaaaatacagaccaaagtcaatcagtaacacaacagctagaatttttaactttattaataagatcttga

SEQ ID NO: 1514 - DNA, 2168 bp, Rattus norvegicus
  Genbank Accession No. NM_012603
actcgctgtagtaattccagcgagagacagagggagtgagcgggcgggttggaagagcccagtgtgcagagccccactccgggcttcctaggaaggcagctctggagtgagaagggctttgcctccaggcttgctgcctcctcgacccaatcctcccgctgacccaacatcagcggtcgcaaccctcgccgcctctgggaaactttgcccattgcaacgggcagacacttctcactggaacttacaatctgcgagccaggacaggactccccaggcgcaggggagggaatttttgtctatttggggacagtgttctctgcctctgcccgcgatcggctcccctgaaaagagctcctcgcgttatttgaagcctgaatttcctttgggaggtggaaaacccgacagtcacgacgatgcccctcaacgtgagcttcgctaacaggaactatgacctcgactacgactcggtgcagccctatttcatctgcgacgaggaagagaatttctatcaccagcaacagcagagcgagctgcagccgcccgcacccagtgaggatatctggaagaaattcgagctgctgcccaccccgcccctgtcccccagccgccgctccgggctctgctctccgtcctatgtcgcggtcgctacgtccttctccccaagggaggacgatgacggtggcggtggcaacttctccaccgccgatcagctggagatgatgaccgagctacttggaggagacatggtgaatcagagcttcatctgcgatcctgacgatgagaccttcatcaagaacatcatcatccaggactgtatgtggagcggcttctcggccgctgccaaactggtctccgagaagctggcctcttaccaggctgcgcgcaaagacagcaccagcctgagccccgcccgcgggcacagcgtctgctccacctccagcctgtacctgcaggacctcaccgccgcagcgtccgagtgcatcgacccctcagtggtcttcccctacccgctcaacgacagcagctcgcccaaatcctgtacctcgtccgattccacggccttctcttcttcctcggactcgctgctgtcctccgagtcctccccacgggccacccctgagcccctagtgctgcatgaagagacaccgcccaccaccagcagcgactctgaagaagaacaagatgatgaggaagaaattgatgtggtgtctgtggaaaagaggcaaccccctgccaagaggtccgagtcagggtcatccccatcaagaggccacagcaaacctccacacagcccactggtcctcaagaggtgccatgtctctactcaccagcacaattatgcagcacccccctccacaaggaaggactatccagctgccaagagggccaagttggacagtggcagggtcctgaaacagatcagcaacaaccgcaaatgctccagccccaggtcctcagacaccgaggaaaacgacaagaggcggacacacaacgtcttggaacgtcagaggagaaacgagctgaagcgtagcttttttgccctgcgcgaccagatccctgagttggaaaacaacgaaaaggcccccaaggtagttatcctcaaaaaagccaccgcctacatcctgtccgttcaagcagatgagcacaaactcatctcagaaaaggacttactgaggaaacggcgagaacagttgaaacacaaactcgaacagcttcgaaactctggtgcataaactgaccggaagtgaggaggagctggaatctcgagtgtaaggagaacggttccttctgacagaacttggacttcaaaaaatgcatgctcaaagcctaacctcacaaccttggctggggctttgggacttcagccataatgttaactgcctcaaagttaaggcataaaagaacttttttttatgcttcccatcttctttctttttcctttaacagatttgtatttaattgttttttttaaaaaaatcttccggtgtacatagggcctttaaatgtaaataactttaataaaacgtttataacagttatacaagattttaagacatgtatgataaaccataattttttttatttaaagaccttttcatttttaaagttgatttttttctattgtttttagaaaaaataaaataattggaaaaaatataattgagcca

SEQ ID NO: 1515 - DNA, 3243 bp, Rattus norvegicus
  Genbank Accession No. NM_012608
gcggagatgtgcaagtggcgaagctggaccgagtgcaggcgcaagctgctgagcggctgaggcgagggattttaggtgatgggaagatcagaaagtcagatggatattactgatatcaatgctccaaagccgaagaagaaacagcgatggactccactggagatcagcctttctgtgctcgtcttgctcctgactatcatagctgtgacaatgattgctctctatgcaacctatgatgatggtatttgcaaatcatcagactgcataaaatcagctgctcgactgatccagaacatggatgcctctgctgagccatgtacggacttcttcaaatatgcttgtggaggctggttgaaacgcaatgtcatccctgagaccagttcccgatacagtaattttgacattctaagagatgaactagaagtcattttgaaagatgtccttcaagaacccaaaactgaggacatagtagcagtgcagaaagcaaaaactttgtacagatcatgtataaatgaatctgctattgatagcagaggtgggcaacctctgctcacactgttaccagatatatatgggtggccagtagcatcacaaaactgggaacaaacatatggtacttcttggacagctgagaaatctattgcacaactgaattctaaatatgggaaaaaggtcctcattaatttttttgttggcactgatgataagaattctacccagcatataattcattttgaccagcctcgacttggcctcccttccagagactactatgagtgtacaggaatatataaagaggcttgcacagcatatgtggattttatgatttctgtggccagactgattcgtcaggaacaaagattgcctattgatgaaaaccagctctctttggaaatgaataaagttatggaattggaaaaagaaattgccaatgccacaactaaaccagaagaccgaaatgacccaatgctgctttataacaaaatgacattggccaagctccaaaataacttctctctggagatcaatgggaagccattcagctggtcaaatttcacaaatgaaatcatgtcaactgtgaatattaatattcaaaatgaggaagaagtggttgtttatgctccagaatatttaaccaaacttaagcctattcttaccaaatattctcccagagatcttcaaaatttaatgtcctggaggttcataatggatcttgtaagcagcctcagccgaaactacaaggagtccagaaatgctttccgcaaggccctttacgggactacatccgaaactgcaacctggagacggtgtgccaactacgtcaatgggaacatggagaatgctgtggggaggctttatgtggaagcagcttttgctggagagagcaagcacgtggttgaagatttgattgcacaaatccgtgaagtttttattcagactttagatgacctcacttggatggatgctgagacaaaaaagaaagctgaagagaaggccctggcaattaaagaaaggattggctatcctgatgacatcatctccaatgagaataaactgaataatgagtatcttgagttgaactacaaggaagaggaatactttgagaacataattcaaaatttgaaattcagccaaagcaagcagctaaagaagctccgagaaaaggtggacaaagatgagtggataagtggcgcggcggtagtcaatgcattttattcctcaggcagaaatcagatcgtcttccccgccggcattttgcagcccccattctttagtgctcggcagtccaactcattgaactatgggggcatcggcatggtcatcggacatgaaatcacacatggctttgatgacaatggcagaaattttaacaaagatggagacctcgttgactggtggactcagcagtctgcaaataatttcaaagaccaatcccagtgtatggtgtaccagtatggaaactttacatgggacctagcaggtggacagcatctcaatggaattaacacactaggagaaaatattgctgataatggagggattggccaagcatacagagcctatcagaattatgttaaaaagaatggtgaagaaaaattactccctggacttgacctcaatcacaaacaactattcttcttgaactttgcccaggtgtggtgtggaacctaccggccagagtatgcagtcaattccattaaaacagatgtacacagtcctggcaatttcaggatcattgggactttgcagaactctgctgagtttgcggatgcctttcattgccgcaagaactcatacatgaatccagaaaggaaatgtcgggtttggtgatcttcacaggaagtggagcatccatggcaggactcgccaaagccacagaaacaggaagtcttccctcagagaacgtgggccccggaagtttcttcagcttcttgggggaaattcacagagatgagcacgagctaacaaaaatgaaattagattattaaaaccgctgtgaatgaaaggggagaaaacctacgatctagcaaatcaatcacttcactgtgtaaataattaccttccaacggtaatattaccgttcacttctggttctcacacagactgcagctttcatgctgtctgtagagaacagtgttaacacttaaagcaggttatgacttctgatcaagaggaggaagacgctgaatacagttgggcaccaaagtacagatttgcctctcagcactcacttttgtttgcaacattcagctccttcaaaattctcccaaagaacccccatgcatactgtggccttcaggctcctgcagtgtggaactcattttaccatgcataaattattcattcattccacatcattttagtttgagcactcttagagcttaaactagagagtctgaaatggttccgccatttacccacttgagtggtgttgagactcttcagccccctacagatttttgagcaatttcttgctctcgctgcccctcagacttagtcttttaaaggatttgtagtaatgtataaaaaacattctatatttaattattaactacacatgaccaaataaaccattgctataggtaatcattgaatattgacattatatggccaagatagatagttaagaagatctgtaacatgatgtgcagatgaaaatttgaaactttttaagcctgtaaatcatattgctgaaaatcttcaaacacaaactctggggtgagcattaccattgaacagttg

SEQ ID NO: 1516 - DNA, 790 bp, Rattus norvegicus
  Genbank Accession No. NM_012612
ggctgagagagaaaccagagagtgagccgagacagcaaacatcagatcgtgccccgacccacgccagcatgggctccttctccatcaccaagggcttcttcctcttcctggccttttggctcccaggccatattggagcaaatcccgtatacagtgcggtgtccaacacagatctgatggatttcaagaacctgctagaccacctggaggagaagatgccggtagaagatgaggtcatgcctccgcaggccctgagcgagcagaccgatgaagcgggggcggcacttagctccctctctgaggtgcctccctggactggggaagtcaacccgtctcagagagatggaggtgctctcgggcgcggcccctgggacccctccgatagatctgccctcttgaaaagcaaactgagggctctgctcgctggccctcggagcctgcgaaggtcaagctgcttcgggggtaggattgacaggattggagcccagagcggactaggctgcaacagcttccggtaccgaagataacagccaaatctgctcgagcagatcgcaaaagatcccaagccttgcggtgtgtcacacagcttggtcgcattgccactgagaggtggtgaataccctcctggagctgcagcttcctgtcttcatctatcacgatcgatgttaagtgtagatgagtggtttagtgaggccttacctctcccactctgcatattaaggtagatcctcacccctttcagaaagcagttggaaaaaaataaatccgaataaacttcagcaccacggac

SEQ ID NO: 1517 - DNA, 3053 bp, Rattus norvegicus
  Genbank Accession No. NM_012620
cccccgagagctttgtgaaggaggaacgctgcacacccgcctcccgcagcacacagccaaccacagctgagcgacacgcaacaagagccaatcacaaggcacttccgaaagctccaggatgcagatgtcttcagccctcacttgcctcaccctgggcctggttctggtctttgggaaagggttcgcttcaccccttccagagtcccatacagcccagcaggccaccaacttcggagtaaaagtgtttcagcatgtggtccaggcctccaaagaccgaaatgtggtcttctctccctacggcgtgtcctcggtgctggctatgctgcagctgaccacagcagggaaaacccggcagcagatccaagatgctatgggattcaatatcagtgagaggggcacagctcctgccctccgaaagctctccaaggagctcatggggtcatggaacaagaatgagatcagtactgcggacgccatctttgtccagcgggacctagagctggtccagggcttcatgccccacttcttcaagctcttccggaccacggtgaagcaggtggacttctcagaggtggaaagagccagattcatcatcaacgactgggtggagaggcacaccaaaggtatgatcagtgacttactggccaagggggctgtaaatgagctgacacgcctggtgctggtgaacgccctctatttcaacggccaatggaagacccccttcttagaggccagcacccaccagcgcctgttccacaagtctgatggtagcaccatctccgtgcccatgatggctcagaacaacaagttcaactacactgagttcaccactccggatgggcacgagtacgacatcctggaactgccctaccacggcgaaaccctcagcatgttcattgcagcaccctttgaaaaagatgtgcccctctccgccatcaccaacattttggacgctgagctcatcagacaatggaagagcaacatgaccaggctgccccgcctcctcatcctgcctaagttctctctggagactgaagtggacctcagagggcccctggagaagctgggcatgactgacatcttcagctcaacccaggccgacttcacaagtctttccgaccaagagcagctctctgtagcacaagcactacaaaaggtcaagatcgaggtgaacgagagcggcacagtggcgtcttcctccacagccattctagtctcagcccgcatggcccccacggagatggttttagaccgatcctttctctttgtggttcggcacaatccaacagagacaatcctcttcatgggccagctgatggagccttgagagtgggatgagaagcctttcctttgggacaaaactggacgtgttataagcagagactctgaagaaaagaattgttttaaggactctttggggagaaagagaaggcctttctttcttaccccggcactggtaaatctttccaaccagcctcccagacctcagactctcgaagaggaaagagtctaactccctcactagggacctatcttactaaggtctcatccaaccatagaactcacagaatctggatctgcccagcattcagcctttggacccagttcccaccaaggccccagcagggccaacccactacgccttcactcagcaaagtcttttgtgttccagtcacactctgggtacctcttgtatcgtcctccattgctatgaaggatgacccaggccaaaggaagaagcactgtcctatctcaaggtccactgtggaaatgaacaccttgcccatccccaaggggcagcagatagacagatcgaatgatcgcccgatatcaagccttctcccagctcccgtcctgccctcccttccctgacagccgccttgtgttatttcagagtgtagatgacttgtttacagcttttttcgacccacaaacttttctcattttgaaagcgtgaaagaaaggtcagatgtgcacgtgccttgctctttatcctgggtctccctgtgaggggagaggggtcctggggagattccaggggtgtgattgaatatttatcttgtttatcttatacgtttgttggggagaagaagcactattaaggagaaagccttttatttaaaccatggcatatggtgtcccatttggggtctgtatccctgtatgtcagggaggcatcactccacaaacccgcccctcgggtggcccggcgtcggggctcacactgccgcctagtggcagccgaacacgcccttgccccatccctcccccgcatcctcccccgtggctcttttccttagggatcttgccaaggtgatgcttggcagcccacggtaaaggaagggggaaaaagattaggtgggagagagagagagagagagagagagagagagagagagagagagagagagagagagagagagagagagaaagagagagagatgtttgagagagggcaaagtggtttcaaatttttccaatacattcagaagccgagtgggaaagggggctgtgtgacctaacaggacagaactttctccaattactgggtgactcagctgcactggtgactcacttcaatgtgtcatttccggctgctgtaagtgagcagtggacacgtgggggggggggggtgaggatgaaagaaacagccagctcctggtcaaccaccttagttagataatcttttttgaaagcttcctagctgggggtatgatcagaaaaccaatttactgaaaaactgcacaggaaggtaacgtgaatctaatttcatagcgggccgctctgcatccgttacatctccactggaaaaaaataatcattttctttttgtgtgtgtgtgtgtgttttagcttttctccctctccctctttctctctcatttcattatgcactggataaccatacaccgtgtaccacaggggcccaaatgtggggtcacatggtcttgaattttgtggggtacatatgcctttgtttgtttgttttcacttttgatatataaacaggtaaatgtgtttttaaaaaataataaaaatagagaatatgcagac

SEQ ID NO: 1518 - DNA, 1635 bp, Rattus norvegicus
  Genbank Accession No. NM_012630
ggtcaagcgagctggattctagggaaacatagaagagtaatcatccagagaggggctctggtggagctcactagccattgactgttcttttcagaagtctggactccctgacctacaaggcctctcaagctaaaggacacttctctgtgaagggagcctctgatacattgcctatagcaagaagaaggggccaacctgaagaaaaacatgccatctgcacttgctttcgtcctacttgttctcaacatcagcctcctgaagggacagtcaccaccagggaaacctgagatccacaaatgtcgctctcctgacaaggaaacattcacctgctggtggaatcctgggacagatggaggacttcctaccaattattcactgacttacagcaaagaaggagagaaaaccacctacgaatgtccagactacaaaaccagtggccccaactcctgcttctttagcaagcagtacacttccatctggaaaatatatatcatcacagtaaatgccacgaaccaaatgggaagcagttcctcggatccactttatgtggatgtgacttacatcgttgagccagagcctcctcggaacctgacattagaagtaaaacagctaaaagacaaaaaaacatatctgtgggtaaaatggtccccacccaccataactgatgtgaaaactggttggtttacaatggaatatgaaattcgattaaagcctgaagaagcagaagagtgggagatccattttacaggtcatcaaacacagtttaaagtttttgacctatatccagggcaaaagtatcttgtccagactcgctgcaagccagaccatggatactggagtagatggagccaggagagttccgttgaaatgccaaatgacttcaccttgaaggacacaaccgtgtggatcattgtggccattctctctgctgtcatctgtttgattatggtctgggcagtggctttgaagggctatagcatgatgacctgcatctttccaccagttcctgggccaaaaataaaaggatttgatacccatctgctggagactggttctccaagcaaatacaaggtggatctgtacctggcccttcctggaggattccagaaactggacaatgcaggggaacttgactactgaagctgcagactcaaataggagcctctcaaaatgggttctaccaccatcgcaacaaatgctgagaacaagacagaaatttcccagtgccaataatctagtatccaggacgcctgcctggttagactttaaatttgctcaatgacaaacgagatcagtgttaattgtgtttcttgagcagctctcgtttgtttttctcttttgtcagcctcagccatctgccatcttgatccctcagtctcacgtggtgatatctatctttctgtgtgtgtgtgtatctctgtgtgtctctctgtgtcatctctctgtctctatgtgtctctgttcctctgtgtcttcctttgtcctttgtgttctctctctctctctctctctctctctctctctctctctctctctctctccaacttgcttcatgcttttctgggcttgagtgtgcttaagaaaacacattttacgatcatcagaataaccccccctttaaataaaaaactgtcc

SEQ ID NO: 1519 - DNA, 765 bp, Rattus norvegicus
  Genbank Accession No. NM_012631
atggcgaaccttggctactggctgctggccctctttgtgactacatgtactgatgttggcctctgcaaaaagcggccaaagcctggagggtggaacactggtggaagccggtaccctgggcagggaagccctggaggcaaccgttacccacctcagagtggtggtacctgggggcagccccatggtggtggctggggacaacctcatggtggtggctggggacaacctcatggtggtggctggggtcagccccatggcgggggctggagtcaaggagggggtacccataatcagtggaacaagcccagcaagccaaaaaccaacctcaagcatgtggcaggggctgccgcagctggggcagtagtggggggccttggtggctacatgttggggagtgccatgagcaggcccatgctccattttggcaacgactgggaggaccgctactaccgagaaaacatgtaccgttaccctaaccaagtgtactacaggccggtggatcagtacagcaaccagaacaacttcgtgcacgactgtgtcaatatcaccatcaagcagcatacagtcaccaccaccaccaagggggagaacttcacggagaccgacgtgaagatgatggagcgtgtggtggagcagatgtgcgtcacccagtatcagaaggagtcccaggcctattacgacgggagaagatctagcgccgtgcttttctcctcccctcctgtgatcctcctcatctccttcctcatcttcctgatcgtgggatga

SEQ ID NO: 1520 - DNA, 4127 bp, Rattus norvegicus
  Genbank Accession No. NM_012637
agccgctgctggggaggttggggctgaggtggtggcgggcgacgggcctcgagacgcggagcgacgcggcctagcgcggcggacggccgagggaactcgggcagtcgtcccgtcccgccatggaaatggagaaggaattcgagcagatcgataaggctgggaactgggcggctatttaccaggatattcgacatgaagccagtgacttcccatgcagaatagcgaaacttcctaagaacaaaaaccggaacaggtaccgagatgtcagcccttttgaccacagtcggattaaattgcatcaggaagataatgactatatcaatgccagcttgataaaaatggaggaagcccagaggagctatatcctcacccagggccctttaccaaacacgtgcgggcacttctgggagatggtgtgggagcagaagagcaggggcgtggtcatgctcaaccgcatcatggagaaaggctcgttaaaatgtgcccagtattggccacagaaagaagaaaaagagatggtcttcgatgacaccaatttgaagctgacactgatctctgaagatgtcaagtcatattacacagtacggcagttggagttggagaacctggctacccaggaggctcgagagatcctgcatttccactacaccacctggcctgactttggagtccctgagtcacctgcctctttcctcaatttcctattcaaagtccgagagtcaggctcactcagcccagagcacggccccattgtggtccactgcagtgctggcattggcaggtcagggaccttctgcctggctgacacctgcctcttactgatggacaagaggaaagacccgtcctctgtggacatcaagaaagtgctgttggagatgcgcaggttccgcatggggctcatccagacggccgaccaactgcgcttctcctacctggctgtgatcgagggtgcaaagttcatcatgggcgactcgtcagtgcaggatcagtggaaggagctttcccatgaagacctggagcctccccctgagcacgtgcccccacctccccggccacccaaacgcacattggagcctcacaatggcaagtgcaaggagctcttctccaaccaccagtgggtgagcgaggagagctgtgaggatgaggacatcctggccagagaggaaagcagagccccctcaattgctgtgcacagcatgagcagtatgagtcaagacactgaagttaggaaacggatggtgggtggaggtcttcaaagtgctcaggcatctgtccccactgaggaagagctgtccccaaccgaggaggaacaaaaggcacacaggccagttcactggaagcccttcctggtcaacgtgtgcatggccacggccctggcgactggcgcgtacctctgttaccgggtatgttttcactgacagactgctgtgaggcatgagcgtggtgggcgctgccactgcccaggttaggatttggtctgcggcgtctaacctggtgtagaagaaacaacagcttacaagcctgtggtggaactggaagggccagccccaggaggggcatctgtgcactgggctttgaaggagcccctggtcccaagaacagagtctaatctcagggccttaacctgttcaggagaagtagaggaaatgccaaatactcttcttgctctcacctcactcctcccctttctctggttcgtttgtttttggaaaaaaaaaaaaaagaattacaacacattgttgtttttaacatttataaaggcaggtttttgttatttttagagaaaacaaaagatgctaggcactggtgagattctcttgtgccctttggcatgtgatcagattcacgatttacgtttatttccgggggagggtcccacctgtcaggactgtaaagttcctgctggcttggtcagcccccccacccccccaccccgagcttgcaggtgccctgctgtgaggagagcagcagcagaggctgcccctggacagaagcccagctctgcttccctcaggtgtccctgcgtttccatcctccttctttgtgaccgccatcttgcagatgacccagtcctcagcaccccacccctgcagatgggtttctccgagggcctgcctcagggtcatcagaggttggctgccagcttagagctggggcttccatttgattggaaagtcattactattctatgtagaagccactccactgaggtgtaaagcaagactcataaaggaggagccttggtgtcatggaagtcactccgcgcgcaggacctgtaacaacctctgaaacactcagtcctgctgcagtgacgtccttgaaggcatcagacagatgatttgcagactgccaagacttgtcctgagccgtgatttttagagtctggactcatgaaacaccgccgagcgcttactgtgcagcctctgatgctggttggctgaggctgcggggaggtggacactgtgggtgcatccagtgcagttgcttttgtgcagttgggtccagcagcacagcccgcactccagcctcagctgcaggccacagtggccatggaggccgccagagcgagctggggtggatgcttgttcacttggagcagccttcccaggacgtgcagctcccttcctgctttgtccttctgcttccttccctggagtagcaagcccacgagcaatcgtgaggggtgtgagggagctgcagaggcatcagagtggcctgcagcggcgtgaggccccttcccctccgacacccccctccagaggagccgctccactgttatttattcactttgcccacagacacccctgagtgagcacaccctgaaactgaccgtgtaaggtgtcagcctgcacccaggaccgtcaggtgcagcaccgggtcagtcctagggttgaggtaggactgacacagccactgtgtggctggtgctggggcaggggcaggagctgagggtcttagaagcaatcttcaggaacagacaacagtggtgacatgtaaagtccctgtggctactgatgacatgtgtaggatgaaggctggcctttctcccatgactttctagatcccgttccccgtctgctttccctgtgagttagaaaacacacaggctcctgtcctggtggtgccgtgtgcttgacatgggaaacttagatgcctgctcactggcgggcacctcggcatcgccaccactcagagtgagagcagtgctgtccagtgccgaggccgcctgactcccggcaggactcttcaggctctggcctgccccagcacaccccgctggatctcagacattccacacccacacctcattccctggacacttgggcaagcaggcccgcccttccacctctggggtcagcccctccattccgagttcacactgctctggagcaggccaggaccggaagcaaggcagctggtgaggagcaccctcctgggaacagtgtaggtgacagtcctgagagtcagcttgctagcgctgctggcaccagtcaccttgctcagaagtgtgtggctcttgaggctgaagagactgatgatggtgctcatgactcttctgtgaggggaacttgaccttcacattgggtggctttttttaaaataagcgaaggcagctggaactccagtctgcctcttgccagcacttcacattttgcctttcacccagagaagccagcacagagccactggggaaggcgatggccttgcctgcacaggctgaggagatggctcagccggcgtccaggctgtgtctggagcagggggtgcacagcagcctcacaggtgggggcctcagagcaggcgctgccctgtcccctgccccgctggaggcagcaaagctgctgcatgccttaagtcaatacttactcagcagggcgctctcgttctctctctctctctctctctctctctctctctctctctctctctctctaaatggccatagaataaaccattttacaaaaataaaagccaacaacaaagtgctctggaatagcacctttgcaggagcggggggtgtctcagggtcttctgtgacctcaccgaactgtccgactgcaccgtttccaacttgtgtctcactaatgggtctgcattagttgcaacaataaatgtttttaaagaac

SEQ ID NO: 1521 - DNA, 1059 bp, Rattus norvegicus
  Genbank Accession No. NM_012642
atgggcgggaggaggatgcctctctgggcactcttgttgctctggacctcttgtagcttcagtctcccgacagacacagccagctttggacgaatcttgctcaagaaaatgccctcggtccgggaaatcctggaggagcggggagtagacatgaccaggatcagtgctgaatggggtgaattcatcaagaagtcttcctttaccaatgttacctcccccgtggtcctcaccaactacttggatacccagtactatggtgagatcggcattggtaccccatcccagaccttcaaagtcatctttgacacgggttcagccaacctctgggtgccctccaccaagtgtggtcccctctacactgcctgtgagattcacaacctctatgactcctcggaatcctctagctacatggagaatgggactgaattcaccatccactatggatcagggaaggtcaaaggtttcctcagccaagatgtggtaactgtgggtggaatcattgtgacacagacctttggagaggtcaccgagctgcccctgatacccttcatgctggccaagtttgacggggttctgggcatgggcttccctgctcaggctgttgatggagtcatccctgtcttcgaccacattctctcccagagggtgctaaaggaggaagtgttttctgtctactacagcagggagtcccacctgctggggggcgaagtggtgctgggaggcagtgaccctcaacattaccagggcaactttcactacgtgagcatcagcaaggccggctcctggcagatcaccatgaagggggtctctgtggggcctgccaccttgttgtgtgaggagggctgtatggcagtggtggacactggcacatcctatatctcgggccctaccagctccctgcagttgatcatgcaagccctgggagtcaaagagaagagagcaaataattacgttgtgaactgtagccaggtacccaccctccccgacatctccttctacctgggaggcaggacctacactctcagcaacatggactatgtgcaaaaggtgaggctgtga

SEQ ID NO: 1522 - DNA, 1540 bp, Rattus norvegicus
  Genbank Accession No. NM_012645
ggatcgcacatgggggcgatggcaccgcgcacgctgctcctgctgctggcggcggtcctggcccccacccagacctgggcgggctcacactcgctgcggtatttccacaccgccgtgtcccggcccggcctcggggagccccggttcatttctgtcggctacgtggacgacacgcagttcgtgcgctacgacagcgacgcggagaatccgagatacgagccgcgggcgcggtggatggagcgggaggggccggagtattgggaggagcagacactggtcgccaagggacaggagctggattaccgagtgagcctgaggaacctgctaagctactacaaccagagcgagggcggctctcacaccatccagaggatgtatggctgtgacgtggggtccgacgggagcctcctccgcgggtatgagcagcacgcctacgacggccgcgattacatcgccctgaacgaagacctgaaaacatgggctgtggcagactttgcagcatggatcacccggagcaagtggcagcggaatggtgctgcagagagaagcagggcctatctggagggcacgtgtgtggagtggctcctcagatacctggagcgcgggaaggagacgctgctgcgctcagatcccccagaggcacatgtgacccttcaccccagacctgaaggtgatgtgaccctgaggtgctgggccctgggcttctaccctgctgacatcaccctgacctggcagttgaatggggaggacctgacccaggacatggagcttgtggagaccaggcctgcaggggatggaaccttccagaagtgggcatctgtggtggtgcctcttgggaaggagcagaattacacatgccgtgtggagcatgaggggctgcctgagcccctttcccagagatgggagccttctccatccaccgactccaacttacttctgttgttcttggagctgtggcagtttttgtagttttggccatcattggagctatggtggttgttgtgaggaggaggaggagaaacacaggcaggtacagctcccagagctccgttgtgtctctcccagattgtgaagcatgaagacagctgcctggagtggactgagtgacagacgatgtgttcaggtctctcctgtgacatccagagccctcagttctctttagacaccagtgtctgaagttccctgtgattctatggcttcagtgtgaagaactgtggagtccagcctgccctacacaccaggaccctgtccctgcactgcctgtgttgcctaccacattcagccttgctggtccagcctgggggtggagggtggggacatctgcatcctgtccccctgtgccaccctgagcttcagcccctcactccacactgagaataagaatctgagtgtgaacttgattgttcacatccttgacacagtgtggatagctttttaaattactggatggaatacttagaggttttttgttttggggttttgctttgtttccttttgtttttgaaaaaataaatggcagatggagaagcttccagaaaaa

SEQ ID NO: 1523 - DNA, 8553 bp, Rattus norvegicus
  Genbank Accession No. NM_012647
accccctgtctttgcttttcctctttagtaaggatattattgcacatgtgagatttttacttcctactgtaggctgaattctagaaacctgcactggagactgctacattcaacacgcacatggattctgtgctatgattaccattccttttatttcagcactttcttacgcgaggagctaaacagtgactaaagaagcaggatgaaaagatggcacggtcagtgctggtacctccaggacctgacagcttccgcttctttaccagggaatcccttgctgctatcgaacagcgcattgcagaagagaaagctaagagacccaaacaggaacgcaaggacgaagacgatgaaaatggcccaaagccaaatagtgacttggaagcaggaaaatcccttccttttatttatggagacattcctccagagatggtgtcagaaccactggaggacctggacccctactatatcaataagaaaacctttatagtattgaataaggggaaagcaatctcgcggttcagcgccacctctgccctgtacattttaactcccttcaaccccattagaaaattagctattaagattttggtacattctttattcaatgtgcttatcatgtgcacaattcttaccaactgtgtgtttatgaccatgagtaaccctccagactggacaaagaatgtggagtatacttttacaggaatttatacttttgaatcacttattaaaatccttgcaaggggcttttgtctagaagatttcacatttctacggaatccctggaattggttggatttcacagtcattacttttgcgtatgtaacagaatttgtaaacctaggcaatgtttcagctcttcgaactttcagagtcttgagagctttgaaaactatttctgtaattccaggcctgaagactatcgtgggggccctgatccagtcagtgaagaagctctctgacgtcatgatcctcaccgtgttctgtctcagtgtctttgctctaatcgggctgcagctcttcatgggcaacctgaggaataaatgcttgcagtggcccccagacaattctacctttgaaataaatatcacttccttctttaataactcattggattggaatggtactgccttcaataggacggtgaacatgtttaactgggacgaatatattgaagataaaagtcacttttattttttggaaggacaaaacgatgctctgctttgtgggaacagctcggatgctggacagtgtccagaaggatacatctgtgtgaaggctgggagaaaccccaactacggctacacaagttttgacaccttcagctgggccttcttgtccttatttcgtctcatgactcaagacttctgggaaaacctttatcagctgaccttgcgtgctgccgggaaaacatacatgatattttttgtgctggtcattttcttgggctcattctacctgataaatttgatcctggctgtggtggccatggcctacgaggaacagaaccaggccacactggaggaggctgaacagaaggaggcagagtttcagcagatgctggagcaactgaagaagcagcaggaggaagctcaggcagcagctgcagcagcgtccgcagaatccagagacttcagcggggcaggcgggataggtgttttctcggagagttcgtcagtagcctcaaagttaagttccaaaagtgaaaaggagttgaaaaacagaagaaagaaaaagaaacagaaagaacaggctggggaggaagagaaggaagacgcggtgcggaaatctgcctctgaggacagcatacgaaagaaaggcttccagttttccctggaaggaagtagattgacctacgagaagagattttcctctccgcaccagtctctcttgagcatccgaggctccctattttctccaagacgcaacagtagagcaagccttttcaacttcaaaggtcgagtgaaggatattggttccgaaaatgactttgcagacgatgaacacagcacatttgaggacaacgacagcagaagagactctctatttgtaccacacagacatggagaaaggcgtcctagcaatgtcagccaggccagccgtgcctcccgggggatacccactctacccatgaatgggaagatgcacagtgcagtggactgcaacggtgtggtgtccctggttggaggcccctctgcgctcacatcgcctgtggggcagctgctgccggagggcacaactactgagacagaaataaggaagaggagatccagttcttaccacgtctctatggacttgttggaagacccttcaaggcaaagggcaatgagtatggccagtattttgacgaacactatggaagaacttgaagaatccagacagaaatgcccaccctgctggtataaatttgctaatatgtgcctgatttgggactgttgtaagccatggctaaaggtaaaacacgttgtcaatctggtagtgatggatccatttgttgacctggccatcaccatctgcattgtgttaaatacgctcttcatggccatggagcactaccccatgactgagcagttcagcagtgtgctgtctgttgggaatttggtcttcactgggatcttcacggcagaaatgtttctcaagataatagccatggatccatattattacttccaagaaggctggaatatctttgatggctttatagtgagccttagtttaatggaactcggcttggcgaatgtggaaggattgtcagttctccgatcattccggctgcttagagtcttcaagttggcaaagtcctggcccacactgaacatgctcattaagatcatcggcaactcggtgggtgcactgggcaacctgaccctggtgctggccatcatcgtcttcatttttgccgtggtcggcatgcagctgtttggaaagagctacaaggagtgtgtctgtaagatttccaatgattgtgagctcccgcgctggcacatgcaccacttcttccactccttcctgatcgtgtttcgagtcctgtgtggggagtggatagagaccatgtgggactgcatggaggtcgcgggccagaccatgtgccttactgtcttcatgatggtcatggtgattgggaaccttgttgtcctgaacctcttcttggccttgctcctcagttctttcagctcagacaacctggctgccacagatgacgataacgaaatgaacaacctccagatagccgtgggaaggatgcagaagggaattgattttgttaaaaggaagatacgtgaattcattcagaaagcctttgtcagaaagcagaaagctttagatgaaatcaaaccgctggaagatctgaataacaagaaagacagttgtatctccaaccacacgaccatagaaataggcaaggacctcaattacctcaaagatggaaacgggacgaccagtggcataggcagcagtgtggagaagtatgtggtagatgagagtgattacatgtcgttcataaacaaccccagcctcaccgtgactgtgcccatcgcccttggagagtctgactttgaaaacttaaacacggaagaattcagtagtgagtcagatatggaagaaagcaaggagaaattgaatgcaactagctcatctgagggcagtacggttgatataggcgctccggcagagggagagcagccagaggccgaaccggaagaatcgcttgaaccggaagcgtgtttcacagaagactgtgtgagaaagttcaagtgttgtcagataagcatagaagagggcaaaggcaagctctggtggaacttgaggaaaacgtgctacaagatagtagagcataactggtttgaaaccttcatcgtttttatgattctgctcagcagtggtgctctggcctttgaagacatttatattgagcagcgaaagaccatcaagaccatgctggagtatgctgacaaggttttcacttatatcttcatcctggagatgcttctaaagtgggtggcctatggtttccaaatgtatttcaccaatgcctggtgctggctggacttcctgatcgttgatgtctccttggttagcttaactgcaaatgccttgggctattcggaacttggtgccatcaagtccctccgaacgttaagagctctgagacctctacgagccttatcccgatttgaaggaatgagggttgttgtaaacgctctcttaggcgccatcccctccataatgaacgtacttctggtctgcctgatcttttggctaatattcagtatcatgggggtgaatctctttgctggcaagttctaccattgcatcaactacaccacgggggaaatgtttgatgtgagcgtggtcaacaactacagtgaatgccaagctctcattgagagcaatcagacggccaggtggaagaacgtgaaggtcaacttcgataacgtgggactcggatacctttctctgctccaagtagccacctttaaaggatggatggatatcatgtatgcagctgttgactcaagaaatgtagaactgcagcccaaatacgaagacaatctctacatgtacctttactttgtcatcttcatcatcttcggctcattcttcaccctgaacctgttcattggtgtcatcatagacaacttcaaccagcagaagaagaagtttggaggtcaagacatctttatgacagaagaacagaagaaatactacaatgcaatgaagaagctcggctccaagaaaccgcagaagcccattcctcggcctgcaaacaaatttcaagggatggtctttgattttgtaaccaaacaagtctttgacatcagcatcatgatcctcatctgcctcaacatggtgaccatgatggtggaaacggacgaccagagtcaggagatgaccaacatcctgtactggatcaacctggtgttcattgtcctgttcacgggcgagtgtgtgctgaagctcatctccctccgccattattatttcaccatcggctggaatatttttgattttgtggtagtcatcctctccattgtaggaatgtttctcgcggagctgatagagaagtatttcgtgtcccctaccctgttccgagtcatccgcctggccaggattggacgaatcctacgcctgatcaaaggcgccaaggggatccgcactctgctctttgctctgatgatgtcccttcctgcgctgttcaacatcggcctcctgcttttcctggtcatgttcatctacgccatctttgggatgtccaactttgcctacgttaagagggaagttggaattgatgacatgttcaactttgagacttttggcaacagcatgatctgcctgttccaaatcaccacctctgccggctgggacggactgctggcccctatactaaatagcggacctcctgactgtgaccctgaaaaagatcaccctggaagctcggtgaagggggactgtgggaacccatctgtggggattttcttttttgtcagctacatcatcatatccttcctggtggtggtgaacatgtacatcgctgtcatcctggagaacttcagcgtcgccaccgaagaaagtgcagagcctctgagtgaggacgactttgagatgttctacgaggtctgggagaagttcgaccctgacgccactcagttcatagagttctgcaagctttctgactttgcagctgccctggatcctcccctcctcatcgcaaagccaaacaaagtccagctcattgccatggacctgcccatggtgagtggagaccgcatccactgcctggacatcttgtttgcttttacaaagcgggtcctgggcgagagtggagagatggacgctcttcgaatccagatggaagaaaggttcatggcttccaacccctccaaggtctcttatgagcccattaccaccaccctgaaacggaaacaagaggaggtgtctgctattgtcatccagcgagcatacaggcggtatctcctgaagcagaaagttaagaaagtttcgtctatctataaaaaagacaaaggtaaagaagacgagggaacgcccatcaaagaagacatcatcacagataaactgaacgagaattcaactccagagaagactgatgtgacaccttccacaacttctccaccttcctacgatagcgtgacgaaaccggagaaggaaaaatttgaaaaggacaaatcagaaaaagaggacaaagggaaagatatcagggaaagtaaaaagtaaaaaaataaaataataataataataacgaaaattaaaaattaaaaaaaaagaatattccatttcgtgatcaactgtttacagcctgtgttggtgatgtatctgtgactccctcaggaggtccatgccaaactgactgtttctctaagtgtatacttaaggtcagtgcctataacaagacaggacctcgggtcagcacactgggattcaccaaaccagacaaagagcaccgacgggaggcttctatgttcacaaccagctgacactgctgaagagcggagagcaatggctactcagactagaagaacatggaaacggggaggaaagttaaatttttatgtaaatttaacatgtgacacttgatagcggtaactgtcaccactgtttgtgttttaactgccacacctgccatatttttacaaaatgtgtgctgtgactttatcactttttttttttgattcacgggttgtttactcttatatgtgactatttttgtaaacgggtttatgttcggggagagggattacggaggggattcgacgtttctctatgtataacgagatctattttcaacgaaggtaatgctgcagctctcattcacacacgacgatatcccatcacaccaggaaagagcttacttctcatttcaggatgtttttagattttttgaggtgcttaaatagctattcatatttttaaggtgtttcatccagaggaattttaatgtgcctgtaaatgttccatagaaccacaaccatcaaaaagagttgttttatttttacatagttcattatatgtacatgtatatatgtctatatgtatatggccgtgtatatacatatatatgtatacacacatgcatacatatgcacacacagaccatcacatgctcagagtcctgacagcatgactataacatttttttaataagtgtcctttggtaaaaaaaaatatatatacatatatatatatatctcctatcagtcctttctaagaaacccaaactaccaaaaaccacccccacggccactttctgaagttggttctgcttttttttccctgcagtattgtttagccatcttctgctcttggtaaggttgacatagtgtatgtcaattaaaaaacaacaacagcaacaaagtctgctttgtaaatagtaattttacccagtggtgcatgtttgagcaaatgaaaatgatttaagcacagtatttactgcatcaaatatgtaccacagttaagtatagtttgcaagctttcaacaggcgacatggtgtcactgggtcccttagagtttgaagctgtcaccgctgcatgtctctcttgctgatgccgctgtatcttaacccttctgctgttcagaagtctaacagggaagccatacgtcggtggcgaagtgaagcaaatcggtccaccaggaactcactcttcgtgacatgagccatgggttgcggtaaacgggaaggagatccttgttcttggttctcccaaaccttaatggaacagccggtgagatgtctgacagtgtaagctgcttagatctgttaaaagtatgtgcttcgagttttctaaggaaatatacatattgtaaaaaagggggggctcattttattttatttcaaagccttttgtacataaaatgggaaattaaaagtatcttcaggttgacgtcacagttctaccgttagtttctgttccccggcactttttaatcaaggcacttcgtcacggaagagataaggcctaagaggcagtgtagggctctggctgtcgttgttggtactgtggacttgcgcgtatttccacttgaaacaattctcattccaagtctaatgtccatttgctttcaatagtgatgccttatcattgacaagagatttcaaggggagcagatgacactcttggcattgcctgagtaggatgtcctcacctagtgtttctcctctactcatccatcttttttaatgttcgtttacacagatagatagatggatagatagaatcttactcatccacatggcaccagagctgtttcaggtatgattcgggaaccaagcgctctctctctctctctctctctctctctctctctctctctctctctctctctctctctgttttccacaaaaccagttagtgaaatgatatcgccaattacagccaaacactttgtttcacagacaaccttcaatgtagattctttatactaaagctgttgacttgtagcgtgttcatgaatgcatgcaggaaaatgctattaccatacagagctaccggtaagccacattacgatcaagccaaaagaataaagatttttttttttgcttt

SEQ ID NO: 1524 - DNA, 2462 bp, Rattus norvegicus
  Genbank Accession No. NM_012649
tgtgctgttggaaccatggcgcctgtctgcctgtttgcgccgctgctgctgttgctcctcggaggtttccccgtcgccccaggcgagtcgattcgagagactgaggtcatagacccccaggacctcctggaaggcagatacttctctggagccctcccggacgatgaagacgctgggggccttgagcaggactctgactttgagctgtcgggttccggagatctagatgacacggaggagcccaggaccttccctgaggtgatttcacccttggtgccactagataaccacatccccgagaatgcccagcctggcatccgtgtcccctcagagcccaaggaactggaagagaatgaggtcattcccaaaagggtcccctccgacgtgggggatgacgatgtgtccaacaaagtgtccatgtccagcacttcccagggcagcaacatttttgaaagaactgaggtcttggcagctctgattgtgggcggcgtagtgggcatcctcttcgccgttttcctgatcctgctgctggtgtaccgcatgaagaagaaggatgaaggcagttacgacttgggcaagaaacccatctacaaaaaagcccccaccaacgagttctacgcatgaagcttcttcccatgagtgctgcttggacttcatggggagaggagttgaggattgtggacagtggacattggcagagagagggcaccttaatactgacttgtatctccatctctggtcacctttctggtgtcagaagagatatgatcttctactgtgctgcctcagagagagagagagagagagagagagagatgggatggggtgcggagggagtgtccgtgtgtgtgtgtgtgtgtgtgtgtgtgtgtgtgtgtgtgtgtctgtctgtctgtctgagttgccctggcagaaaaatggggttaaacttgttctttcttgaaggcaagcctggaattgggtctttttgttgttgtttcaaatttctagaatagaatgtaggaccagtttagttcctgccgttaacatgtctcatttatgactgcctttattctagaggcaaggagttgggggcaaggagctggaacccgctgcaccttgagatgtgttcacccgagtacttcctcacactacagggtctctgtggtgtatctcggggcattctaggctcagtgacttttgaaattcaaccttttttttttttttttaaatccagggagggtgggactgaagtgctgacagctcatgctgaagtacacttgtagaagatttgtaaaatgtaaggttttttttttttttttttaatggtccattccttcatgggagcgtgtgccctgggctgagagcgtggggatgcacagatgttctttctagaacatattcgttgcaacagctaactttgtgttttcatggttttttatgttttgttttgtttttttgaaaatgagagaagagctggagagatgatttttatgatttttttttgttttgttttttactatttatagcttcagacggggctgcttttctctacctttctgtctttactgtttcccactattttttttttttaatgttctgtgctcttgtttttgaccctggccctttctgaagttgctttatcttaaaaagtagctacagtgttctagcagattccagaatataatgtagggggtagcgggatatttgtgttcttgtaatatatattatccttcctcggttctaggagaatagataaatatatttttttaggatatagaatgatactacaggtctcatgttggctgggtggctgcgtgagtgagttttcgtgcggctgagtaagctgttgccctcttctcttgccctgctcctggtgccttctcgagatcgagctggagtgactgagggtacctgactctaacctcactgtgccttctgccgggggctctgcccaggagcctctgggtttgctttctccaggctctctagatgcacgatccaatacagtgacctcctgtggctgtatcaatcagttcacttgactatgtgattggaaatcattcctctgttgcactggccacacaatttaagtgcctagtcaccatccaccgagcacagagattgaggctggtttagcaggttacggttcagttttgcttgtctccccgggcaagagaaggggacttaggaggaaggtgatgaggtcccagggactcctgtcacccaggactctccctcttacagaggaaagacctagtagcttaaaaggtctgggctgtgtgggggtggggcggtcataccactccctcaaccatgccctatgcctgtaagcccccatcaccacctccgtgcagggtcctagctggctgggtcctcttctagccttgtgcctgctccttttctgtatcccttactctgttgtctgttactgatttttttgataaaaagataataaaacctggtactttctaaaaaaaaaa

SEQ ID NO: 1525 - DNA, 5153 bp, Rattus norvegicus
  Genbank Accession No. NM_012654
ccagctccgggatagcgcagagggctgtgacgaagagcgcacgaggtaccacggtatgcgtgtcggctcctggagctgagcagcagcgatgtggcacccggctctgggaccagggtggaagccgctgctggcgctggccgtggccgtgaccagcctgcgaggcgtgaggggcattgaggaggaaccgaacagtggtgggagcttccagatagtcaccttcaaatggcaccacgtccaggatccatacatcatcgcactctggatcctcgtggccagcttggccaaaatcgtcttccatctgtcccacaaggtcaccagtgttgtcccggagagtgctctgctcatcgttctgggcctggtgctgggcggcatcgtctgggcagctgaccacatcgcctccttcacactcacacccacactcttcttcttctacctgctgccccctattgtgttggatgctgggtacttcatgcccaatcgactcttctttggcaacctgggcaccatcctgctatatgctgtcattggcactatatggaacgcagctaccacaggattgtccctctatggtgtcttcctcagtggcctgatgggcgaactgaagatcggcctcctggatttcctgctatttggcagcctcattgcagctgtggacccggtggctgtgctggctgtgtttgaggaagtccatgtcaatgaagtcctgttcatcattgtttttggggagtcactgcttaatgacgcggtgactgtggtcttgtacaatgtgtttgagtctttcgtgacgctgggtggtgatgcagtgactggcgtggactgtgtgaaaggcatagtgtccttcttcgtggtgagcctggggggcactctggtgggtgtcatcttcgccttcctgctgtccttggtgactcgtttcaccaagcatgtgcgtatcatcgagcctggcttcgtctttgtcatttcctacctgtcctatctgacctccgagatgctgtccttgtcagccatcctggccatcaccttttgtggcatctgctgtcagaagtacgtgaaggccaacatctcagagcagtcggccaccaccgtgcgctacactatgaagatgctggcaagtggagcagagaccattatcttcatgttcctgggcatctcggctgtggaccccgtcatctggacatggaacacagcttttgtgttgctgacactggtcttcatttctgtataccgagccattggtgttgttctgcagacctggatcctgaatcgctaccgcatggtgcagctagagaccattgaccaggtggtcatgtcctacggtggcctgcgtggggcagtggcctatgccttggtggtacttctggatgagaaaaaagtcaaggagaaaaacctgtttgtcagcaccactctcattgtggtcttcttcacagtcatctttcagggcctgaccattaagcccctggtgcagtggctgaaggtgaagaggagcgagcagcgtgagccgaagctcaacgagaagctgcatggccgggctttcgaccacatcctctcagccattgaggacatctcaggacaaattggacacaattacctcagagataagtggtccaattttgataggaagttcctcagcaaagtcctcatgagaagatctgctcaaaaatctcgagatcggatcctgaatgttttccatgagctgaatttgaaggatgccattagctatgtggccgagggagagcgccgtgggtccctggccttcattcgctccccaagtacggacaatatggtcaatgtggacttcagcacaccccgcccatctacagtggaggcatccgtctcctatttcttgagggaaaatgtcagtgctgtatgcctggacatgcagtccttggaacagaggcggaggagcatccgtgacaccgaggacatggtcacccaccacacgttgcagcagtacctctacaagcctcggcaggagtacaagcatctctacagtcggcacgagctcacacccaatgaggatgagaagcaggacaaggagatcttccacaggaccatgcggaagcgcctggagtcctttaagtcggctaagctgggcatcaaccagaacaagaaggcagccaagctatataagagggagcgcgcacagaagcggaggaatagcagcattcctaatgggaagctgcctatggagaatctggcacacaacttcaccatcaaggagaaagatttggaactttcagagcctgaggaggccaccaactatgaagagatcagtggaggcattgaatttctggccagcgtcaccaaagatgtagcctctgactctggggcaggaattgataatcctgtgttctcccctgacgaggatctggacccaagcatcctatccagggtgccaccctggctgtcccctggggagactgtggtgccctcccagagggcccgtgtccagattcccaactctcccagcaacttccgccgcctgactccattccgcctcagcaacaaatcagtggattccttcctgcaggctgatggccccgaggaacagctccaacccgcttcccctgagtccacacacatgtgatacaggctctggcacaccacttactggacgcttgtctcgtcagtcatctgctgctgcccagcacgcattgctccctgcagggcttgcccacccacgtgccccaagccccgccccacctgagcgcacttcgactgtcacttttgcctctggtgttcctgggacagagccagagcaccgggccccacccagtgcccacgctcggtcggcggctgcgcgccgggtacacagtaggcgctcattccaaaagcctcgcccacgccgacgcccagctctgctaaaactcgcttctcttccgggctctacagaactgccactgcacgctctggagcaagaagagacgccgctgtgatcgctgcctggccgatggcccagctccgagggtctccctcagtggcccctccccaaccagctagtgttcttagggtccaacgcaccctaggagttttaatgcatagcctagccctaggaagaatcttttaatccatatggtgtcctcaggataccacattgccacctgccgtcttcttgccctggttcagttcctagggctctgtggtgctgcctccccacccctacccagaggcgagcccttgttagtgtttgccacccttattctgagaggagaaagatccatgagaggcctgtagcggacttaatcactgctggtacaaacaaaggtctcaaaaattgagatttgtagaagtggcaccacccaaatcaacctcattctaaataggcagcagttttttgtgcgtccccagaatatacacccctgtggccctatctgaccccttccaagttagttctccagactgccctatcaccttatgatcaactgcagaaatatttggctcttctagctcagactttcctgtccagccccttccagcctgggccttgccgtcaaaaacaaggtgtccggcctgaactatccctaagttgggaacactgcagatggccaggcaagctgggctaggggctagaagtggcccactggaagccttccttggtcaaaattatagccagctctggcatctatcaaaggagggctctacatcacccaggagtagaggaatgcaggaatccagtctctgaacattttgtcctgtccctaggtcttcagggcctccgccttagaacattggccctctggagggtaagaggctgggccctcagcccttatcaacttcctcagaagtccagtgttcaagagtcacctgagttttgcttccaactcactagaaactttgcctgcaccacagggagatcgagatggggctaaaggtggacttaatgacttcctggagacttctgaaacaaagcactcaggtctctgctcaggaaactaaatactgtgtctcaggaacaaggttgacagttaccttcagaggagtcacaggaaagtctgtcaatctgtattaatgctgcagttgatttgtagacaggaagagagctgggaggagtgaaagcaaagcaagtccgcccaacatactgcatctgcttcagagtgtcgcccccccccccaactgagcctgccagtatgctgttgactgtctagttcacactcagccatcagatgctcagcatctggtttccacagcccttgaagcatttgtccctttccgaattgaagtccagccactgacaatgccagggtcagtaatttcaccagactatttggagctgccatttggggtacttccaaggcaggctgtgcttggctactgtacccggggtgttctgagaggcatctatcagcctctgctctgcagacaagtttctcagacctttctgtgccaggacactgccttaacacctcatccaatctgctggacatggggtccaattcccactgcagaattagaagccaagtgtgacgagacagtgcctcagcaactgtcaccttgctccagatacccagagataccaaagctagcagccgggggtgatcaatctgtggaaccctttgacactctgtccatgttttagctgtgcacaggccatgtcctttgagtgtgtgaactacaccactgggcatagccatatggaacagtcttgacaagaaagcctcattcacaaaaccccacttcctgtacctaaatgatacatacagtggctacatttcatagttgaggaccctcttgttcttgtcattgttgtacaatagaatgtaaaatcctatgaatgtatttccttaggaaaactattgtaaaagttttttttttattaggagagaatttctatttatttaatactgaactttgacctactttgtggtactacaaagtatacaaatttaggaaatttgtatttccgcttctgtattttcttgaaaataattttattacagtgttcaatatactatgtattaataatctttttatgaaaggaaatttaaagaactcatcaaaaccagaaatatattttgagtggttaaaattgtgtattaatgttgtgaacataatcatagttgaactttaattctgatctcagaataatgtgccttaaaatgcccccatgtgttgggcagcatctgtacaaggagtccattagcaaagctgcagtgact

SEQ ID NO: 1526 - DNA, 1638 bp, Rattus norvegicus
  Genbank Accession No. NM_012679
acccgcgtcaccaggaggagcgcactggagccaagccgcagacgggactccagactccaaagaggccacaccatgaagattctcctgctgtgtgtggcactgctgctgacctgggacaatggcatggtcctgggagagcaggagttctctgacaatgagctccaagaactgtccactcaaggaagtaggtatgttaataaggagattcagaacgccgtccagggggtgaagcacataaagaccctcatagaaaaaaccaacgcagagcgcaagtccctgctcaacagtttagaggaagccaagaagaagaaagagggtgctctagatgacaccagggattctgaaatgaagctgaaggctttcccggaagtgtgtaacgagaccatgatggccctctgggaagagtgtaagccctgcctgaagcacacctgcatgaagttctacgcacgcgtctgcaggagcggctcggggctggttggtcgccagctagaggagtttctgaaccagagctcacccttctacttctggatgaacggggaccgcatcgactccctgctggagagtgaccggcagcagagccaagtcctagatgctatgcaggacagcttcactcgggcgtctggcatcatagatacgcttttccaggaccggttcttcacccatgagccccaggacatccaccatttctcccccatgggcttcccacacaagcggcctcatttcttgtaccccaagtcccgcttggtccgcagcctcatgcctctctcccactacgggcctctgagcttccacaacatgttccagcctttctttgatatgatacaccaggctcaacaggccatggacgtccagctccatagcccagctttacagttcccggatgtggatttcttaaaagaaggtgaagatgacccgacagtgtgcaaggagatccgccataactccacaggatgcctgaagatgaagggccagtgtgagaagtgccaagagatcttgtctgtggactgttcgaccaacaatcctgcccaggctaacctgcgccaggagctaaacgactcgctccaggtggctgagaggctgacccagcagtacaacgagctgcttcattccctccagtccaagatgctcaacacctcatccctgctggaacagctgaacgaccagttcacgtgggtgtcccagctggctaacctcacacagggcgatgaccagtaccttcgggtctccacagtgacaacccattcttctgactcagaagtcccctctcgtgtcactgaggtggtggtgaagctgtttgactctgaccccatcacagtggtgttaccagaagaagtctccaaggataaccctaagtttatggacacagtggcagagaaagcgctacaggaataccgcaggaaaagccgcatggaatgagacagaagcatcagttttctatatgtaggagtctcaaggagggaatctcccagctttccgaggttgctgcagacccctagagaactccacatgtctccagcgcctaggcctccaccccagcagcctctccttcctctgggttctgtactctaatgcctgcacttgatgctctcgggaagaactgcttcccccacgcaactaatccaataaagccaccttgcg

SEQ ID NO: 1527 - DNA, 2259 bp, Rattus norvegicus
  Genbank Accession No. NM_012693
ctggctactatgctggacacaggactgctcctggtggtcatactggcctccctaagtgtcatgttcttggtgtccctctggcagcagaaaatcagggagagattgcctccaggacccactcctttgcctttcattggaaattatctgcagctgaatatgaaagacgtatacagttccatcacacagctcagtgagcgctatggtcctgtgttcaccattcaccttgggcctcgacggattgttgtgctttatggatacgatgcagtcaaagaggctttggtggaccaagctgaggagttcagtggacgtggcgaactgcctacctttaatatactcttcaaaggctatggtttttcattgagcaatgtggaacaggccaagcgtatcaggcgcttcaccatagccacattgagagattttggtgtgggcaagcgtgatgtacaggagtgtatcctggaggaggcaggctatttgatcaagacgttgcagggcacttgtggagcccccattgacccttccatctacctgagcaaaacagtctccaatgtcattaactccattgtcttcgggaaccgcttcgactatgaggacaaagagttcttgtcactgttggagatgatcgatgaaatgaatatatttgcagcctcagccacagggcagctctatgacatgttccattcagtgatgaagtacctgcctggaccacagcaacagatcatcaaggttactcagaaactggaagacttcatgatagagaaagtgaggcagaaccatagtaccctggaccccaattccccaaggaacttcattgactcctttctcatccgcatgcaagaggagaaatatgttaattcagaattccacatgaacaacctagtgatgtcatcattaggcctcctctttgctgggactgggtcagtcagctccacgctataccatggtttcctgctactcatgaagcatccagatgtggaagccaaggtccatgaggaaattgagcgagtgatcggcaggaaccgacagcctcagtatgaggaccacatgaagatgccctacacccaggctgtgatcaatgagatccaaagattttctaacttggctcccttgggcattcctcgaaggattatcaagaacacaaccttccgtggcttcttcctccccaagggcaccgatgtattccctataataggttctctgatgacagaaccaaagttcttccctaaccacaaagacttcaacccccagcacttcctggatgacaagggacagttgaagaagaatgctgcatttctccctttttccattggaaagcgattctgcttgggagatagcctggctaaaatggagctcttcctgctgctcaccaccatcttgcagaacttccgttttaagttcccaatgaatctagaagacatcaacgagtaccccagtcccatagggtttaccaggatcataccaaattacaccatgagcttcatgcccatctgattctgagttgaatcaaggtggggcaagagggagggagagcctgaagtggggccagggtgcaggtggagagaacagagaagatgaagatgagggttaagaagggaccacacccatggaagaaacacaaaagacttctcagtttggtaaaattgtaacagtcctaataaaaagaaagaaacacccagtaggcagcagtaacaacaactgagactcatggggcaaaggtggctcacctctgcagaagctgtcctgcccttctctcactcagtcctctacacaagagcagcatgtccccaagcccaacgtacaggttcaaaagatagaacttaaaaaatttgaacctaaactgaggtggaaaagacacagttagctaggattgacacattggactctatcaccagcattcaggagggagggaacatggctccctaggaggcctgccagaattacaaagtgaaactcatctcaaaaaaggaacaacagaaaataaaatttcaaattgatttctcttagaccataagagtccagatctgtatccaaagctatttggttatattttttgttattgttgttttgtttacacattgtgtttttctttcggtttgtaagtctgtttgggatatttaatttacatttactgattagtgtgggtggtagggcataccatggctcaaatgtggaaaccaaagaaaagcttttggaagtgtcatctcccttacaatacgtgtgtccaagaactcaaattcagacaataaagcttgatagcaagca

SEQ ID NO: 1528 - DNA, 1417 bp, Rattus norvegicus
  Genbank Accession No. NM_012696
agagggaacctttaatcatgaagctaattactatcctgctcctctgctccaggctcctgccaagtttagcgcaggaagaaggcgcccaggaattgaactgcaatgatgagactgtatttcaggctgtggatactgctctgaagaaatataacgctgagttagaaagcggcaaccagtttgtgttgtaccgagtgactaagggcactaagaaggatggcgctgaaacattgtattccttcaagtatcaaatcaaggagggcaactgctctgttcagagtggcctcacctggcaggactgtgacttcaaggacgctgaggaagccgctactggcgaatgcacaacaactttggggaagaaagaaaataaattctccgtagccacccagatctgcaatattactccaggtaagggtcctaagaagacagaggaggacctctgtgtcgggtgtttccaacccataccgatggatagctcagacctgaagcctgttctgaaacacgctgtggagcattccaacaacaacacgaagcacacccacctctttgctctcagagaagtaaagagtgcccactcacaggtggtggctggcatgaattataaaattatctactccattgtgcaaacaaattgttcaaaggaggattttccttccctccgtgaagactgtgtaccccttccctatggcgatcatggtgagtgtacgggtcatacccacgtggatattcataacacaattgccggcttctcacagagctgtgacctttatccaggagatgatttgtttgaactacttcccaagaattgccgtggctgccccagggagatacctgtagacagcccggagctgaaggaggcacttggtcattccattgcacagcttaatgcacagcataaccatattttctatttcaagattgacaccgtgaaaaaggcaacatcacaggtggttgctggagtaatatatgtgattgagttcatagccagagaaactaactgttccaagcaaagtaaaacagaactgacagcggattgtgagaccaaacacctcggtcaaagcctcaactgcaatgctaacgtgtacatgagaccttgggagaacaaagtcgtcccgactgtcagatgccaagcactagatatgatgatttctaggcctccaggattttcacctttccggctggtgcgagtacaagaaactaaagaaggaacaactaggctcctaaactcatgtgagtacaagggcagactctcaaaggcaagggcaggcccagcacctgaccatcaggcagaagcttcaaccgtgacatcatagcctggcaaagacccggagtggaaggaccagaagactcctgggatgtgtgcagtatggaagcatgtttcttcatcacctgatcctgggtgaaataaagttcagactcg

SEQ ID NO: 1529 - DNA, 1882 bp, Rattus norvegicus
  Genbank Accession No. NM_012697
gcaggcctggctaaactggtgagggccctacccagccatgcccaccgtggatgatgtcctggagcaagttggagagtttggctggttccagaaacaagccttcctgttgctatgcctgatctcagcttctttagctcccatctatgtgggcatcgtcttcctgggcttcacccctggacattattgccagaatcctggggtggctgagctgagccagcggtgtggctggagccaggcagaggagctgaactacactgtgccgggcctgggaccttcggacgaggcctccttcctcagccagtgcatgaggtatgaggtggactggaaccagagcacccttgactgtgtggacccactgtccagcctggttgccaacaggagtcagttgccattgggcccctgcgagcatggctgggtatacgacactcccggctcctccatcgtcactgagtttaacctggtgtgtggagacgcctggaaagtggacctttttcagtcctgtgtgaacttgggcttcttcctgggctccctggttgtgggttacattgcagacaggtttggccgtaagctctgtctcttggtgaccacgctggtcacatctgtgtccggtgtgctaacagcggtggccccagactatacatccatgttgctctttcgcctgctgcagggcatggtcagcaagggcagctgggtgtccggctataccttgatcacagagtttgtcggctctggctacaggagaacgacggccattttgtaccagatggccttcacagtggggctagtggggcttgccggggtggcctatgccattccagactggcgctggctccagctagctgtgtccctgcctaccttcctcttcctgctgtattactggtttgtcccagaatccccccggtggctgttgtcccagaagagaaccacgcgagctgtcaggataatggagcaaattgcacagaagaacgggaaggtgcctcctgctgacctgaagatgctctgccttgaggaggatgcctcagaaaagcgaagtccttcgtttgccgacctgttccgcactcccaacctgaggaagcacaccgtcatcctgatgtatctatggttctcttgtgctgtgctgtaccagggtctcatcatgcacgtgggagccacaggggccaacctctacctggacttcttttattcttctctggtggaattccccgcggccttcatcatcctggtcaccattgaccgcattggccgcatctacccaatagcggcctcgaatctggtgacgggggcagcctgcctcctcatgatctttatcccgcatgagctgcactggttgaacgttaccctcgcctgtcttggccgtatgggggccaccattgtgctgcagatggtctgcctggtgaacgctgagctgtaccctacattcatcaggaatcttgggatgatggtatgctctgccctgtgtgacctgggtgggatcttcacccccttcatggtgttcaggctgatggaagtttggcaagccctgcccctcattttgtttggggttttgggcctgactgctggggccatgactcttcttctcccagagaccaagggtgtggctttgcctgagactattgaagaagcagagaacctggggaggaggaaatcaaaggccaaagaaaacacgatttaccttcaggtccaaacaggcaagtcctcaagtacctgacagggatgctgtgccaggagctgagtggcagagagaaaggaggacttgccacttggaggattcccagaagcctttgcctttccagactcttgtatatatgcaccaggttccaaatgaactaccaaccttaaagacttttctgaaagcccaaaaaaaaaaaaaaaaaaaaaaaaa

SEQ ID NO: 1530 - DNA, 3653 bp, Rattus norvegicus
  Genbank Accession No. NM_012734
cgccgatctgccgctggaggaccactgctcaccagggctactgaggagccactggccccacacctgcttttccgcatcccccaccgtcagcatgatcgccgcgcaactactggcctattacttcaccgagctgaaggatgaccaagtcaaaaagattgacaagtatctgtacgccatgcggctctctgatgagattctgatagatatcctgacacgattcaagaaagagatgaagaatggcctctcccgggattataatccaacagcctccgtcaagatgctgcccaccttcgtccggtccattccggacggctcagaaaagggggatttcattgccctggatctcggcgggtcttcctttcgaatcctgcgggtgcaggtgaaccacgagaagaaccagaacgtcagcatggagtctgagatctacgacaccccagagaacatcgtgcatggcagtggaacccagcttttcgatcatgtcgctgactgcctgggagacttcatggagaaaaagaagatcaaggacaagaagttacccgtgggattcacattttccttcccctgccgacaatccaagatagatgaggctgtactgatcacgtggacaaagcggttcaaagccagtggcgtggaaggagcggatgtggtcaagttgctgaataaagccattaagaagcgaggggactatgatgctaacattgtcgccgtggtgaatgacacagtagggaccatgatgacctgcggttatgatgaccaacagtgtgaagtcggcctgatcattggcacaggcaccaatgcttgctacatggaggaactgcgacacatcgacctggtggaaggcgacgaggggaggatgtgtattaacacggaatggggagcctttggggatgatgggtccctggaagacatccgaaccgagtttgacagagagttagaccgtggatctctcaaccctgggaagcagctgttcgagaagatggtgagcggcatgtacatgggggagctggtccggctaatcctggtgaagatggccaaggaaggcctcttattcgaagggcgcatcactccagagctgctcacgaggggaaagttcaacactagtgacgtgtccgccattgaaaaggataaggaaggcattcaaaatgccaaggaaatcttaacccgcttgggagtggagccgtctgatgttgactgtgtgtcggtccagcacatctgcacgatcgtctccttccgatcagccaacctggtggccgccacgctcggtgccatcttgaaccgcctgcgggacaacaagggcacaccacgcctgcggaccacggttggcgtggacggttctctctacaagatgcacccacagtactcccggcggttccacaagaccctgaggcgcctggtgcctgactccgacgtccgtttcctcctctcagagagtggcacgggcaagggggccgccatggtgacggcagtagcctaccgcctggctgagcagcaccggcagattgaggaaaccctggcccacttccgcctcagcaagcagacgctgatggaggtgaagaagaggctacggacagagatggaaatggggctgaggaaggagaccaacagcaaagctactgtcaaaatgctgccttcttttgtccggagcatcccggatgggactgaacacggtgacttcctggccttggatcttggaggaacgaatttccgggttctgctggtaaagatccgcagtgggaaaaagagaacagtggaaatgcacaacaagatctactccattcccctggaaatcatgcagggcaccggggatgagctgtttgaccacatcgtctcctgcatctctgacttcctggactacatggggatcaaaggcccccggatgcctctgggcttcaccttctcatttccctgccatcagacgaacctggactgtggaatcttgatctcatggacaaagggtttcaaagccactgactgtgagggccatgatgtagcctccttactgagggatgcggtgaagaggagagaggaatttgacttggatgtggtggctgtggtcaacgacaccgtgggcaccatgatgacctgtgcgtatgaagaacccacttgcgaaattggactcatcgtggggacgggcaccaatgcctgctacatggaggagatgaagaatgtggagatggtggaggggaaccagggccagatgtgcatcaacatggagtggggcgccttcggtgacaatgggtgtctggatgacatcagaacagactttgacaaagtggtggacgaatattctctaaactctgggaaacaaaggtttgagaaaatgatcagtgggatgtacctgggtgagatcgtccgtaacatcctgattgacttcaccaagaaaggcttcctcttccggggacagatctccgaaccactcaagacccgaggcatctttgagaccaagtttctctctcagattgagagtgaccggttagcgctgctccaggtgcgggccatccttcagcagctgggtttgaacagcacgtgtgacgacagtatcctggtcaagaccgtgtgtggggtggtgtccaagagggcggctcagctgtgtggtgccggcatggccgccgtggtggaaaagatcagagagaacagaggcctagaccatctgaatgtaactgtgggagtggatgggacgctctacaaacttcatccacacttctccagaatcatgcaccaaactgtgaaggaactgtcaccaaagtgtaccgtgtccttcctcctgtctgaagacggcagcggcaagggggccgcccttatcacagctgtgggcgtgcggctcagaggagacccttcgatcgcctaaaagccaggatcctcccagcccccagcccgccacccttccagcactcctctctagaaccgacgaccacacccccgtgttccacccagcaagccctgggagacccagccagcgcccactccgccgcagcagagggaggaaggggaccgcagtaacggagcaccacgtagaataccacccagagcgcgtgtgctgttgatctgatctctcgcctggacccctaatccctgccctgccactctgcatgattcaagttcgacctggccatgcattgcccatgagtgaacgtagcggcaccccggtgcgtctactgcagatgtccagctaggaaagagtcccctctcttggacagtcttctgggcccttccaagcccatccgtggagtcggcctctcctcccctctcccccgtgtgaagtgtgttatcaccagcagacactgccggactcctgcccacaggggcgtggcctgaaggcggagtgtggacatggcactgctgttccgttcccttcccctcccagcacccgccgcagcctgccatcccgtctggatgtatcgatgccacagaattgtgaattgtgtgtccgtccgtggagccagtcctagccacattattgacagtcttgcattttgttttgtctcctggtggtgggggtggaggtggtaggggtgcgctaaggtgggcagtcctgtgggagaacatcttgctagaaggaaccaacccacgaaacaacaccatcactggaatttccatcgcccgaattctttagtgagccattgttgtacgtctagtaaactttgtactgattc

SEQ ID NO: 1531 - DNA, 3945 bp, Rattus norvegicus
  Genbank Accession No. NM_012744
cgcggcggccacggcttgaggcgacggggcgaagatgctgaagttccaaacagttcgagggggcctgaggctcctgggtgtccgccgatcctccacagcccccgttgcctccccaaatgtccggcgtctggagtacaagcccatcaagaaagtaatggtggccaacagaggtgagattgccatccgagtgtttcgtgcctgcacagagctgggtatccgcacagtggctgtctactcggagcaggacacaggccagatgcaccggcagaaagctgatgaagcctaccttattggccgtgggctggctcctgtgcaagcctacctgcacattccagacatcattaaggtggccaaggagaatggtgtagatgctgtgcaccctggctatgggttcctctcagagagagcagactttgcccaggcctgccaagatgctggagtccgattcattggtccaagcccagaggtggtccgcaagatgggagacaaggtggaagcccgggccattgccattgctgcaggcgttccagtggtccctggcactaattcccccatcaattccctgcatgaggcacacgagttctctaacacctatggtttccctattatcttcaaggctgcctatggaggtgggggccgtggcatgagggttgtgcatagctacgaggagctggaagagaattacacccgggcctaccctgaggccttggcagcctttgggaatggggcattgtttgtggagaaattcattgagaagccaagacacattgaggtgcagatcctaggggaccaatatgggaacatcttgcacttgtatgagcgggactgctccatccagcggcggcaccagaaggtggtagagattgcccctgctacccacctggacccccaacttcggtcacgcctcaccagtgactctgtcaaacttgccaagcaggttggctatgagaatgcaggcactgtggagttcctggtggacaagcatggcaagcactacttcatcgaggtcaattcccgcctgcaggtggagcacacggtcactgaggagattacagatgtggacctggtccatgctcagatccatgtgtccgaaggccggagcctgcctgacctaggcctgcggcaggaaaacatccgaatcaatggttgtgccattcagtgtcgggtcaccactgaggaccctgcacgcagcttccagccagacactggccgcattgaggttttccggagtggtgagggcatgggcatccgcctggacaatgcctcagcattccagggagctgtcatatccccccactatgactccctgctcgtcaaagtcattgcccatggcaaagaccaccctacagctgccaccaagatgagcagagccctggcggagttccgtgtccgaggtgtaaagaccaacatccccttcctgcagaatgtgctcaacaaccagcagttcctagcgggcattgtggacacccagttcatcgatgagaaccccgagctgttccagctgcggcctgcacagaaccgggcccagaagttgctacattaccttggacacgtcatggtcaatggccctaccactccaatccccgtcaaggtcagtcccagccctgtggaccccattgttcctgtggtgcccataggcccacccccagctggtttcagagacatccttctgcgagaggggccagagggctttgccagagctgtgcggaatcaccaggggctgctgctaatggacacaaccttccgggatgcccaccagtcactacttgccactagagtgcgcacacacgatctcaaaaagattgcaccctacgttgcccacaacttcaacaacctcttcagcatagagaactggggaggagccacatttgacgtggccatgcgcttcttgtatgagtgcccctggcggcggctccaggagctccgggagctcatccccaacatcccattccagatgctactgaggggggccaatgctgtgggctacaccaactaccctgacaacgtggtcttcaagttctgtgaggtggccaaagagaatggcatggacgtcttccggatctttgactcccttaactacctgccaaacatgctgctgggcatggaagcagctggcagtgctgggggtgtggtggaagctgccatctcctacacgggtgacgtggctgaccccagtcgcactaaatactcactggagtactacatgggcttagctgaagaactggtgcgagccggcactcacatcctctgcattaaggacatggcaggcctgctgaagcctgcagcatgcaccatgctggtcagctccctccgggaccggttccccgacctcccactgcacatccatacccatgacacatcagggtcaggtgtggcagccatgttggcctgtgcacaagctggggctgatgttgtggatgtggcagtcgactctatgtctgggatgacctcacagcccagcatgggggccctggtggcctgtaccaaagggactcctctggacacagaggtacccctggagcgtgtgtttgactacagtgagtattgggaaggggctcgggggctgtatgcagcctttgattgcacggctaccatgaagtctggcaactcagacgtgtatgagaatgaggatccagggggccagtacaccaacctacacttccaggcccacagcatgggacttggctccaagttcaaggaggtcaagaaggcctatgtggaggctaaccagatgctgggggacctcatcaaggtgacaccatcctccaagattgtgggggatctggcccagttcatggtgcagaacgggttgagccgggcagaggcagaagctcaggcagaagagctgtccttcccccgctctgtggtggagttcctgcagggctacattggcattccccatgggggtttccctgaacccttccgttctaaggtgctaaaggacctgccaaggatagaaggagggcctggagcctccctccctcccttgaacctgaaggagctggagaaggacctgattgataggcatggagaggaggtgaccccagaggacgttctctctgcagccatgtaccctgatgtctttgctcagttcaaagacttcacggctacctttggccccctggatagcctgaatactcgtctctttcttcaaggacccaaaattgcagaggagtttgaggttgagctggaacggggcaagaccttgcacatcaaagccctggctgtaagcgacctgaaccgtgctggccagaggcaggtgttctttgaactcaatgggcagcttcgatccattctggttaaagacacccaggccatgaaggagatgcacttccatcccaaggccttgaaggatgtgaagggccaaattggggcccctatgcctgggaaggtcatagacgtcaaggtggcagcaggagccaaggtggttaagggccagcccctctgtgtgctcagcgccatgaagatggagactgtggtgacttcgcccatggagggcactatccgaaaggttcacgtgaccaaggacatgactctggaaggcgatgacctcatcctagagattgagtgatcttactccagactggcagcctggccaaccctaccccaagcctctcaacagaagctgtgcagccagggcaggcccaggcagtacctgagggctaggccttgaggtcctgtcccatgggacagcacacacactacctgcaatggccctcccattcccttcagctatttgtccttgtcttgctggcaggcagttctcacatattcatctcttgccaaataagggtctgctcctcgtgggagaccacaggtgtacagtaggtggccttgtacctgggagaggggttctacctctgggggtagagggaagaagacctaattcataggtcctgggaaatttgctcaataaaagtggccttcccttgccctccacaaaaa

SEQ ID NO: 1532 - DNA, 2924 bp, Rattus norvegicus
  Genbank Accession No. NM_012747
atggctcagtggaaccagctccagcagctggacacgcgctacctggagcagcttcatcagctgtacagcgatagcttccccatggagctgcggcagttcctggcgccttggattgagagccaagattgggcatatgcagccagcaaagagtcacacgccactctggtgtttcataacctcttgggcgagatcgaccagcagtatagccgattcctgcaggagtccaatgtcctctatcagcacaacctgcgaagaatcaagcagttcctgcagagcaggtatcttgagaagccaatggaaattgcccggattgtggcccgatgcctgtgggaagagtctcgcctcctccagacggcagccacggcagcccagcaagggggccaggccaaccaccccacagctgccgtagtgacggagaagcagcagatgctggaacagcatcttcaggatgtccggaagcgtgtgcaggatctagaacagaaaatgaaagtggtggagaatctccaggatgactttgatttcaactataaaaccctcaagagtcaaggagacatgcaggatctgaatggaaacaaccagtctgtgaccagacagaagatgcagcagctggagcagatgctcacggccctggaccagatgcggaggagcatcgtgagcgagctggcagggctcttgtcagcaatggagtacgtgcagaagacactgaccgatgaagagctggctgactggaagaggcggcagcagatagcgtgcatcggaggccctcccaacatctgcctggaccgtctggaaaactggataacttcattagcagaatctcaacttcagacccgccaacaaattaagaaactggaggagctgcagcagaaagtgtcctacaagggggaccctattgtgcagcaccggccaatgctggaggagaggatcgtggatctgttcagaaacttaatgaagagtgccttcgtggtggagcggcagccctgtatgcccatgcacccggaccggcccttagtcatcaagactggtgtccagtttaccacaaaagtcaggttgctggtcaaatttcctgagttgaattatcagcttaaaattaaagtgtgcattgataaggactctggggatgtcgctgccctcagagggtctcggaaatttaacattctgggcacgaacacaaaggtgatgaacatggaggagtccaacaacggtagcctgtctgcagagttcaagcacctgaccctgagggagcagagatgtgggaatgggggccgtgccaattgtgatgcctccttgattgtcactgaggagctgcacctgatcacctttgagacagaggtgtaccaccaaggtctcaagatcgacctagagacccactccttgccagtcgtggtgatctccaacatctgtcagatgcctaatgcttgggcatcaatcctgtggtataacatgctgaccaataaccccaagaacgtgaacttcttcactaagcctccgattggaacctgggaccaagtggccgaggtgctgagctggcagttctcgtccaccaccaagcgagggctgagcatcgagcagctgaccaccctggccgagaagctcttagggcctggtgtgaactactcagggtgtcagatcacatgggctaagttttgcaaagaaaacatggccggcaagggcttctcgttctgggtctggctagacaatatcatcgaccttgtgaaaaagtatatcttggccctttggaatgaagggtacatcatgggtttcatcagcaaggagcgggagagggccatcctaagcacaaagcccccgggcaccttcctgctgcggttcagtgagagcagcaaggaaggaggggtcactttcacttgggtggaaaaggacatcagtggcaagacccagatccagtctgtagaaccatataccaagcagcagctgaacaacatgtcatttgctgaaatcatcatgggctataagatcatggacgctaccaacatcctggtatccccactggtctacctctaccctgacattcccaaggaggaggcattcggaaagtattgtcgccccgagagccaggagcaccctgaagctgacccaggtagtgctgccccttacctgaagaccaagttcatctgtgtgacaccaacgacctgcagcaataccattgacctgccgatgtccccccgcactttagattcattgatgcagtttggaaataacggtgaaggtgctgagccctcagcaggagggcagtttgagtcgctcacgtttgacatggatctgacctcggagtgtgctacctccccgatgtgaggagctgaaaggcaaagctacagagtatgactgagacactgcccatgtcaccttagcagcaactcagatcactgaactcactgtgtccagattttttctttaacctcctacttctgctgtctttgggcagtctgggtactttttaaaatagagaactgagtgagcgtgggtgatgcgctcttatgtgaggaggagggcacctcttgagtccgtgatggctgtgaaagcagagggctgggggggagcgaaaggaaacacctatgttctgtccgcctgtcctcctggtttgttgttgacaagcgcctcctggtgccatggcatcctgctgcccctttctgtgagctgataccccaggctgggactcccggctctgcactttcaacctggttaatgtccacatagaagctaggactaagcctataggcttctctttaagttaaaaaaaaaaaaaatactaagaattaaagggcaaaacacactgaaaacagcatagcctttccatatcaaagaaaactcgggtaacagccttttcggtgctttaagctgtcttaggctgatcatttatataaactctgcaatggttcaatcaatctgtaaagacagctgagaac

SEQ ID NO: 1533 - DNA, 2142 bp, Rattus norvegicus
  Genbank Accession No. NM_012749
atggtgaaactcgcaaaggccggcaaaacccacggagagtccaagaaaatggctcctcctccaaaggaggtggaagaagatagtgaggatgaagaaatgtcagaagatgaagatgacagcagtggagaagaggaggttgtcatccctcagaagaaaggcaaaaaggctaccacaactccagcaaagaaggtggttgtttcacaaacaaaaaaggctgcagttcccacaccagctaagaaagcagctgttaccccaggcaaaaaggcagcagccacaccagccaagaaagctgttacaccagccaaagtagttccaacacctggtaaaaagggagctgcacaagcaaaagcattggtaccaactcctggtaaaaagggagctgtcactccagccaagggggctaagaatggtaagaatgccaagaaggaagacagcgatgaggatgaagatgaagaggatgaagatgacagcgatgaggatgaagatgaagaggatgaatttgagccaccggtagtaaaaggagtgaaaccagcaaaagcagctcctgctgctcctgcctcagaggatgaggatgaggaagatgatgatgatgaagatgatgatgatgatgatgaagaggaggaggaggaagatgactctgaggaagaagttatggagatcacaccagccaaaggaaagaaaactcctgcaaaagttgttcctgtgaaagccaagagtgtggccgaggaggaggaagatgatgaggatgatgaagatgaagaggaggatgaagatgaagaagatgaagaggacgatgaagatgaggatgaggaagaagaggaagaacctgttaaagcagcacctggaaaacggaagaaggagatgaccaagcagaaagaagcccctgaagccaagaaacagaaaatagaaggctcagaaccaactacacctttcaacctgttcattggaaaccttaatccaaacaagtctgttgctgaattaaaagttgccatcagtgaactttttgctaaaaatgatcttgctgctgtggatgtcagaactggtacaaataggaaatttggttatgttgattttgagtctgctgaagacctagaaaaggccctggagctcactggtttaaaagtgtttggcaatgaaattaaactagaaaaaccaaaaggaagagatagtaagaaagttcgagctgcaagaacacttttagccaaaaacctctctttcaacatcactgaggatgaattaaaagaagtgtttgaagatgctgtggagatcagattagtcagccaggatgggagaagtaaagggattgcttatattgaatttaagtctgaggctgatgcagagaaaaacttggaagaaaagcagggggcagaaattgatggacggtctgtttcactctactacactggagagaaaggacaaaggcaagagagaactggaaagaatagcacttggagtggtgaatcaaagactttggttttaagtaacctttcctacagtgcaacagaagaaacacttcaggaagtattcgagaaagcaacctttattaaagtgccccagaacccacatggcaaatctaaagggtatgcatttatagaatttgcttcatttgaagatgctaaagaagctttaaattcctgtaataaaatggaaattgagggcagaacaatcaggctggagttgcaaggacccaggggatcacctaatgcgagaagtcagccatccaaaactctgtttgtcaaaggtctgtctgaggataccactgaagagaccttaaaagaatcatttgagggctctgttcgtgcaagaatagtaactgatcgggaaactggttcttctaaagggtttggttttgtagactttaatagtgaggaagatgccaaagctgccaaggaggccatggaagatggagaaattgatggaaacaaagttaccttggactgggccaaacctaagggtgaaggtggctttggtggtcgaggtggaggcagaggaggtttcggaggcagaggtggtggcagaggcggaagaggcggatttggcggaagaggccggggagggtttggaggcagaggaggcttccgaggcggcagaggaggcgggggagacttcaagccacaaggaaagaagacgaagtttgaatag

SEQ ID NO: 1534 - DNA, 1703 bp, Rattus norvegicus
  Genbank Accession No. NM_012752
ggcacgagtctccacgcaccggagcatccagagagtcgccgcgcgccgacggagcggacatgggcagagcgatggtggtcaggctagggctggggttgctgcttctggcactgctcctacccacgcagatttattgcaaccaaacatcggttgcaccattttccgggaaccagagtatctctgctgccccaaatccaactaatgctaccaccagatctgggtgtagctccctgcagtccacagccggtctcctggccctctctctctctctcctacatctctactgttagagactcaggccaagaaacgtctctacttccccatctagacccaccccgaatggcaaccacaagtccaatgtgagtgaccaggaagagacaggtccacatcaaatcggctgttaccattacctcaacagaaaacactgagaatccgaaattcgactggcttaaaggacgcgtgaagggtttgagagctgagagatgccaatatgggatctgctggagttttatgtccgagatgaagacaagcatccaaaattgacgtgatttgctcgaaatgtggcttaagaaatgtggacacttaaaactctcactcgaaatcgggcgtaggtttgatgtagagggagaaggatggggtgtggaatggaggtccattattttcattggttccttcgacctataaggccataatgcagttaggtggtattcaaaagcttctctgatgctatttctgtgtatgttggaaggaactaccaggtgttattttaaatccccgatgtgttgttttgttactactaatttaataggctaaactctaggtgaagtcccacgtcgttgacctctagttcttctctccggaacagaacgttttacaccctccttctgtggctttaggtcacccacccccaaatccagccacccctgagtaaatctgatttcaaaagtcacaacggcaaagcatttcccagtgtcttttctcactcaccacgggtactaagttcacttaggtgagctggttctccagagagcagaattctgttgatctcggctaatctccaaacgctgcgttttattttggcatatgtcgagggcttttcatgatttaaagcgtggtctgttagcaaggccaaaattatgagtcttgaaattctacaggcaaatatgcaacccagcatttgggatgtgaggactggaagctctcacagaattacacaaagtcttttatacaatttctgtaaatacttttttttttttaaagagaaaaacaaaaccatggatcggaataaccacgtttggaatactttggttatcagttcatatttttagatagtttgacattggtcctgtgcctgagagggggtttggttctacagtaagtttttttttcccccaatttccttgatacacacataccttctaaaacacagacatttcctcaaaaaaaaaaaaaaattccttttgttcgcatggtcacacactgatgcttgccattctgggatctaatacggtcacagtagtcttgataaccagaatcatttttttctccgtctttagaaacctacccgggaacaaggagacctcacagacccgaagctactgtgtgtgtgaatgaacactccccttgcctcatacccgaatgctgtacatctatttgattgtatattgtgtttgtgtattgtaaataaaagaaagaaatggctg

SEQ ID NO: 1535 - DNA, 8810 bp, Rattus norvegicus
  Genbank Accession No. NM_012756
agcttcgactcgctgttgcggcgcgatcgagacccaggcgcggctcggaacggccagccgccgtgagccccacgccacacgcgatgcgggccgttctgccgggacccgtgcctccggggccgcgcgtcgcgctcctgctgccgctcctgctgctgctgctcgtggcggccgcgggctccgcgcagggccaggccgtggacttggacgccttgtgcagttacacatgggaagctgttgattccaaaaataatgcagtttataaaatcaacccctgtggacatgtggataatcccaggtgtgggccgacaagtgctgtctgtatgtgtgacctaaagtcagaaaactgccggtcagtgggtgactcacttttgagaagttcagccaaatcactcctggaatttaacaccactacgggctgccagccttcagagcacagaatccagactagcattacatttctgtgtgggaagaccctgggaactcctgaatttgtaactgccacagactgtgtgcattacttcgaatggaggactactgcagcctgcaagaaagacatatttaaagctgataaggaggtgccatgctatgtatttgatgacaagttacagaagcatgatttgaacccactgatcaagctgaatggcggctacctggtggatgactctgacgctgacgcatctctgttcatcaatgtgtgtagagacatagactcccttcgggaccccagcacacagctgagagtctgccctgctggcactgctgcctgtctgctgaaggggaaccaggcatttgatgttggccggcccaaggaggggctgaagctattgagcaaggacaggctcgttctgacttatgttaaggaagaaggagaaaagccagacttctgtaatggtcacagccctgcagtgacagtaacatttgtgtgcccatctgagcggagagagggcaccattcctaaactcactgccaactgtcgctatgaagttgagtggatcactgagtatgccagccacagagattacttggagagtgaaacctgctccctcagcagtgagcagcatgatattgctattgaccttagtcccttggcccagcatgaagaagggtccccctatgtagctgatggaggagaatataggttttttatgaatgtctgtggggacacaaaggtctcactctgtaacaaagaggctgctgtttgtcaagagaaaaaggtggattccactcaagtcaaaatagcaggaagacaccagaaccagacactccggtactcagatggagatctcaccctaatctattctggaggtgatgagtgtagttccggcttccagcggatgagtgtcataaactttgagtgcaacaaaaccgcaggtcaagatgggagaggagagcctgtgttcacaatcgaggtggactgcacatacttcttcacgtgggacactaaatatgcctgtgtaaaagagaaggaagatctcctctgcggggccatcgacggcaagaaacgttacgacctgtctgtgctggctcgtcactcagaatcagaacagaattgggaagcagtggatggcagccaggctgagtcagaaaagaggaatttcttcatcaatgtctgtcaccgggtgctgcaggcgggaaaggccaagaactgtcctgaaggtgctgccgtgtgtgctgtggataagagtggaagtaaaaatctaggaaaatttgtctcttctcctacaaaagagaaaggacacattcagctctcttactctgatggcgatgactgtggtaatgataagaaaataacaactaacatcacatttgtgtgcaaaccaggtgatctggaaagtgctccagtgctgagagctgcagggcccgatggctgctcctatgagtttgagtggcacacagctgctgcctgtgtcctgtcgcagacggagggagaaaactgcactgtccttgatgctcaggcagggttttcttttgatttgtcactcctcacaaagaagaatggtgcatataaagttgagacagacaagtatgacttctacataaatgtttgtggccctgtatccgtgaacctgtgtcagtcaaactcaggagcctgccaggtagcaaaaagtggtaagtcttggaacttggggctgagtaatactaagcttacgtactatgatgggatgatccagctgagctacaggaatggcacgctgtataacaatgaaaagcacacaccgagatccacactgattaccttcctctgtgaccgtgatgctggagtgggcttcccagaatatcaggaagaggacaactctacctacaacttccggtggtacaccagttatgcttgcccggaagagcccctggagtgcatggtgacagacccctccatgatggagcaatatgacctctccagtctagtgaagtttgaaggtggccgtggaggaaactggtatgccatggaaaactcccgagaacatttcacacggaggaaatactacctcaacgtgtgccggcctctaaatcctgtgccaggctgtgatcgatatgcatctgcttgccagagtaaatacgaaaacaatgagggctccttggcagagactgtggccatcagtaacttgggagttgcaaagacaggccctgtggtggaggagagcggcagcctcctcttagagtatgtgaacggctctgcgtgcaccaccagtgatggccggctaaccacctacagcaccaggatccatcttgtgtgtggtcgaggaactatgaattcccatcccatattcactttcaactgggaatgtgtggtcagtttcttgtggaacacggaggctgcctgccccatccagacgatcacagattcagaccaggcttgctctataagggaccccaacagcggatttgtgtttaatctgagcccacttaactattctcaaggacacatggtcttaggcattgggaagacttttgtgttcaatatctgtggtacaatgcctgcctgtggaacggttgcagggaagccagcccttggctgtgaggcagaaactaagatcaaagacattaaggatctgaagccagaaaggccagtcgggatggagaagagcctccagttgtctgccgaggggttcctcactctgacctacaaaggctcttctccttctgacagaggcacagccttcatcatccgtttcatttgcaatggtgacatttacccagggacccccaagttcctgcatcaggacattgactctgcacgagggatccggaacaccttctttgagtttgaaactgcattggcttgtattccttctgtagtggattgtcaagtgactgacccagctgggaacgagtacgacctgagtgccctgagcatggtcaggaagccgtggactgctgtggacacgtctgtgcatgggaagaagaggcgcttctatctgagcgtgtgcaccccactgccttacattcctggctgcgatggcattgcaatggggtcctgcatggtgtcagaagacaaaagtcagaacttgggtgtggtgcagatcagtcctcaagctactggaaacggatctctcagcatcctgtatgtgaatggggataggtgtggaaaccagcgctactccaccaggatagtgttcgaatgtgcccagacgtcgggctcacctatgttccagctcctgaacaactgtgagtatgtgtttgtgtggcgaacagtggaggcctgccctgtggtcagagaggaaggagacaactgccaggtgaaagaccccagacacggcaatttgtatgacctgaagcccctggccctcaatgacaccatcatcagtgctggcgagtacacctactacttccgggtctgtggaaagctgtccttagatgtgtgctctgcccatgatgggtccaaggcagtctcatcatgccaggaaaagaaaggaccacaaggattccagaaagtggcagggctccttaatcagaagctgactttcgaaaatggactgttgaaaatgaactacagtgggggggacacctgccataaggtgtatcagcgctccacaaccatctatttctactgtgaccggacgactcagaagccagtgtttctgaaggaaactttggactgctcctatttgtttgagtggcgaacacagtatgcctgcccacctttcaatgtgacagagtgctctatccaggatgaggctggcaactccattgacctctcctcactgtcaagatacagtgacaactgggaggctgtgaccaggacaggggccactgagcattacctcatcaacgtatgcaagtctctgtctccacaggctggcacagatccatgccctccagaggcagctgtttgtctgctggatggctccaagcctgtgaacctcggcagggtgagggatggtcctcagtggacagctggtgtgactgtcctgaagtatgtggatggtgacttgtgccccgacaaaattcggaaaaggtcaaccattattcgcttcacctgcagtgacagccaagtgaactccaggcctctgttcatcagtgctgtacaggactgtgagtacacattttcctggcccacacctgctgcctgtcctgtgaagagcaacatacacgatgactgccaagtcaccaaccccagcacaggccacctgtttgacctgagctccctaagtggcaaagctggcatcacagcctcctacagcgagaaggggatggtcttcatgagcatctgtgaggagaatgtgaactgtagccctggagtaggggcctgctttggacagaccaggatcagtgtgggccaggccagcaagaggctgagctacaaggatcaggtcttgcagctggtgtatgagaatgggtccccatgcccctccaagtcaggcctgaggtacaagagtgtcatcagcttcgtgtgccggccggaggctggacccaccaacaggcccatgctcatctccttggacaagcagtcgtgtacactcttcttctcctggcacacgcccctggcctgtgagcaggcgacggaatgcaccgtgcggaatggaagctcgattattgacctgtcacctctcatccaccgcactggtggttatgaagcatacgatgagagtgaggacgacacctctgataccacccctgacttctacatcaacatctgtcagccactgaatcccatgcatggagtgccctgccctgcaggcgcctcagtatgcaaagtccccgtggacgggccccctatagatattgggagagtcacaggccctccaatattcaatcccgtggccaatgaggtctacctgaactttgagagcagcactccttgcttagcggacaaatatatgaactacacctcactaattgcgtttcactgcaggagagggatcagcatgggaactcctaagctgataaggaacaatgactgtgactttgtgtttgagtgggagactccgattgtctgtcctgacgaagtgaagacacagggctgtgctgtaacagatgagcagctgctctatagcttcaacctgacgagcctttccacaagcactttcaaagtcactcgggacgctcacacatacagtataggggtgtgcacaacggcagctgacttagaccaggaaggctgcaaggacggcggggtctgtctgctctctgggagcaaaggagcttcttttgggcgcctagcgtcgatgcagctggattacaggcaccaggatgaagcagtcatcctgagttatgtgaacggtgatccttgccctccagaaacggaagatggcgagccctgtgtcttccccttcatttacaaaggggagacctatgacgaatgtgtattagagggacgagcgaaactgtggtgtagcaaaactgcgaattacgatcgtgaccacgagtggggcttctgcagaccgagcaacagtcaccggatgtctgcgatcatatttacttgtgatgagaacgaagatattgggaggccagaagtgttcagtgaagatcgtgggtgtgaggtgacatttgagtggaaaacaaaagttgtctgccctccgaagaagatggagtgcaagtttgttcagaagcataaaacctatgacttgcgattgctctcatccctcacggggtcctgggattttgtgcatgaaggaaactcgtactttatcaatctgtgccaaagagtatataaaggtcccctggactgctctgagagagccagcatttgcaagaagagtgccactggtcaagtccaggttttggggcttgttcatactcaaaaactggaagtcatagatgaaacagtccttgtcacttactcaaaaggccattcttgtggtgggaataagactgcatcctcagtgatcgagttgacctgtgcaaagactgtgggcaggcctgcattcaagaggtttgatattgacagctgcacctactacttttactggtactcacgggctgcctgtgctgtgagacctcaggaggtgaacatggtgaatggaactcttaccaaccctgtgactggcaagagcttcagcctcggggaaatttattttaagctgttcagcgcctctggggacatgagaagcaatggggacaactatctgtatgagatccagctctcctctatctccagctcttctaaccctgcgtgctccggtgccaacatctgccaggtgaagcccaatgaccagcacttcagcaggaaagtgggcacctctgacatgaccaagtactacgtccaagacggtgatctggatgtggtgtttacctcttcctccacgtgtggcaaagataagaccaagtctgtgtcttccaccatcttcttccactgtgaccctctgctgaaggacggggtccccgagttcagccacgagactgctgactgccagtaccttttctcctggtacacttcagctgtgtgtcctctgggtgtggactttgatgatgagaatgctgtgccagagtataaagggctctcagagcggagtcaggccgttggggcagtcctcagtctcctcctggtggcactgactggctgtctgctggccttgctgcttcataagaaggagagaagggaaactgtgataaacaagctgaccaattgctgcagaaggagctcgggggtgtcctataagtactcaaaggtcagcaaggaggaggagacagatgagaatgagacagaatggctgatggaagagatccaggtgccagcccccagactaggcaaggacgggcaggagaacggccacattaccaccaagacggtgaaagcagaagctctcacttccctgcatggggatgaccaagacagtgaggatgaggtcctgaccatcccagaggtgaaagttcacacaggcagaggagccgaggtggaaagctcacagcccctgagaaatccccagcgcaaggtcctgaaggaaagggagggggagaggatggggctggtccgcggtgagaaggccagaagagggaagttcagacccggacagcgcaagccaacaacccctgccaagctggtgtccttccatgatgacagtgacgaggacctcctacacatctgactccgtggtgcctacaggagaaggtggcaccatggacagccaagcatctccaaccaaataagacttcagctcgatgatgcgtctgtcattttgcctttaacaaaactgcttcaaagggaagtttctgtaatgggggagaggatgggggaggtgggcaccactcttccatgatcgtttacagtcagtggaacaaggtgttgcttgaatcggccaaagggcgctacttggtgcccagggttttgccccaagtcctcacttacgatcatagctgctgtgtgcttccaacaggtgcccaggccacatgcatctcacaacagagggctgtgtttgaaaaaaacccttgctgctttagaccctatagggtgaccatttatatttttagcattgtaattctctccccctatttattgactttgacaattactactcaggtttgcgaaaaaggaaaaaaaaaaaaaaaccagtttcttctgccagcaagggcataaggtgaagctggcattatgctggagccttgtacgtggctcctgagctggtccttgatgcacactttagtgagctgcagtattctattcttcgctttgcgttttgtaagggcacacatacatgcacaggtccccgagtgcctcggtttgggaaggcccgcctgctccgtgccctacctcgtctctatagctgcagctctttgcacgaatccttctgggtgtcgcttttgcccgctggtgagcgccagcagctcacccagaggtgggtgtttgtgcatgcgatggagtagaggctcttggagaggagccgcacttcaggtttgggctgtaggtctcatctcttcaggttctcaatgccacctttactgtgctttttgcttttattttaagggggaaatgtttatcacccattcaacctataagaagccttaatttgcacagggtgacttacagacaccgtgaaatacggtgggccagtgttgtgtgtgggcttgtgcagggcagtgtcccgggatggaaggccaggcccggtccactggctgtggactcctttcctgatgtgttcaatgacttctcacattatagagttgtatataggtggtatttacatacccagaagcaaagtaccccgcagaatttcttggtttatgcctgattttgctagcttatttgatttcacattgagtgtatttttaaaaattgatttttttcttcattttttaatcaactttactgtaatatgaagtattcaatttcaataaaaataaattattaaaaaaaaaaaaaaaaaaaaaaaaaaaaa

SEQ ID NO: 1536 - DNA, 5028 bp, Rattus norvegicus
  Genbank Accession No. NM_012760
gcctggcaggcgggagaacgctccggagttgtggccgtgggcaccgggctcgcggcaagaggagcggagagcgggcatctcctgagcgccgtcatggctgcttaggctgcgcctgccagcggaccgacggtgtcgcccgaatccggctcggataggtctggttggagtctgtgcctgcttgcttggcgtgtggttgttcctgcttgattggcacggtgccattggcttcgtatttgggaatcggaggagttaatcttgtctcttctcacaggttcgagtcctcagaccttctgcaggactccatccatatctgcctcgcagctgactctcctgctcacacagaagacggccatcctagatccccagctattgtgctgaccatccccttcctgctccggatctcgcctggctgctaggctgtggtgctgccttttcagagtcaggctgtagcgactccccgccttcgtcccggctgggcttaggtggaacagtggttcatctcatctcatcagcacttctgaagaagaaagtgtgagaagcagaggccatggctccttttcgctgtcaaaaatgcggcaagtccttcctcaccctggagaagttcaccatccacaattattcccacaccagggagcgcccattcaagtgctccaagactgagtgtggcaaagccttcgtctccaagtataagctgatgagacacatggctacgcactctccccagaagacgcaccagtgcactcattgtgaaaagactttcaaccggaaggatcatctgaagaatcacctccagacccacgatcccaacaagatgatctacgcctgcgaagattgtggcaagaaataccacaccatgctgggctacaagaggcacatggccctgcattcggccagcagcggcgatctcacctgcggcgtctgcaccctggagctggggagcaccgaggtcctgctggaccacctcaagtctcacgcggaagaaaaggcccaccacgcgcccagggagaagaaacaccagtgcgaccactgcgagagatgcttctacacccggaaggatgtgcgtcgccacctggtggtccacacaggatgcaaggacttcctgtgtcagttctgcgcccagagatttgggcgcaaagaccacctcactcgtcacaccaagaagacccactcccaggagctgatgcaagagagcctgcaagcaggagaataccagggcggttaccaacccattgcgcctccgttccagatcaaggctgatcccatgcctcctttccagttagaaatgccccccgagagcgggcttgatgggggcttgcctcctgagattcatggtctagtgcttgcttccccagaggaggttccccagcctatgctgtctatgccgccaatgcagccaatgccagagcagcctttcactctgcaccctggggtagttccctcctctcctcccccgatcattcttcaggagcataagtacagcccagttcctacctcttttgccccgttcgtaagcatgccgatgaaagcagatctcaagggcttttgcaacatgggtctctttgaggaatttcctctgcaagagtgtcagtcgcctgtcaagttcagtcagtgctttgagatggctaaggaagggtttgggaaagtcaccctgcccaaagagctgctggtagatgctgtaaatatagccattcctggctctctggagatttcctctctcttggggttctggcagctgccccctcctcctccccagaatggcttcatgaatggcaccatccctgtgggggccggggagccgctgccccataggataacttgtctggcacagcagcagccaccacctctgctacctccgccgccgccgctgccgctgccagagccgctgccacagccacagctgccgccacagtttcagttgcagctccagccccagccccagatgcagccccagatgcagctgcagcctctacagctgcagctgccccagctgctgccccagctgcagcccgagcctgagccagagccagagccagaggaagaagaggaagaagaagaagagatagaagaagaagaagagatcgaagaagaagaagaagccgaaccagaagcagaagaagaagaggaggcagaagacgaagaggaggcagaggaagaggaagaagagccacagccagaagaagcccaaatagcaatgagcgctgtgaatatgggccagcccccgctacccccgacccctcatgttttcacagctggcaccaacactgctatcctgccccatttccaccacgcgttcagataaattggttttttaagagggtgcttctcttctggaagatgtttcaaacaccagttccagttccagacatcagttacagtttgaagagaagcgttggaaaaacaggaatggggtttctagcttattgccatgagtagattgagaaaaagaactctcttaactgcatgcactgtgccaatacatatatatatatatatatatatatatatatgtatatatatatatatatatatcatccttagtattcatgctttgtaccaaacttagtgagtgcgggcgttctccgtaatcgaactgcaagtagtatcatattattaccctgatattgttagtctcatattattagccttgtattattctcatataatcaaaaccaagatccaaaacatgagctgctaatttgtaaatatcgtgttgagtgttagccgtcgtagtgatgttagctgcgtagttgcgtgttagcactgcctaggaagggcacgagggccaagttgggcttctcccacttggaagatgttttgaagagaagggggtgatctccgtagggcgtccgtaactaggccgtgtgttcttttcagggacccgtctaccttcaggattggatgtagtttagtcgctcttcttcttagctcgctttgtagtttgtccttctggtagcctactgtgtgtgtctgtgtgtagctttataggaaagttccgtgtgaagctgtcggtgtcttcgttttcaaaagtgaattttaaatgtatttttcaatatttttcatgtgatgttgtaccaatgtgaattatgacttcgtttatcttaaagacaaaactggttgtcagtcatatctgacaggaagaaagaaatccctgtgggtaggcaagtcaagtggccaactaatgagaagaagcatcaatcgaaagtgttggctgactgggacactcatgattctcacaggactttgagaaacgtactggaattaaaaaaaaaaaagcttaagtacattagataagaattttctttgcctagcttaacctactacttaagcctcttaagttctgaagtattgtgatcaaccaataggaaaatgtatctgtagttgatgaatttcagtccttgttactttgtatcccaagaggtttgtgttttgggaatgtaaccgtacttgtaatctcagttggtatcttgctaatcgatttgaaagtgtaaaacctaacccttgaagactctgtatttccttttttgagactgtatttcccagcatgtataccctaacctttggagactctgtattctgtttttgagactttccccccgccccccagcatatgtaccccgacccttgaagactgtatttcgtttttgagagcgtatttcccagcatatatacactaacccttgaagactctgtatttccttttttgagactgtatttcccagcatatatacactaacccttgaagactctgtatttccttttttgagactgtatttcccagcatatatacactaacctttgaagactctgtattctgtttttgagacccccccccagcatatgtaccctaacccttgaagactgtatttcgtttttgagaacgtatttcccagcatatatacactaacctttggaagactctgtatttcatttttgagactgtgtttcttagtatacataccctaacctttgaaagactccatttttgagacttccccccccccagcatttgtgccctaacccttggaggctttgtattttttttttgagacttttccgccagcatatatacactaacccttgaagactctgtatttcatttttgagacttttttccccagcatatataccgtaacccttgaagactctgtattccgtttttgagatttttttccctcagcatatataccccaacctttgaagactctgtatttcatttttgagactttttcccagcatatataccctaacctttgaagactctgtattccatttttgagattttttccctcagcatatataccctaacctttgaagactctgtatttcgtttttgagattttttcccccagcatataaacactaacctttgaagactctgtatttcatttttgagacttttttcccagcatatataccctaacccttgaagactctgtaatctgtttttttttttttttgagactttttcccccagcatatatacactaacctttgaagactctgtattccattttttgagacttttttccccagcatatataccctaacctttgaagactctgtatttcatttttgagactttttccccagcatatataccctaacctttgaagactctgtattccgtttttgagaccccccccccggcatgaataccctaatctttgaagactctggtatttcatttttgagatttttttcccctcagcatatatacactaacctttgtagactctgtattccgtttttgagactttccccccccagcatgtataccctaacctttgaagactctgtatttccagcatttgtaccctacccttgaagactctgtatttcccagcatttgtaccctaacccttgaagaccctgtatttcgtttgtaagacttttccccagcatatatatcctacatataataaacgctaagcatctagcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1537 - DNA, 1209 bp, Rattus norvegicus
  Genbank Accession No. NM_012762
atggccgacaaggtcctgagggcaaagaggaagcaatttatcaactcagtgagtgtagggacaataaatggattgctggatgaacttttagagaagagagtcctgaaccaggaagagatggatacaatcaaacttgcaaatatcactgttatggaaaaggcacgagacctgtgcgatcatgtcactaaaaaaggaccccgggcaagccagatgtttatcacttacatttgtaatgaagactgctacctggcagaaattctggagcttcagtcaggtccatcagctgaaactgtttttgttacagaagattctaagggaggacatcctttctcctcagaaacaaaagaaaaactgaacaaagaaggtggcgcatttcctggaccgagtggttccctcaagttttgccctttagaaatagcccagaaattatggaaagaaaatcattcagagatttatccaataatgaaaacacccactcgtacacgtcttgccctcattatctgcaacacagactttcaacatctttctcggagagtcggagctgatgttgacctcagagaaatgaagttgctgctgcaggatctgggctatactgtgaaagtcaaagaaaatctcacagctctggagatgacaaaagaattgaaagaatttgctgcctgcccagagcacaagacttctgacagtaccttccttgtattcatgtctcatggtctccaggagggaatatgtgggatcacatactctaatgaagttgcagatattttaaaggttgacacaatctttcaaatgatgaacacattgaagtgcccaagcttgaaagacaagcccaaggttatcattattcaggcatgccgtggagagaaacaaggagtggtgttgttaaaagattcagtaggaaactccgaagagggattcttaacagatgcaatttttgaagatgatggcattaagaaggcccatatagagaaagattttattgctttctgctcttcaacaccagataatgtgtcctggagacatcctgtccggggatccctcttcattgagtcactcatcaaacacatgaaagaatatgcctggtcttgtgacttggaggacattttcagaaaggttcgattttctttcgaacaaccagactctagactacagatgccaaccactgaaagggtgaccctgacaaaacgtttctacctcttcccaggacattag

SEQ ID NO: 1538 - DNA, 2335 bp, Rattus norvegicus
  Genbank Accession No. NM_012770
ctccagtggctgagtgatcaactatactcgatgtatcttccagggcttctgcagaagtgcaagatgtcttcatgacctacaccgtgtatgatgacatcatcaccattaagctcatccaagaagcctgcaaggttctggatgtgtccatggaagccattctgaagctctttggcgaatacttctttaagttctgtaagatgtctggctatgacaggatgctgcggacacttggaggaaatctcaccgagtttattgaaaacctagatgcactccacagttacctggcactgtcctatcaggaaatgaacgcaccatcctttcgagtggaggaaggagctgacggggcgatgcttctccactactactcagacagacatggtctgtgtcacattgtaccaggtatcattgaagctgtggccaaggacttctttgacactgatgtggccatgagtatcctggatatgaacgaagaggtggaaaggacagggaagaaagaacatgttgtgtttctggtcgtgcagaaggctcacagacagataagaggagcaaaggcaagccggccacaaggcagtgaggacagccaggcagaccaggaggctctccagggaacactccttcggatgaaggagagatatttaaacatccctgtttgccctggggagaaatctcactcaactgctgtgagggcatcggtcctttttggaaaagggcccctcagggacaccttccagcccgtctatcctgagagactatgggtcgaagaggaggtgttctgtgatgcttttcctttccacattgtctttgatgaagcactaagggtcaagcaagctggagtgaatattcagaagtatgtccctggaatcttaacccagaagtttgcactagatgagtatttttccatcatccaccctcaagttactttcaacatctccagcatctgcaagttcattaacagtcagtttgtcttgaagacaagaaaagaaatgatgcccaaagcaaggaagagccagccgatgctcaaactccggggtcagatgatctggatggagtctctgaggtgcatgatcttcatgtgttccccaaacgtccgcagcctgcaagagctggaagagagcaagatgcatctttctgatatcgctccgcacgacacgaccagggatctcatcctcctcaaccagcagaggctggcagagatggagctgtcctgccaactggaaaagaagaaggaggagttgcgtgtcctttccaatcacctggccatcgagaagaagaagacagagaccttgctgtatgccatgctgcctgaacatgtggccaaccaactcaaggagggcagaaaggtggctgcaggagaatttgaaacatgtacaatccttttcagcgatgttgtgacatttaccaacatctgtgcagcctgtgaacctatccaaatcgtgaacatgctgaattcaatgtactccaagtttgacaggttaaccagtgtccatgatgtctacaaagtagaaacaataggggatgcttacatggtggtgggtggagtaccagtacccgttgaaagccatgctcaaagagtcgccaattttgctctggggatgagaatttctgcaaaagaagtgatgaatcctgtcactggggaacctatccagatcagagtgggaatccacactggaccagtcttagcaggtgttgtgggagacaagatgcctcggtactgcttgtttggtgacactgtaaacacagcctctaggatggaaagtcacgggcttcccagcaaagtgcatctgagccccacagcccacagagccctgaaaaacaaagggtttgaaattgtcaggagaggcgagatcgaagtgaaggggaaaggaaagatgaccacatactttctgatccagaacctgaatgccaccgaggatgagataatggggcgaccttcagcccccgctgatgggaaggaagtatgtactcccggaaaccaagtcaggaagtcccctgctgtcccgaggaacacagaccatcagcaacaagtctacaaaggagacccagcagacgcttctaatgaagtcacacttgctgggagcccagtggcagggcgaaactccacagatgcagtcaataaccagccatcaccagatgagaccaagacaagtgtcgttgctagtggccctgtgctgtctgctttctgtgttgtgctgtgatcacgagaaaaagtgatcctatgggatccatttcctgtattccatggcagcaaagggaattaatttataaaaatgcttaagttcaaaatgtttttgtttccatatctcccttggggcccctttgagaataaaaaaattag

SEQ ID NO: 1539 - DNA, 2683 bp, Rattus norvegicus
  Genbank Accession No. NM_012776
gaattcgggcgggcgacgagcgaggaccgggcggggcggcggcggcgccgaggccgacaagccgcgcgggccgggccgggccgagcgagcgggagcggagcggagcctcgggcggcgggaggaacagcgccgccgccgccaagatggccgacctggaggcggtactggccgatgtgagctacctgatggccatggagaagagcaaggccacgccggccgcgcgcgccagcaagaagatcctgctgccagagcccagcatccgcagcgtcatgcagaagtatctagaggatcgaggagaagtgacctttgaaaagatcttctcacagaagttaggatacctgcttttccgggacttctacctgaaccatctggaagaggccaagcccttggtggagttctatgaagagatcgagaaatatgagaagctggagacggaggaggaacgtgtggtccgcagccgggagatctttgactcctacatcatgaaagaactgctggcctgctcacatcccttttcaaagaatgccacggagcatgtccagggccacctggtgaagaagcaggtacctccagatctcttccagccatacattgaggagatttgtcagaacctccgaggggatgtgttccacaaattcattgagagtgacaagttcacacggttctgccagtggaagaatgtagagctcaacatccacctgaccatgaatgacttcagtgtgcatcgaatcatcgggcgtgggggcttcggtgaggtctatgggtgccggaaagcagacacaggcaagatgtacgccatgaagtgtctggacaagaaacgcatcaagatgaagcagggagagaccctggctctgaacgagcggatcatgctttccctcgtcagcactggggactgccccttcatcgtgtgcatgtcatatgcattccacacaccagacaagctcagtttcatcctggatctcatgaacggtggggacctgcactaccacttgtctcagcatggagtcttctctgaagccgacatgcgcttctacgcagctgagatcatcctgggccttgaacacatgcacaatcgctttgtagtctacagggacctaaagccagccaacattctcctggatgagcatggccatgtgagaatctcagacctgggcctagcctgtgacttctccaagaagaagcctcatgccagtgtgggcacacacgggtacatggccccggaagtcctacagaagggcgtggcctatgacagcagtgccgactggttctccctgggctgcatgctcttcaagttgttgcggggacacagccccttccggcagcacaagaccaaagacaagcatgagattgaccgcatgacattgacaatggctgttgagctgcctgactccttctcccctgaactccgatccctgctggaaggtttgctgcagagggatgtcaatcggagactaggctgtctgggccgtggggctcaagagataaaagaaagccccttcttccgttccctggactggcagatggtcttcttacagaagtaccctcctccactgatccccccacgcggggaggtgaatgcagcggacgcctttgacattggctcctttgatgaggaggacacaaaaggaatcaagttactggacagtgaccaggaactgtaccgcaacttccctctcaccatctctgagcggtggcaacaggaggtggcagagactgtctttgataccatcaatgctgagacagaccggctggaggcacggaagaaagccaaaaacaaacagctgggccacgaggaggactacgccctgggtaaggactgcatcatgcatggctacatgtccaagatgggcaaccccttcctgacccagtggcagcggcgatacttctacctgttccccaaccggcttgagtggaggggtgaagacgaggctccgcagagcctcctgaccatggaagagatccagtcggtggaagagacacagatcaaggaacgcaagtgtctcctgcttaagatccgaggtggcaagcagtttgtcctgcagtgtgatagtgaccctgagctggtgcaatggaaaaaagagctgcgcgatgcttaccgtgaggcccagcagctggtgcagcgagtgcccaagatgaagaacaagccacgctcacctgtggtggagctgagcaaggtgccactgattcagcgtggcagtgccaacggcctctgattcacccatctgctgcccgcctgcccacccgccttttataaacctctaatttattttgttgaatttttattatttgttttcgcaaagcggaaaaggttttattttgtaattattgtgatttcctgtggccccagccaggcccagccccagggaggggcctgcttgcctcagctcctgctgccaccaacccagccactgtctagcacccctgccccgcccccaccgcatgcccctagggtccttgctcccagtatcttcctactgggaagaggagcaaccctcagcagccctcttgcccctccatggggtgaagccacagtcggtgggtgtgtcacttcaggctctgtgggctacactcagcctgaggcccagctgggtggcccagcacccctaccctaggaaggtgcaacacagggatactacttgaactttcctatcatagctcccatgccacagagggacccgaattc

SEQ ID NO: 1540 - DNA, 2840 bp, Rattus norvegicus
  Genbank Accession No. NM_012791
agagtctcaagttttcagagtggctttgctcttactgtgctttcattcgcagctgttatagttttgccgctggactcttccctcccttcccccaccccatcaggatgatatgagacttgaaagaagacgatgcatacaggaggagagacttcagcatgcaaaccttcatctgtccggctcgcaccgtcattctcattccatgctgctggccttcagatggctgcacagatgccccattcacatcagtacagtgaccgtcgccagccaaacataagtgaccagcaggtttctgccttatcatattctgaccagattcagcaacctctaactaaccaggtgatgcctgacattgtcatgttacagaggcggatgccccaaaccttccgtgatccagcaactgctcctctgagaaaactctctgtggacttgatcaaaacatacaagcatattaatgaggtttactatgcaaaaaagaagcgaagacaccaacagggccagggggacgattctagtcataagaaggagcggaaggtttacaacgatggttacgatgacgataactatgattacattgtaaaaaacggagaaaagtggatggaccgttatgaaatcgactccttaataggcaaaggttcatttggacaggttgtgaaagcatatgacagagtggaacaagaatgggtcgccattaaaatcatcaagaacaagaaggcgtttctgaatcaagcgcagatagaagtgcggctgcttgagctcatgaacaaacatgacactgagatgaagtactacatagtgcatttgaaacgccactttatgtttcggaaccatctctgtctagtgtttgaaatgctgtcctataatctctatgatttgttgaggaacaccaacttccgaggggtctctttgaacctgacacgaaagtttgcacaacagatgtgcacagcattgcttttccttgcgactccagaacttagtatcattcactgtgacttaaagccggagaacatccttctgtgtaaccccaaacgaagtgcaatcaagattgttgactttggcagctcttgtcagttggggcagaggatataccagtatattcagagtcgcttctatcggtctccagaggtgctactgggaatgccttatgaccttgctatcgacatgtggtcccttggatgtatcttggttgaaatgcacactggagagcctctgttcagtggtgccaatgaggtggatcagatgaataaaatagtggaagtcttgggcatcccacctgctcatattcttgaccaagcaccgaaagcaagaaagttctttgagaagttgcctgatggcacttggagcttaaagaagaccaaagatggaaaacgggagtacaaaccaccaggaacccgtaaacttcataatattcttggagtggaaacaggaggacctggcgggcggcgtgctggggagtcaggtcacactgtagctgactacttgaagttcaaagacctcattttaaggatgcttgattatgaccccaaaactcggattcaaccttattatgccctgcagcacagttttttcaagaaaacagctgatgaaggtacaaacacaagcaacagtgtgtccaccagccctgccatggagcagtcccagtcttcaggcaccacctccagcacctcctccagctcaggtggatcctcgggaacgagcaacagtgggagagccaggtcggatccgacgcaccagcatcggcacagtggcgggcacttcgctgctgctgtccaggccatggactgtgagacacatagtccccaggtgcgccagcagtttccggctcctctgggctggtcaggcactgaagctcctacacaagtcactgttgaaactcatcctgttcaagaaacaacctttcatgtagcccctcagcagaatgcattgcatcatcaccatggaaacagttcccatcatcaccaccaccaccatcaccaccaccaccaccatggacagcaagccttgggtaaccggaccaggccaagggtctacaattctccaacaaatagctcctctacccaggattctatggaggttggccacagtcaccactccatgacatccctgtcttcctcaacaacttcttcctcgacatcttcctcctctactggtaatcaaggcaatcaggcctatcagaaccgcccagtggctgctaacaccttggactttggacagaatggagctatggacgttaatttgaccgtctactccaatccccgccaagagactggcatagctggacatccaacataccaattttctgctaatacaggtcctgcacattacatgactgaaggacatctgacgatgaggcaaggggctgatagagaagagtctcccatgacaggagtttgtgtgcaacagagtcctgtagctagctcgtgactacattgaaacttgagtttgtttcttgtgtgtttttatagaagtggtgtttttttcccaaaaacaaaagtgcaaagctgcttgaatcagaaggagattaacacactgaaccgctacgagagggcaaagctgacttttttttttaacttgaaaagattgcaaagggacaatgaagtttttaagagccatgtccacccatcttcatggagcgctcagagtgtcctctttctgcctcccccatttaacttccatctcccggtcacagtgggttttgtctttctatccaacaaaagttaatgttcagctgttggtcttggtcatttgccaactaattttaaaataaaaaggcactgcacataatttgcataaagggccccatagggtgttttggttttttcatttttattttttcccctttt

SEQ ID NO: 1541 - DNA, 924 bp, Rattus norvegicus
  Genbank Accession No. NM_012793
cctggtggttccgcagccgtactctcctggcctggtgtgcacagcctcaccatgagttcttctgcagccagcccgcttttcgcgcctggcgaggactgcggccccgcgtggcgcgcggcccccgcggcctatgatacgtctgacacgcacctgcagatcctgggcaagccagtaatggagcgttgggagaccccctacatgcattcgctggcggctgctgctgcctccagagggggccgggtcctggaagtgggctttgggatggccattgcagcctccagggtgcagcaggcccccataaaggaacactggattattgaatgcaacgatggggtcttccagcgtctacaaaactgggccctgaagcagccacataaggttgttcccttgaaaggcctgtgggaggaggaggcacctacactgcctgatggtcactttgatgggattctatacgacacatatccactgtctgaagagacctggcacactcaccagttcaactttattaagactcatgctttccgtttgctgaagcctgggggtatcctcacttactgcaacctcacgtcctggggggaactcatgaagtccaagtacacagacatcactgccatgtttgaggagactcaggtgcctgcactgctggaagctggcttccagagagaaaacatctgtacagaggtgatggcgctggtgcccccagccgactgccgctactatgccttccctcagatgatcacacccctggtcaccaagcactgagcggctggcccagggctacaaggagaatatgtcctcctcagtgcctttgtagctggagtgtggctccagcctctccactatccctgcagtgtgacatcctaacctctgcctggtacggccatctccccagagctcaggagtaaaataaatgctaccaagact

SEQ ID NO: 1542 - DNA, 1258 bp, Rattus norvegicus
  Genbank Accession No. NM_012796
gggggaacgcgtcagacttggccaactgaggctgggctggacccctattgtggaatcgcggacacttcctacagttgtcgaacgcaatccgtctacaccaccttgtgtcactacctaccaccatgggtttggagctctacctggacctgctgtcgcagcccagccgcgcggtctacatcttcgccaagaagaatggcattccctttcagttgcgtaccgtggatttactcaaagggcagcacttgagcgagcaattctcccaggtgaactgcttaaagaaagtgcctgtcctcaaagacggaagcttcgtgttgaccgaaagcactgccatcttgatttacctgagttccaagtaccaggtggcagaccactggtacccggccgacctacaggcccgtgcccaagtccacgaatacctgggttggcatgccgacaacatccgtggcacctttggagtactcctgtggaccaaggtgttggggccactcattggggtccaggttcccgaggaaaaggtggaacggaacagaaatagtatggtcttggctctgcaacgtctggaggacaagttcctcagggacagggccttcattgctggccagcaggtgacgctagcggatctcatgtctctagaggagttgatacagccggtggctcttggctgtaatctgtttgaggggcggcctcaactgacagcgtggcgagagagggtggaggcgttcttgggtgctgagctatgtcaggaggcgcacaaccccatcatgagcgtcctgggacaggcagccaagaaaacattaccagtaccccctccggaggcccatgccagcatgatgcttcgaattgccaggattccctgagtggttttttttccctgagtatttttattgctataaagactcattttgtattttgcctctttgttttgttttgtttttgtttcttcttgtcccaacctttttttttttttttttttttctggctccttttctggctctgggaggagctttgctcaaaagggacaccacctatccttagcatgcttctcttgaggtacagtatgcacaaccaataggagacccaagtcaataatatataaaaggtgcttaaaaaaaaaaaagcaaacagtaacacacacgaagaaatcaaccaaaaattggtggacatctgttttttattataatatagattctgaatattttaaggaataaagagttattgttttattacattgccctctaatctgtatggaataaattat

SEQ ID NO: 1543 - DNA, 2268 bp, Rattus norvegicus
  Genbank Accession No. NM_012798
actgggctctcgagcaagcgagaggtcagtgcggagccggaggcgcttgtccagttccaacgccagctcgcaggcatggccccagcagcagcttcgggtggcagcaccctgcccagtggcttctccgtcttcgtcaccttccctgacttgctcttcatctttgagtttatctttggaggcctggtgtggatcctgatcgcctcctccctggtacccatgcccctggtccagggctgggtgatgtttgtgtctgtgttctgcttcctggccaccacttccctgatggtcatgtacataattggtactcatggtggggagacttcctggatcacactggatgcagcctaccactgtgtggctgccctgttttacctcagtgcctcagtcctggaagccctggccaccatcacaatgttcgatggctttacctacaggcattaccatgagaacatcgctgcagtggtgttcgcctatgtggctactctgctctacgtgatccatgctgtgttttccttaatcagatggaagtcttcataggacagcagattgggagctgaaacccagagcaattaactggtcagcctgtcttccccattaacttcctggaacagactgaatggtggagaaaagaaaacaagccaaaagaaaacaaaacagacacaaaaacaaaaggaaaccatgttcgagtctcttgggtgttacgtttaccttctgttagggtttagggcttgctgaatttaacttccagccaaaggaggaaagagttgtcttggcgggccctttctgcccttgaccaggacagtgggtgggagcttggaaccttgatctgaagaaatgacaatttccccttgacccttggagcaggtcctaacaattgcctttcggaattttccacaagctctttgcaccactcatcccctggcatatcttagattttgtggatagtctaggtgtcacaggcactgaaattcacccaacagaggtctctagatagatgttcatggtggaagatgaacccctttgaaatacttcattaaatacctttatgtctcatgcttcgggtggggaactgggatgtttttcattctcaggaatcagggactgacacctttctactcaactttcttcctgccagagtcctttgatgtaacctgaacctcaagggacaattcagatgtgtgtgctgggccagtctttcccacaatgactcactgaggatgccaccctcacaacagtgtccaccaggacagtgtctcccttgtaggtgcatcccagggagctcaaggaacaacagtttgctaaattagaatcttttcaagctcagaaaactaggtgtgggcattccttctcttcttagggctgatctaaaatgctctagtctgtgtttgggcatgttctcagatcatttctttcggggagaagagggacctgactccagagcaaagggagagacaatggctatttctggctgccacattccaggtgagggacatctgacctgaaagaagaaagtataattaggaaggacatggagagcctgcaaagtcagacatctgctaggagatctcacctggaccccacagtttaaaggattgacaaactagagttggaaccccagatgcagggacgtcctgccagccaccaggactgccaggattctagcctcggtcagcttccactagctgatgttttattctccaacaaagtgggagattgagacctacaaccaaattagatttggggagttttctaccttggttctgaggatggaacccagggggtacacatgctgggtaagcactcttctcctggatcccatcttcagccccaaattgagtcccagtggcacatccaggaggcctttggttatcccagccatactggtacccaaatctgccatttgccccacttaacacagtcaaaatttcatactaaaacgcaagcaaaagattagggggatttatttttaaaaattaaaatataaactaagagattatatgaagttcattataatggttaacaaagtctgtaactgaacgctgactggggtccgtcttatattttcaacaaaactgaaccataacattacactaaccagcagctcaacatgagcgagggttgggttttttggtttttgtttttttttttgataagaagaaaagagagatgaaggaaggaagaaaggaacaaaggaagggtgactaagatgaattttccaagggtttctcaatgtttcagatttttaatcattaaaagaaactttcatac

SEQ ID NO: 1544 - DNA, 1543 bp, Rattus norvegicus
  Genbank Accession No. NM_012803
cgaaattgcagtttctccttggcccacccctgtgtcagcagctccaggatgtggcagttcagaatcttcctgctgttcgcgtccacctgggggatttctggcgtatcagcccatcccgacccagtgttctccagcagcgagggtgcccaccaggtgcttcgggtcagacgagccaacagcttcctggaggaggtgcgggcaggcagcctggagcgggagtgtatggaggagatctgtgacttcgaggaggcccaggagattttccagaatgtggaagacacactggccttttggatcaagtacttcgatggtgaccagtgctcaactccgcccttggaccaccaatgcgacagcccatgctgcggccatggcacatgcatcgacggcctgggcggcttcagctgcagctgcgataagggctgggagggcaggttctgtcagcaggagatgggcttccaggactgtcgggtgaaaaatggcggctgctaccactactgcctggaggagaccagagggcggcgctgccgttgcgccccgggctatgagctggcagatgaccacatgcactgcaggcccaccgtgaattttccgtgtgggaaactgtggaagcggactgacaagaaacgcaagaacttcaaacgggacatagacccagaagacgaagaactagaactaggtccaaggatagtcaatggaacactaacaaagcagggtgacagtccctggcaggcgatccttctggactccaagaagaagctagcctgtggaggggtgctcatccacacctcctgggtgctgacggcagcccactgtctggagagcagcaagaagcttaccgtgaggcttggtgagtatgatctgagacgcagggacccctgggagttggacctggacatcaaggaggtcctcgtccaccctaactacacccggagcaacagcgacaacgacatcgccctgctccgcctgtcccagccagccacactctctaaaaccatagtgcccatctgtctgccgaacagcggcctggcgcaggagctcagtcaggctggccaggagacggtggtgacaggctggggctatcaaagcgacaaagtcaaggatggcagaaggaaccgcacctttattctcaccttcatccgcatccctttggccgctcgaaatgactgcatgcaggtcatgaacaacgtggtctcggagaacatgctctgcgccggcatcattggagacacgagagacgcctgcgacggcgacagtgggggacctatggtggtcttctttcggggtacctggtttctggtgggcctggtgagctggggtgagggctgtgggcacctcaacaactatggcgtctacaccaaagtgggtagctacctcaaatggatccacagctacataggggaaagggatgtttccctgaagagcccgaagctgtagcatccctccctgctcatctctggggcccagaggtcactcttagaataaggctgggctagtgagtaccaagacaggggacattaaaggggcaagcaacacctgaaaaaaa

SEQ ID NO: 1545 - DNA, 3324 bp, Rattus norvegicus
  Genbank Accession No. NM_012804
gaattccagtgcggctcgctcgccctgccggtgccatggcggccttcagcaagtacttgacggcgcggaactcctcgctggcgggggccgcgttcctgctgttctgcctgctccacaagcggcgtcgcgccctcggcctgcacggtaagaaaagtggaaaaccgccattacagaataatgagaaagaaggaaagaaagagcgagctgtggtggacaaagtgtttttatcaaggctctcacagatcctaaaaattatggtccctagaacattttgtaaagagacagggtacttgatacttattgctgttatgctggtatctcgaacatactgtgatgtttggatgattcaaaatggcacactgattgaaagtggcatcattggtcgtagcagtaaagatttcaagagatacttattcaacttcatcgctgccatgcctcttatctctctggttaataacttcttgaagtatgggttaaatgagctcaaactgtgcttccgtgtgcggctcactagatacctctatgaggagtatctccaagccttcacctactataaaatgggcaacctggataacagaatagcaaacccagaccagctgcttacacaagatgtagaaaagttttgtaacagtgtagttgatctttattcgaatcttagtaagccatttttagacatagttttgtatattttcaagttaacaagtgcaattggagctcagggcccggcaagcatgatggcctacttgcttgtttctgggctattcctaactcgactcagaagacccatcggtaaaatgacgattatggagcagaagtatgaaggagaatatagattcgttaattcacggcttatcactaatagtgaagaaattgccttttacaatgggaataaacgagaaaagcagacaatccactctgtcttccgaaaactggtggaacacctacataatttcattttcttccggttttctatgggtttcattgatagcatcattgccaaatatattgccactgtagttgggtacctggttgtcagtcgcccgttcctagacctggcgcatccgcgacaccttcacagcacccactcagagctgctggaggattactaccaaagtggaagaatgcttttgagaatgtctcaagctttggggcggatagttttggctgggcgtgaaatgactagattggctggttttacggctcggattacggaattaatgcaagtactaaaggatttaaatcatggcaaatatgaacgtacaatggtgtcacaacaggataagggtattgaaggagcacaagctagtcccttgatacctggtgctggagaaatcatcaatgcagacaacattataaagtttgatcatgttcctttagcaacaccaaatggagatatcttgatccaagaccttagttttgaagttcgatctggggccaacgttctcatttgtggtccaaatggctgtggaaagagctccctcttccgtgttcttggtgaattatggcctctctttggaggacatcttactaaacctgagagaggaaagttattttatgttcctcagcgaccctatatgaccctgggaacactgagagaccaagtaatatatccagatggaaaggaggatcagaagaagaaggggatatctgaccaagtgctgaaggggtacttggacaatgtacagttgggccatatccttgagcgggaaggaggctgggacagtgttcaggactggatggatgtactcagcggaggagaaaaacaaagaatggcgatggcaagattgttttatcataaaccccagtttgccattctggatgagtgcacaagtgcagttagtgtggatgtggaagactacatttacagccactgtcggaaggttggcatcaccctcttcactgtctcacacaggaaatccctttggaaacaccacgagtactacctgcacatggatggcagaggcaattatgaattcaaaaagatcacagaagacacagttgagttcggatcatagagaccatctggagaacttcacacttcacaagagaatgaatgaacagaatgcatttgtaaacaacgtgcattgtaaaataaagttaagcttgttttttttaaaaaaacaaagctacaaattgactagatataggataattgaaacatgttaaaacatttaatattgtataggatattgctaattgtgtatatgttggtttaattattaattatgtactaagaatgtccttattcttgtggttaaaaaacctgcctgaattaaattgggcttaaatcagtgtaacctgattcatgggatgtaaaccatttgaagtcagctaatttgacttttatagctctgtctttttctttaatgaagaaccctatttaaaactgggtcattagctgtttattctaacaaagtagtcttgagttcctttttgggtttttttttttttttttttttttttttttttgtgccccatggtagtgggaaccaaaccaatcacaatgttttattggaacatattccatcatcacaggatagcatttattaaacagtggcggatttctctagctgctacatttattctcattcctcatacataccttgaggtgcatttgattccaggagagccatttgggttttctttagctaaataataaatgtacccgtctcagtcttttggactgagtcgttctgaaggctctcgtgtggacagcagtgtgtgcagtctcttacagtccgtgcctgctccacatggtaccagtcttaccagtgcttgagagctcagacacaccctgctgcatgaagttggaggtctcgggagggttttagattttgtgacgggaaccggaaaggctcgtcagagtgtggctgtgtcatggtgagcaccacgtggctgtagaggcccgacatgaggtaatgcactgagcacacaacgccactgctgctgtctgtggctgtgggttcttaaaagtgctggactttgtcatgctcgtgggccaatgacatttcctaggagcggcctctgactcctgtgcagctgcgtctgtgtcagctctggctccctggaaccacgagtgactttgcacaaaggagggctgagagcggacttgatcagtaagtcgtcgtgaatcagtttgcttgagtgggctcggaatgggccttatcacgatggttttgtttcttcgtaactcataatcactggctaccaggataaccctgatgtattgattccgtgaatacatcacattcaatcttaccatgtctccttagcaaacgtgtgtacttattttctgttcagattaaaaaaaaaaaaaaggaattc

SEQ ID NO: 1546 - DNA, 1504 bp, Rattus norvegicus
  Genbank Accession No. NM_012816
gctgcgtggcgtcagggttctggagctggcaggcctggccccagggccgttctgcgggatgatcctggcggacttcggcgccgaggtggtgctcgtggacagactgggctccgtgaaccaccccagtcacctggcccgaggcaagcgctcgctggcgctggacctgaagcggtctccgggagccgcggtgttgcggcgcatgtgcgcacgcgcggacgtgttgctggagcccttccgttgcggtgtcatggagaaactccagcttgggccagagactctacggcaggacaatccaaagctcatctatgccaggctgagtggatttggccagtcgggaattttctccaaagtagctggccatgacatcaactatgtggctttgtcaggtgtcctgtcaaagattggcaggagcggtgagaacccataccctcccctgaacctcctggccgactttggtggcggtggcctcatgtgcacattgggcattttgctggctctcttcgaacgcacgcggtctggcctagggcaggtcattgatgcgaacatggtggaaggaacggcatacttaagtactttcctgtggaaaactcaggccatgggtctgtgggcacagcctcgagggcaaaacctgttagatggcggggcacctttctacacaacctacaagaccgcagatggggagttcatggctgtaggtgcaatagaaccccagttctacacactgctgcttaaaggacttggacttgagtctgaggaactccccagccagatgagcatagaagattggccagaaatgaagaagaaatttgcagatgtgtttgcaaggaagactaaggcagagtggtgccagatctttgacgggacagatgcatgtgtgaccccagtgctgactcttgaggaggccctccaccaccagcacaacagagaacggggctccttcatcactgatgaggagcagcatgcatgcccccgtcctgcaccccagctttccagaacccctgctgttccttctgccaaaagggacccttctgtgggagagcacactgtagaggtgcttaaagactatggattcagtcaggaagagatccatcagctgcactcggatagaatcattgaaagtaataagctaaaagccaacctctgactcaggttcacagctcaagtgaatctgaaggctgtatctgtactggagaaggatgcccaccactgtccgtatggaaatgtgaatgaacagtaatgaagtaatccaaatattccaatcaagacacaacgaaagactgattacagagaaatgactgtgctctcacactgctcatccgagcctctgattgaggagtatttttgtgtgtgtactgatattaacttgtggcagttttctgcctttcagcttacttggtgaagtgcattcactgattaaaacccttttgtaaatgcaactctgataatatattaaatgaactaatataactttaataaataaagcttttttttccttgaaaaaaaa

SEQ ID NO: 1547 - DNA, 1630 bp, Rattus norvegicus
  Genbank Accession No. NM_012817
cttttttttcctctcccttgatttcaacattttcccgatcttcttggcgccgccgacgcctcttacctgttctgcgcagcgcgcgagctggcagctgagagaagtgggggtgcgttttaggttttaagcaaaggcaaaaaaaaaaattaagccaaatccattttttttccttcacctctccccgtttcaaggcctccaagatcattatttctgtagctttggggtgagcgattctgtgtttctcttcatcacccctccaattctgccccgatcccgcctgggtctccactcactgcgtgcacctggcgcgcctcttttttttttcacccccaacctgttgcaagtctttaatccttgcaattgggacttgcgtgcaggcacctgaatcctccttgcctcatattttgcaagtgtttggaggacagcacctgctttacctgcaagagatattttttaaaaaaaaaaaaatctccaggctccctcttggcccctttctccacacactctcgctctcctgccccgccccgaggtaaagccagactcggaaaaaatggtgatcagcgtggtcctcctgctgctggccgcctgtgccgtgccggctcaaggcctgggctctttcgtgcattgtgaaccctgcgacgagaaagctctgtccatgtgtccccccagccctctgggctgtgagctggtcaaagagcccggctgtggctgctgcatgacttgcgccctggcggagggacagtcgtgtggcgtctacactgagcgctgcgcccagggtttgcgctgtctcccccggcaggatgaggagaagccgctgcacgccctgctgcacggccgcggggtttgcctcaacgaaaagagctacggcgagcaaaccaagatagagagagactctcgggagcatgaggaacccaccacctccgagatggctgaggagacctactccccgaaggtcttccggcccaagcacactcgcatttccgagctgaaggccgaggctgtgaagaaggatcgcagaaagaagctgacccagtctaagtttgtggggggcgcggagaacactgcccacccccgagtcatccctgcacctgagatgagacaggaatctgaccaaggcccctgccgcagacacatggaagcttccctccaggagttcaaagccagcccacgcatggtgccccgtgccgtgtacctgcccaactgtgaccgcaaaggattctacaagagaaagcagtgcaagccttctcgtggccgcaaacgtggcatctgctggtgtgtggacaagtatgggatgaagctgccgggcatggagtacgtcgatggggactttcagtgccacgccttcgacagcagtaacgttgagtgacgcgtcccctcccttcctccccctttcctaccccccagccccaactccagccagcgcctccctccaccccaggacgtcactcatttcatctcatttaggggaaatatatatacatatatatttgaggaaactgaggacctcggaatctctagcaagggctaaggagacactccccattcccgaccccggaaacgtattcctatttgaagcaagttgaacggacagagaagggaagaagagaaggggcaagaaggagcgaggaat

SEQ ID NO: 1548 - DNA, 1454 bp, Rattus norvegicus
  Genbank Accession No. NM_012823
ctcaccttctcagagcttctcctcgggcttcgctgccgccctaaaggttactgtgatctcggcttgagagcaaggtggacagccatggcggcgtctttgtgggttggacctcgagggaccataaacaattatccaggctttaacccatcagtggatgccgaagctatccggaaagcaatcaaaggaattggaactgacgagaaaactctcatcaacattctgacggagcggtcgaacgcacagcggcagctgattgtcaagcatatacaagaggcgtatgaacaggcgctgaaagctgacttgaagggtgatctctctggccactttgagcatgtcatggtggctcttattactgcaccggccgtgtttgatgccaagcaactgaagaaatccatgaggggcatgggcacagatgaagacaccctgattgaaatcttaacaaccaggacaagcaggcagatgaaggagatctcgcaggcctattatacagcatataagaagaatctcagagatgacattagctctgaaacgtctggagacttccggaaagctctgctgactttggcagatggtggaagagacgaaagcctgaaagtggatgaacatctggccaaaaaagatgcccagaccctctacgatgctggtgagaaaaaatggggcacggatgaagacaaattcaccgagatcctgtgtctacggagctttccgcagctgaaactgacatttgatgagtacagaaacattagtcagaaggacattgaggacagcattaaaggagaattatctgggcattttgaagacctgctgctggccgtagttcgctgtacgaggaacaccccagcttttttggcaggaagacttcatcaggctttgaagggagctggaacagatgaattcactctgaacagaataatggtctccagatcagagattgaccttctggacatccgacgtgagttcaagaagcactacggctgctctttatactcagccatccaatcagatacttctggagactacagaactgtgctgttgaagatctgtggaggagatgattgaagaagatggcttccaacagctgcctgccccgatggtggaccgcctcaacagctctgcttactgctttcgtacagcactccagcaatgggcaagcgaatgcaagacagcaacccgtctgcctgatgcgcattggcttccttcaatgcaacagcaaaaatgaacttgattttattttagagcatctcattcataatgtagaggtttataagggaaattcaatctagaattaaagacctactaatgattttttatttggcttaggaagttggaatctgtgttgttcaaagccattaaacataaatcaggatactaaaaatggctgcctttgctaaatgtaatttttgtatttgttttccgtaactactaatactgtatgttgcctggtgccaacaaat

SEQ ID NO: 1549 - DNA, 4918 bp, Rattus norvegicus
  Genbank Accession No. NM_012833
tgcactttaacatctgctttcccagaggaaaaagtaaaggagaaacagtacaatcatagaagagtcttcgtaacagaagcgcgaggagagcattatggacaagttctgcaactctactttttgggatctctcattactggaaagtccagaggctgacctgcctctttgttttgagcaaactgttctggtgtggattcccttgggctttctttggctcctggctccttggcaactttacagcgtgtacagatccaggaccaagagatcttctataaccaaattctaccttgccaagcaggtgttcgtcgtgtttcttcttattttagcagccatagacctgtctcttgcgctcacagaagatactggacaagccacagttcctcctgtcagatatacgaatccaatcctctacctgtgcacatggctcctggttttggcagtccagcacagcaggcaatggtgtgtacgaaagaactcttggttcctgtctctgttctggatcctctcggtcttatgcggcgtattccagtttcagactctgatacgagcactcctgaaggacagcaagtccaacatggcctactcctacctgttcttcgtctcctacggtttccagattgtcctcctgattcttacagccttttcaggaccaagtgactcaacacaaactccatcagtcacggcttcctttctgagtagcattacatttagttggtatgacaggactgttctgaaaggttacaagcatccactgacactagaagatgtctgggatatcgatgaagggtttaaaacaaggtcagtcaccagcaagtttgaggcggccatgacaaaggacctgcagaaagccaggcaggcttttcagaggcggctgcagaagtcccagcggaaacctgaggccacactacacggactgaacaagaagcagagtcagagccaagacgttctcgtcctggaagaagcgaaaaagaagtctgagaagaccaccaaagactatcccaaatcgtggttgatcaagtctctcttcaaaaccttccacgtagtgatcctgaaatcatttatactgaaattaatacatgaccttttggtgtttctgaatcctcagctgctgaagttgctgatcggtttcgtgaagagctctaactcatacgtgtggtttggctatatctgtgcaatcctaatgtttgctgtgactctcatccaatctttctgccttcagtcttactttcaacattgttttgtgttgggaatgtgcgtacggacaaccgtcatgtcttcgatatataagaaggcattgaccctatctaacttggctaggaagcagtacaccattggagagacggtgaacttgatgtctgtagattcccagaagctaatggatgcgaccaactacatgcagttggtgtggtcaagtgttatacagattactttgtccatcttcttcctgtggagagagttgggaccgtccatcttagcaggtgttggggttatggttctcctaatcccagttaatggagttctggctaccaagatcagaaatattcaggtccaaaatatgaagaataaagacaaacgtttaaaaatcatgaatgagattctcagtggaatcaagatcctgaaatactttgcctgggaaccttcatttcaagagcaagtccagggcattcggaagaaagaactcaagaacttgctgcggttcggccagctgcagagtctgctgatcttcattttacagataactccaatcctggtgtctgtggtcacattttctgtctatgtcctggtggatagcgccaatgttttgaatgcggagaaggcatttacctccatcaccctcttcaatatcctacgcttccctctgtccatgcttcccatggtgacctcatcgatcctccaggccagtgtttctgtggaccggctggagaggtatttgggaggagacgatttagacacatctgccattcgccgcgtcagcaattttgataaagctgtgaagttttcagaggcctcttttacttgggacccggacttggaagccacaatccaagatgtgaacctggacataaagccaggccaactggtggctgtggtgggcactgtaggctctgggaaatcctctttggtatcagccatgctgggagaaatggaaaacgttcacgggcacatcaccatccagggatccacagcctatgtccctcagcagtcctggattcagaatggaaccatcaaagacaacatcctgtttgggtccgaatacaatgaaaagaagtaccagcaagttctcaaagcatgcgctctcctcccagacttggaaatattgcctggaggagacatggctgagatcggagagaaggggataaatctcagtggtggtcagaagcagcgagtcagcctggccagagctgcctatcaagatgctgacatctatattctggacgatcccctgtcggctgtggatgctcatgtgggaaaacacattttcaacaaggttgtgggccccaacggcctgttggctggcaagacgagaatctttgttactcatggtattcacttccttccccaagtggatgagattgtagttctggggaaaggcaccatcttagagaaaggatcctatcgtgacctgttggacaagaagggagtgtttgctaggaactggaagaccttcatgaagcattcagggcctgaaggagaggccacagtcaataatgacagtgaggcggaagacgacgatgatgggctgattcccaccatggaggaaatccctgaggatgcagcttccttggccatgagaagagaaaatagtcttcgccgtacactgagccgcagctctaggtccagcagccgacgtgggaagtccctcaaaaactccttgaagattaaaaatgtgaatgtcttgaaggagaaggaaaaagaagtggaaggacaaaaactaattaagaaagaatttgtggaaaccgggaaggtcaagttctccatctacctgaagtatctacaggcagtagggtggtggtccatacttttcatcatccttttctacggattgaataatgttgcttttatcggctctaacctctggctgagtgcttggaccagtgactctgacaacttgaatgggaccaacaattcgtcttctcatagggacatgagaattggggtctttggagctctgggattagcacaaggtatatgtttgcttatttcaactctgtggagcatatatgcttgcagaaatgcatcaaaagctttgcacgggcagctgttaaccaacatcctccgggcacccatgaggttttttgacacaactcccacaggccggattgtgaacagattttctggtgatatttctactgtggacgacttgctcccccagacacttcgaagctggatgatgtgtttctttggcatcgctggcactcttgtcatgatctgcatggccaccccagtcttcgctatcatcatcattcctctcagcattctttatatttcggtgcaggttttttatgtggctacttcccgccagctgagacggttggattctgtcaccaaatctccgatctattctcacttcagtgagactgtcacaggtttgcccattatccgtgcctttgagcaccagcagcgatttctagcttggaatgagaagcagattgacatcaaccagaaatgtgtcttttcctggattacctccaacaggtggcttgcaattcggctggagctggttggaaacttggtcgtcttctgttccgccttgctgctggttatttatagaaaaaccttaaccggggacgttgtgggctttgttctgtccaacgccctcaatatcacacaaaccttgaactggctagtgaggatgacgtcagaagcagagaccaacattgtggcagttgagcgaataagtgaatacataaatgtagagaatgaggcgccctgggtgactgacaagaggcctccggcagactggcccagacatggtgagatccagtttaacaactatcaagtgcggtatcggccggagctggatctggtactgaaagggatcacttgtaacatcaagagcggagagaaggtcggcgtagtgggcaggactggggctgggaaatcatccctcacaaactgcctcttcagaatcttagagtctgcggggggccagatcatcattgatgggatagatgttgcctccattggactgcacgaccttcgagagaggctgaccatcattccccaggaccccattttgttctcggggagtctgaggatgaatctcgaccctttcaacaaatattcagatgaggaggtttggagggccctggagttggctcacctcagatcctttgtgtctggcctacagcttgggttgttatccgaagtgacagagggtggtgacaacctgagcatagggcagaggcagctcctatgcctgggcagggctgtgcttcgaaaatccaaaatcctggtcctggatgaagccacggctgcagtggatctcgagacggatagcctcattcagacgaccatccgaaaggagttctcccagtgcacggtcatcaccatcgctcacaggctgcacaccatcatggacagtgacaagataatggtcctagacaacgggaagattgtcgagtatggcagtcctgaagaactgctgtccaacagaggttccttctatctgatggccaaggaagccggcattgaaaatgtgaatcacacagagctctagcagctggttccgtggctggcggactataagaacagtttctattatttgctttggtttctgtgactgtgctctaggtgcaaagacacatattttgttcccgttgctcaggctggcctcaaactctaaggctccagcaatctctggtctcagccagagacctgtaaaaatagacacttcaaagattatcatgaataaata

SEQ ID NO: 1550 - DNA, 590 bp, Rattus norvegicus
  Genbank Accession No. NM_012838
gcaggtttttctagggtccagacacccaggtctcctagttggctctctccgtagcttctctgtgatattctaaccagtgcttgccaaagatgatgtgtggcgcgccatccgccacaatgccggccacgaccgagacgcaggagatcgccgacaaggtgaagtctcaacttgaagagaaagcaaatcagaagtttgatgtctttaaagccatatccttcaggagacaggtagtggccggcaccaacttcttcatcaaggttgatgtcggcgaagaaaaatgtgtgcacttgagggtgtttgaacccctccctcatgagaacaagcctttgaccttgtcttcttaccagaccgacaaagaaaagcacgatgagctaacctacttctgattactgcagcccctttgccaaatacttcacctttggaatccgtgtttgggaccacgaagtaaatacccctctgtgagcagcttcctttgtgatgcccaaacggcgttgtattttgtttctttccaaacaattattttcagaaaactgtataaaaactatctctctaaatatatatttttagagaccgtaaaaaaaaaaaaaaaa

SEQ ID NO: 1551 - DNA, 318 bp, Rattus norvegicus
  Genbank Accession No. NM_012839
atgggtgatgttgaaaaaggcaagaagatttttgttcaaaagtgtgcccagtgccacactgtggaaaaaggaggcaagcataagactggaccaaacctccatggtctgtttgggcggaagacaggccaggctgctggattctcttacacagatgccaacaagaacaaaggtatcacctggggagaggataccctgatggagtatttggaaaatcccaaaaagtacatccctggaacaaaaatgatcttcgctggaattaagaagaagggagaaagggcagacctaatagcttatcttaaaaaggctactaatgaataa

SEQ ID NO: 1552 - DNA, 4801 bp, Rattus norvegicus
  Genbank Accession No. NM_012842
caaaaggagaagccatcagggaaggaatcctatctgcatatttcgtctttagccccatccctcattcccggtggggtttggaactttccatcaattctttccctgtctcatttctctttgagcctttgcctagctgtgcctgtcacagcgagaaatcagtcaccctccgccttccagcactcttaggctctgagaaatttggcatacgggtgtcaggtattaaaacagctaaataaaagatgccctggggctgaaggccagcgtggctggaagttctgggggtcagaagcctgactccgcctgctccaagctctagcaatttaagtcacccgggggttttttgttttggtttggtttggtttttcttgaccttagaaccaccgagaccatgctgttctcgctcaccttcctgtcggtgtttttaaagattactgtactcagtgtcacagcacagcagaccaggaactgtcagtcaggtcctctcgagagaagcgggactaccacgtatgccgccgccggtcctcccaggttcctgattttcttacaaggaaacagcatctttcggattaacacagatggaacaaatcaccagcaattggtggtggatgccggcgtctcagtggtcatggattttcattacaaggaagagagactctattgggtggatttagaaagacaacttttgcaaagagttttctttaatgggtcaggacaagagacagtgtgcaaggtggataagaatgtgtctgggctggccataaactggatagatggggagattctccggacggaccgatggaagggagtcatcacagtaacagatatgaacgggaacaattcccgtgttcttctgagttccttaaaacgtcctgcaaatatattagtggatccaacagagaggttgatattttggtcttcagtggtgactggcaaccttcacagagcagatctcgggggtatggatgtaaaaacactgctggaggcaccagagaggatatcagtgctgattctggatatcctggacaaaaggctcttctgggctcaggacggtagagaaggaagccacggttacattcactcctgtgactataacggtggctccatccatcatatcagacatcaagcacggcacgatttgcttactatggccattttcggtgacaagatcttatactcagcactgaaagagaaggcgatttggatagccgacaaacacactgggaagaatgtggttcgagttaacctcgatccagcctctgtgccgccaagagaactgagagtcgtgcacctacatgcacagcccgggacagagaaccgtgctcaggcctctgactccgaacgatgcaaacagagaagaggacagtgtctctacagtctctctgagcgagaccccaactcagactcgtcggcatgcgctgaaggctatacgttaagccgagaccggaagtactgcgaagatgtcaatgagtgtgccttgcagaatcacggctgtactcttgggtgtgaaaacatccctggatcctattactgcacatgccctacaggctttgttctgcttcctgatgggaaacgatgtcacgaacttgttgcctgtccaggcaacagatcagagtgtagccatgattgcatcctgacatcagatggtcctctgtgcatctgtccagcaggttcagtgctcggaaaagatgggaagacatgcactggttgttccttctccgataatggtggatgcagccagatctgccttcctctcagcctagcatcctgggaatgtgattgctttcctgggtacgacctacaattggaccgaaagagctgtgcagcttccatgggaccgcagccatttttactgtttgcaaattcccaggacatacgacacatgcattttgatggaacagactacaaaactctgctcagccggcagatgggaatggtttttgccttggattatgaccccgtggaaagcaagatatattttgcacagacagccctgaagtggatagagagggctaatctggatggctcccagcgagaaagacggatcacggaaggagtagacacgccagaaggtcttgccgtggactggattggccggagaatctactggacggacagtgggaagtctgtcattgaagggagtgatttgagcgggaagcatcatcaaataatcatcaaagagagcatctcaaggccacgaggaatagctgtgcatccaaaggccaggagactattctggacggacacggggatgtctccgcggattgaaagctcttcccttcaaggttctgaccggacgctgatagccagctctaatctactggaacccagtggaatcgcgattgactacttaacagacactttgtactggtgtgacaccaagctgtctgtgattgaaatggccgatctagatggttccaaacgccgcagacttacccagaacgatgtaggtcacccattctctctagctgtgtttgaggatcacgtgtggttctcggattgggctatcccatcggtaataagggtgaacaagaggactggtcaaaacagggtacgtctccgaggcagcatgctgaagccctcgtcactggttgtggtccacccattggcaaaaccaggtgcagacccctgcttacacaggaatggaggctgtgaacacatctgccaagagagcctgggcacggctcagtgtctgtgtcgggaaggattcgtgaaggccccagatgggaaaatgtgtctcactcggaaggatgatcagatactggccggtgacaatgctgatcttagtaaagaggtggcatcgttggacaactcccctaaggcttatgtaccagacgatgataggacagagtcctccacactagtggctgagatcatggtgtcagggctgaactatgaagatgactgcggccctggtgggtgtggcagccatgcccactgtatttcagagggagaggcagctgtgtgtcagtgtttgaaaggatttgctggcgatggaaacctgtgttctgatatagacgaatgtgagctgggtagctcagactgtcctcccacctcgtccaggtgcatcaacaccgaaggtggctatgtctgccaatgctcagaaggctacgagggagatgggatctactgtctcgacgttgatgagtgccagcaggggtcgcacggctgcagcgagaatgccacctgcaccaacacggagggaggctacaactgcacctgtgcaggctgcccatcagcacctggactgccttgccctgactctacctcaccctctctccttggaaaagatggctgccactgggtccgaaacagtaacacaggatgcccgccgtcgtacgatgggtactgcctcaatggtggcgtgtgcatgtatgttgaatccgtggaccgctacgtgtgcaactgtgtcattggctatattggagaacgatgtcagcaccgagacttacgttggtggaagctgcgccatgctgactacgggcagaggcacgacatcactgtggtgtctgtctgtgtggtggcgctggccctgctgctcctcttagggatgtgggggacttactactacaggactcggaagcagctatcagagagctcaaagaagccttccgaagagtcaagcagcaacgtgagcagtaacgggcctgacagcagcggggctggggtgtcttctggtccccaaccttggtttgtggtcctagaggaacaccaacagcccaagaatgggcgtctgcctgccgctggcacgaacggcgcagtagtagaggctggcctgtcttcctccctgtaactcgggccagtgcacctgacttcctggagacagaagccccgaatatatgagatgggcacagagcaaagctgctggattccaccatcaaatgacaaaggaccccaggaaatggaggggaacccccacttaccctcctacagggaatggcctctagctgtgtgggctgagaagaagctgcattctctccagtcagctaatggatcgagtcaacaaagggcctcagacctgccccagcaaacagagccagttctgtagaaactgggagcagacagaaggtaccgaaagtgaaatagcaaaccaggctgaagggtggtagagcggcagatctggtactcctgtctccacggctaatcactgctcagggtcctgaagataactgcatagctgcatagctgatagccgcgacttctgcttcttgcttcaagcagtcccgttgaagacgatcaaaagagaagtggagaaaaatcatcagaaaccgaagtcaagacggttcacgtgtgtaagctgtgtccttcctacccctggactgttgggctcttttccttgttgtctcagaagaaatgggttaaagcaggcgatcacatgctttgttgattgcacagtagatgatatgatctacatagatcttagctcactctcacggaaaggctggaacattatagatgctgcaagatacactgcaagtgtggcccctgctcataattttgccttctgaattgtgattagtgaaaataattgtaacttagagtccgatttattcagaatcagagcattatttttatactatgaaaatctttgaatgaagatatttaactttaaaaacatttcctaagagacaacagtgtttcttaatcattgtcttttcttcttgcagtctttcccagtgaaaacggtaaattctgctgtttgcatagaatctttaacttatttttaagatatgagattgtaaacaaattgcttgatttatttcaatcaatttattctaattatttaaataaaatcacccctaag

SEQ ID NO: 1553 - DNA, 2006 bp, Rattus norvegicus
  Genbank Accession No. NM_012857
gccggcgccgcagctgccgggcctctcgagtcggtggacgcgccctcccgccggcctcgccgcccgcgcaaccgccgtccttcggcctcggctgcgtcgcgccatggcggccccgggcgcccggcggccgctgctcctgttgctgctggcaggccttgcacacagcgccccagcactgttcgaggtgaaagacaacaacggcacagcgtgtataatggccagcttctctgcctcctttctgaccacctatgatgctggacatgtttctaaggtctcgaatatgaccctgccagcctctgcagaagtcctgaagaatagcagctcttgtggtgaaaagaatgcttctgagcccaccctcgcaatcacctttggagaaggatatttactgaaactcaccttcacaaaaaacacaacacgttacagtgtccagcacatgtatttcacatataacctgtcagacacacaattctttcccaatgccagctccaaagggcccgacactgtggattccacaactgacatcaaggcagacatcaacaaaacataccgatgtgtcagcgacatcagggtctacatgaagaatgtgaccattgtgctctgggacgctactatccaggcctacctgccgagtagcaacttcagcaaggaagagacacgctgcccacaggatcaaccttccccaactactgggccacccagcccctcaccaccacttgtgcccacaaaccccagtgtgtccaagtacaatgtgactggtgacaatggaacctgcctgctggcctctatggcactgcaactcaacatcacctacatgaagaaggacaacacgactgtgaccagagcattcaacatcaacccaagtgacaaatatagtgggacttgcggtgcccagttggtgaccctgaaggtggggaacaagagcagagtcctggagctgcagtttgggatgaatgccacttctagcctgtttttcctgcaaggagttcagttgaacatgactcttcctgatgccatagagcccacgttcagcacctccaactattccctgaaagctcttcaggccagtgtcggcaactcatacaagtgcaacagtgaggagcacatctttgtcagcaaggcgctcgccctcaatgtcttcagcgtgcaagtccaggctttcagggtagaaagtgacaggtttgggtctgtggaagagtgtgtacaggacggtaacaacatgctgatccccattgctgtgggcggggccctggcagggctggtcctcatcgtcctcatcgcctacctcatcggcaggaagaggagtcacgcgggctatcagaccatctagcctggtgggcaggtgcgccacagacgcacacgggcctgttctcacatccccaagcttagataggtgtggaagggagggaggcacacttgtggcaaactgttttcaaatctgctttatcaaatgtgaagctcatcttgcaacatttactatgcacaaaggaataactattgaaatgacggtgttaattttgctaactgggttaaatattttgctaactggttaaatgttaatatgttaccaaagtagagctctaaagaggacaagaaggctccacgcatttgacttttaagacttggtgtttggttcttcattcttttactcagatttacgccttacaaagggaatctctggtccagacacttgggcctggcaagggtggctgatggtggttaggctgcacacttgagaagcaaacaggagcagggacgtcctgccacacaggcacgcacagggtcagcctctggacacttggcttgggctgcctggcctggggggctagactctggcatctggctgggcacacccaccagtgtttctgtgctctgccgcctgtgagctaccactttcctaaatagaaaatggcattatggggttggggatttagctcagtggtagagcccttgcctaggaagcgcaaggccctgggttcggtccccagctccggaaaaaaaaaaaagac

SEQ ID NO: 1554 - DNA, 812 bp, Rattus norvegicus
  Genbank Accession No. NM_012861
ctcagttccagagcctgtgtaccgttccaggttacggagtttctgcacagtttgcaaactggaacttggcagaatggctgagatctgcaaaatgaaatacacggtgttggacagccctttggggaagatagagctgtccggctgtgagcgaggcctgcatgggatacgatttctcagtgggaagaccccaaacactgaccccacagaggctccagcctgtcctgaggtgctcggtgggccagagggagtgccagagcccctggtgcagtgcacagcctggctggaagcctatttccacgaacctgcagccacagaggggcttcccttgcctgctctccatcaccctgtgttccagcaagattcattcaccagacaggtgttatggaagctgctgaaggttgtgaaattcggagaaatggtttcttaccagcaattagcagccctggcaggcaaccccaaagcggctcgtgcagtaggaggagcgatgaggagcaatccagtccccatcctcatcccctgccacagggtgattcgcagtgacggtgccattggcaattactctggaggaggacagactgtgaaagagtggcttctggcccatgagggcatcccaactggacagccggcctccaaaggcttgggtctgattgggagctggctcaagccatccttcgagtcttccagcccaaagccgtctggctgaaattgagtaaccgtttgaatgacacatagatgtaatgcggtgttggaagcggatgtgtggtgggtaccactatattaaaagagctgcatgtgtcctgggaaaaaaaaaa

SEQ ID NO: 1555 - DNA, 521 bp, Rattus norvegicus
  Genbank Accession No. NM_012862
acacccgagaccatgaagagcctgctccctctggccatcctggctgcgctggccgtggcagccctgtgctatgaatctcacgaaagcatggaatcctatgaagtcagtcccttcaccacccggagaaatgccaacacctttatatcccctcagcagagatggcacgctaaagcccaggaaagagtccgggaactcaacaagcctgcccaggagatcaacagggaggcctgtgatgactacaagctgtgtgagcgctacgccctgatctacgggtacaacgccgcctacaaccgctacttcaggcagcgccgaggagccaaataagagcgcaaggaaacagtcgctttgttacggagtctggtttcatattcccctgcagtagcattaccgatacacagattcgtgttcgttgcttgttcctcacatgatctcctgtcggctgggccactccttccttccgcgggttgaaagtaatgaaagagcagtattaagaaatgtgtttatatataataaaattctgg

SEQ ID NO: 1556 - DNA, 2432 bp, Rattus norvegicus
  Genbank Accession No. NM_012870
atcaaaggcagggcatacttcctgttgcccagaccttatataaaacgtcatgttcgcctgggcagcagagaagcacctagcactggcccagcggctgccgcctgaggtttccagaggaccacaatgaacaagtggctgtgctgtgcactcctggtgttcttggacatcattgaatggacaacccaggaaacctttcctccaaaatacttgcattatgacccagaaaccggacgtcagctcttgtgtgacaaatgtgctcctggcacctacctaaaacagcactgcacagtcaggaggaagacactgtgtgtcccttgccctgactactcttatacagacagctggcacacgagtgatgaatgcgtgtactgcagccccgtgtgcaaggaactgcagaccgtgaaacaggagtgcaaccgcacccacaaccgagtgtgcgaatgtgaggaagggcgctacctggagctcgaattctgcttgaagcaccggagctgtcccccaggcttgggtgtgctgcaggctgggaccccagagcgaaacacggtttgcaaaagatgtccggatgggttcttctcaggtgagacgtcatcgaaagcaccctgtaggaaacacaccaactgcagctcacttggcctcctgctaattcagaaaggaaatgcaacacatgacaatgtatgttccggaaacagagaagcaactcaaaattgtggaatagatgtcaccctgtgcgaagaggcattcttcaggtttgctgtgcctaccaagattataccgaattggctgagtgttctggtggacagtttgcctgggaccaaagtgaatgcagagagtgtagagaggataaaacggagacacagctcgcaagagcaaactttccagctacttaagctgtggaagcatcaaaacagagaccaggaaatggtgaagaagatcatccaagacattgacctctgtgaaagcagtgtgcaacggcatatcggccacgcgaacctcaccacagagcagctccgcatcttgatggagagcttgcctgggaagaagatcagcccagacgagattgagagaacgagaaagacctgcaaacccagcgagcagctcctgaagctactgagcttgtggaggatcaaaaatggagaccaagacaccttgaagggcctgatgtacgcactcaagcacttgaaagcataccactttcccaaaaccgtcacccacagtctgaggaagaccatcaggttcttgcacagcttcaccatgtaccgattgtatcagaaactctttctagaaatgatagggaatcaggttcaatcagtgaagataagctgcttatagttaggaatggtcactgggctgtttcttcaggatgggccaacactgatggagcagatggctgcttctccggctcttgaaatggcagttgattcctttctcatcagttggtgggaatgaagatcctccagcccaacacacacactggggagtctgagtcaggagagtgaggcaggctatttgataattgtgcaaagctgccaggtgtacacctagaaagtcaagcaccctgagaaagaggatatttttataacctcaaacataggccctttccttcctctccttatggatgagtactcagaaggcttctactatcttctgtgtcatccctagatgaaggcctcttttatttatttttttattctttttttcggagctggggaccgaacccagggccttgcgcttgcgaggcaagtgctctaccactgagctaaatctccaacccctgaaggcctctttctttctgcctctgatagtctatgacattcttttttctacaattcgtatcaggtgcacgagccttatcccatttgtaggtttctaggcaagttgaccgttagctatttttccctctgaagatttgattcgagttgcagacttggctagacaagcaggggtaggttatggtagtttatttaacagactgccaccaggagtccagtgtttcttgttcctctgtagttgtacctaagctgactccaagtacatttagtatgaaaaataatcaacaaattttattccttctatcaacattggctagctttgtttcagggcactaaaagaaactactatatggagaaagaattgatattgcccccaacgttcaacaacccaatagtttatccagctgtcatgcctggttcagtgtctactgactatgcgccctcttattactgcatgcagtaattcaactggaaatagtaataataataatagaaataaaatctagactccattggatctctctgaatatgggaatatctaacttaagaagctttgagatttcagttgtgttaaaggcttttattaaaaagctgatgctcttctgtaaaagttactaatatatctgtaagactattacagtattgctatttatatccatccag

SEQ ID NO: 1557 - DNA, 324 bp, Rattus norvegicus
  Genbank Accession No. NM_012875
  misc_feature (1)..(324): n = a or c or g or t
tctctcttgattcagatcctcgccatgtcttctcacaagactttcagaatcaagcgattcctggcaaagaaacaaaagcaaaatcgtcctattcctcaatggattcggatgaaaactggtaacaaaatcaggtacaactctaagagaagacactggaggagaacgaagctgggtctataaggagtcacactacggccagactgaggatttctactgaatcaccgtcatcgatcagtccgaccagatggatttcaacatttttaacctagagatttacttgtgtctgaactaatttgtccagtaataaaatttagaacctttcan

SEQ ID NO: 1558 - DNA, 2573 bp, Rattus norvegicus
  Genbank Accession No. NM_012879
actccgcttgctcctcctcctacaatgtataaccaggcagagctgaggacagctactcatccacattcggaacaggacctggattgagacaacaactccgcacacaacatgtcagaagacaagatcaccggaaccttggctttcactgtcttcactgcagtgctgggttccttccagttcggatatgacatcggtgtgatcaatgcacctcaagaggtaataatatcccattatcgacatgttttgggtgttcctctggatgaccgaagagctaccattaactatgacatcaatggcacagacaccccactcatagtcacaccagcacatacgacaccagacgcctgggaagaagagactgaaggatctgctcacatagtcactatgctctggtctctgtctgtgtccagctttgcagtaggcggaatggtcgcctcgttctttggtgggtggcttggggacaaactcggaaggatcaaagccatgttggctgcaaacagcctctcgttgactggagccctcttgatggggtgttccaaatttggaccggcacatgctctcatcattgctggaagaagcgtatcaggactgtactgtgggctaatttcaggactggttccaatgtacattggcgagattgctccaaccacactcaggggtgccctgggcactcttcaccaactggctcttgtcacaggcattcttattagtcagattgctggcctcagcttcattctgggcaatcaggattactggcacatcctacttggcctatctgctgtaccagctctcttgcagtgtctgctactgctcttctgtccagaaagccccagatacctttacctaaatttggaagaggaagtcagggcaaagaaaagcttgaaaagactaaggggcactgaggacatcaccaaagatattaatgagatgaggaaagaaaaggaagaggcgtcgactgagcagaaggtctccgtgatccagctcttcacggatccgaattatcggcagcccattgtggtggcactgatgctacacttggctcagcagttctctggaatcaatgggatattttactattcaaccagcatttttcagacagctggcatcagccagcctgtgtatgcaaccatcggcgttggtgccatcaacatgatcttcacagctgtctctgtgctgcttgtggagaaggcggggcggcggaccctgttcctggccgggatgattggcatgtttttctgtgccgtcttcatgtcgctgggactggtgttgctggataagttcacctggatgagttatgtgagcatgacggccatcttcctcttcgtcagtttctttgagattgggccaggtccaatcccttggttcatggttgctgaatttttcagccaaggaccccgtcccacggctctggcactggctgcctttagcaactgggtctgcaatttcatcatcgccctctgcttccagtacattgcggacttcctcgggccttacgtgttcttcctttttgctggggtggtcctggtcttcaccctgttcacattttttaaagttccagaaaccaaaggaaagtcttttgacgaaattgctgcagaattccggaagaagagtggttcggccccaccacgcaaagccactgtacaaatggaattcctggggtcatcagagactgtgtgaggatgagctgcctaaaatccaggaacagaccagaagggaaccaggtgctccctcttaactcgaatccttcatgagtgtaggactacacccaggaggatcatttattccttttgaagaatttgtacagactccgattagaaacgtcaacatatatcattaccaaagaaagtatttttttaacttagagaatctattttggatggtaaaactcttcagtaaaccagaggctgctctgcttctctacagggaaagcacgttataagcttcctcgcctggttctactgaaattggagagctttcaacatatcactgctcttaaaagcacgtgactaagaaatctgaagctacaactgatatatatatatttaaatataattccattggaattttcttagccacagatctgatgctgaaggacctatggctggcaaggctcacactcaaactgacgtctctgttacccacctcggtttctctcacatgtactagactttgtgttttgttttaaactatttttctgcatttttatagagaactcctgagtatgttaagctatatttgtaatgaaaagcctcttctttacagctaccaaaatcttcatgtagtgagagaaaacgtttcagtttctttgatgtatattgtaaggttaaacgctcgagtttttcctagccattgagtctagattatcagttaatattagcatctaaaccatgttagttactctccatttcagtcctttgtattgtacttttacttgtttttttttttaattgcccatggcacacacttaaaaccatcaggagtcaggcattttgcatattgcctccaaaatctaataaactggaccaatcacagggaaatctggaataaagagctgctctatttgttcatttttt

SEQ ID NO: 1559 - DNA, 1729 bp, Rattus norvegicus
  Genbank Accession No. NM_012880
ggctcacaagcagctggccagttctggggaggcagctcagaggctctttctcaggcctctagctgggtctgtcctgtacttcaccagaggaaaaacgttcttgggagagcttgtcaggtgtggaacctcagccatggtggccttcttgttctgcaacctgctactggtggcctgtggctctgtcacctggaccatgtcagataccggagagtccggtgtcgacttagcagaccggcttgacctggttgagaagataggcgacacgcactccaaagacctggagatctggatggagctaggaaaacaacgggaggcggatgccagggagatgcacgcagtctgcagggtacagccctcagccatgctgcctcccgatcagccacagatcacaggcttggtcctcttccggcagctggggcccagctccagacttgaggcctccttcaatctggagggcttcccagccgagcagaacacctccaaccacgccatccacgtgcatgagttcggggacctgagccagggctgcgagtccaccggaccacactacaacccgctgggtgtgccgcacccacagcacccgggggacttcggcaacttcgtggtgcgcgatggccgcctttggaagcatcgaatgggcctggccacgtcactggccggaccgcactcgatcttgggccgcgctgtggtggtccacgctggcgaggacgacctgggtaaaggtggcaaccaggccagcgtgcagaacggcaacgcaggtcgccggctcgcctgctgcgtggtaggcaccagcaactcggaggcctgggagagccagacaaaggagcgcaagaagcggcggcgggagagcgagtgcaagaccacttaagcatcacccagggccgcctagcctagctgctgcgcgcatagatgcctccacacgcgccctctagacgcctccagtcatcctagaggtctctgggtgtcctagactgacgcttcccagacacctcaatcgcctctgtgcgccccacactcttccacataccccagacacctctgtatggctcagatgccttcaagaacctcctcggccacgtccacgagccccagatgttcccacgtgccctgggcactgttctcggagaccaggacacttttttgtaacctaggaatccttcacacctatgcactccacagaccaactccttcgtgctctaggtccacctcgaactactttatgccccaagacaatcccataagcccctagcatcccctttgaaacagtctttgagtttgctcccagagaattccccgcttacccccagaggtcgaatgtgcgcagataactctccttttactctgaggacatcccagtggaccttctagagaactcccttggggtgttctgaaatatcaccaccccacttccttctgcccccttttgttttctttctgtcccctagcacccgagacttctctcttccctagagacctcgtttgtcttccccttgttcctcctagggctctgggaccaccctgacacacacacacacacacacacacacacacacacacacacacacacacacacatccctaagattccatgttcctgatcacctcctgccgggcccctggttctgttttcatctgtttcccatatggtgcctgcaccccaaggagagcagctcctccgagagtatttgacaacctttatgctgctcattaaaaccacagcaattcaaaaa

SEQ ID NO: 1560 - DNA, 1457 bp, Rattus norvegicus
  Genbank Accession No. NM_012881
gcaagcctcagcatccttggctttgcagtctcctgcggcaagcattctcgaggaagccagccaaggaccaactacaaccatgagactggcagtggtttgcctttgcctgttcggccttgcctcctgtctcccggtgaaagtggctgagtttggcagctcagaggagaaggcgcattacagcaaacactcagatgctgtagccacttggctgaagcctgacccatctcagaagcagaatcttctagccccacagaattctgtgtcctctgaagaaacggatgactttaagcaagaaactcttccaagcaactccaatgaaagccatgaccacatggacgatgatgacgacgacgatgacgacggagaccatgcagagagcgaggattctgtgaactcggatgaatctgacgaatctcaccattccgatgaatctgatgagtccttcactgccagcacacaagcagacgttttgactccaatcgcccccacagtcgatgtccctgacggccgaggtgatagcttggcttacggactgaggtcaaagtccaggagtttccctgtttctgatgaacagtatcccgatgccacagatgaggacctcacctcccgcatgaagagccaggagtccgatgaggctatcaaggtcatcccagttgcccagcgtctgagcgtgccctctgatcaggacagcaacgggaagaccagccatgagtcaagtcagctggatgaaccaagcgtggaaacacacagcctggagcagtccaaggagtataagcagagggccagccacgagagcactgagcagtcggatgcgatcgatagtgccgagaagccggatgcaatcgatagtgcagagcggtcggatgctatcgacagtcaggcgagttccaaagccagcctggaacatcagagccacgagtttcacagccatgaggacaagctagtcctagaccctaagagtaaggaagatgataggtatctgaaattccgcatttctcatgaattagagagttcatcttctgaggtcaattaaagaagaggcaaaaccacagttccttactttgctttaaataaaacaaaaagtaaattccaacaagcaggaatactaactgcttgtttctcagttcagtggatacatgtatgtggagaaagaaatagatagtgttttgggccctgagcttagttcgttgtttcatgcagacaccactgtaacctagaagtttcagcatttcgcttctgttctttctgtgcaagaaatgcaaatggccactgcattttaatgattgctattcttttatgaataaaatgtatgtagaggcaggcaaacttacaggaacagcaaaattaaaagagaaactataatagtctgtgtcactataatcttttggttttataattagtgtatattttgttgtgattatttttgttggtgtgaataaatcttgtatcttgaatgt

SEQ ID NO: 1561 - DNA, 1384 bp, Rattus norvegicus
  Genbank Accession No. NM_012882
ccgacttcgtacagcaatcgagtgagcacactgctctttgagcccgagtgcgctgcctaactgcgaagtaccgccgccgtgcccgccccggcgtgggcaccctgtcctgcacagagacacgcgtggtctggcacccggcctgaagctgacagcatggagcccctctctctggcctccacaccaagctggaatgcctcggctgcttccagtggtaaccataactggtcactggtgggctcagcatcgccaatgggagcccgggcagtattagtgcctgtgctctacctgttggtgtgcaccgtgggactgagtggaaatacactggtcatttatgtggtgctgcggcacgccaagatgaagacagttactaacgtgtacatcctgaacctggccgtggctgacgtattatttatgttgggacttcctttcctggccacgcagaacgccgtcgtctcctactggcccttcggctccttcttgtgccgcctggtcatgacactggatggcatcaaccagttcaccagtatcttctgcctgatggtcatgagtgttgaccgctacctggccgtggtccaccctctccgctcagcccggtggcgtcgcccacgggtagccaagatggccagcgcggccgtctgggtcttttcgctgctcatgtctctgccgctcttggtcttcgcggatgtccaggagggctggggcacctgcaacctgagctggccagagcctgtggggctgtggggtgcagccttcatcacctacacgtctgtgttgggcttctttgggcccctgctggtcatctgcttgtgctacctgctcattgtggtcaaggtgaaggctgcaggcatgcgcgtaggctcctcaaggcggaggcgctcggagccgaaggtgactcgcatggtggtggtcgtggtgctggtgtttgtgggctgctggctgcctttcttcattgtcaacatcgtcaacctggccttcacactgcccgaggaacccacatctgccggcctctatttctttgtggtggtcctatcttatgccaatagctgtgccaaccccctgctctacggctttctctcggacaacttccgccagagcttccggaaggttctgtgcctacgtagaggatacggtatggaggatgcggacgccatagagccacggccagacaagagtgggcggcctcaggccacactgcccacacgcagctgcgaggccaatgggctcatgcagaccagcaggatttgaatgcccctgtaacaccctgggggtcctccaggcctccacggtgttgtcttctgggatctgagagtttgctgagatgcattcacccccaggcctacaagttggactcctctcggtggcagtgtgaagacaggacctgcag

SEQ ID NO: 1562 - DNA, 2117 bp, Rattus norvegicus
  Genbank Accession No. NM_012891
aattccgcggcggctttggagatgcagtcggcccggatgaccccgagtgtggggcgacaactgctgcggctgggggcccgaagctcgcggtctgctgcgcttcagggacaaccccggcctacctctgcccagcgactttatgccagtgaggccactcaggcagttctggaaaagccagagaccctctcctctgatgcttccaccagagaaaaacctgccagggcggaatctaagtcttttgctgtgggaatgttcaaaggccagcttaccaccgaccaggtgttcccatacccatctgtgctcaatgaaggacagacacaatttctcaaagagctggtgggaccagtggcccggttctttgaagaagtgaatgaccctgccaagaatgactccttggagaaggtggaggaggacactttgcagggactcaaagaactgggggcatttggtctgcaagtacccagcgagctgggtggtttgggcctctctaatacccagtacgctcgcttggcagagattgtgggcatgcatgaccttggtgttagcgttaccctgggagcccatcagagcatcggtttcaaaggcatcttgctctatggcacaaaggcccagaaggaaaaatacctccccagagtggcatccgggcaggctttggcggctttctgcctgactgagccctcgagcgggtccgatgtggcctctatccgaagctcagctgtacctagcccctgtggaaagtattatactctcaacggaagcaagatctggatcagtaatgggggtctggcagacattttcactgtctttgccaaaacgccaattaaagatgcagccacgggggccgtgaaagagaagatcacagctttcgtagtggaacggagctttggaggggttacccatgggctccccgaaaagaagatgggcatcaaggcatctaacacatcagaggtgtactttgatggagtcaaggtgccagcagagaatgtgctaggagaagtgggagatggcttcaaggttgctgtcaacatcctcaacaacggaagatttgggatggctgcaaccctagcaggcaccatgaaagccatcattgccaaggcggttgatcatgctactaaccgtacccagtttggggacaaaattcacaactttggggtgatccaggaaaagctggctcggatggctattctgcagtatgtgactgagtccatggcttacatgctgagtgccaacatggaccagggattcaaagacttccagatagaagctgccatcagcaaaatctttggctcggaggcggcctggaaagtgacagatgagtgcatccagataatggggggcatgggcttcatgaaggaaccaggggtagagcgtgtgctccgagatattcgaatcttccggatctttgaagggacaaatgacattcttcgactgtttgtggctctacaaggctgcatggacaaaggaaaggaactcacgggacttggtaatgccctaaagaatcctcttggaaatgttggcctcctcataggagaagcaagcaaacagctgaggcggcggacagggattggcagtggtctgagtctctcgggaattgtccacccagagttgagtcgcagtggtgaactggcagtgcaggctctggaacaatttgccactgtagtggaggcgaagctgatgaagcacaagaaagggattgtcaatgaacagttcctgctgcagcgactggcagatggagccattgacctctacgccatggtggtggttctctccagagcctcaagatccctgagtgagggctacccgacagcacagcatgagaaaatgctctgtgatagttggtgcattgaggctgcaacacggattcgagaaaacatggccagccttcagtccaaccctcagcagcaggagctctttcgtaacttcagaagtatctccaaggccatggtggagaatggtggcctggtcaccagtaacccccttagagtctgaagactcctaatcaggccctagcacagtcgtgtgccttcttctatgccaaacacaggcccccttcatgggggcactggagtacttactgccttaaggacaataaattttctaccaaaaaaaaaaaaaaa

SEQ ID NO: 1563 - DNA, 1116 bp, Rattus norvegicus
  Genbank Accession No. NM_012899
gcctagactccgtcttagcagactgctgtgttccgccggcccccaccatgcaccaccagtccgttctgcacagtggctactttcacccactgcttcgggcctggcagaccaccccctccaccgtcagtgccaccaacctcatctatcccatctttgtcacggatgttcctgatgatgtccagcccattgccagcctcccgggagtggccaggtatggcgtaaaccagctagaggagatgctgagacctctggtggaagccggccttcgctgtgtcctgatctttggcgtccccagcagagttcccaaggatgaacagggctctgcagctgactcagaggactccccaactattgaggctgtccgtctgctgaggaagaccttccctaccctcctagtggcctgtgatgtctgcctgtgcccctacacctcccatggccactgtggcctcctgagtgaaaatggagccttcctagcagaggaaagccgacaacggttggcagaggtggcactggcctatgccaaggcaggttgtcaggttgtagctccatcagacatgatggatggacgagttgaagccatcaaggctgccctgctaaaacatggacttggcaacagggtctctgtgatgagctatagtgccaaatttgcctcctgtttctatggtcctttccgggatgcagctcagtcaagcccagctttcggagaccgacgctgttatcagctgcctcctggagcccgtggcctggccctccgagcagtggcccgggacattcaagagggagctgacatactcatggtaaagccgggattaccctacctggatatggtgcaggaggtgaaggacaagcaccccgagctccccctcgcagtataccaggtgtccggagagtttgccatgttgtggcacggagccaaggctggggcctttgatctcaggactgctgtactggagtccatgacggccttccgcagagccggtgctgacattatcatcacctactttgcaccccagctgttgaagtggctgaaggaagagtgaaggaaagtgaaggacttggtcttgacagagctccctgggccttacagaagggaaaaagtaaaggcgctgttagaac

SEQ ID NO: 1564 - DNA, 1402 bp, Rattus norvegicus
  Genbank Accession No. NM_012904
cgagcaaagcttctcttcagttccctggaagacaaggcaatacaaagatactttattaaaaatggcaatggtatcagaattcctcaagcaggcctgctatattgaaaagcaagagcaggaatatgttcaagctgtaaaatcctacaaaggtggtcctggatcagcagtgagcccctacccttccttcaatccgtcctcggatgttgctgccttgcacaaagctatcatggttaaaggtgtggatgaggcaaccatcattgacatccttaccaagagaaccaatgctcagcgccagcagatcaaggcagcatacttacaggagactgggaagcccctggatgaaaccttgaaaaaagcccttacgggccacctggaggaggttgttttggctatgctcaagaccccagctcagtttgatgcagatgaactccgtgctgccatgaagggacttggaacagatgaagacactctcattgagattttgacaacaagatctaaccagcaaatcagagagattactagagtctacagagaagagctgaaaagagatctggccaaagacatcacttcggacacatctggagactttcgtaatgccttgcttgctctcgccaagggtgatcgctgtgaggatatgagtgtgaatcaagatttggctgatacagatgccagggctttgtatgaagctggagaaaggagaaaggggacagacgtgaatgtgttcaatacaattttgaccacaagaagctatcctcatcttcggaaagtgtttcagaattatagaaagtacagtcaacatgacatgaacaaagccctggatctggaactgaagggtgacattgagaagtgcctcacaaccattgtgaagtgtgccaccagcactccagctttctttgctgagaaactgtatgaagccatgaagggtgctggaactcgccataagacattgatcaggattatggtctcccgttcggaaattgacatgaatgaaatcaaagtattttaccagaagaagtacggaatccctctctgccaagccatcctggatgaaaccaaaggagactatgaaaaaatcctggtggctctgtgtggaggaaactaaacatcccaactgctctgtaagattccgaggagaacatctcttagccgttgttttcttcctattgcaaggcttaagtaggaaagttgctttgtcagtaagtctaattaccttctttgaataatgtagcctataaatatgttttagatcattcatctgtacaatagagaaatacttgttttgttaattatgtttatcccaaattataaatccctgtaagcaagtcactttggtaccattcctgagaaagaagtttacatagaataaaataaaacaattttataagacaaaaaaaaaaaaaaa

SEQ ID NO: 1565 - DNA, 939 bp, Rattus norvegicus
  Genbank Accession No. NM_012909
atgtctccatgggggcatgcttccctttggactagaggaagagagaagagaaagagagagggagggaggaagagccacccccgtggcccagacccctggccagcgcgcagaagtcggagcagcatgtgggaactcagatccatagccttctcccgagcagtgctggctgagttcttggccacgctcctttttgtcttctttggccttggctcagccctccagtgggccagctccccaccctctgtgctccagatcgccgtggcctttggtctgggcatcggcatcctggttcaggctctgggccatgtcagcggggcacacatcaaccccgccgtgactgtggcatgcctggtgggttgccatgtctccttccttcgagctgccttctatgtggctgcccagctgctgggcgccgtggctggggctgccatcctccatgagattactccagtagaaatccgtggggacctggctgtcaatgctctccacaacaacgccacagctggccaggctgtgactgtagagctcttcctgaccatgcagctggtgctgtgcatctttgcctccaccgacgagcgccgcggtgacaacctgggtagccctgccctctccattggtttctctgttaccctgggccacctccttgggatctatttcaccggttgctccatgaatccagcccgctccctggctccagcagttgtcactggcaagtttgatgatcactgggtcttctggatcggacccctggtgggcgccatcatcggctccctcctctacaactacctgctgttcccctcggcaaagagcctgcaggagcgcttggcagtgctcaagggcctggagcccgacaccgactgggaggaacgtgaagtgcggcggcggcagtcggtggagctccactctcctcagagcctgcctcgcggcagcaaggcctga

SEQ ID NO: 1566 - DNA, 1758 bp, Rattus norvegicus
  Genbank Accession No. NM_012911
tttttttttttttgcctattaaaaggtttatttcttccctatgctcagaaacgaagatatggccttgctggtccctcccctgaaatctcatcttcaaggattgggaggcagaaggggacctggcagcgggtgagaaggctgcgagcgagccgcgaacccggcgggtggagggcggcgacggcgcgcgcaccatgggtgaaaaacccgggaccagggtcttcaagaagtcgagccctaactgcaagctcaccgtgtacttgggcaagcgtgactttgtggatcacttggacaaagtggatcctgtcgatggtgtggtgcttgtggatcctgactacttgaaggaccggaaagtgtttgtgaccctcacctgtgccttccgctatggccgagaagacctggatgtactgggcctgtctttccgcaaagatctgttcatcgccacctaccaggccttcccccccatgcccaacccacctcggccccccacccgcctacaggaccgactgctgaagaagttgggccagcatgcccaccccttttttttcacaataccccagaatttgccttgctccgtcacactgcagccaggaccggaggacacagggaaggcctgtggagtagactttgagattcgagccttctgtgccaaatctatagaagaaaaaagccacaaaaggaactccgtgcggcttatcatcagaaaggtacagtttgctcctgagacacccggcccccagccatcagctgaaaccacacgccacttcctcatgtctgaccggaggtccctgcacctagaggcttccctggacaaagagctgtactaccatggggaacccctcaatgtcaacgtccacgtcaccaacaattctgccaagaccgtcaagaagatcagagtgtctgtgagacagtatgccgacatttgcctcttcagcaccgcgcagtacaagtgtcctgtggctcagcttgaacaagatgaccaggtgtctcccagttccacattctgcaaggtgtacaccataaccccgctgctcagtgacaaccgagagaagcgtggccttgcccttgatgggcaactcaagcacgaagacaccaacctggcttccagcaccattgtgaaggagggagccaacaaggaggtgctgggaatcctagtatcctacagggtcaaggtgaagctggtggtgtctcgaggcggggatgtctccgtggagctacctttcgtcctaatgcaccccaagccccacgaccacatcacccttccccgaccccagtcagccccccgggaaatagacatccctgtggataccaacctcattgaattcgataccaactatgccacagacgacgacatcgtgtttgaggactttgcgaggcttcggctgaaggggatgaaggatgacgactgtgatgaccagttctgctaggaagaggggctgggagaggtaggggtgggcaggactgaggtccactgcccttgcgggtaggagggtcccagcctctcctccttccccgttcgtccacccgagatacacactggacccatcactcgttgaaagtgggcattaatcttttgacttcagctctgccaccccagccctgctccctagggtggcaagctgtgtacacacctaaagttttgggaagggaagggaacactgaaagcaaggagtgaatgtagagaaaaggagtagaaaggacacccatgtttggcctcataccaacccacccccagtcaccacttctgcctcccccgaattc

SEQ ID NO: 1567 - DNA, 1893 bp, Rattus norvegicus
  Genbank Accession No. NM_012912
tgtctcactcagcgagacgcgcggtgcacggtgcttccccggcggacgaccgaccaacccgcgctccggcagagtccttggcgctcgcctgccggcgggacagacagcccgcctctagccgctctctggaccctggccgccccgagcgaagactggagcaaaatgatgcttcaacatccaggccaggtctctgcctcagaagtcagcgcgaccgccatcgtcccctgcctctcacctcctgggtcactggtgtttgaggattttgctaacctgacaccttttgtcaaggaagagctgagattcgccatccagaacaagcacctttgccatcggatgtcctctgcgctggagtcagtcaccatcaacaacagacctctggagatgtcagtcaccaagtctgaggtggcccctgaagaagatgagagaaaaaggaggcggcgggaaagaaacaaaattgctgctgccaagtgtcgaaacaagaaaaaagagaagacagagtgcctgcagaaggagtcagagaaactggagagtgtgaatgccgaactgaaggcccagatcgaggagctgaagaatgagaagcagcatctgatttacatgctcaacctgcaccggcccacgtgtatcgtccgggctcagaacgggcggacgccggaagacgagaggaacctttttatccaacagataaaagaaggaacattgcagagctaagcagaggtggcatgggggcaattggggagtccttactgaatcctccttttccaccccaaaccctgaagccattggaaaactggcttcctgtgcacttctagaatctcagcagccacgagctgttgggtcaggagggcctgcggtgactactgcgttgtcccactctgtccccgagtgaaccgtggagcaggcaggagcatcctttgtctcaccggctccaggatttaggccttaccatcccggccattctcagatgacctagctggccccaggctggggtcccatgcaaagcaggatcgcactaatgggatgcaggcagaagtgtctaccttgacaggtggggtggaccacgtcctccactgcggctgacaacatccctcctagggaagatggagtgagaacattcatcattgaagttgtccaatggccagggtatgctttctagaaactatgctgttctgtcctagactgactgtgcatagggcattcatttctgagcctggtgttgtgctatttagatgtttgtcttgcacaacattggcgtgatttttttccgggagtttcatcagacctgatttccgagagtttgggggtctgccactgtggacaatatcccccaaaagtgtttgggtggccatgtaaactggctgatgaccagctgtgctactctgtgctgaccgaggactgatgcctccttcccctgtacccactgctgaggaagaacccgggcacagcagctgtccttggctacaaactgttacaatgtcacagaacgaaggcacaaagtcccgctttcaaagggcgtaggactccacactcagtgacagggcaggaagagccaaggattctccgttttcccttccttcccaccaaaaaccacagcccgtggagactggtatttgaagccaggagtggggcaaggaaggtgtctgcactgtgggatgttaactgcgcttttgtcttgaagctattttgagatgcggtccagagtatttcagctgggaggtccctcccactggccaccagggctctggctactgttaaaattctgatgtttctgtgaaatcctcagtgttcaatccagactcagtagtatattacagttttctgtaagagagaacgttacttatttatcccagtattcctagcctgtcaacgtaataaaatatcagaatgagacctggt

SEQ ID NO: 1568 - DNA, 1818 bp, Rattus norvegicus
  Genbank Accession No. NM_012913
ctcctaacggagagttgttcccggccgtgcggtcctccgtcgccgtcgctgggctgcgccgccgctgtcgccaggacgcgccgccgagcccctcgtcgcctctagccccgcggcctccgttcacctcaacttccactcgcccatcatgacgaagactgagaagaaatccttccaccagagcctggccgagtggaagctgttcatctacaacccgaccagcggagagtttctggggcgcacctccaagagctggggtctcatcttgctcttctacctagttttttatgggttcttggctgcactcttcacattcaccatgtgggtcatgctccagactctgaatgacgaggttccgaagtaccgagaccagattcctagtccaggacttatggttttccccaaaccaccgactgccttggattatacatacagcatgtctgacccacatacttataaaaagtttgttgaagacctgaagaatttcctaaagccatattctgtggaagaacagaagaatctcacagattgccctggtggagcactttttcatcaggagggtccagactatagtgcgtgtcagttcccagtttccttgcttcaagaatgtagtggtgtgaatgattctaattttggctactccaaaggacaaccttgtgttcttgtgaagatgaacagaataatcgagttagtcccagatggagctccatatattacatgtataacaaaggaagaaaacatagcaaatatagtaacttatcctgatgatggacttatagacttaaagtattttccatattatgggaaaaaacggcacgttggatatcgacagcccctagttgccgtccaggtcatatttggggccgatgctaccaagaaagaagtaacaattgagtgccaaattgatggaaccaggaacctaaaaaacaagaatgaacgtgacaagttcttgggacgagtttcatttaaagtcatagcacatgcctaggagtaggctgtctgcacagagtaaatgttgtgttgtctccattctgtatcagctggacctgccattctaggatatgaggccacctgggaggaggaagtggtatgggacacacttgggtgacatcataacatgcttccagatcatagtgttcagtgtcctctgaagtaactgcctgctgcctctgctgcccttgaacccatgtacggtcgccagacagggaccagtgagctcccaatcccaaacatgcagagtgggggtctcgtcgtcttctgtgtgtaattgccaaatgtctaaagcttcatgtgctgtgctgtgtaaatattttatggatttaacactggtaactgtcatattttgatgccaagaaagttttagggaaaaaatggtaccttgccaacatcaagtgactttagctgaagaaatgtgtgagaagttctgtatgtgatgaaggagaaagggaaataaagtggatctgaaagtactgaccctggttctgcgtacgtgtgagtgagtgcctgtcgtatgctctagtggtttttacatgctgaactagactatagctgactgtactgagaggacagactttctgttgtaatacatatttaaaatactatcggggtgactgagtgtggaatcaagcttccacactcaggtgtcgtagacacatggaagaaacagtgttttaattaggtgaatgagtaccgatgtttttgctttgttttgttttttgaatgaaatgaaattcccaagacataaattgtatagtttttcaaaatgtcttaagtgcttttatttagtagactatggaccctaataaaaaaaatgtgaaatac

SEQ ID NO: 1569 - DNA, 833 bp, Rattus norvegicus
  Genbank Accession No. NM_012915
gaattccaaaatatgtaaggctttcaatttattacagatcacccaagaacataatgatatacatgtagtcagaaaacacgatgtagaaatcatagtgagttgtccagacatggtcagtagattattctttctggcatgctccagtgtcaacactcaataaagagcactaaaatccttccatacaattaagtatcagcgatgtaccatattgcagaaaggggtggctgagcaacagtttgttgatactataagacttccatgctcaacagtcgtagcgttgcactcagcacagctctggtttccatatacaaattttccatctcgagtggttactacaacccaggcacaaatctcatcaggataagtctgacatttctgtcttccaacatgacaaaatcctgtagaatcgaagctagtacgctcggtgtctggggtatgagggtcctgcaaacccgaggcttcggctcggactcgtcggagagcatggattcgggcgctggctccatccgagaagctggtggggccttcgggaaacgagagaaggctgaagaggatcggtacttccgagagaagactagagagcagctggctgccttgaagaagcaccatgaagatgagattgaccaccattcgaaggagatagagcgtctgcaaaaacagatcgaacggcataagaagaagattaaatacctaaagaatagtgagcattgagtgcacacagtcagtctctcacagagtggccagtatcattccccacttctatagagattgttttgaatgattgatgtttgacctgtgtgctactaacagataataaattatcaccggaattc

SEQ ID NO: 1570 - DNA, 3169 bp, Rattus norvegicus
  Genbank Accession No. NM_012923
ccgcacgctgaaccggaggaactgcgcctagtcggggcgctgagggaccctccaccgggacgccggcccctccccgggcctctgctcacttgcccccctgcgagcccgtccccctagtcggcctctcggatcggggacgtggggcgagctgagagcaggcccggggtgggtggtcactgtggagaagacgtggctgtcaagatgatagaagtactgacaactgactctcagaaactgctacaccagctgaacaccctgttggaacaggagtccagatgtcagccaaaggtctgtggcctgaaactgattgagtctgcacatgataatggcctcaggatgactgcaagactccgggactttgaagtcaaagatctactgagtctaactcagttctttggcttcgacacagaaacattttcccttgctgtgaatttactggacagattcttgtctaaaatgaaggtacaggcgaagcatctcggctgtgtcggactgagctgcttttatttggctgtgaaatcgattgaagaggaaaggaacgtcccgctggcaactgatttgatccggataagtcagtataggttcacagtttcagacctgatgagaatggaaaagattgtgttggagaaagtgtgctggaaagtcaaagctactactgccttccaatttctgcagctctattactccctcattcgggagaccttgccatttgaaaggagaaacgatctgaattttgaaagactagaagcccaactgaaggcgtgccactgcaggatcatattttctaaggcaaagccttctgtgctggcgctggcaatcatcgctttggagatccaagcactgaagtatgtggagttaacagaaggagtagaatgtattcagaaacattccaagataagtggccgagatctgaccttctggcaagagcttgtttccaagtgtttaactgaatattcatcaaacaagtgttccaagccgaacggtcagaagttaaaatggatcgtgtctgggcgcactgcacgacaactgaagcacagttattacaggataacccacctcccaacaattcccgaaaccatgggttagttggcaaatctggttgttatcctctgtgtacagaacatttcccagtgagatcgtttttgtgctataacttaaggattgaaatactaccttcaatataaagaatacaggatgaaaacagtaaaggaaacgtgagtttgttggtctagacagagaatactgggaggcattcactgtgtaccgcagtctgaagagaaatgagtatcaaacctctagacacatgctcatactgctgtcaaaggactagcgtagaaaagagagtcctccaaaccggaagtttaaatgtagttactaaaatagcacttcttataacttacatatccccccactgtggcttatttaaagttacagaagtccaagcagaacgacaaaagatgtgacccatatatgaacacattttaatctgttcattgattaggagagtgaatatgaacttgcatgatgcccatgttaggtttctggaaactgccggggtatcttaattctctagtattctccctctgtggcagttgggctaatacaaagtaactatacgcatgagaatataaaatcagtctctgatacatacacatttttaccatcaaaatttcttaatcatagcaaagacttacctttttatgattaggaattttttttttaatgtatggcagcacatgcctttaatcccaacactagggaggcagaggcaggtggatctctttgagttcgaagccaggctggtctttacagtgagttccaggacagctggagagctacagaatggagagacgctgtctcaaaaacactcaaaacaaacaaacaaaccataccagtttgtaggcagacttctgttgggttgggtttgtactgtttgcctatgcagtgggattacagcagcagcaacaaaaactgtccctgaagtctttctctgccactgtgacctgagtttcctatggtacgcgatttactctaggaaacctcagcccctcaccacgttagctgttggcaaatggcctcacagttgcggaaagtcccaattctaggcttgggaaagcaatgcttagatttgaattggcccatgaagcattcaaatcaaggctaaagacataaatgtgaaataaaactgtgaaccttcattttaacattgatctcacttcccagatttaatcaatatatacttaggtggtattaaaaatggtaaactgcctaatttaaatctcaaaatttaaactatgaggtttacatcaaagccaacatttcacaaatgtactttttaaggtattaaaagaggtatttaagcagtaaatggtttcttggcacccataaccaagtaatagttaagttagaggtgggacttttttattgctatgagaattacatttaaacttttgggtgttttataaaaagcagatttcacaagttttgaaaattgtgacctttactgaaatttgttacctttaatatttcttctagaggataggtatttataaaagaaaaattcgtcagaattgctgcctcaatctagtcccatttgagaaaatttgtttctactgtctcaataactggatgaaatatcactctgaaaacttgcctattgcactaaagctagtttaggcttgataaaacactccaggaggtttttaccacagactgtttctattaaaactgctgcttctcatgtacaattttgttttaaaaggaaccgagtacatctgcaaaacctaagtcttaagggacgtcaggaggtaccttcagaattataggatcaccatggtagtggggattctccatgctggccttgaatgtttgatcttcactgctgaaatgtgggtagctcctcagcgccctgtagagcctgagtctacctagaatagctgtaaccattttgacaagtaatggataagaaaattatccattgagaagctaaaaacaaaacaaaacaaaaccaaagaacgggtgtattttattcttaacctttgtaaaccatcactgagaacacttcagttcttcctaacagctgttatgcttcgatttgaaaaaaatactgagtggataaccaactaccatcatgctttgggtacacctttcaataaaattactgaaatgc

SEQ ID NO: 1571 - DNA, 1523 bp, Rattus norvegicus
  Genbank Accession No. NM_012925
ggcacgagggagcccgaaactggcgcaggcaagaagaacctctagcacagatctagctgactgcgaggttgcagatttggtggaccagcacaatgagagctcggaggggattcatcttactcctgcttctggctgtcctctgttccacaggtgttagcctcagatgctacaactgtttagacccggtttcttcatgcaaaacaaacagcacttgctctcctaacctggatgcttgtcttgttgctgtatccggaaagcaagtctatcaacagtgttggagattttcggattgtaatgccaagttcattttgagccgactagaaatcgcaaacgtacaatacagatgctgccaggcggacttgtgtaacaaaagcttcgaagacaagccaaacaatggggcaatctccctattggggaagacagcgttgctggtgacctcggttctggcggccattttgaagccttgtttctaaatcatctctaagctcccgatgcctcctttcttttttccttctttttcttcttcttcagcactctaaagcctttattattttccaacttatattcgtttaggaaacaatatagttcacttgaaatcttggataagagggagggttgtaagcagcacggaagagcaccgaagagcaccgtgcacatagggaaggcccacctgcaggtacagagtgaagtgcgtgggtaaaacactaacaggttatgtaatcttcctttgtcacttcggagggctggctttcagtttcagcttaagtgggtttccggcaaccctcagggatatctctttggttcccggaatgtagctgaggagtgaggtcagaaagtacctttaagtgagtggaccaggaggattctcttcattactctgacacactcaaaacgctttcataacttttacaggtcctgagctggtgtgcaaatgttccatatgtgagctgtcagtcaggggcgctgattgttcatttgctttaaaacaacaaaaacaaaaacaacaacaaaacagttctgggaatgaaacccagtgcattgagcatgtaggcaagtgctttacccataagccccagctccagctccagcagcgaatgaagcagctgcattttcagctagaaaacatagggatttgacctacatttcaacaagacctctgaaccagatgtgatgatgcttgcttagtatgtttagcatctcagtgctctggaggcagagacaggaggagggccataagttgaaggccagcctgaccttcacagtggtctccaagtcacctaaaactatatagtaagaccttgcctcaaatgaaaaacaaaatggcgagtggtggtgcatgcctttaataccagcacttgggagtagaagcaggtgcatctccgtaggtcaaagccagccagttcccggacagccaaggctatacagagaaagcctgtctatacatacatacatacatacatacatacatacatacatacatacatagaaaagaaaaacctcaaaacaacaataacaacaaaaca

SEQ ID NO: 1572 - DNA, 2296 bp, Rattus norvegicus
  Genbank Accession No. NM_012930
cctgcttgctcaggaactccctcagccgccgcgttctctagccgccgttgctgcccgggacgatgatgccgcgcctgctgtttcgtgcctggccccgctgcccctcgcttgtcctgggagcccctagtaggcccttaagtgctgtctcggggccggacgattatctgcagcacagcatcgtgcccaccatgcactaccaggacagcctgcccaggctgcctatccctaaacttgaagacaccatgaagagatacctcaatgcacagaagcctctcttggatgacagccagttcaggagaacagaagcgttgtgtaagaattttgagactggcgttgggaaggagctgcatgcccacctgcttgctcaggataagcagaataagcacaccagctacatctcaggcccctggttcgatatgtatttaactgctcgagactctatcgttttaaactttaatccatttatggcattcaatccggacccaaagtctgagtataatgaccagcttaccagggcaaccaacttgactgtttctgcagtccggtttctgaagacacttcaggctggccttttagaaccagaagtgttccacttgaacccttccaaaagtgacacagacgccttcaaaagactcattcgctttgttcctccctctctgtcctggtatggagcctacctggtcaacgcatatcccctggatatgtcccagtatttccggcttttcaattcaactcgtatacccagacccaatcgtgatgaactctttactgacaccaaggctagacacctcctggtcctaagaaaaggacatttctatgtctttgatgtcctcgatcaagatgggaacattgtgaatcccttagagattcaggcacatctaaagtacattctctcagacagcagccctgtgcccgagtttcctgtggcatatctgaccagtgagaaccgagatgtctgggcagagctcagacagaagttgatttttgatggcaatgaggaaaccctgaagaaagtggactctgctgtcttctgcctctgcctagatgacttcccgatgaaggatcttattcacttgtcacacaccatgctgcacggcgatggcacaaaccgctggtttgataagtcctttaacctcattgtagccgaggacggcactgctgcagtccacttcgagcactcgtggggggatggggtggcagtgcttaggtttttcaatgaagtgttcagagacagcactcagacccctgccatcactccccagagccagcctgccgccaccaactcctctgcgtctgtggagacgctcagcttcaacctcagcggtgctctcaaggctggcatcactgctgccaaggagaagttcgacaccacggtgaaaaccctcagcattgactccattcagttccagagaggtggcaaggagttcctgaagaagaagcagctgagccccgatgcggtggcccagctggccttccagatggccttcctgagacagtatggccagacggtggctacctatgagtcctgcagcactgcagccttcaagcacggccgcacagagactatccgcccagcctccatctttactaagagatgctccgaggcgtttgtcagggacccctccaagcacagtgtgggcgagcttcagcacatgatggctgagtgttccaaataccatggccagctgaccaaagaagcagcgatgggccagggctttgaccgacacttgtatgctctgcgctatctggcaacggccagaggactcaacctacctgagctctatctggatcctgcataccagcagatgaaccacaacatcctgtccaccagcactctgaacagcccagcagtgagccttgggggctttgcccctgtggtccctgatggctttggcattgcatatgctgttcacgatgactggataggctgcaatgtctcctcctactcaggacgcaatgcccgagagtttctccactgtgtccagaagtgcttggaagacattttcgatgctctagaaggcaaagccatcaaaacttagcttcctagtcgctgaaaagcctccattcttcctcatgaacatggatgttcatgtagctggaaggtgccatcttgtgcccaacaaaactaatcccaaggtgcttccacagccagtgctgcaggctgagctggaagagcccaactgaaggtagtgagaggtcgcagctgtaaagccctctttgttcaggagatagggtttggaaaactaactcagctgtatttattgtttaaatagaaataaaacctggtgttgcttag

SEQ ID NO: 1573 - DNA, 3335 bp, Rattus norvegicus
  Genbank Accession No. NM_012931
gtacgcgggtagcacggcctctggccgtggagcaccatgaagtacctggtgagtgtgggcgcggggccggccaggcgggcgggcggtctggaggacgtttcctgggggccccgagtgtcccgccggccgcagagttaccgggcagctcggcacgtaaacgagtccctccctcggtccgcctttcgagtccccgcagctcacggagctagcgtgacgccctccgcagcccttgggtccgggttgcctgagactcagcccgaggcggtatgcagagggactgagaaaccgagatttgctgagggctgcaaaccggcggcgagccgcgacaagaacgtgctggccaaagccctctatgacaacgtagctgagtctccggatgaactctccttccgaaagggtgacatcatgacagtgctcgagcgggacactcagggcctggatggctggtggctctgctcactgcatgggcgccagggcattgtgcctggtaaccgcctcaagattctggttggcatgtatgacaagaagccagcagcacctggaccaggcccacctgccaccccaccccagccccagcccagccttccccagggcgtccatactccagtgcctccagcttcccagtacagtcccatgctccccactgcataccaaccccaacctgacaatgtgtacctggtacccactcccagcaagactcagcaaggtctctaccaagcccctgggcccaacccacagttccagtcacccccagccaaacaaacatccacattctcaaagcaaacacctcatcactcatttcccagccctgccacagacctttaccaggtgcctccagggcctggaagtccagcccaggacatttaccaggtgccaccttccgctggcacagggcatgacatctaccaagtccctccatctttggacacccgcagctgggagggaacgaagccaccggcaaaggtggtggtacctactcgagtgggacagggctatgtgtacgaggcctcccaggcagaacaggatgagtacgacaccccgcgccacctgctagctccaggttcccaggacatctatgatgtgccccctgttcgaggactgcttcccaaccagtatggccaggaggtatatgacaccccgcctatggcagtcaaaggccccaatggccgagacccgttgttggatgtgtatgacgtgccccctagtgtggagaaaggcctgccgccgtccaaccatcattcggtgtatgatgttcctccttctgtgagcaaggatgtgcctgatggcccactgctgcgtgaggaaacatatgatgtaccccctgccttcgccaaacccaagccttttgatccgacccgacatccattaatcctcgctgcacctcctccggactccccaccagctgaggatgtgtatgatgtgccaccccctgctcctgacctctatgatgtgccccctggtttgcggcggcctggccctggaacactgtatgacgtgcctcgagagcgggtgctccctcctgaggtggctgatgggagtgtaattgatgatggtgtgtatgctgtgcccccaccagccgagcgagaggcgccaacagatggcaagcgcctgtcggcctctagcacgggcagcacacgcagcagccaatcggcgtcttccttggaggtagtggtgccaggtcgggagcccctggagctggaagttgctgtggagaccctggctcggctacagcagggtgtgagcaccaccgtagcccaccttctggacctggtgggcagtgccagtggccccgggggctggcgtagtacctctgagccccaggagcctcccgtgcaggacctgaaagctgcagtggccgcagttcatggggcagtacatgagctcctggagtttgcccgcagtgcagtgagcagtgccactcacacttctgaccgcactttgcacgccaagcttagccggcagctacagaagatggaggatgtgtaccagacactggtggtccatggtcaggtccttgacagtggccggggaggtccaggattcactctggacgacctggaccgcctggtggcctgctcacgggctgtgcccgaggatgccaagcagctggcctcctttttgcatggtaatgcctcgctgcttttcagacggaccaaagcccctggccccgggcctgagggcagcagctccctgcacctcaaccccaccgataaagccagcagcatccagtcacgccctctaccctcacctccaaagttcacctcccaggactctccggatggccagtatgagaacagtgaagggggttggatggaggactatgactacgttcatctgcaggggaaggaggaatttgagaagacccagaaggaactgctggaaaagggcaacatcgtgcgacagggaaaaggccaactggagctgcagcagctgaaacagtttgagcgactggagcaggaggtgtctcgtcccatagaccatgacctggccaactggacaccagcccagccccttgtgccggggcggacagggggactggggccttcagaccgacagctgctgctcttctacttggagcagtgtgaggccaacctgaccacactgacagatgcggtggacgccttcttcaccgcagtggccaccaaccagccacccaagatctttgtggcacacagcaagtttgtcattcttagtgcacacaagcttgtgttcattggggacacactgtcacggcaggcaaaggcagctgatgtgcgaagcaaagtgacccactacagcaatctgctgtgtgacctcctgcgtggcatcgtggccaccaccaaggccgctgccctgcagtacccatccccatctgctgcccaggacatggtagacagggtcaaggagctaggccacagcactcagcagttccgccgtgtcctgggccagctggctgccgcctgaaagcagaagactgggctgtgaggctggggagtgggtagcggtggtgtgagctacccaggcgctcgtcttgaagtggagatcctgcaggtttggggacaggtaaccccagctctgctttgggcctggtgccctcaactgtccagggatttgtacatatttatatcaaggcaggatgcagaatgcctcctcggagaggctgaggagccccgtcagagtggaccatgggctgggatcaccagggttggggcacatgggctccagtccacagggctccctgggacaggaagtacagtgtggtgtacacctctgcaccaagaaaacctaaagaactatttttcactattgatttttttccaatcatttgactaatagtctacatttaataaaatttt

SEQ ID NO: 1574 - DNA, 528 bp, Rattus norvegicus
  Genbank Accession No. NM_012935
atggacatagccatccaccacccctggatccggcgtcccttctttcctttccactccccaagccgcctctttgaccagttcttcggagagcacctgttggagtctgacctcttctctacagccacttccctgagccccttctaccttcggccaccctccttcctgcgggcacctagctggattgacactgggctctcagagatgcgtatggagaaggacaggttctctgtgaacctggacgtgaagcacttctctccagaggaactcaaagtcaaggttctgggagacgtgattgaggtgcacggcaagcacgaagagcgccaggacgaacatggcttcatctccagggagttccacaggaagtaccggatcccagccgacgtggatcctctcaccattacttcttccctgtcatcggatggagtcctcactgtgaatggaccaaggaaacaggcctctggccctgagcgcaccattcccatcacccgtgaagagaagcctgctgtcactgcagcccctaagaagtag

SEQ ID NO: 1575 - DNA, 1362 bp, Rattus norvegicus
  Genbank Accession No. NM_012939
gcgatgtggactgcgctgcccctgctgtgcgctggggcctggctgctgagtgctggggccaccgctgagctgaccgtgaatgccatagaaaagtttcactttacgtcatggatgaaacagcatcaaaagacgtacagctcgagggagtacagccacaggctgcaggtgtttgccaacaactggaggaagattcaagcccacaaccagaggaaccacacatttaaaatgggattgaaccagttttcagatatgagctttgccgaaataaaacacaaatacctctggtcagagcctcagaattgctcagccaccaaaagtaactacctccgtggtactggcccctacccatcctccatggactggaggaagaaaggaaatgtcgtttcaccagtgaagaaccagggggcctgtggcagctgctggactttctcaaccactggggccctagagtcagctgtggctattgccagtgggaaaatgatgaccttggctgagcagcagctggtggattgtgcccagaacttcaacaatcatggctgccaaggaggtctccccagccaggccttcgagtacatcctgtacaacaagggcatcatgggagaggacagctacccttacataggcaagaatggtcagtgcaaattcaacccagaaaaggccgtcgcgttcgtcaagaatgttgtcaacatcacactcaatgatgaggctgcaatggtagaggctgtggccctatacaatcctgtgagctttgcctttgaggtgactgaagattttatgatgtataaaagtggtgtctactccagtaactcctgtcataaaactccagataaagtaaaccatgcagtcctggctgttggctatggagaacagaatggattactctactggattgtgaaaaactcttggggctccaactgggggaacaatgggtacttcctcattgagcgtggaaagaacatgtgtggcctggctgcctgtgcctcctaccccatccctcaggtataagccacggctgcacaggccaactgcttggcagacaaagggaggaactggtcctacgatgagaatgccgccctggagaaagttgttcagaaatccacccagaggccctctcactcctgagtctagacgcctaaagacaagtaaggaagaacttgaccagcaacaagcccgcccatgtgacgacatcaccagccatacgctttgtttgaatatggtttttaaatgacccaaaaccatgtggacctagaatcttctcttttcagctctcttcatatagggaaagctccgatggcttaccttttctatgttgtatattcaataaatgcagtgaacgcctgcctgggctgggcctagacccct

SEQ ID NO: 1576 - DNA, 1550 bp, Rattus norvegicus
  Genbank Accession No. NM_012945
gggcccccccgtctccgccaggctcgggaccatgaagctgctgccgtcggtggtgctgaagctctttctggccgcagtgttgtccgcgttggtgaccggtgagagtctggagcggcttcggagaggtctggcggcagcaaccagcaaccctgaccctcccactggaaccacaaaccagctgctacccacgggagctgatcgcgctcaggaggtccaggacttggaagggaccgatctggaccttttcaaagttgctttctcctccaagccacaagccctggccaccccaggaaaagaaaagaacgggaaaaagaagaggaaaggcaaggggttaggaaagaagagagatccatgccttaagaaatacaaggactactgcatccacggagagtgcagatacctgaaggagctccgtattccctcgtgccactgcctccctggttaccatggacagaggtgtcatgggctgaccctaccggtagagaaccccctgtacacatatgaccacactaccgtcttggctgtggtggctgtagtactgtcatctgtctgtcttcttgtcatcgtgggacttctcatgttcaggtaccataggcgaggaggttatgacttggaaagtgaggagaaagtgaagttgggcatggctagctcccactgaggaggatctgagctcaaggagccttcagaggatggctacttctgagatggcggttccttacaagttctacagagggaaaatacttcaccagcagccatgaagacttcttcattcattcccagttgctaccctgactgggcctcctgtaattgctctgcaaaaatatcagagcctctaagtgccaaacagactatgccccgctgggatctggatcagaagaaagcaggagcaagtgagcccttcaggccttcctgatcctccaccactgaacccactggtttgtttaaacacttagcttctggattaaagtgtcagctagtttccatatgctccaggatttttggctgaaaaaaaaaaaagaagagaggacggatgagtggtttatggactggaagagatcaacagagttgagaagctaagtgttcaagtagccacaggggatctgctgtttggaccctccagcacgctggatttgatgagctaactgtgaaatatctcaagcccgagaactcttgagttttgggacttctacccagagggaaaaataacaagtattttgttgttgttgttgtttgtttgtttttaaaatgcctcttaaattatatatttattttattctatgtatgttaatatatttagtttttaacaatctaacaataatatttcaagtgcctagactgttactttgccaatgtcctggcccgcctctcttgcagctcttccacctggctcaatgccacactcccatctgctctgtaacccatctgtagtaatttattgtctgtctacatttcagaagatgcccctgtagcagagtatcccagggtgggttgtgtatggtcggagtgcaaggatggatttgggcagagccactctgtgagttggactgcag

SEQ ID NO: 1577 - DNA, 3418 bp, Rattus norvegicus
  Genbank Accession No. NM_012950
cccacgcgtccggtgagctgctcctaagaaagtaggcgaccgcgcgctcggccgcgcgggcagcctcgggacaatggggccccggcgcttgctgctcgtcgcggtcggcctcagcctgtgcggtcctttgctgtcttcccgcgttcctatgagacagccagaatctgagaggatgtatgctacgccgtatgctacgccaaacccccgctcattttttctcaggaatcccagtgaagatacatttgaacagttccccctaggggatgaggaggagaaaaatgaaagcataccgctcgagggcagggcagtctacttaaataaaagccgttttcctcccatgccgcctcctcccttcatctccgaggacgcctccggatatctgaccagcccctggctgacgctcttcataccctccgtgtacacgtttgtgttcatagtcagccttcccctgaacatcctggccatcgctgtgtttgtctttcggatgaaggtcaagaagccggccgtggtgtacatgctgcacctggccatggccgatgtcctcttcgtgtccgtgctccccttcaagatcagctactacttctccggcaccgattggcagttcgggtccggaatgtgtcgcttcgccaccgcagcgtgttattgtaacatgtacgcctccatcatgctcatgacagtcataagcattgaccggttcctggcagtggtgtaccccatccagtccctgtcctggcgcactctgggccgagccaacttcacctgcgtggtcatctgggtgatggccatcatgggggtggtgcccctcctcctcaaagagcagaccacccaggttccggggctcaacatcaccacctgccacgacgtcctcaacgagaccctgctgcatggcttttactcgtactatttctccgccttctccgccatcttctttcttgtgccgttgatcatttccacagtctgctacacgtccatcatccgatgcctcagctcctccgcggtggcgaaccggagcaagaagtcgcgggctttgttcctgtccgccgccgtgttctgcatcttcatcgtctgctttgggcccaccaacgtcctcctgattgtgcactacctgctcctctccgacagtcctggcacagagacggcctattttgcttacctcctctgcgtctgcgtgacgagcgtggctagctgcatcgaccccttgatttactactatgcctcctccgagtgccagaagcacctttacagcattttgtgctgcagagaaagctctgattccaacagttgcaacagcaccggccagctgatgcccagtaagatggatacctgctctagccacctgaataatagcatatacaaaaagctactagcttagggaaagggtggctggaaggttccatgaagaaaaggttggaaagtgaacagctggggaacccccatcagtccctggcaagaactgtattgacttcaacgccttaagaaaaccgccaacgtctgatttgcatgcatacttcttacaagtgctatcaagtgtatagattggataatcaccagcaaggtgatgggaacggagtcaaggtttccagtgttgcttagtgctgggatagtagttgagcgtcacctcttctatatctaggtgactttaacatacaggtggtgtgcacacacacagtggcagtgcagggtggattctgcgctttgacgctttcttgtttattccctggacagttgctatagaaataatctgattctctgacttaataaagtctgggttggtggatgctatgccctgggcagctgaagaccccagtgatagggaagaagcccatagtttagacttaagacagcttttgcctatgtgtctatatttatatattttcaaatatttgataggtaatgtttagtgatggaaggatgagacagtattacctgtgtaggggaaggtcttgaacaaccacagtttaagaattatcaaagcagttgaaaagccccgttttgatacgcaatttacttacaaaatacgtggaccaagactgagcataagactcgccaggaatgtaagaaacctttcaaagcagccaagcctgataactagacacagccatctgcatggaggcctctgagcatgaggtatatcataccccttcagctatgcctcccagagagcagagatgaggaccaccaggcccactccaccctgctaggggtctcatttgctgtgaactgattatgtcaattagaaattggcaagggaggggatgccatcttgggaggcagtaacacctgcacatctgacaatcggagaaaggtgtgtttacatccagcagctgtcccgcaagctggcccttgcacagacagacacacccatgtgccctggtcacactgttggatagtgggccgtagactgactgactgtcggagaatagctgagtcctgcccttactcaggcagcgcagagagctggcacgcggtcagctgtgacgtatgcgctgcaaaccatcgcacatagaagttgtcattagctggatgtcaccaagcatatgtcacacaagcacggcctatcagctaaaccgctttggatatctgagtctctgcttccggtaactatagattgggataaagacacaatacaagatgtatatttttaatacataagcccttcagtctacaataattagatgctattattacaaatgttttgttaaaaattactcagatcagcctggcattttgtcgcatgcctttaagcccagtaggtgggaggcagaggcagtcagatggtaaacaactttttttttttttgttctttttttcagagctggggaccgaacccaggaccttgtgcttgctcggcaagtgctctaccactgagctaaatccccaaccccggtaaacaacttttttaagaagcaagcaaacacactgaagtccagttttaagaaatatataggtcagtttggttaaaaataataataatgaaaggaaatttcattgattgaaattgattgcaatgtaggaaaattagcctgtatttctctcaagagttactgaagttgtttttaaagtcttttaatgccacagtgactaacaagcatataaaaatcttcatgcctttgacaaattaatttagaagttaatttaaaacatatccttttcctggttaaaaaaatatgttggcattttaagcagataagactagaaagtatttaagaaaacaaagtatttcccaatactgtagaatagcttccatgaaactcccctagttgtctggttaactcggttcctgtgttgatttatctaaatcattgactccctgtcctgtgctctgtgacttaacgtaactgttaccactgcacttgtgaactttcgtgtcattgttttgtgttcaccctctttttttaaaaaatatattaataaacta

SEQ ID NO: 1578 - DNA, 3616 bp, Rattus norvegicus
  Genbank Accession No. NM_012959
gcggccgcaggttgggtcggaactgaacccctgaaagcgggtccgcctcccgccctcgcgcccgcccggatctgagtcgctggcggcggtgggcggcagagcgacggggagtctgctctcaccctggatggagctgaactttgagtggccagaggagcgcagtcgcccggggatcgctgcacgctgagctctctccccgagaccgggcggcggctttggattttgggggggcggggaccagctgcgcggcggcaccatgttcctagccactctgtacttcgcgctgccactcctggatttgctgatgtccgccgaggtgagtggtggagaccgtctggactgtgtgaaagccagcgatcagtgcctgaaggaacagagctgcagcaccaagtaccgcacactaaggcagtgcgtggcgggcaaggaaaccaacttcagcctgacatccggccttgaggccaaggatgagtgccgtagcgccatggaggccttgaagcagaagtctctgtacaactgccgctgcaagcggggcatgaagaaagagaagaattgtctgcgtatctactggagcatgtaccagagcctgcagggaaatgacctcctggaagattccccgtatgagccggttaacagcaggttgtcagatatattccgggcagtcccgttcatatcagatgttttccagcaagtggaacacatttccaaagggaacaactgcctggacgcagccaaggcctgcaacctggacgacacctgtaagaagtacaggtcggcctacatcaccccctgcaccaccagcatgtccaacgaggtctgcaaccgccgtaagtgccacaaggccctcaggcagttcttcgacaaggttccggccaagcacagctacgggatgctcttctgctcctgccgggacatcgcctgcaccgagcggcggcgacagactatcgtccccgtgtgctcctatgaagaacgagagaggcccaactgcctgagtctgcaagactcctgcaagaccaattacatctgcagatctcgccttgcagatttttttaccaactgccagccagagtcaaggtctgtcagcaactgtcttaaggagaactacgcagactgcctcctggcctactcgggactgattggcacagtcatgactcccaactacgtagactccagcagcctcagcgtggcaccatggtgtgactgcagcaacagcggcaatgacctggaagactgcttgaaatttctgaatttttttaaggacaatacttgtctcaaaaatgcaattcaagcctttggcaatggctcagatgtgaccatgtggcagccagcccctccagtccagaccaccactgccaccactaccactgccttccgggtcaagaacaagcctctggggccagcagggtctgagaatgagatccccacacacgttttaccaccctgtgcgaatttgcaggctcagaagctgaaatccaatgtgtcgggtagcacacacctctgtctttctgatagtgatttcggaaaggatggtctcgctggtgcctccagccacataaccacaaaatcaatggctgctcctcccagctgcagtctgagctcactgccggtgctgatgctcaccgcccttgctgccctgttatctgtatcgttggcagaaacgtcgtagctgcatccgggaaaacagtatgaaaagacaaaagagaaccaagtattctgtccctgtcctcttgtatatctgaaaatccagttttaaaagctccgttgagaagcagtttcacccaactggaactctttccttgtttttaagaaagcttgtggccctcaggggcttctgttgaagaactgctacagggctaattccaaacccataaggctctggggcgtggtgcggcttaaggggaccatttgcaccatgtaaagcaagctgggcttatcatgtgtttgatggtgaggatggtagtggtgatgatgatggtaattttaacagcttgaaccctgttctctctactggttaggaacaggagatactattgataaagattcttccatgtcttactcagcagcattgccttctgaagacaggcccgcagcctagtgtgaatgacaagtggaggttggcctcaagagtggacttggcagactctaccttgtagtaatgttcacctttccgtgtatggtctccacagagtgtttatgtatttacagactgttctgtgatcccccaacaacaacaaccacaaattccttggtcacctccaaatgtaaccggtcctttagcccagtagaggagggtgggtgtggccctggcacagctcccggattgttgatgggcactctcctgagctttgcttgagtgagaagctgaatgtagctgaaaatcaactcttcttacacttcttactgcttcgttcacttacgaggtcacatatagaacaaacatcaccaactattagcttaccgttagcttcccaactattagctttctatgttttgaaagcagtgttgctgaccccatgttttaatgatggtttaatacatgcagccctttcctctcatcggtaacactagctccaacatcaacttcatgcatgtggctctcaaaagcaggccccaagaagcccagttctttaggagaaagctgcgtcctgtttctgtggacaggcaggaggaaacagagcagcctgcccgtggtgtctttatctgttttgaaatcaaggctgcctgtgtgtaaggaatggttcaattcttataaagggtgccactgttgatgccacaactggcagttggtctagctccaggacaccggtttccatgttgcctggcagagacagctttgattgggactggctggccacaagggatgggatgaagatgtgctgccctctctttcaaagttgagccctgccagggcacatagaagcatctttgctcctgaccacaacgtagaacagcttggattcaaggtcatcaagcgtctcctgtacattgctctgtgaccttcataacagactgtcccgcacaaaaggaacggcagtttatggatctagagtgggagcacagggtctggaaaggtgaaccgattggcaaaatacacagaacaggagggagagtctcaagccgagacatcttgcttactagccacacaccatctcctggagccctcctcctgacctgggcagacccttaggtgtatatctaaagacctcttcaatgttcaggttcagaatctgtaaatggttgcgtcctggcacccattcctgaaaactgaacaaaggagaggatatctttcctccattgagccctgaaagtatgactggcttctcaccctcccacagagcagggagccctggtgcacacagtctcctgatatcctccctgctctttgaggtttgccttgggagaaaatgattcacctcgggaggggacgctttggtgtctgaagtacgtttatatcgaaatgttaatgaatacccatgtaaaatactcaatagccacctttcttcccttcacaatgttttcgaggggaatgcatccaacatccaagtgtacctggtcagtgggaagttccatgaagactcatacattgaataaacatattcgatgtgccgaaagcggccgc

SEQ ID NO: 1579 - DNA, 1225 bp, Rattus norvegicus
  Genbank Accession No. NM_012963
gtctggctcccgctctcacagccattgcagtacattgagctccatagagacagcgccggggcaagcgagagccggacgggcactgggcgactctgtgcctcgcggaggaaaatcaactaaacatgggcaaaggagatcctaagaagccgagaggcaaaatgtcctcatatgcattctttgtgcaaacctgccgggaggagcacaagaagaagcacccggatgcttctgtcaacttctcagagttctccaagaagtgctcagagaggtggaagaccatgtctgctaaagaaaaggggaaatttgaagatatggcaaaggctgacaaggctcgttatgaaagagaaatgaaaacctacatcccccccaaaggggagaccaaaaagaagttcaaggaccccaatgcccccaagaggcctccttcggccttcttcttgttctgttctgagtaccgcccaaaaatcaaaggcgagcatcctggcttatccattggtgatgttgcgaagaaactaggagagatgtggaacaacactgctgcggatgacaagcagccctatgaaaagaaggccgccaagctgaaggagaagtatgagaaggatattgctgcctacagagctaaaggaaaacctgatgcagcgaaaaagggggtggtcaaggctgagaagagcaagaaaaagaaggaagaggaagacgacgaggaggatgaagaggatgaggaagaggaggaagaagaggaagacgaagatgaagaagaagatgatgatgatgaataagttggttctacgcatgtttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagctagccctgtcctggtggtattttcaatagccactaaccttgcctggtacagtctgggggttgtaaattggcatggaaattaaagcaggttcttgttggtgcacagcacaaattagttatatatggggacagtagttttggttttttggttttctttttttttttgtgtttttgttttttttcctttttgtttttttttccatcttcagttgtctctgatgcagattatacgaaggtaattgttgttctgttaactgaataccactctgtaattgcaaaaaaatg

SEQ ID NO: 1580 - DNA, 2049 bp, Rattus norvegicus
  Genbank Accession No. NM_012964
aaccagctatcaccaagctcgataggcttttcacctctacctaaaaatcttcccactattttgctacatagacgggttgattcatgaaattgtttttaggtagctcgtttggtttcggggttcttagcttaaattctttttgctaaggattttctagttaattcattatgcaaaaggtacaaggtttaatctttgcttatttttactttaaattagtctttcaccattcccttgcggtactttctctatagctcctggtaagtaaatttctttctccaatactttttgagttaaatgttttagtttatgggggggggggttagttatgttggttggttggaaaaatctgaaacagaaaaactcttagaatacatagaagaaattagctgtgcatctgatcaagtggaaaaatacaaactagatattgcccagttagaagaagatttgaaagagaaggatcgtgagattttatgccttaagcaatctcttgaggaaaaggtttccttttctaagcaaatagaagacctgactgttaaatgtcagctgcttgaagcagaaagagatgatctcgtcagcaaggacagagaaagggctgaaagcctcagtgctgagatgcaggttctaacagagaagctgcttctagaaaggcaagaatatgaaaagctgcaacaaaatgaattgcaaagccagtcacttctgcagcaagaaaaggaactgtctgctcatcttcagcagcagctctgctcatttcaagaggaaatgacctccgagaggaatgtctttaaagaacagttgaagcttgccctggatgagctggatgccgtccagcagaaggaggagcagagtgaaaagctggttaaacagctagaagaggaaacgaagtcaactgcggaacagctgaggcggctggatgatctgctgagagagaaagaaattgaactggagaaaagaaccgctgcacatgcccaggccactgtgattgcgcaagagaagtacagtgacacagcgcagactctgagagatgttactgctcagttagaaagctataagtcatcaacacttaaagaaatagaagatcttaaactggagaatttgactctacaagaaaaagtagccatggctgagaaaagggtagaagatgttcaacaacaaatattaacagctgagagcacaaatcaggaatatgcaaaggtggttcaagatttgcagaacagctcaacattgaaagaagcagaaattaaagaaatcacatcttcatatcttgagaaaataactgatttgcaaaatcaactccgacaacaaaatgaagactttaggaagcagctggaagaggaaggggcaaaaatgacagagaaagaaactgcagtgacagaattaaccatggaaattaataaatggcgtctcctatatgaagaactgtatgacaaaactaaaccttttcagcaacaactggatgccttcgaagcagagaagcaggcactgttgaatgaacatggtgcaactcaggagcagctaagtaaaatcagagactcctacgcacagctgcttggccaccagaatctgaagcaaaaaatcaaacatgtcgtgaaattgaaagatgaaaatagccaactcaaatcggaggtgtcaaaactccgatctcagcttgctaaaaggaaacaaaatgagctcagacttcagggagaattagataaagctctgggcatcaggcactttgaccctcctaaggctttttgccatgaatctaaggagaatgtgaccctcaagactccattgaaagaaggcaacccgaactgctgctgagtcagactgcagggaccgtggaagtggacgtccaagatacttgctgaagattgttctcttcattattcttgatattatgtttatagtatatattatataatgtatttaatttctactgcctattcttaggtatatgaaacggtaattcaacatttgttatcaaaatgtattttgacattttattttctattatgtgtctccttaatcatcacctggatcacctcattctgaaccattgcttggctt

SEQ ID NO: 1581 - DNA, 2602 bp, Rattus norvegicus
  Genbank Accession No. NM_012967
ctgctgcctgcactttgccctggtcctccaatggcttcaacccgtgccaggcccatgctgcctctgctcctggtcctggtcgccgttgtgatccccgggcctgtcggtgctcaggtatccatccatcccacagaagccttcctgcctcggggtggatccgtgcaggtgaactgctcttcctcttgcgaagacgagaacctcggcctggggttggagactaactggatgaaagacgaactatcgagtggacacaactggaagctcttcaagctgagcgacattggggaagacagcagaccactgtgctttgagaactgtggcaccacgcagtcctcggcttctgccaccatcactgtgtattcgttcccagagcgagtggagctggatcctctgcccgcctggcagcaggtgggcaagaacctcatcctgcgctgcctggtggaaggcggagcaccgcggacacagctctcagtagtgctgctccgtgggaatgagacactgagccgccaggcagtggatggggaccccaaggagatcacattcacggtgctggccagcagaggcgaccacggagccaatttctcatgcttcacagaactggacctcaggccacaagggctgtcactgttcaagaatgtctccgaggtcaggcagctccggactttcgatcttccgactagggtcctgaagctcgacacccctgacctcctggaggtgggcacccagcagaagttcttgtgttccctggaaggcctgtttcctgcctctgaagctcagatatacctggagatgggaggccagatgctgaccctggagagcacaaacagcagagattttgtgtcagccactgcctcagtggaggtgactgagaagttggacagaaccctgcagctgcgctgtgttttggagctggcggaccagaccctggagatggagaagaccttgagaatctacaacttttcagctcccatcctgaccctgagccagccggaggtctcagaaggggaccaagtaactgtgaagtgtgaagcccacggtggggcacaggtggtgcttctgaacagtacttcccccaggccacccacctcacagggtacttcccccaggccacccacctcacagatccaattcacactgaatgccagcccggaggatcacaaacgacgcttcttttgctctgcggccttggaggtggatgggaagtccctgtttaaaaaccagaccttggaactccatgtgctatatggtcctcacctggacaagaaggactgcttggggaactggacctggcaagaggggtctcagcagactcttacatgccagccccaggggaatccagcccctaatctgacctgcagccggaaagcagatggtgtcccgctgcctatcgggatggtgaagtctgtcaaacgggagatgaatggtacctacaagtgccgtgcctttagctcccgtgggagtatcaccagggacgtgcacctgacagtgctgtaccatgatcagaatacctgggtcataattgttggtgtgttggtactgatcattgcgggcttcgtgatcgtggcgtccatttacacctattaccgccagaggaagatcaggatatacaagttacagaaggctcaggaggaggccctaaaactcaaggtacaagccccgcctccctgagcccactggacaggacacctgcctgggccccgctgctcttgaacagatcaatggacagcatttacccctcacccacctcctctggctgtcacaggacaggacagtggcctggggatgcatacttgtagcctcaggcctaagaggactcggaggggcaagactgtgaactcgtgacctggacacacctacagcctggtgggcctgcagccaagaaaggctgacttccttctctattacccctgctgaggggccccctaccttaggaaggtgtgatatccggtagacacaagcaagagaagaaaaggaacaccatgcttcctctgacatgggaaagctgggacactgtccccaactcttgttgatgtatttattaattcagagttctgacagttatttattgagtaccctgtacagacactagaggagtgagcaggttaacatgtaagttattgcctagaccctggtgaaggggcacaacagagtctggggaaagatcatacgggtttgggcttctccacaggtcagggtgctttcctcaaaagagctgatttctttcacgagtcatataaatactatgtggacgagcagtggccctctgctcgtagacctctctgggacccctgcctcctcccacagcctggagtctcccagcaccagcatgggtgaccacctccccacctacatacattcctacctttgttcccaatgtcaaccaccatgcctaaatatggacgctcacctttagcagctcaacaatggagtctcatgcccgtgaaattatggtcaatccctgcatgcctccacccggctccacctcaaagagaatgcctgggagaaaatgttccaaccacttagaagggtcctgcaagctgttgtgggagggtaggcacccctcccagcgcagaagcctttcctttgaatcaataaagtttta

SEQ ID NO: 1582 - DNA, 585 bp, Rattus norvegicus
  Genbank Accession No. NM_012973
cgtccatccaggtccaggcgtgcagagttttgctccacatcagggaaaccgtgaagccccaggatggccctgtccaattccacaactgttctgccttttctggcctcgctgtggcaggaaacagatgagccgggtggcaatatgtcggcggacttggctcgtaggtcccagctccgagatgacagcaagctggaggctctctatatcctcatggtgctgggtttcttcggcttcttcaccctgggcatcatgctgagttacatccgatccaagaagctggaacactcgcacgaccctttcaacgtgtacatcgagtcggacgcctggcaggagaaaggcaaggccctcttccaggcccgcgttctggagagcttcagagcttgctatgtcattgaaaaccaggcggccgtagaacaacctgccacacaccttcctgaactgaagccactgtcatgaaccccatagttaattaatagacaagtgataagtgggtctttctagtcaaatgcctgccagtctttattgtagaggtacccttgagtttttataaggggtgagttaataacaccagttttctgaaattgc

SEQ ID NO: 1583 - DNA, 872 bp, Rattus norvegicus
  Genbank Accession No. NM_012976
ggaagagagcgttggttctcccaagacagaagagatgtcttccttcagcacccagactccatacccgaacctagctgtacctttcttcaccagcatcccaaatgggctttacccatccaagtccatcgtcatatcaggcgtggtcttgtcagatgctaagaggttccagatcaaccttcgctgtgggggtgacattgctttccacctgaacccccgttttgatgagaatgctgtggtccgaaacactcagatcaacaactcctgggggcccgaagagcgaagcctgcctgggagtatgcccttcagtcgtggccagagattctcagtgtggatcttatgtgaaggtcactgcttcaaggtggccgtggacggtcagcatatttgtgaatacagccaccgcctgatgaacttgccggatatcaacactctagaggtggctggtgatatccagctaacacacgtggagacctaggaaggtctctggcctagggatgaaggctgaggaaccctacctgagtcttgtcacctcttccctgtctcagccctgcctccccaaatcctgtcatcaaagagagcctcattggcaggagttccaggaaggtgacattcccaattcacaccctccacaaagggggagtcctgggctgtgggacacatggctgtgagcccacagtgtcagccattgctcccaagctagtcatcttctgagggaagtgacctccctgggtttgcccctttctctgaccctttcccttcacccctccaggagggccaccttgatgtcatcccactggcctccaactgacccagaatgtccacattaacttttccccaatctttcccaatgcccataaaataaagaatatcaacgc

SEQ ID NO: 1584 - DNA, 3027 bp, Rattus norvegicus
  Genbank Accession No. NM_012991
ggcagtagctggatgagggcgttgcttgcctcctcccttttttttctccgattggttctgaggggtatattcgagttgcaaaatggcggccccgagcgctctcttcagcgttcagtagcagcttcaggctgagcggatgtctcttctcctcagtttcggactcagagacacgcggctccctactcctgctgatcacgaagtccttgaaggcgctcaacgcaccggaatctcccagcggccgcgaccgccgcctcggccctgctctccgcggcgccggaactcagcgtgatctgcggcggccgtctaggaggttcacaaaaatggcgaagagagttgcggagaaggaattaacagataggaattgggatgaagaagatgaagttgaagagatgggaacattctcagtggccagtgaggaagtcatgaagaacagagccgtgaagaaggcaaagcgtaggaatattggctttgaatctgatagcggaggagcctttaaaggtttcaaagggttggttgtgccttctggaggaggagggttttctggatttggtggtggctctggagggaagcctctggaaggactgacaaatggaaacagcacagacagtgccacgcccttctccagtgcaaagacagcagcggagcctaaggcagcctttggttcttttgctgtgaatggccctactactttggtggataaaaagatctccagtcctaaatgcaatagcagcaatcagccgccctcctccggcccagcctccagtacctcctgcactgggaatacctatcataagcagttggctggcttgaactgctctgtccgggattggatagtgaagcatgttaacacaaacccactttgtgacctgacgcccatttttaaagactacgagagatacttagcgacgatcgagaagcagctggagaatgggggtagcagcagctcagagagacagacagacagggcgacggctgcaatggagcctccttccctttttggttcaacaaaactacagcaagattcaccattttcatttcatggcaacaaagcggaggacacatctgaaaagttggagtttacagcagaaaagaaatcggacgcagcacaaggagcaacaagtgcctcgtttaattttggcaagaaaattgagagctcagttttgggctctttaagctctggctccctaactgggttttcattctctcctggaaactctagtttatttggtaaagatgctgcccagagtaaagcagcctcttcaccgttttctgctaaagcatccgagagtcaagcaggaggcagcagcagtgagtgcagagatggtgaagaagaggagagtgatgagccacccaaggtggtggtgactgaagtgaaggaagaggatgctttctactccaaaaaatgtaaactattttacaagaaagacaatgaatttaaagagaagggtgtggggaccctgcatttaaaacccacagcaactcagaagacccagctcttggtgcgggcagacaccaacctaggcaacattctgctgaatgttctgatcccacccaatatgccgtgcacccggacagggaagaacaatgtccttatcgtctgtgtccccaaccccccacttgatgagaagcagcccactctcccggtcaccatgctgattcgggtgaagacgagcgaggatgctgatgagttgcacaagattttactgcagaaaaaggacgtctgagcactgaggctgaccagggcacgtcaccatgttgctgcttccctttgcccctaaacttagtcacattctttcctctttgtactgtgacattctgagaacttctaggtaacttgaaacttttgtgaggaagattaaggccaataaatcctttcagtgtgtcgaagctgttctcccttcctaagaactaagcaaaatacattggagtgaaaagtttgggaagattttttaatgtcgattcattgagtaaactaacctaagtgattcttacggactgtaatcagggtaccagttagctctccaaaggctccctcaggcagccacgggtgccactctcttcctgccctgggagactcaatggcagtgtccacagagttccagaagacgcctgctcccctcctgtgggcttgtttggtccgtgactagcactcctgccaaataccacaccggcacactgtaaccgcgcttgttctgtttccttctgagcggaactgtgggtcctggggatctctgtccttagcctgtttttgacaggtgctggcctttgacctggaactgcttgactgaaccaggcactgcctttccatgggaagagagggcaggtagtggcttgtcggggagctggcgaggtatagactgggttttgtcgtttatccatgaggtgctcttacttgcttacctccctagttaacatggatgggggctgtcaggaataatggattttattaaaagcacaaatttggtagcattttttaaatatcatttctataccacaaacaagcctttattttaaaagaaaaaagtgaaattgtgctgaaaagggttgtatgctcgtggccgtttgtgccccggggacctggtggtcacagtctgaatggagccctgtcagagggtgctcgtgagaaggaagagtgtgggagtggagacggctcattcggcctgtgacttcagacagcagcatgttattcagcgtctgaaaagvccaatttcatttttacctttttacggatgaggtattcttgagtctgcccacttggaagagagccatggttctacacgccattcatgccacttgagagcggtgaggttaccgatactagcattctctcaaggccagacatcagttaaatgcaaggtttgttgacgagctggtcacggctccctcctaaccccagtgccggaaagctgaggcaggaagaccgtgtgagttcacaacagcctgagctacgcagtaggaacccctccccctaaaataaaataaaagtttggtgtctaaaaaaaaaaaaaaaaaaaaaaaaaaaaaaaa

SEQ ID NO: 1585 - DNA, 1232 bp, Rattus norvegicus
  Genbank Accession No. NM_012992
gttttccgtccggcttctctcacactcaagtgcgcgcctccacctcatggaagactcgatggacatggacatgagccctcttaggcctcagaactaccttttcggttgtgaactaaaggctgacaaagattatcactttaaagtggataatgatgaaaatgagcaccagttatcattaagaacggtcagtttaggagcaggggcaaaagatgagttgcacatcgtagaggcagaagcaatgaactatgaaggcagcccaattaaagtaacactggcaactttgaaaatgtctgtacaaccaacagtttcccttgggggcttcgaaattacaccacctgtggtcttgaggttgaagtgtggttctgggcctgtgcacataagtggacagcacctagtagctgtagaggaagatgcagagtcagaagatgaagatgaggaagatgtaaaactcttaggcatgtctggaaagagatctgctcccggaggtggtaacaaagtcccacagaaaaaagtaaaacttgatgaagatgatgatgaggatgatgaagatgatgaggatgatgaagatgatgatgatgatgattttgatgaagaggaaactgaagaaaaggttccagtgaagaaatctgtacgagataccccagccaaaaatgcacaaaaatcaaaccaaaatgggaaagatttaaaaccatcaacaccaaggtcaaagggtcaagagtccttcaaaaaacaggaaaaaactcccaaaacacccaaaggacctagctctgtagaagacattaaggcaaaaatgcaagcaagtatagaaaaaggtggttctcttcccaaagtggaagccaagttcattaattatgtgaagaattgtttccggatgactgaccaggaggctattcaagatctctggcagtggaggaagtctctttaagaaaatggtttaaacagtttgaaataattctgtcttcatttctgtaatagttgctatctggctgtcctttttataatgcaaagtgagaactttccctactgtgtttgataaatgttgtccaggttcaattgccaagaatgtgttgtctaaaatgcctgtttagttttcaaggatggaactccgccctttacttggttttaagtatgtatggaatgttatgataggacatagtagtagtggtggtcagatgtggaaatggtagggagacaaatatacatgtgaaataaactcagtattttaataaagt

SEQ ID NO: 1586 - DNA, 2175 bp, Rattus norvegicus
  Genbank Accession No. NM_013013
attgcagcctgcggagtgaagcgcgccatgtatgctctcgctctcctcgccagccttctggtcaccgctctgaccagccctgtccaggacccgaagatatgctctgggggctcagcagtagtgtgcagagatgtgaagacggcggtggactgtagggctgtgaagcactgccagcagatggtctggagcaagcccacagcaaaatcccttccttgtgacatatgcaaaacggttgtcaccgaagctgggaacttgctgaaagataatgctactgaggaggagatcctccattacctggagaagacctgtgcgtggattcatgactccagcctgtcagcctcttgcaaggaggtggttgactcttacctgcctgtcatcctggacatgattaagggggagatgagcaaccccggggaagtgtgctctgcgctcaacctctgccagtcccttcaggagtacttggccgagcaaaaccagagacagctggagtccaacaagatcccggaggtggacctggcccgcgtggttgcccccttcatgtccaacatccctctcctgctgtaccctcaggatcggcctcgcagccagccgcagcccaaggctaacgaggacgtctgccaggactgtatgaagttggtgactgacatccagactgctgtgaggaccaactccagctttgtccagggcttggtggaccacgtcaaggaggattgtgaccgcctcgggccaggcgtgtctgacatatgcaagaactatgttgaccagtattctgaggtcgccgtccagatgatgatgcacatgcaacccaaggaaatctgtgtgatggttggcttctgtgatgaggtcaagagagtgccaatgaggactctggtccccgccactgaggccatcaagaatatcctccctgccctggagctgacggacccctatgagcaggatgtgatccaggcccaaaatgtgattttctgccaagtttgtcagcttgtgatgcgcaagttgtctgaactgattatcaacaatgccactgaggaacttctaattaaaggtttgagtaaagcctgctccctgctccctgctcctgcttcaaccaagtgccaggaagtgctggtaacatttggcccctccctgttggacgtcctcatgcatgaggtgaacccgaactttctgtgcggtgtgatcagcctctgttctgccaacccgaatttggtggggacccttgaacaacctgcagcagccattgtatctgcactgcccaaagagcctgcaccgccaaaacagcctgaagagcccaagcagtctgcattgcgcgcccatgtgcctcctcagaagaacggggggttctgtgaggtgtgcaagaagctggtcatctatttggaacataacctggagaaaaacagcaccaaggaggagatcctggctgcacttgagaagggctgcagcttcctgccagacccttaccagaagcagtgtgatgaatttgtggctgagtatgagcccttactgctggaaatccttgtggaggtgatggatccttcctttgtgtgctcgaaaattggagtctgcccttctgcctataagctgctgctgggaaccgagaagtgtgtctggggcccaggctactggtgtcagaacagtgagactgctgcccgatgcaatgctgtcgatcattgcaaacgccatgtgtggaactagctttccagcttgcagaagtcgcctacttgtgggtctagggtaatgaacacatagatctatttgacttaataagtaggagcccccttttgtcttcccccatctcctgtcccttactatagcatttctgtcacgtaagaggcgctgacagcacttccgtgtcccatttctgctccaaggatgaggacacttgggcttcagctccccggctgcccttttcacccacctgctggaggggggtggtgagccagagggcaggagcatgtgctcagccctctcggtgtgtagggatcatggccatctcctagcgtcagggaactgcgcaacttcctgtgctaccaaggagtttaatttggatgcttagaagcacagagtgatcaggcctttagagtgtgggatggccattgccacagcacagagacttgagaagcacctgctgcaggtggcttgctgtgacgttgccgtccctggtcagccttcattctg

SEQ ID NO: 1587 - DNA, 2410 bp, Rattus norvegicus
  Genbank Accession No. NM_013026
gcgggctagaggagacagagcctggcgctgaggaaggaatctggcagtcgagagctgactccagccgacggaacctgcagcccttgctccggacagcagcgcgccgggcaggagtccgggatagcgaagcgcagagcaatcagcagagcctgcccggagctccgtgcaaccggcaactccgacccacatagcccgccgagctcccgccgccggtccgggcagcatgagacgtgcggcgctctggctttggctctgcgcgctggcgctgcgcctgcagcctgccctcccgcaaattgtcaccgcaaatgtgcctcctgaagaccaagatggctctggggacgactcagacaacttctctggctcaggcacaggtgctttgccagatatgactttgtcacggcagacaccttccacttggaaggatgtgtggctcctgacagctacacccacagctccagaacccaccagcagggataccgaggccaccctcacctctatcctgccggctggagagaagcctgaggagggagagcccgtggcccacgtggaagcagagcctgacttcactgctcgggacaaggagaaggaggccaccaccaggcctagggagaccacacagctcccagtcacccaacaggcctcaacagcagccagagccaccacggcccaggcatctgtcacgtctcatccccacggggatgtgcaacctggcctccacgagaccttggctcccacagcacccggccaacctgaccatcagcctccaagtgtggaggatggaggcacttctgtcatcaaagaggttgtggaggatgaaactaccaatcagcttcctgcaggagagggctctggagaacaagacttcacctttgaaacatctggggagaacacagctgtggctggcgtcgagcctgaccttcggaatcagtccccagtggatgaaggagccacaggtgcttctcagggccttttggacaggaaggaagtgctgggaggtgtcattgctggaggcctggtgggcctcatctttgctgtgtgcctggtggctttcatgctataccggatgaagaagaaggacgaaggcagttactccttggaggagcccaaacaagccaatggcggtgcctaccagaaacccaccaagcaggaagagttctacgcctgatggggaaatagttctccccccacaacccctgccactcactaggctcccatttgcctcttctgtgaaaaacttcaagccctggcctccctaccgctgtgccgtctcctctgcacccagacccttctgcccgagcggtctcagggtgtgctgggaattccttctcctctgacttctgctagaagcttgggtgcagagggtttcttgcattttgtctttctaccacagccacgcctgttgtccactcttctgacttggcttctccaaatgggaggagactcagctctggacagaaagggaacccaactgctttggacctagatggcctattgtgactggaggatcctgaggacaggagaggggcttcaacagacacgccatagcacttacccatagagaccattagggttggctgtgctgtggtagggaaggagtccagggctccttggaattcacttctcattgtggggaggtctactttagacaacttggttttgcacatgtttcctctaatttttctgttttagagccccagcagaccttacttctggggtaaggcaagtcagttgactggtgtccccacctcgcttccctaatctacattcgggagaccgcatcggggttaaataagacttttcattttcgtttttgtttttaacctagaagaaccaaatccggacaccaaaacgtaggcttagtttgtgtgttgtctctgagtttgtcgctcatgcgtgcaacagggtatggactatctgtttggtgccccatttttggtggcccataagtaggctggctagcccaggatgccatggagtagccacctcttgaccagtcatgcctgtgtgcatagactcagggccatggcctttgtgacattggaagagcctgtgtgagaacttcctcctagattagtctagggatggaggggaggagactgtacagtttgggaggaggggtgacaagggtgtccaagactctcccacctttggtactaactctggtcaccctttctcctggaagttgacaagacacatcttgagtatggctggcactggctcctccatcaagaaccaagttcaccttcagctcctgtggccctgttcccaggctggagtcagaaatgtttcccaaagagtgagagtcttttgcttttggcaaaacgctacttaatccaatgggttctgtacagtagattttgcagatgtaataaactttaatataaaggagtcctatgaaaaaaaaaaaaaa

SEQ ID NO: 1588 - DNA, 664 bp, Rattus norvegicus
  Genbank Accession No. NM_013027
tgctgctagttggtcgggtcctcgctttgtgcggggatgcgacgtgcagcaatggcgctagccgttcgagtcgtgtattgtggagcttgaggctataagcccaagtatctccagctcaaggagaagctagaacatgagttccccggatgcctggacatctgtggcgaggggactccccaggtcaccgggttctttgaagtgacggtagccgggaagttggttcactccaagaagagaggtgatggctacgtggatacagagagcaagttccggaaactggtgactgccatcaaagccgccttggctcagtgccagtgagccctagaggcagggtcctgaaggctcctggccggcctttcttggcagccgcttcatgacaggaaggactgaaatgtctcaaagacctgtggtctttcttcgatgttctgcggccaccaagtcaggccagagatggattctgtgtgtgggtgccttcccagaatctacctgtgcacgcaccccgccctgccctcccgccctcttcctcacctctctctgaattcccccatgtttcctaccttccctcctgctttggtttcccgtctccccctcaagactgcaagaagacgggcagccgtgtcgccaggtgttcctggttgaataaaggttggccaaggcaacctga

SEQ ID NO: 1589 - DNA, 2440 bp, Rattus norvegicus
  Genbank Accession No. NM_013030
agcagtcgagctggagctgagccatagtcaaggactcattgtgggtgcccatcatgatgtcctacagcgagagattggggggaccggctgtctccccacttccagtccgtgggagacacatggtgcatggggcagcctttgcttatgtccccagcccacaagtcctgcacaggattcctgggacaaccacctatgccatctccagtctgagcccggtagccctcacagagcacagctgtccctatggggaggtcctggaatgtcatgacccgctccctgccaagctggcccaggaagaggagcaaaagccagagcccaggctgtcccagaagcttgcccaggttggcacaaagctcctgaaggtgccgttgatgctaggcttcctttacctctttgtctgctccctggacgtgctcagctctgccttccaactggccggagggaaagtggctggggacatcttcaaggacaatgccatcctgtccaacccagtggcagggctggtggtgggaatcctggtgacagttctggtgcagagctccagcacctcgacatccatcattgtcagcatggtctcctctggcttgttggaggtgagctccgccattccgataatcatgggctccaacatcgggacctctgtcaccaacaccattgtggccctgatgcaggcgggggacaggactgacttcaggcgggcttttgcaggggcaacagtgcatgactgctttaactggctgtctgttctggtcctgctgcccctggaggctgccacgggctacctgcaccacgtcaccgggcttgtggttgcctccttcaacatccgtggtggccgtgatgcccctgaccttctcaaggttatcacagagcccttcacaaagcttatcatccagctggacaagtctgtgattaccagcattgccgtgggggatgagtccctgaggaatcacagtctcattcggatttggtgtcaaccagagacaaaagaggcttccacttctatgtccagggtagaggccattggcagccttgcaaacaccaccatggagaaatgcaaccatatcttcgtggatactgggctgcccgacctggccgtggggctcattctgctggcgggctccctggtggtcctgtgcacttgtcttatcctcctcgtcaagatgctcaactctctgctgaagggccaagtggccaatgtcatccagaaggtcatcaacacagacttcccagcccccttcacttgggtcacaggctactttgccatggtggtgggcgccagcatgacgtttgttgtccagagcagttccgtgttcacctcagccatcactccgctcattggcctgggtgtgatcagtattgagcgggcctaccctctcaccctgggctccaacattggtaccaccactacagccatcctggcagcactggccagccccagggagaagctctccagctcctttcagattgccctctgccacttcttcttcaacatctcgggcatcctcctgtggtacccgctgccctgcacacgtctgcccatccgcatggccaaggcactgggcaaacgcactgccaagtaccgctggtttgccgtcctctacctcctcgtgtgcttcctgctcctgccctcactggtgtttggcatttctatggcaggctggcaggctatggtcggtgtgggcacaccctttggggccctgctcgccttcgtggtgcttgttaacgtcctgcagagtcgaagtcccgggcacctccccaagtggctgcagacatgggacttcctaccccgctggatgcactctctgcagcccctggatggccttatcacaagagccaccttgtgctatgccaggcccgagccccgttcaccccaacttccccccagagtcttcctggaggagcttcctcctgccacgccctctccccgcctggcactgcccgctcaccacaatgccacccggctctaggctgcaggtccagactattgcctggaggcgagggacgggatttttacagagcccacagtagaaaggcacagcatgtttgtgagtgtgtgtgcatgcatgtagatgcatgtcacttgaggtacatgattttgtgccacccttgggtacctgtccctactcagggccacagcggggtgggctttttttgcaattaagaagcagtgtgcacaaattacatgctaggtcctgagcctttgtggccatcaggacaggagtatgcgagtgcatggtgtgggtacaggggatgcagatgcatgaggagcccccaaaattttctgggaagagtcggctatgccctctcaccttctcactacccttgtcccaacaggagaggcagaagagcagctggccttctgtatacatgagcctttcctctgccaattctgctaactgtgcatagaaaaagttttaaaagttgcatctgtcctgatcat

SEQ ID NO: 1590 - DNA, 2586 bp, Rattus norvegicus
  Genbank Accession No. NM_013037
gggtagtctgaagagaccagaggaaggagcaccaagtagcctcagggccctgggtttattcttcccagcccttcatctgggctacactgatttctcttttggaccctacatcagacagcacacatcaaccgcctagtggactcaccgttaccttcctgtgccattgccatcggagagatctcggccatcaatcactagcacatgattggcaaatggagaatggggctttgggctttggcaattctgacagttcccatgtatttcatagtgacagagggcagaaaaacatcctggggtctagaaaacgaggctttaattgtcagatgcccccaaagaggaggtgcgattaaccctgtggaatggtattattcaaatacaaatgaaagaattcctactcaaaagagaaatcggatcttcgtctcaagagatcgtctgaagtttctaccagccaaagtggaagactctgggatttatacgtgtgttatcagaagccctgaatcgattaagaccggatctttgaatgtcaccatatataaaagaccaccaaactgcaaaatccctgattacatgatgtactcgacagtagatggatcagataaaaattccaagataacatgtccaacaattgccttgtataattggacagcgcctgttcagtggtttaagaactgcaaagctctccaagggccaaggttcagggcacacatgtcctatttgttcattgacaaagtgagtcatgttgatgaaggtgactacacatgtcgattcactcacacggagaacggaaccaattacattgtgactgccaccagatcattcacagttgaagaaaaaggcttctctacatttccagtaattacaaaccctccacacaactacacagtggaagtggaaataggaaaaacagcaaacattgcctgctcagcttgctttggcacagcctctcagttcgttgctgtcctgtggcagattaacaaaacgagaattggatcttttggcaaagcaagaattcaagaagagaaaggcccaaataaaagttccagcaatggcatgatttgcttaacctcactgttaaggataactggtgtgaccgacaaggacttctccctgaaatatgactgtgtggccatgaaccatcacggagtgataaggcaccccgtaagactgagaaggaaacaaccaagtaaggagtgtctctcacaaattgcttgacaaaattggctgaatttgctgcaaaccacaatcctttttctcagaggactgtgtgttatagcttggtcccaggggattcatcatgatcgtgggattagttggccagtttcctcaaatgtgtttttcatgttgagaaagctccttaaatctggtctgtccagaatgtttctgtcttctagaaggactctctgtcattgtatctttcctctctctgtttccccttgtccttgttctcctcacggtcctccccatcccttcaccttccttcacgttctctctactcttcttcccttatctctgggctccttctcacctgttagtggcttcttcagtcaccctttgcacatgctacaagggacattggtgttgatactgggttggaagcagtaataaccctactgtgtttctccctttgtgactcttgtaacagaaaacaacttacacattaggtggatgaccaacttgatcccattttaaaagagtagagaaaacatgatatttttacccttaacactctcttatgatactaaccactgcctcaatggcaatacaactaatgtaaaaacattattttaacttctttcaaatatcaagagggtgtggaagggagagagacactgactctaagctcatagtgatatgtggggcatttattgggattaagatattgattaaatgattagggtgggggtacctattggataccatcaagctgtgtcactgcctgaagtggtagttgggatttttttttggttctgtttgtcttctttggtttgttttaactatagagaccattctgctcttgaactcctagagttccacctggctttgcctctcaggtcctgggattaaagccatatgtcaccttacccagccaggatgtttcttgttttggtttcaattttagagcctctggcttgtaagatttttataaagtagagtttgattcataggtggccagagttgtgactcatagatgggttttagtgaggtcttaggcatccaccccttataatgctgttacccagggtgactgtggaccacagcactgtgttatgagatggtggaggtcatggcacattctataggaaaagagaagccaagcccctagtctcaccaggcacaaccttgagtcctcactgctctcctctgccaacaggaccttttgtccagatttctgagtattctctagttacatttgtatttgaactatatttgtgttatctgtaattctgtatttgttttgtttgtgtgtggttttgtattttccagattatttttaattcacctgttgctattcaaatcaatgtatctgtactgcttcatcaacacagcctgttaaataaaagtcgtgtctgttgttgttgaatgata

SEQ ID NO: 1591 - DNA, 5000 bp, Rattus norvegicus
  Genbank Accession No. NM_013040
agcagctggcctcccaccaccctaaaaataatccactcgccgctgtctgctgacccgggaggaaaacttgtcatcccatggagtgtgtgagctcctcggcttgctccagagagatccccaaccgctttgaggagtcagtgactgagttctgtggacttgtttgaaatttacatcttcagactgtgcgcaggcggttggaaggtagatcaagtgcaccagtagggggactaagttcctgagccaaagtcaaggctaatcaactaagaagaaatgagcctttccttctgtggtaacaacatctcctcctacaacatctaccatggtgttctccaaaacccctgctttgtggacgcactcaacctggtccctcacgtcttcctgctgtttatcacctttccgatcctgttcattggatgggggagccaaagctcaaaagtgcaaattcatcacaacacatggcttcattttcctggacacaacctgagatggattctgacgtttgcactcctgtttgtgcatgtctgcgagatagcagaaggcattgtttcagactcgcaacgggcgtccaggcatctccaccttttcatgccggctgtgatgggatttgtcgccaccaccacatccattgtgtattaccacaacattgaaacatcaaacttccctaaattacttttagctttattcctgtactgggtcatggccttcattacaaagacaataaagttggtcaaatactggcagttggggtggggaatgtcagacctgcgcttctgcatcacgggagtgatggtcatcttgaatggactgctgatggctgtggagatcaatgtcatccgggtccgaagatatgttttcttcatgaatcctcagaaagtgaagcctccagaggacctccaggacctgggcgtgaggttcctccagccgtttgtgaatttgctgtccaaagctacttactggtggatgaacacgcttatcatatcagctcacaggaaacctattgatctgaaggcgatcggaaagttgccgatagcaatgagggcggtgacgaattatgtttgcttgaaggaggcctacgaagagcagaagaaaaaggctgcggatcatccgaatcggactccctccatatggctggccatgtacagggcttttgggagaccgatcctgctgagcagcacgttccgctacttggctgacttgctgggctttgccggccctctttgtatttccggaatcgtccagcgtgtgaatgaaccgaagaataacacgacgagattttcagagacactctcatcaaaggagtttctggaaaatgcccatgtgctggctgtcctgctcttcctggccctcatcctgcaaagaacatttttgcaggcttcgtactatgtgaccatagagaccggcatcaacctgcgtggggctctgctggctatgatctacaacaaaatccttcgactgtctacttctaacctatccatgggcgagatgaccctgggacagatcaacaacttggttgccatagaaaccaatcagctcatgtggttcttgttcctgtgtcccaatctgtgggccatgcccgttcagatcataatgggggtgatcctgctctataatctgcttgggtcaagcgcactggtaggcgcggcggtcatcgtgctcctcgcaccgattcagtacttcatcgccacgaagctggcggaggctcagaagagcactctggattattccaccgagaggctgaagaagacaaacgagatactgaaaggcatcaagctccttaagctgtatgcctgggagcacattttctgcaagagcgtggaagagactagaatgaaggagctctccagcctcaaaaccttcgcgctctacacgtcgctttccatcttcatgaacgcagccattcccatcgcagccgttcttgcaacatttgtgacccatgcctatgccagtggcaacaacctgaaacccgcagaggcctttgcctctctgtctctcttccacatcctcgtcacaccgctcttcctgctgtccacggtggtcagattcgcagtgaaagccatcatcagcgttcagaagctgaatgagtttctcttgagcgatgagattggcgaggacagctggaggactggggaggggacgctgccttttgagtcctgtaagaagcacaccggagtgcaatcaaaaccgataaacaggaagcagcctggaaggtaccacctggacaactacgagcaggcgcggcgtcttcggcctgctgagactgaagatgttgccataaaggtgacgaacggatacttctcatggggcagtggtttagccacattatccaatattgacattcgaattccaacaggtcagctaaccatgattgtgggtcaggtgggttgtggcaaatcgtctctcctccttgccatccttggtgagatgcagaccctggaaggaaaagtttactggaacaatgtaaatgaatctgagccttcttttgaagcaacccgaagcagaagcaggtactctgtggcttatgctgcccagaagccttggctcctcaatgctacggtcgaggaaaacatcacttttggaagttctttcaacagacagaggtacaaggctgtcaccgatgcctgctctctgcagccagacattgatttgttaccctttggagaccaaactgaaattggagagaggggtatcaacctgagtgggggtcagaggcagagaatctgcgtggcccgggcactctaccagaacaccaatattgtcttcttggacgatccattctccgctctggacatccacctgagcgaccacttgatgcaggaagggatcctgaagtttctccaggacgacaagaggacggtcgtccttgtgactcacaaactacagtacctgacgcacgcggactggatcatagccatgaaggatgggagtgtgttaagggaagggactttgaaagacatccagaccaaagacgtggagctctatgaacactggaaaaccctcatgaatcggcaagatcaggaattagaaaaggacatggaagccgaccaaacaacgctggagaggaagactctccgaagagctatgtactcaagggaggccaaagcacagatggaggatgaagatgaagaggaggaggaggaggaagatgaggacgacaacatgtcaactgtaatgaggctcaggacgaagatgccctggaagacctgttggtggtacctcacttcaggagggtttttcctgctcttcctcatgatcttctctaagcttttgaagcactctgtgatcgtggccatcgactactggctagctacgtggacctccgagtacagtataaacgacccagggaaagctgaccagaccttctatgtggctgggttcagcatcctctgtggagcgggcattttcctttgcctcgtcacctccctcactgtagaatggatgggtctcaccgccgccaagaacctccaccacaatctcctcaataagataattctgggcccaataaggttctttgataccacgcccctgggactgatcctcaatcggttttctgctgataccaacatcatcgaccaacatatccctccgaccttggagtcgctgacccgctctaccctgctctgcctgtcggctattgggatgatctcctatgctacacccgtgtttctcatcgctcttgcgcccctgggcgtcgccttttatttcatccagaaatacttccgggttgcctctaaggatctccaggaactcgatgacagcacccagctccccctgctttgtcacttctcagaaacagctgaagggcttaccactatccgggccttcaggcatgaaaccagattcaagcaacgcatgctggagctgacagacacaaacaacattgcctacttatttctctccgcagccaacagatggctggaggtcaggacggactacctgggagcttgcattgttctgacggcctccattgcatccatcagtggctcttccaactctggactagtgggcttgggccttctgtatgccctcacgataaccaattacctgaattgggttgtaaggaacttggccgacctcgaagtccagatgggcgcagtgaagaaagtgaacagtttcttaactatggagtctgagaactatgaaggcaccatggatccttctcaagtcccagagcattggccacaggaaggtgagatcaagattcacgatctatgcgtcagatatgaaaataacctgaagcccgttctgaaacatgtcaaggcttacatcaagcctgggcagaaggtgggcatctgtggtcgcaccggtagtgggaagtcctctctatctctggctttcttcagaatggtcgacatatttgatggaaagatagtcattgatggaatagacatttccaagctgcccttgcacacgctccgctctagactgtccatcattctccaggacccaatcctgttcagcggctctatcagatttaacttggatcctgaatgcaagtgcacagacgacaggctctgggaggctctggaaattgctcagttgaagaatatggtcaaatctctgccaggaggcctagacgccactgtcaccgaaggtggtgagaacttcagcgttggacagagacagctgttctgcctggccagggcctttgttcgaaagagcagcatactcattatggatgaggccacggcctccatcgacatggccacggaaaacattttgcagaaagtagtcatgacagcctttgcggatcgcacggttgtaaccatagctcaccgtgtctcctctattatggatgcgggccttgttttagtcttttctgagggtattttagtggagtgcgatactggtccaaacctgctccagcacaagaatggcctcttttctactttggtgatgaccaacaagtagaccagcaagatctgctcctccaagtgtctcgttctctgcatcgggttcacaccattctgactgctgacctggtcattgtgatgaagagagga

SEQ ID NO: 1592 - DNA, 1666 bp, Rattus norvegicus
  Genbank Accession No. NM_013043
cggcagccgagtcggattgagctgctgcagacgccaggccactccagccagcactgccgttttcacgccccggctgcagacagctaggaggctttatctagtttgaaccaggctgctggagctcgctccttccctctctttttttccacgaggctgtttttttatttggctgcaattgcatgaaatcccaatggtgtagaccagtggcgatggatctaggagtttaccaactgagacatttttcaatttctttcttgtcgtctttgctgggaactgaaaacgcttccgtgagacttgacaatagctctggtgcaagtgtggtagctatcgacaacaaaatagagcaagctatggatctggtgaaaagccatttgatgtatgcagttagagaggaagtggaggttctgaaggagcagatcaaagaactaatagagaaaaactcccaactggagcaggagaacaatctgttgaagacactggccagtccggagcagctcgcccagtttcaggcccagctgcagactggctcccctccggctaccacgcagccacaggggaccacacagccccctgcacagccagcgtcccagggctcaggatcaaccgcatagcctgctatgccccaacagaactggctgctgctgtctgaactgaacagaccgaagagatgtgctagtgagaagccgcctccagtcacccatttcattgctgtctgcgaaagagacgtgagactcacacatgctgttctcgctttctccccagtattaagcactcatatgcttttggcttgaagaaatatactagttgagtgaattaaaggttaaacagagagtgagcatggatgtaccctgtgcaacgtggcagatgtctgaggaatggtttgattgacgctgaggaggagctctgtgccttttcaaccctccccagccgcccactctactcccaagctctggggctcgcctgcatggggctcagaaggtgggctgctcctggattttgtgttctcctctccttcccttcaaagaatttgagaggccagaaacgagactgcaaagggggggatgcagtccttttacaaaaccgacaactgtcaccaaagcttataaaacaggacagtactgtccctcttttctgaaacatcagaagacacaaaactgttagtgacacaacggtgacaggtagctgggacctaggctatcttattatgaaggttgttttgcttgttgtatatttgtgtatgtagtgtaacgaatttgtacaatagaggaccgtaactactgttaggttgtacagattgaagtttagatgttccattggctgtctgaaaaggtgtggattgtccttcctagagagatctacttaaaaactgcttcgtgacaaaaaccacacctgaagaaattttaagaatttggcacagttagtcactttgtgtcacccggaatctagctgctgagtcttgcaaagtaaaccccctgttgactgatgtcagttgagctagtgaatgaatagatggagaaacgtcagtcagttgctgaggaagtggatttcccagtaggggtttctgcagctcacctgtatagtcctgcgcatgttccccacacagaacccactgtatttacctgttctacttgtcacctttcaataaagcatatcaaatgttgatacc

SEQ ID NO: 1593 - DNA, 1689 bp, Rattus norvegicus
  Genbank Accession No. NM_013052
tgcagccagctagcgagaaggcgcgagcggcggcgcagccagcagcctcccgccagccggcgagccagtgcgcgtgcgcggcggcggcctcggcggcgaccgggaagcggacgggcgggcgaggcgagcgaggcaggcggtgcgggcgtgcgaggcgaggccgatcgcgagcgacatgggggaccgagagcagctgctgcagcgggcgcgactggcggagcaggcggagcgctacgacgacatggcctccgccatgaaggcggtgacagagctgaatgaacctctatctaatgaagatagaaatctcctctctgtggcctacaagaatgtagttggtgccaggcgatcttcttggagggttattagtagcattgagcagaaaaccatggcagatgggaatgagaagaagctggagaaagtcaaagcctatcgggagaagattgagaaggagctggagacagtttgcaatgatgtcttggctctgctcgacaagttccttatcaagaactgcaatgattttcagtacgagagcaaggtgttctacctgaaaatgaagggcgattactaccgctacctggcagaggtggcttctggggagaagaaaaacagtgtggttgaagcttctgaggcagcgtataaggaagccttcgaaatcagcaaagagcacatgcagccaacacaccccatccggcttggcctggccctcaatttttctgtgttctactatgagatccagaatgcaccagagcaggcctgcctcttagccaaacaagccttcgatgatgctatagctgagctggacacattaaacgaggattcctataaggactccactctcatcatgcagttgctgcgagacaacctcaccctctggacgagcgaccagcaggatgaagaagccggagaaggcaactgaagacccatcaggtccctggcccttcctttacccaccacccccattatcactgattcttccttgccacaatcactatatctagtgctaaacctatctgtattggcagcacagctattcagatctgccctcctgtcccttggaagcagtttcagataaaccttcatgggcatttgctggactgatggttgctttgagccacagagcgctccctttttgaattgtgcagagaagtgtgttctgaacgaggcattttattatgtctgttgatctgtagcaaatccatgtgatggtaattgagtgtagaaaggagaattagccaacacaggctatggctgctatttaaaacaagctgatagtgtgttgttaagcagtacatctcgtgcatgcaaaaatgaatttgaccctctcaccccttctttcagctaatggaaactgacacacgacaacttgttccttcaccatcagctttataaactgtttctcgtgagctttcaggcccctgctgtgcctctttaaattatgatgtgcgcacaccttcttttcaatgcaatgcatcagaggtttttgatatgtgtaacttttttttttggttgtgattaagaatcatggatttattttttgtaactctttggctattgttcttgtgtaccctgacagcatcatgtgtgtcaacctgtgtcaatcatgatgggtggttatgaaatgccagattgctaaaataaatgttttggacttaaaaagagtaaataaatgctgctttggggatattaaaa

SEQ ID NO: 1594 - DNA, 2099 bp, Rattus norvegicus
  Genbank Accession No. NM_013053
agatcaaagtggtgggactcgcgtcgcggccgcggagactagaaggaggactccggatccggctcggcgctcgccctcgctcgccatggagaagaccgagctgatccagaaggccaagctggccgagcaggccgagcgctacgacgacatggccacctgcatgaaagccgtgacggagcagggcgccgagctgtccaacgaggagcgcaacctgctatctgtggcctacaagaacgtggtcgggggccgcaggtccgcctggagggtcatctcgagcattgagcagaagaccgatacctcggacaagaagttgcagctgatcaaggactatcgggagaaagtggagtctgagctgaggtccatctgcaccacggtcctggaattgttggataagtatttaatagccaatgcaactaatccagagagtaaggtcttctatctgaaaatgaagggagattatttccggtatcttgctgaagtcgcttgtggtgatgatcgaaaacaaacgatagaaaattcccaaggagcctaccaagaggcatttgatataagcaagaaagagatgcaacctacacatccgatccgcctggggctggctcttaacttttctgtattttactatgagatccttaataatcccgagcttgcctgcacactggctaaaacggcttttgatgaagccatcgccgagcttgatacactgaatgaagactcctacaaagacagcaccctcatcatgcagttgcttagagacaacttaacattatggacatcagacagtgcaggagaagaatgtgatgcagctgagggggctgagaactaaaggcatccaggacaccaacctccttcccctcaagaaaacctttttacatctccattccttattccacttggatttcctctagcaaggaagcccattcatgtgtatggggtcaactgtttatagtcttttcacactgcagctttgggaaaactccatcccttggtttgtgttgtctccaccttcctggtgtgcagttactgctgtagaaaagtatcaatagcttcatttcatataaacacgagtaacttccagacacttgtgtagaggactgacagcacatttggtatttaagtaatctgaaccagttctgcaagtgactgtgttttgtattactgtgaagatatggaaatggtagtgcattacaatttaaagtgattgtaataataacgtcttgatttctacattccttttctgaactttcttgggggtttcctttcagaagcaacttttccatgctcttactacaaattcctttttagtaggaatccagaagtgttagattgaatgggaaagcgcttaatgcatccgggcttgggggtcacagattgaaatgtctcctgtgtcacattctggaggttacatctgtctgtgacaacagggcgtttccttatgcattcttcatttgctgctgtttaagttgacaacttccttcccaataaaaattcacttacacctcctgccttcgtagctctggtattcactttaccttgtgacagaagtagcatgttgctgccagaatacaagcattgctttgggcaaattaaaatgcatgtcctttcttaatacactaggaaggagaaataaagtacacaagtccaagtctaaactttagtacttttccatgcagatttgtgcacatgtgagggggtatccagtttgtccagtgattgttctttagagagttggaccactatattgtgtgtttgctaatcattgactgtagtcccaaaaaagccttgtgaaaatgttatgccctatgtaacagcagagtaacataaaataaaactacattttataaaaccatttattatggctttgtaacagttgcatacccatattttaagaacagacaaatttactactttttgaagtttgttgctatttctctttatgtaacatataatggtgatatccatatttctgcattgtggtacacttgtctagggtgcctggcactgtaaaattggactatatttctccagatagcctcatgggttgtcttcctcagatgtaatgataactggttaggtgtcatgtgtaataaagtgaacatttg

SEQ ID NO: 1595 - DNA, 568 bp, Rattus norvegicus
  Genbank Accession No. NM_013058
ctccaacctccaacatgaaggcgctgagcccggtgcgcggctgctacgaggcggtgtgctgcctgtcggaacgtagcctagccattgcgcgaggccggggtaagagcccgtcggcggaggagccgcttagcctcttggacgacatgaaccactgctactcgcgcctgcgggaactggtgccgggagtcccgcggggcactcagcttagccaggtggaaatcctgcagcgtgtcatagactacatcctcgaccttcaagtggttctggcagagcccgcgcctggacccccggatggtccgcatctcccgatccagacagctgagctcactccggaacttgtgatctccaaggacaagaggagtttttgccactgacccggtcgtcctggcacctcccgaacgcaggtgctggcgcccgttccgcttgggaccctgggactctgggaccctctctccagccggaagcctgaggggcatggatgagcttcgatcttgccacagccctcttcatttaccctgaactcatgcctcgaggctggacctggagcccgagagcgaaggactgaact

SEQ ID NO: 1596 - DNA, 2415 bp, Rattus norvegicus
  Genbank Accession No. NM_013059
cacggcgctccttagggccaccgctcggcgcgccgggacagaccctccccactcctgcctgcaggatcggaacgtcaattaacggctgacactgccccccacctcttcccacccatctgggctccagcgaggaacggatctcggggtacaccatgatcttgccatttttagtactggccatcggaccctgccttaccaactcatttgtgccagagaaagagaaagaccccagttactggcgacagcaagcccaagagaccttgaaaaatgccctgaaactccaaaaactcaacaccaacgtggccaagaacatcatcatgttcctgggagatggtatgggcgtctccacagtgacagctgcccgcatccttaagggccagctacaccacaacacgggcgaggagacacggctggagatggacaagttcccctttgtggctctctccaagacgtacaacaccaacgctcaggtccccgacagcgcgggcactgccactgcctacttgtgtggcgtgaaggccaacgagggcaccgtgggagtgagcgcggccactgagcgcacgcgatgcaacaccactcaggggaacgaggtcacgtccatcctgcgctgggccaaggatgctgggaagtccgtgggcatcgtgaccaccactcgggtgaaccacgccactcccagtgcagcctatgcgcactcggccgatcgggactggtactcggacaatgagatgcgcccagaggctctgagccagggctgcaaggacatcgcctatcagctaatgcacaacatcaaggacatcgatgtgatcatgggtggtggccggaagtacatgtaccccaagaacagaactgatgtggaatatgaactggatgagaaggccaggggcaccagactggatggcctggacctcatcagcatttggaagagcttcaaacctagacacaagcactcccactatgtctggaaccgcactgaactgctggcccttgacccctccagggtggactacctcttaggtctctttgagcccggggacatgcagtatgagttgaatcggaacaacctgactgacccttccctctcggagatggtggaggtggccctccggatcctgacaaagaatcccaaaggcttcttcttgctagtggaaggaggcaggattgaccacgggcaccatgaaggcaaggccaagcaggcgctgcatgaggccgtggagatggatgaggccatcggaaaggcgggcaccatgacttcccagaaagacacgttgactgtggttactgctgatcactcccacgttttcacgtttggtggctacacccccaggggcaactccatttttggtctggctcccatggtgagcgacacggacaagaagcccttcacagccatcctgtatggcaacgggcctggttacaaggtggtggacggtgaacgggagaacgtctccatggtggattatgctcacaacaactaccaggcccagtccgctgtccccctgcggcacgagacccacggtggggaagatgtggcggtctttgccaagggccctatggctcacctgcttcacggcgtccatgagcagaactacatcccccacgtcatggcgtatgcctcctgcattggagccaaccttgaccactgtgcctgggccagctctgcgagcagcccctccccaggggccctgctgcttccactggctctgttccccctacgcaccctgttctgagggcccaggtcccacaagagcccacaatggacagccggctcccctccctttgtggcctgccacctggccgcccacactcaacggggaggcccaggcaacctcgagcaggaacagaagtttgctacctgcctcacttccgcccggaaccctccgtgggtcggattcctggctctgccgttgtttctctattcactgccttttggccagcagggtgggtttctctcttgggccggcaggacacagactgcgcagattcccaaagcaccttatttttctaccaaatatactctccagaccctgcaaccatcatggaacattccagatctgaccttctctcccctaccccttctctctggaacactgggtcccatagtcacagccagtccctcaacccaaccctccttggagggaagaccaggtctgctcagggtgagactcccaggaagccacctccggggttggctgtctacccagggtggccaggctgggaagaacaacccagccggacaggacgcacacactccccacccagctccagagactcgccaacccttcactgaagcgactcccctgtttggaatagcaaaaaaaaaaagaaagaaaaaaaagaaaaaaattttaatttctctttttggtgttggttaaaagggaacacaagacatttaaataaaatgttccaaataaaaaa

SEQ ID NO: 1597 - DNA, 1150 bp, Rattus norvegicus
  Genbank Accession No. NM_013069
gcagcagcagcagcaccagcagcacttgggggaaaagctagaggctagagtcatggatgaccagcgcgacctcatctctaaccatgagcagctgcccatcctgggccagcgtgctagagccccagaaagcaattgcaaccgtggagtcctgtacaccagtgtctctgtcctggtggctctgctcttggctgggcaggccaccactgcttacttcctgtaccagcagcagggccgcctggacaagctgaccgtcacctcccagaacctgcaactggagaaccttcgcatgaagcttccgaaatctgccaaacctgtgagcccgatgcgcatggctactcccttgctgatgcgcccactgtccatggataacatgctccaagcgcccgtgaagaatgttaccaagtatggcaacatgacccaggaccacgtgatgcacctgcttacgaagtctggacccgtgaactacccacagctgaaggggagcttcccggagaatctgaagcaccttaagaactctatgaatggtctggactggaaggtctttgagagctggatgaaacagtggctgttgtttgaaatgagcaagaactccctggaggagaagcagcccacccagactccacctaaagagccactggacatggaagacccatcttctggcctgggagtgaccaagcaggatatgggccaaatgttcttgtgaagacagaagccagctctgcacggcggcacgtcccctgctcctcagcccttcttacactccctaacatcacacccattccgtcttcctgcacctgggcttgagactggtatctgcttcaccgtccctgacacaacaaatgaaaccggaacagaatgagaacactggagggagggccttgctgcctacccccatctaaaggacccccatttctgacccattagcagtctttaatgtggggctctgagatctaggcccactgacagggataggggatgccctacccttaatctaggctggatacatttgctgtcttctcaaggaagaggccaagccctcccagcaacccttcctcatgtcctgccgacgcccctgggatccctgctcagccaagcttgtcagcagcctgtaggaccatggttcacgtgacaataaaaggtagaaggtaaa

SEQ ID NO: 1598 - DNA, 10705 bp, Rattus norvegicus
  Genbank Accession No. NM_013070
aaaaaaggaaaaccaaaattctcctaaggtccaacgcaagctccccactacccgaacacgcccagaggaaccctggggcctctgggacttggttagcaggtattcatggtagcctggaccattattccgaggtagtcttcagaagaggatctgggaaagcctttggattatattgaaactcatccaagatggccaagtacgggcaccttgaagccagccctgatgatgggcagaatcagttcagtgatatcattaagtccagatctgatgaacacaacgatgtacagaagaaaacctttaccaaatggataaacgctcgattttcaaagagtgggaaaccacccatcaatgatatgttctcagacctcaaagatgggagaaagctcttggatcttctagaaggcctcacaggaacatcattgccaaaggaacgtggttccacaagggtgcatgccttaaataatgtcaaccgggtgctgcaggttttacatcagaacaatgtggagctggtgaatatcggaggcactgacattgtggatggaaatcccaagctgacgctgggtttgctgtggagtattattctgcactggcaggtgaaggatgtcatgaaagatatcatgtcagacctgcagcagacgaacagcgagaagatcctgctgagctgggtacggcagaccaccaggccctacagccaagtcaacgtcctcaacttcaccaccagctggacagatggactcgcattcaacgccgtgctccaccggcacaaaccagatctcttcagctgggacagagtggtcaaaatgtccccaactgagagacttgaacatgcttttagcaaggcccatacttatttggggattgaaaaacttctggatcctgaagatgttgccgtgcagctccctgacaagaaatccataattatgtatttaacgtctctgtttgaggtgcttcctcagcaagtcactatagacgccattcgagaggtggagacgctccccaggaagtacaagaaagaatgtgaaggggaagaaattaatatccagagtgcagtgctgacagaggaaggccagagtccccgagctgagacgcccagcacagtcaccgaggttgacatggatttggacagctaccagatagcactagaggaagtactgacatggctgctgtctgcggaggacacgttccaggagcaagatgacatttctgatgatgtcgaggacgtcaaagagcagtttgctacccatgaaacatttatgatggagctgagtgcgcaccagagcagcgtggggagtgtcctgcaggctggcaaccaactgatgacacaaggcactctgtcggatgaggaggagtttgagattcaggagcagatgaccttgctgaacgccagatgggaggcgctccgggtagagagcatggagagacagtcccggttgcatgatgccctgatggaactgcagaagaaacagctgcagcagctctcaggctggctgaccctcacagaggagcgcattcagaagatggaaagcctcccagtgggtgacgacctaccctccctgcaaaacctgcttgaagaacataaaagtttgcaaagtgacctcgaagctgagcaggtgaaggtgaattccttaactcatatggtggtgattgtggatgaaaacagtggggagagcgccacagctgttttggaagatcagttacagaaactgggtgagcgctggacagctgtatgccgctggactgaagaacgttggaacaggttgcaagaaatcaatattttgtggcaggaattattggaagaacagtgtcttttggaagcttggctcaccgaaaaggaagaggctttgaataaagtccaaactggcaactttaaagaccagaaggaactcggtgtcagtgtccggcgtctggctattttgaaggaagacatggaaatgaagaggcagactctggaccaactgagtgagattggccaagacgtgggccaattgctcagtaatcccaaggcatctgagaagatgaacagcgactctgaggagctaacccagagatgggactctttggttcagagactagaagactcttctaaccaggtgactcaggctgtagcaaagctcggcatgtcccagattcctcagaaggatcttttggagaccgttcatgtaagagaacaaggaatgataaagaagcctaagcaggagctgcctcctcctcccccaccgaagaagagacagatccacgtggatgtggaggccaagaaaaagtttgatgccacaagtgcagaactgcagagctggattttgagatcaaaggctgccctccagaacacagagatgaacgagtataagaagtcgcaggagacctcgggagtgagaaagaaatggaagggattagaaaaagaacaaaaggaaaagatcccccagctggatgaactgaatcaaaccggacaaatccttcaggagcaaatgggaaaagaaggccttttggctgaagaaataaacgacgttctggaaagggttttgttggagtggaagatgatctctcagcagctggaagatctgggaaggaagatccagctgcaggaggatataaatgcttattttaggcagcttgatgctctcgaaaagaccatcagggcgaaggaagagtggctgagggatgcatccttttctgaatcaccccagcggtctttgccaagcttaaaggattcctgccagagggaactgacagacctccttggccttcaccccagaattgagatactgtgtgcaagctgttcagccctgaggtctcagccctctgtcccaggttttgtccagcagggttttgatgaccttcgacgtcactaccaggctgtgcagaaggctttagaggaataccaacaacagctagaaaatgagctgaagagccagcctgaacctgcgtatttggacacactgaacactctgaaaaaaatgctaagcgagtcagaaaaagcagcccaggcctctctgagtgccctgaacgatccctcagcggtggagcaggccctgcaggagaaaaaggcccttgatgaaacccttgagaatcaaaaacctacattgcataaactttcagaagaaacgaaggctttggagaaaaatatgcttcctgatgtggggaaaacgtacagacaagaatttgatgatgcccaaggcaaatggaataaagtaaagaccaaggtttccagagatttacgttcgcttgaggaaatcatccccagactcagagattttaaggctgattcagaagtcatcgagaagtggacgaatggcgtgaaagacttcctaatgaaagagcaggctgcccaaggagataccactgccctgcagaggcagcttgaccaatgcaccacatttgccaatgaaatcgaaacaatcgagtcatctctgaaaaacctgagggacatagagactagccttcagaggtgtcccgtcactggagtcaagacatgggtacagacaagactagcggattaccaatcccaactggagaaattcagccaagagattgatattcaaaagagcaggttgtctgacagtcaggagaaagccatgaacttgaagaaggatttggctgagatgcaggagtggatggctcaggccgaagaggactatctggagagggacttcgagtacaagtctccagaagaacttgaaagtgcagtggaggagatgaagagggccaaagaggacgtgctgcagaaggaggtgagggtgaaaattctcaaggacagcatcaagctcgtggctgccagggtgccctctggtggccaggagctgacatcggagttcaacgaggtgctggagagctaccagcttctctgtaataggattcgagggaagtgccacacactagaggaggtctggtcgtgttgggtggagctgcttcactatctggatctggaaaccgcgtggttgaacactttggaggagcgcatgcagagcacagaggccctgcctgagagggcagaagctgttcacgacgctctggagtctcttgagtctgttttgcgtcatccagcggataatcgcacccagattcgggaacttgggcagactctgattgatggtgggatcctggatgacatcatcagcgagaagctggaggcttttaacagccgctatgaagagctgagtcacttggcggagagcaaacagatctctttggagaagcaactccaggtcctccgcgaaactgaccacatgcttcaggtgctgaaggagagcctaggggagctggacaagcagcttaccacatacctgacggacaggattgatgccttccaactgccccaggaagctcagaagatccaagcagaaatctcagcccatgagctcaccctggaggagctgaaaaagaatgtccgccctcagccccccacctcccctgagggcagaaccacaagaggagggagtcagatggacctgctccagaggaaactccgagaggtttccaccaaattccagcttttccagaagcccgcgaatttcgagcagcggatgcttgactgcaagcgcgtgctggatggcgtgaaggccgagctccacgtcctcagtgtgaaggatgtggaccccgacgtcatccagacccacttggacaagtgcatgaaactatataaaacgttgagcgaggtcaagcttgaagttgagactgtcatcaagacagggaggcacattgtccagaagcagcagacggacaacccaaaaggcatggatgagcagctcacttctctgaaagtcctctacaatgacctgggtgcacaggtgacagaagggaagcaggacctggaaagagcctcacagctgtccaggaagttgaagaaggaggctgccatcctctctgaatggctctctaccacagaggctgaactagtgcagaaatctgcctcagaaggggtgatcggtgacctggacacagaaatctcctgggctaaaaacattctcaaggatctggaaaagagaaaagttgacttaaacaccatcacagagagtagtgctgcccttcaacacttggtggtgggcagtgagtctgttttagaagataccctatgtgtgctcaacgctgggtggagccgagtccgcacgtggaccgaggactggcgtaataccttgctgaaccaccagaaccagctggaggtctttgatggacatgttgcccacatcagtacctgtctctatcaagccgaagctctattggatgagatcgaaaagaaaccggcgagtaaacaggaagaaatcgtgaagcgtttactgtcagaactgagtgatgccagcatccaggttgagaatgttcgggaacaagccatcgtcctggtgaatgctcgtggaagctccagcagggaacttgtggaaccaaaattagctgaactgggcaagaactttgaaaaggtgtcccagcacataaacagtgcccaaatgctgattggtcaggatcctgctggaactgttgaagctgttgggcctttctctgacttggaaagcttagagagtgacatagaaaacatgttgaaagttgtggaaaagcacttggaccccagtaatgatgagaagatggatgaggagcgagcccagattgaggaagttctacaaagaggggagcatttgttacatgaaccaatggaggacagtaagaaagaaaagatccgtttgcagttactacttttgcatacacgttacaacaaaatcaaggcaatcccgcagagaaaaacaattccgctttcttctggaattatgtcatctgccctccctgcggattatctggttgaaattaataaaattttgctcactctagatgacattgaattatcgcttaatattcctgaactaaacaccactgtctacgaagacttctctttccaggaagactctctgaagagaatcaaagatcagctggacagactcggagagcagctcgcagcagttcatgagaagcagcccgatgtcatcctcgaagcctctggtcccgaagccattcagatcagggacatgctctctcagctgaacgcaaagtgggacagagtgaataggttatacagcgaccggagagggtccttcgccagggctgtggaagaatggaagcagttccactgtgaccttgatgacctcacgcagtggctgtctgaagctgaggacctgctggtaggcacttgtgctccagatggcagcctggacctggagaaagctaggacacaccagctggaactggaagacggcctcagcagccaccagccctgcttgattgatgtaaaccaaaagggagaagacattgtacagagactccgcccctcagatgcaagctttctgaaggataaactggccagtttaaaccagcgctggagtgctcttgtagctgaggtgaaggatctgcagcccaggctaaaaggagaaagtaagcaggtgtcggggtacaggaaacggctggatgaggtcgtctgctggttaacaaaagtggagaactcggtgcagaagagatcaacccctgacccggaagaaaacccgtgggaattaacagatttagcccaagagatggacgctcaggctgaaaacattaagtggctgaacagagccgaactggaaatgctttcagacaaaaatctgagtttgtgcgagagagataatctttcagaaagcttgaggaatgtaaatacaatgtggaccaagatatgcagagaggtgcctagcctactgaagacacgcacccaagacccctgctctgccccacagacaaggattgctgctcatcccaatgtccaaaaggtggcgctagtatcatctgcatcggatgctcctctgcgtggccccgagatctcagttcctgctgatttggataaaaccatcaccgaactggctgactggctggtgttgatcgaccaaatgctgaagtccaacattgtcactgtgggggacgtgaaggagatcaataagacagtttcccggatgaaaatcacaaaggctgacttagaacagcgccatcctcagctggattttgtattcacattggcccagaatttgaaaaacaaagcttccagttcagatttgagaacagcaatcacgggaaaattggaaaagctgaagacccagtgggagagtacccagcatggcgtggagctgcggcggcagcagttggaggacatggtcgtggacagcctgcagtgggacgaccacagagaagagacggaagagctcatgaggaaacacgaggcccgcttctacatgcttcagcaggcccgccgggacccgcttagcaaacaagtttctgacaatcaactcttgcttcaagaactgggttctggcgatggtgtcatcatggcatttgataacgtcctgcagaaacttctggaagaatacagtagtgatgacaccaggaatgtggaagaaaccacagagtacttgaaaacgtcatggatcaatctcaaacaaagcattgctgatagacagagtgccttggaggctgagctgcggacagtgcagacgtctcgtagagacctggagaactttgtcaagtggcttcaggaagcagaaaccacagcaaatgtgctggccgatgcctctcagcgggagaatgctcttcaggacagtgtcctggccaggcagctcagacagcagatgctggacatccaggcagaaattgatgcccacaatgacatatttaaaagcatcgatgggaacaggcagaagatggtgaaggctctggggaattctgaggaggccacaatgcttcagcatcgcctggatgacatgaaccaaagatggaatgatctgaaggcaaaatctgccagcatcagggcccatttggaggccagtgctgagaaatggaacaggttgctggcatcgctggaagagctgatcaaatggctcaacatgaaagacgaagagcttaagaagcagatgcccattggaggggacgttcccgccttacagctccagtatgaccactgcaaggtgctgagacgtgagctaaaggagaaagaatattctgtgctgaacgccgtagatcaagctcgagtgtttctggctgatcagccgatagaggcccctgaagaacccagaaggaacccacagtcaaagacagagttgactccggaggagagagcccagaagatcgccaaggccatgcgcaaacagtcctctgaagtcagagagaagtgggagagtctaaatgctgtgactagcacctggcaaaagcaagtaggaaaggcgttagagaaactccgagaccttcagggagccgtggatgacctcgacgcggacatgaaggaggtggaggccgtgcgcaatggctggaagcccgtgggggacctgcttatcgactcgctgcaggatcacatagagaaaaccctggcgtttagagaagaaattgcaccaatcaatctaaaagttaaaacaatgaatgacctgtccagtcagctgtccccactcgacctgcatccgtctccaaagatgtctcgccagctggatgacctcaatatgcgatggaaacttctccaggtttcggtggaggatcggctcaagcagctccaggaagcccacagagattttgggccatgttcccaacactttctgtccacttcagtccagctgccgtggcagagatccatttcgcataataaagtgccctattacatcaaccatcaaacacagacaacctgttgggatcatcctaaaatgactgaactctttcaatcccttggtgatctgaataatgtacgtttctctgcctaccgcacagccatcaaaatccgaaggctgcagaaagcactatgcttggatctcttagaactgaacacaacaaatgaagttttcaagcagcacaaactgaatcaaaatgatcagctcctgagtgtcccagatgtcatcaactgtctgaccacaacttacgatgggcttgaacaactgcacaaagacttggtcaatgttccactctgcgtcgatatgtgtctcaactggctgctcaacgtatatgacacgggccggactggaaaaattagagtacagagtctgaagattggattgatgtctctctccaaaggcctcttagaagaaaaataccgatgtctctttaaggaggtggcagggccaacagagatgtgcgaccagcggcagcttggcctgctacttcacgatgccatccagatcccgaggcagctgggggaagtagcagcctttgggggcagtaacattgagcccagtgtccgaagctgtttccagcagaataacaacaagccagaaatcagtgtgaaggagtttatagactggatgcggttggagccacagtccatggtgtggttgccggttctgcaccgtgtggcagctgcagagactgcaaaacatcaggccaaatgcaacatctgcaaagaatgtccgatcgttgggttcaggtacaggagcctaaagcatttcaactatgacgtctgccagagctgcttcttttccggaagaacagccaagggccacaaattacattacccaatggtggaatactgtataccaacaacatctggggaagacgtgcgagatttcacaaaagtactgaagaacaagttcaggtccaagaagtattttgccaaacacccccggcttggctacctgcctgtccagaccgtgctcgaaggagacaacttagagactcctatcacgctcatcagtatgtggccagagcactatgacccctcccagtcccctcagctgtttcatgatgacactcactcaagaatagagcaatacgccacacgactggcccagatggaaaggacaaatggatccttcctaactgacagcagctctaccacgggaagtgtggaggacgagcatgccctcatccagcagtactgccagacgctgggcggggagtctcctgtgagccagccacagagtccagctcagatcctgaagtctgtggagaaggaagagcgtggggaactggagcggatcattgctgacttggaggaagagcaaagaaatctgcaggtggagtatgagcagctgaaggagcaacacctaagaaggggtctccccctgggctcccctccagactccattgtatcccctcaccacacgtccgaggactcggaactgatagcggaagctaaactccttcggcagcacaaagggcggctggaggcgaggatgcagattctggaagatcacaataaacagctggagtctcagctgcatcgcctcagacagctcctggagcagcctgactctgattcccgcatcaatggtgtctccccctgggcttccccacagcatccttcattgagctactcgcttgaccccgacccaggcccacagtcccaccaggcagcatctgaggacctgctggccccgcctcatgacaccagcacggacctcacagatgtgatggagcagctcaacagcacgtttccctcctgcagcccaaatgtccccagcaggccacaggcaatttgaagcatttatccagccaaccaacgtttcccgaccttcagtattgccctcttctgcaaatgccaaccccattcaacctgatgctccgtggctcccagacacttgcctttgagtgctgaccaggtgttctactgagggaatcaaacaccgactatccaaagagaaaaggatgctttgtttttataataacgtatattattgtttccttcttccctttctatgcaactgtaaattaatgaacagagaaggatttgaggtgt

SEQ ID NO: 1599 - DNA, 2153 bp, Rattus norvegicus
  Genbank Accession No. NM_013082
cgtcccctccgttctgcatccccaaacttcagccgcagctctgtttcaacccatcggctgcttgcttcaaatcagacagcaccgcgacccagacacccgagtccgcggagtgaaagcacaacgccgagtaggaccagaccaggaaaatagactcgtgaagcagcaactctggattgggagggcagaagccaacaagtgagaaggcgcggcgtttccggggcgctgtgcgaaagctagagcaggcgccagagaagacagctcgagctcagaacccgagaccaagcctctctcccggaggcagctcagctcctatcttctctaggcccgctgcagcgtgcgctgggcttcgttttatgcgggtacgagccacgtccccggggaatatgcagcgtgcgtggatcctgctcaccttgggcttgatggcctgtgtgtcggcagagacgagagcagagctgacatctgataaggacatgtaccttgacagcagctccattgaggaagcttcaggattatatcctattgatgatgatgactattcttctgcctctggctcaggagcttatgaagacaaagggagtccagatctgacaacatcccaactgattccaaggatctccctcactagtgctgctcccgaagtggaaaccatgacgttgaagacacaaagcatcacacccactcagaccgagtcacccgaagaaactgacaagaaggagtttgaaatctctgaggcagaagaaaagcaggaccctgctgtaaaaagcacagacgtgtacaccgagaaacattcagacaatctgttcaagcggacggaagttctagcagctgtcattgctggcggtgtgattggctttctctttgccattttcctcatcctgttgttggtgtaccgcatgcggaagaaagacgaaggaagctacgaccttggagaacgcaaaccgtccagcgcagcttaccagaaggcacccactaaggagttttatgcataaaactcccacttagtgtctctatttaagagatcactgaacttttcaaaataaagctttagcatagaataatgaatatctttgttatctgttttgttcattacagagccatgctggccctttaatgatgaagatcccattgtatttaaaatttttcatatatttctttagaatgacttaaaagtaaaaatttaacatctgcagtgttctgtgaatagcagtggcaaaatattttgttacaaaaacccttgacattcatggaattgatttgaacatctatgtgcaaatacaaaatgattgtgtttgtcctctggttcaaagatgactgctgttcccctcatcagcagatctccagttgaccttaccgagttgatctttgttaatttatctcttgttcctcttctctgccctcccttcttgtctcctcccttaaaaacaaaaccttatgccttttgtagctgtcatggtgcaatttgtctttgaatgattacaataatggtaatttagtgtatatgtgatttttttcaattatgtaaactttaacctcctctttatgtaatttttttaaatgtcagactacccattttacacttgctttaatttccattccctgtagcttcaggcagatttgcaaaggcaaattataaaattggattattactacgaaactgttagtcctagttatctaagcagtcttctcttggaggatttgacatcactgacaagcctcagcaaacccaaagatgctaacagtatttgagaagttgctacagactcctttggccactgtacttgctagtttacaatttgaaggtacaaggaagagtttaaaggaaaaaaaagatcagtttttgttcttaaaaatgcatttaagttgtaaacatctttttaagcctttgaagtgcctatgattctatgtaacttgttgcagactggtgttaatgagtatatataacagtttttaaaaagttggtattttataagcacagacaattctaatggtaacttttgtagtcttatgaatagacataaattgtaatttgggaacaagcaaactactgaataaatcacatggcctaatattgaaaatgtcactgttataaatttgtacatttcttatcaaatgtacagcttccctttgctatgactgactgtctgttctcagtg

SEQ ID NO: 1600 - DNA, 2130 bp, Rattus norvegicus
  Genbank Accession No. NM_013091
ttttctccgagttttctgaactctggctcatgatcgggcttactggatacgagaatcctggaggaccgtaccctgatttccatctacctctgactttgagcctttctaacccggggctcacgctgccaacacccgggccacctggtccgatcgtcttacttcattcaccagcgttgccaattgctgccctgtccccagccccaatgggggagtgagagaggccactgccggccggacatgggtctccccatcgtgcctggcctgctgctgtcactggtgctcctggctctgctgatggggatacacccatcaggggtcaccggactggttccttctcttggtgaccgggagaagagggataatttgtgtccccagggaaagtatgcccatccaaagaataattccatctgctgcaccaagtgccacaaaggaacctacttggtgagtgactgtccaagcccagggcaggaaacagtctgcgaggtgtgtgataaaggcacctttacagcttcgcagaaccacgtcagacagtgtctcagttgcaagacatgtcggaaagaaatgttccaggtggagatttctccttgcaaagctgacatggacaccgtgtgtggctgcaagaagaaccaattccagcgctacctgagtgagacgcatttccagtgtgtggactgcagcccctgcttcaatggcaccgtgacaatcccctgtaaggagaaacagaacaccgtgtgtaactgccacgcaggattctttctaagcggaaatgagtgcaccccttgcagccactgcaagaaaaatcaggaatgtatgaagctgtgcctacctccagttgcaaatgtcacaaacccccaggactcaggtactgccgtgctgttgcctctggttatcttcctaggtctttgccttttattctttatctgcatcagtctactgtgccgatatccccagtggaggcccagggtctactccatcatttgtagggattcagctcctgtcaaagaggtggagggtgaaggaattgttactaagcccctaactccagcctctatcccagccttcagccccaaccccggcttcaaccccactctgggcttcagcaccaccccacgcttcagtcatcctgtctccagtacccccatcagccccgtcttcggtcctagtaactggcacaacttcgtgccacctgtaagagaggtggtcccaacccagggtgctgaccctctcctctacggatccctcaaccctgtgccaatccccgcccctgttcggaaatgggaagacgtcgtcgcggcccagccacaacggcttgacactgcagaccctgcgatgctgtatgctgtggtggatggcgtgcctccgacacgctggaaggagttcatgcggctcctggggctgagcgagcacgagatcgagcggctggagctgcagaacgggcgttgcctccgcgaggctcattacagcatgctggaagcctggcggcgccgcacaccgcgacacgaggccacgctggacgtagtgggccgcgtgctttgcgacatgaacctgcgtggctgcctggagaacatccgcgagactctagaaagccctgcccactcgtccacgacccacctcccgcgataaggccacacccccacctcaggaacgggactcgaaggaccatcctgctagatgccctgcttccctgtgaacctcctctttggtcctctagggggcaggctcgatctggcaggctcgatctggcagccacttccttggtgctaccgacttggtgtacatagcttttcccagctgccgaggacagcctgtgccagccacttgtgcatggcagggaagtgtgccatctgctcccagacagctgagggtgccaaaagccaggagaggtgattgtggagaaaaagcacaatctatctgatacccacttgggatgcaaggacccaaacaaagcttctcagggcctcctcagttgatttctgggcccttttcacagtagataaaacagtctttgtattgattatatcacactaatggatgaacggttgaactccctaaggtaggggcaagcacagaacagtggggtctccagctggagcccccgactcttgtaaatacactaaaaatctaaaagtg

SEQ ID NO: 1601 - DNA, 556 bp, Rattus norvegicus
  Genbank Accession No. NM_013096
acattctccttctgatagactcaggaagcaatcatggtgctctctgcagatgacaaaaccaacatcaagaactgctgggggaagattggtggccatggtggtgaatatggcgaggaggccctacagaggatgttcgctgccttccccaccaccaagacctacttctctcacattgatgtaagccccggctctgcccaggtcaaggctcacggcaagaaggttgctgatgccttggccaaagctgcagaccacgtcgaagacctgcctggtgccctgtccactctgagcgacctgcatgcccacaaactgcgtgtggatcctgtcaacttcaagttcctgagccactgcctgctggtgaccttggcttgccaccaccctggagatttcacacccgccatgcacgcctctctggacaaattccttgcctctgtgagcactgtgctgacctccaagtaccgttaagccgcctcctgccgggcttgccttctgaccaggcccttcttccctcccttgcacctatacctcttggtctttgaataaagcctgagtaggaagc

SEQ ID NO: 1602 - DNA, 1143 bp, Rattus norvegicus
  Genbank Accession No. NM_013097
cggagacatctctgtgtcagcggtgagtgagctccccttgttcatcgacagttccagagcagactcggggctcatcataccaacagagcaggtctgttctggctactgcagccatctgagtggctttcaggatgaggtacacagggctgatgggaatactgctcaccctggtcaacctgctgcagctggctgcgactctgagaattgcagccttcaacatccggacttttggggatactaagatgtctaatgccaccctctctagctacattgtgaaaatcctgagtcgctatgacattgctgtggtccaagaggtcagagacactcacctggttgctgttgggaagctactggatgaactcaatcgggacatccctgacaactatcgctatataatcagtgagccgctgggccgcaaaagctacaaggaacagtacctttttgtgtacaggcccagccaggtgtctgttttggatagctatcattatgacgatggctgtgaaccctgtggaaatgacaccttcagccgagagccagccattgtcaagttcttttccccatacactgaggtccgagagtttgcgattgtgcccttgcactcagccccaacagaggctgtgagtgagatcgatgccctctacgatgtttatctagatgtccggcaaaagtggggcctggaggacatcatgttcatgggagatttcaatgctggctgcagctacgtcacttcctcccaatggtcttccattcgccttcggacaagccccatcttccagtggctgatccctgacagtgcggacaccacagccacatccacacactgtgcttatgacaggattgtggttgctggagctctgctccaggctgctgttgttcccagctcggctgtcccctttgacttccaagcagaatacagacttaccaaccagatggctgaagccatcagtgaccattacccagtggaggtgacactcagaaagacctgatgtcattgagttcagccacactgcttccggtgaggaagagtccacctcacctatgtgtggtactgcggcattccaacacctcggcacagggaatgtctaccacgcggacttagaaatactgtttaattggagtaaataaagctgagcctgagcaggt

SEQ ID NO: 1603 - DNA, 2237 bp, Rattus norvegicus
  Genbank Accession No. NM_013098
gccagcttcctgaggtaccaaggaggaaggatggaggaaagaatgaacgtgctccacgactttgggatccagtcgactcgctacctccaagtgaattacgaagactcccaggactggtttgtcttggtgtctgtgatcgctgacctcaggaacgccttctatgtcctctttcccatctggttccacattcaagagactgtgggcatcaatctcctctgggtggcagtggttggagactggttcaacctcgtctttaagtggattctttttggacagcgcccgtattggtgggtcctggacactgactattacagcaacagctccgtgcctctgataaaacagttccccgtcacctgtgagactggaccagggagtccctcgggccatgccatgggcacagcaggtgtatactacgttatggttacttctactctcgctatctttcgtggaaagaaaaagtcaacgtatggattccggtgcttgaatgtcgtcttgtggttgggatactgggctgtgcagctgaacgtctgtctgtcccggatctaccttgcggctcactttccccatcaggtggtggctggagtcttgtcaggcattgctgtggctgaaactttcagccacatccggggcatctacaatgccagcctccagaggtactgtctcatcaccttcttcctgtttggtttcgcacttggattttacctgctgctaaaggggctaggggtggacctcctgtggactttggagaaggccaagagatggtgtgagcgccccgagtgggtccaccttgacactacaccctttgccagcctcttcaaaaacctggggaccctcttggggttggggctggccctcaactccagcatgtaccgcaagagctgcaaaggagaactgcgcaagtcgctcccattccgtttggcctgcatcgtggcctccttgggcctgctgcatctctttgactcgctgaagcccccgtcccagattgagtcgatcttctacatcttgtctttctgcaagagtgcgaccgtcccctttgcatctgtcagtcttatcccctactgcctagcccggctcctgggacagacacacaagaagtctttgtaaagcgttaagtctctgacacaagtcagcggccgtgcaaaggactaggagcaacccaagccttgtgcaacccagtgtggggccagaggtgttcacagccaccctggtagccctgtctttctttgccatcgtaaccaaaaaggtgaatttttaaaagctaacagggctgtttgaggaaagcgtgaatgctggaagatgtttccctgatgaatcacttccggtctcctgtccgacacagaagagaaagcccagactagagatcctgacagaatgctctcactgtgcagaatcctccaggccgagggtaaaagaaaagagcgttgtgcatttgctaggaagagaaggaaggatcgggaggagggggagtgtttggtggattgagcaaaccatatgcaagccatgtctacccggcttcagttatgcctgggtctttagatatgtaggacactctcaataatgatagaccagcccgtgtaatgagtagccagttagaggcgatcattctgctcccagatttttctctactgtacatgaaagtcacaccgtgtgcttgtattcctgaatggtaatggtgactgtcactcaggaaccaccaccttctctgtgacaccacagctttgcctcctcggcccaggtctgcgtgccataggactcatcactgcttccctgaccacgctgctggaccctgcattgctgaaccccatgctgctggaccctgtggtgtacggtgggcaattgtttgctggtgcttttgtagggttaagttaaactctgagatcttgggcaaaacggcaaggggagagtcaggattcctctctccaaaggtcactccgaagttacttttgattcctggagcagaaatgactccttcctctagcccaagccagccaagaactcattcttagaggcaaagcagcccaagcccgactgtgcctgtcctccagcctgggctggttttgcagagtgtgtcttcaagaagaaaaaatggtaaagctatttattcaaaatgcttgttttttgctatgaatgatgcctgtgtttccacccacgccaagcacttgttcctattgtcttgataagaaactacatgtgtgcagtattttattaaaacgacattttatttaaaaaaaaaaaaa

SEQ ID NO: 1604 - DNA, 554 bp, Rattus norvegicus
  Genbank Accession No. NM_013102
gccgccgccgccgccgccgccgccatgggagtgcaggtggagaccatctcttctggagacgggcgcaccttcccgaagcgcggccagacctgcgtggtacactacacggggatgcttgaagatgggaagaaatttgactcctctcgggacagaaacaagccttttaagtttacactaggcaagcaggaggtgatccgaggctgggaagaaggggtagcccagatgagtgtgggccagagagccaaactgataatctccccagactatgcctatggagccaccgggcacacaggcatcatcccaccacatgctactcttgtttttgatgtggagcttctaaaactggaatgacagaagtggcctcctcccttagctctgcacatggatctgccatggaggaatctggtacctccagatgggtgcacatgaatccatgggagcttttcctgatgtcccaccactctttgtatagacacctactaactgaatgtgttccgtcactcagctttgcttcggacacctccatgtcctcttcccccttctgtatgtgtgtt

SEQ ID NO: 1605 - DNA, 2026 bp, Rattus norvegicus
  Genbank Accession No. NM_013105
aggaagccctgcagagcatcagaggcccagctagagggacaacacagaggagtaatttgctgacagacctgcagggatggacctgctttcagctctcacactggaaacctgggtcctcctggcagtcgtcctggtgctcctctacggatttgggacccgcacacatggacttttcaagaaacaggggattcctgggcccaaacctctgcctttttttggcactgtgctgaattactatatgggtttatggaaattcgatgtggagtgccataaaaagtatggaaaaatatgggggttgtttgatggtcaaatgcctctgtttgccatcacggacacagaaatgatcaagaatgtgctagtgaaggaatgcttttctgtcttcacaaaccggcggtattttggcccagtggggattatgggaaaggccatctctgtatctaaggatgaggagtggaagagatatagagccttgctgtcacccacgttcaccagtggaagactcaaggagatgttccctgtcatcgaacagtatggagacattttggtaaaatacttgaggcaagagaaaggcaaacctgtccctgtgaaagaagtgtttggtgcctacagcatggatgtgatcaccagcacatcatttggagtgaatgttgattccctcaacaacccgaaggatccttttgtggagaaagccaagaagctcttaagaattgatttttttgatccgttgttcttgtcagtagtactctttccattcctcacgccagtatatgagatgttaaacatctgcatgttcccaaaagattcaatagaatttttcaaaaaatttgtgtacagaatgaaggaaacccgcctggattctgtgcagaagcatcgagtggattttcttcagctgatgatgaatgctcataatgattctaaagacaaagaatctcatacagccctatccgatatggagatcacagcccagtcaatcatttttatttttgctggatatgaacccaccagcagcacactttcctttgtcctgcattccctggccactcacccagatacacagaagaaactgcaggaggagatcgacagggctctgcccaataaggcacctcccacctatgatactgtgatggaaatggaatacctggatatggtgttgaatgaaaccctcagattgtatccaattggtaatagacttgagagagtctgtaaaaaagatgttgaaatcaatggtgtgtttatgcccaaagggtcagtggtcatgattccatcttatgctcttcaccgtgatccacagcactggccagagcctgaggaatttcgcccagaaaggttcagcaaggagaacaagggcagcattgatccttatgtatatctgccctttggaaatggacccaggaactgcattggcatgaggtttgctctcatgaatatgaaactcgctctcactaaagttctgcaaaacttctccttccagccttgtaaggaaacacagatacctctgaaattaagcagacaaggacttcttcaaccaacaaaacccattattctaaaggttgtgccacgggatgaaatcataactggatcatgattttccctcaaggagttctgctgaattcttcagaaatgtggtgtctaagaacaccagaccctttaatttatgtcatgaataaaattcagatgaaattagggcttaatcgactttgttttgatttggtacatctttgctctttctcagtgtctacaatgtacccatctaatataaaggaaatgacaagtcagtgacagaacaggaacttaacctttggtgattctcatgggactacctccatccacatctggttgtctctgttaatttcttttgatagtaaccttgtctctgtaatttgatcaagaatttttcatgaaaatgtgaactattgtgacaactttaattgtagatttggtatcagatgttttagatgcattattctacactaaatgttacatggaaaaaatgtgaataaacacttctttaaaaaatccccatttt

SEQ ID NO: 1606 - DNA, 2528 bp, Rattus norvegicus
  Genbank Accession No. NM_013113
gagcccgcgctccactcctttcgtccttcccggtgactttccctccttgtccctggtccatctcgccagaggtcatagcaggcagagtggtgcagctacagcttgaagcagcagctgcggggttcgctgagccccccgggaggcgatcggagcgcggggagagcaggagtgcggccacgcgcccacctctaggtgcggggctcggagccgcccagcccgcgcgcgccctcctccctcctccctcctccctccgcccccgccgcacctccccctcctcccgctctgcttaggctgctccgcggcgcgcctcgcactcggagagccgcagcggcagcggcgcgtctcgcctttggagacagagccgggccgcggggacaccgagcagtcgccgcgaggacgccagggcgcgcgcagcactcgctttccctcggcctcggccgccactgctgagcagacaccatggcccgcggaaaagccaaggaggaaggcagctggaagaaattcatctggaactcggagaagaaggagtttttgggcaggaccggtggtagttggtttaagatccttctgttctacgtgatattctatggctgcctggccggcatcttcatcgggaccatccaagtgatgctgcttaccatcagtgagctgaaacccacgtaccaggaccgtgtggccccgccaggattgacacagattcctcagatccaaaagactgaaatttccttccgtcctaatgaccccaagagctacgaggcctatgtgctaaacatcatcaggttcctggaaaagtacaaagattcggcccagaaggacgacatgattttcgaggattgtggcagtatgcccagtgaacccaaggagcggggagagttcaatcatgaacgaggagagcgcaaggtgtgcaggttcaagcttgactggctggggaactgctctggtctcaatgatgaatcctacggctacaaagaggggaagccctgtatcattatcaagctcaaccgaatgctgggcttcaaacctaagcctcccaagaatgaatccttggagacttaccctctgacgatgaagtataatccaaacgtcctacctgtccagtgcactggcaagcgcgatgaggataaggataaagttggaaacatagagtactttgggatgggcggattctatggctttcctctgcagtactatccctactacggcaaactcctgcagcccaagtacctgcagcccctgctggccgtgcagttcaccaacctcaccttggacactgaaatccgcattgagtgtaaggcgtatggtgagaacattgggtacagtgagaaagaccgttttcagggacgctttgatgtaaaaattgaagttaagagctgatcacaagcacaaatctttcccactagccatttaataagttaaagaaaaagatacacaaacctactagtcttgaacaaactgtcatacgtatgggacctacacttaatctctatgctttacactagcttctgcatttaataggttagaatgtaaatttaaagtgtagcaatagcaacaaaatatttattctactgtaaatgacaaaagaaaaaaataaaaattgagccttgggacgtgcccatttttactgtaattagactccgtaactgacttgtagtgagcagtgttctggcccctaagtatcgccgccgtctgttttatttagtgtacagtactataggtgcgcactctggtcattttccaagccatgttttatcatatctgttttctactttccgtgagcgaggtttgctgtccaaggtgtaaatactcatgggaataaaactggcatggtactttcccttcctttctcattttcttggctctgagatttcaaaggtaacggcccatcaacaagcatttttaacacactccatagtctttccctgtggtatcaggtctttactattgtttttctttgtttcctggggctggggggtgggctgtcgtgggggaactgccctttaaattctaagtgacgctgcagaaaaacaacggtgatgggttgtgttgtgctccgtgctgagtgctgtctcgccatctctccccttgtcctccagtgtgctccgaagctgtgtctgatctggatctgcccgtcactttggctagtgatggggctagttaatttgcttagtacatttccttttccttctttcctttctctggaggcatcatgtgctggtgctgtgtctttatgaatgttttaaccattttcatggtggaagaattttatatttatgcagttgtacaattttatttttttctgcaagaaaaagtgtaatgtatgaaataaaccaaagtcacttgtttgaaaataaaatctttattttgaactttataaaaagcaatgcagtaccccatagactggtgttaaatgttgtctacagtgctaatccatgttctagcatatgtagtgattgccaggagtacagtgctcttgttggtcttgtgtcagtcaggttaacacaatggacaataaaagaatgaacacattc

SEQ ID NO: 1607 - DNA, 567 bp, Rattus norvegicus
  Genbank Accession No. NM_013118
catactgctgccatgaatgcctggttgctgtctgtgctgtgcctcctgggtgccttggctgtcctggtagaaggggtcactgtgcaggatggagacctttcctttcctctggagtcagtgaaacaacttaagcacctccgggaagtacaggagcccacactgatgagtcacaagaagtttgctctcaggcttccgaagcctgtggcaccagagctatgtagccaatctgcatttccagaagcactgaggcccctctgcgagaaacccaacgccgaggagatcctgcagaggctagaggccattgctcaggacccaaacacatgtgaaatctgtgcctatgctgcctgcacgggatgctagagtgacatcacttgccttcctctcagcccacgtggaagccccttctactttctagaagcagcaaggctaacaaactcatacccccagcttctcagcctaccctggacactgtggggaggaggatgaggagacaactaccccggggaagccttgcctaggggctatgctaaccctctgtcaataaatggagctactgtaaaaaaaaaa

SEQ ID NO: 1608 - DNA, 1482 bp, Rattus norvegicus
  Genbank Accession No. NM_013122
gatcacaggcttggacactccattctttccaactccccacctaaaagtggccttaactacttactagactgattggctggagacctagcccccaagggaggatttggccagggtgatgcctggcccacttagaggacacaagtgcttttgccccttagctgcattgtccaggaaatcaagacgacaaaaggcgtctcccgcgctcgccagggccgtgccacctgcccgctagctcgccgcgctacggtttcccactagccaacatgctgccgagattgggcggccccgcgctgccgctgctcctgccgtcgctgctcttgctgctgctgttgggcgcgggcggttgcggtcctggggtgcgcgccgaggtgctgttccgctgcccaccctgcacgcccgagcgtctggccgcctgcggacccccacccgacgcgccctgcgccgagctggtgcgagagcccggctgcggttgctgctccgtgtgcgcacgacaggagggcgaagcttgcggcgtctacatcccgcgctgcgcccagacgttacgctgttaccccaacccgggctccgagctgcccctgaaggcactggtcaccggcgcgggtacctgtgaaaagagacgcgtgggcgccaccccacagcaggttgcagacagtgaggatgaccactcggagggaggcctggtggagaaccatgtggacggaaccatgaacatgttaggaggcagcagtgctggccggaagccccctaagtcaggcatgaaggaactggctgtgttccgggagaaggtcaacgagcagcaccggcagatgggcaaaggtgccaaacacctcagcctggaggagcccaagaagctgcgcccacctcctgccaggaccccttgccagcaggagctggaccaggtcctggagcgcatctccaccatgcgccttccggatgatcggggtcctctggaacatctctactccctgcatatccccaactgtgacaagcatggcctgtacaacctcaaacagtgcaagatgtctctgaatggacagcgtggggagtgctggtgtgtgaaccccaataccgggaagccaatccagggagctcccaccatccggggagaccccgagtgccatctcttctacaacgagcagcaggagaatgatggggttcacgcccaaagggtgcagtaaaccacagccagtcggtgcctggcttccccaccccaaacaccagcagaaatggagggtgtcagggtgatgggtgtggaggatttcccagttttgacacatgtatttatatttggaaagagaccaacactgagctcagaagcccccctgcgccccccagtggcagttaacctgtacctctgttcctgcttctaatagagagggtggtggcactggggatactgggtacaggcttgggaatggggaaagaaatttttatttttgaacccctgtgtctcttttacttaagattaaaggaaggaaaaat

SEQ ID NO: 1609 - DNA, 2002 bp, Rattus norvegicus
  Genbank Accession No. NM_013130
accaaggcgaggccagggccgaggcgcggggacggcggccgagagctaagcgacgtgggacggtgactgggaacggatcggagcgcgggacccggcccgggtctcgtgcgtccccgccgatgggcctccgccgagccggtgctaactgggtcttccctgaagcagaaggaacagtatttcctacctttccgaaccgaagaccaagaagctagagaatctatgtaaataaactgaaatctctgttggctttgcaccccaccccggagccgtcacttttacctggtctgaggagcgtgtagacctcggccagccgctatgaatgtgaccagcttgttttcattcacaagcccagctgtgaagagactccttgggtggaaacagggcgacgaagaagagaaatgggcggagaaggctgtggacgctttggtgaagaaactgaagaagaagaaaggggccatggaagagctggagaaggccctgagctgccccgggcagcccagtaactgtgtcaccattcctcgctccctggatggcaggttgcaggtgtcccaccggaagggactgcctcatgtcatttattgccgcgtgtggcgctggcccgacctccagagccatcatgaactaaagcctctggaatgctgcgagttcccatttggttccaagcagaaggaagtctgcatcaatccctaccactataagcgagtggagagccccgttctcccaccggtgctggttccgaggcacagcgagtacaaccctcagcacagccttctggctcagttccgaaacctgggacaaaatgagccccacatgccactgaatgccacgttccccgactccttccagcagccacacagccacccgtttgcccagtaccccaacagcagctaccccaactctcctggcagcagcagcagcacctaccctcactccccgaccagctcagacccgggcagcccttttcagatgccagccgacacacccccgcctgcttacctgcctcctgaagaccccatggcccaggatggctctcagcctatggacacgaacatgacgaacatgacggcaccgacactgcccgcggagatcaatagaggagatgttcaagcagttgcttacgaggaaccaaaacactggtgctctattgtgtactatgagctcaacaaccgtgtgggcgaacggttccatgcctcctccaccagcgtgttggtggatggtttcaccgatccttccaacaataagaaccgattctgccttgggctgctctccaatgttaaccggaactccactattgaaaataccaggcgacacatcgggaaaggagtccacctttattacgtcggaggagaggtgtatgcggagtgcctcagtgacagcagcatcttcgtgcagagtcgaaactgcaactaccaccatggctttcatcccaccacggtctgcaagatccccagcgggtgcagcttgaaaatcttcaacaaccaagagttcgctcagctactggcgcagtctgtgaaccatgggttcgagacagagtatgaactcaccaaaatgtgcactattcgaatgagcttcgtgaagggctggggagcggagtaccaccggcaggatgtcactagcaccccctgctggattgagatacacctgcatggccctctccagtggctggataaagtccttacccagatgggttcgccccacaaccctatttcgtcggtgtcttaaaggccctcggcttctgtctcttgcaaactattgggccttgcagtacttgaaggacggagaagtcagacaggatggggagctgtaaaggagccgtgatacttgacctctgtgaccaaccgttggatggagaagctgacaggccttggtaacaagctgttgatatcaagaacccgcttagtttacattgtgacattctgttgtaaaatcaactaaaatgctgacttttagcaggactttgtgaatagttagaaaagagatggccaagccaggggcaaattat

SEQ ID NO: 1610 - DNA, 1417 bp, Rattus norvegicus
  Genbank Accession No. NM_013132
gtcctgctctcaaccgcagcctgcgccctaccttctgcagctccagcctactcctgaccgacagcatcatggctctcagaggcaccgtgactgacttctctggattcgacggcagggctgatgccgaagttcttcggaaggccatgaaaggcttgggcaccgacgaggacagcatcctgaacctgttgacagcccggagcaacgctcagcgccagcagattgctgaggagtttaagactctgtttggcagggaccttgtgaatgacatgaagtctgaactgaccggaaagtttgagaagttaattgtggctttgatgaagccctcccggctctacgacgcctacgagctgaaacacgctcttaagggagctgggacagatgagaaagtgttgactgaaatcattgcctcaaggacacctgaagagctcagggccataaaacaagcttatgaagaagaatatggttccaacctggaagatgatgtggtgggggatacctcagggtactaccagaggatgttggtggtcctccttcaggccaatagagaccctgacactgcaattgatgatgctcaagttgaactggatgctcaggcattgttccaggctggagagctgaagtgggggacggatgaagaaaagttcatcaccatccttgggacacgcagtgtgtctcatttaagaagagtgtttgacaagtacatgacaatatcaggatttcagattgaggaaaccattgaccgagagacctcagggaacttggagaacttactcctggctgtcgtgaagtctattcggagcatacctgcctaccttgcagagaccctctactatgctatgaagggtgctgggacggacgatcacaccctcatcagagtcatagtgtcgaggagtgagattgatctgtttaacatcaggaaggagtttaggaagaacttcgccacgtccctgtactctatgatcaagggcgacacatctggagactataagaaggccctgctgctcctctgtggaggcgaggatgactgaggagctgcctggagtgccctgggcccgcctgctgcccaccatcagcttccttcagcaccacgcctacttacgttcaatgcctgcctgcctgccacgctgccttactcacacgagtgtgtgctaatgaccaaagctgtctcgaatgaaagcagtgttctgctgttctgtctgacagaccttcccacgtctctcagtctagtatctctaagttgcgttttctatcctcttctaaagcttcatttatattaagttaataaccatattaccttgaacggaaccttagccatgaaattgtgaactcttggaagtgctgtcaatcaagcttagtgctctagctgacctgaaaaattaagatggtcgtaatatcagaaacgttgccgacaaataaa

SEQ ID NO: 1611 - DNA, 2664 bp, Rattus norvegicus
  Genbank Accession No. NM_013134
atgttgtcaagacttttccgtatgcatggcctctttgtggcctcccatccctgggaggtaattgtgggaacggtgacacttactatctgtatgatgtccatgaacatgttcaccggcaacaacaagatctgtggttggaattatgagtgcccaaaatttgaagaggacgtgctgagcagcgacatcatcatcctcacgataacccggtgcatcgccatcctgtacatctacttccagttccagaacctgcgtcagcttgggtcaaagtacattttgggtattgccggcctcttcacaattttctcaagtttcgtcttcagcactgtcgtcattcatttcctcgacaaagaattgacaggcttaaatgaagctttgccctttttcctgctcttgattgacctttctagagcgagtgcattggccaagtttgccctgagttcaaactcacaggatgaagtaagggagaatatagcgcgtgggatggcgatcctgggccccacgttcacccttgacgctctggtggaatgtcttgtgattggagttggcaccatgtcaggggtgcggcagcttgagatcatgtgctgctttggctgtatgtccgtgcttgccaactactttgtcttcatgacattcttcccagcctgcgtgtccctggtcctagagctttctcgggaaagccgtgagggtcgtccaatttggcagctcagccattttgccagagttttagaagaagaagagaataaaccaaacccagtaacccaaagggtcaagatgatcatgtctttaggcctggttcttgttcacgctcacagtcgctggatagctgatccttctcctcagaacagcacagcagaacagtctaaggtttccttgggtctggctgaagatgtgtccaagagaattgagccgagtgtttctctctggcagttttacctctccaagatgatcagcatggacatcgagcaagtgattaccctgagcttagcgttgcttttggctgtcaagtatattttctttgaacaagcagagacagaatcaacactctcattaaaaaatcctatcacatctcctgtcgtgaccccaaagaaagctcaagacaactgttgtagacgtgagcctctgcttgtgaggaggaaccagaagctttcgtcagtggaggaggatccaggagtgaaccaagacagaaaagttgaggttataaaacctttagtggcagaagccgagacttcgggcagagctacgtttgtgcttggcgcctctgcagccagccctccattggccctgggggcacaggagcctgggatcgaactccccagcgagcctcgacctaatgaagagtgtctacagatactggagagtgcagagaaaggtgcgaagttccttagtgatgcagagatcatccagttggtcaatgctaagcacatcccagcctacaaactggaaaccctcatggagacgcacgagcgtggtgtgtctattcgccggcagctcctctccgccaagcttgcagagccatcttctctgcagtacctgccttacagagactataattactccttggtgatgggagcttgctgtgagaacgtgatcggatatatgcccatccctgttggagtggcaggacctctgtgcctggatggaaaagagtaccaggtgccaatggcaacaacagaaggttgtcttgtggccagcacgaacagaggctgcagagcgatcagtcttggtggaggtgccagcagccgggtccttgcagatgggatgagccgaggcccagtggtgcgtcttcctcgtgcttgtgactcagcagaggtgaagagctggcttgaaacacctgaagggtttgcagtggtaaaggaggccttcgacagcacgagcagatttgcacgtctacagaaacttcacgtgacgctggcaggacgcaacctctacatccgtctccagtccaaaacgggggacgccatggggatgaacatgatttccaagggtacggagaaagcacttctgaagctgcaagagggcgtgccggagctgcagatactggcggtcagtggtaactattgcaccgacaagaaacctgctgccataaactggatcgaagggagaggaaagactgtggtttgtgaagctgtcattccagccaaggtggtgagagaagtattaaagacgactacggaagctatggttgacgtaaacattaacaagaatcttgtgggctctgccatggctggtagcataggaggctacaacctccatgctgccaacatcgtcactgccatctacattgcatgtggccaggatgcagcacagaatgtggggagttcaaactgtattacgttaatggaagcaagtggtcccacaaatgaagacttatacatcagctgtaccatgccgtctatagagatcggaaccgtgggtggtgggaccaaccttctacctcagcaagcctgcctgcagatgctaggtgttcaaggggcgtgcaaagacaatcctggagaaaatgcacggcagcttgcacgaattgtgtgtggcactgtgatggctggtgagttgtccttgatggcagcattggcagcaggacatcttgtcagaagtcacatggttcacaacagatcaaagataaatttacaagatctgcaaggaacatgcaccaagaaggcagcttga

SEQ ID NO: 1612 - DNA, 8806 bp, Rattus norvegicus
  Genbank Accession No. NM_013138
ccggatcgtccaagtcgccgggctgcgaggtggcactgcgctcctttccgcccagcgcgcctcagtcctctgcaccgagcctggcagctcgcttctgggcgactttgccgcctcgagccccggaggccaaagccatgaatgaaatgtccagctttcttcacatcggggacattgtgtccctgtacgccgagggctctgtcaacggcttcatcagcactttggggctggtggatgaccgttgtgtggtggagcctgcagctggggacctggacaacccccccaagaagttccgagattgcctcttcaaagtgtgccccatgaaccgctactccgcacagaagcagtactggaaagccaagcagactaagcaggacaaagagaagatcgccgatgtggtgttgctgcagaagctgcagcatgcagcccagatggagcagaagcaaaacgacacagagaacaagaaggtgcacggggacgtggtgaagtacggcagcgtgattcagcttctgcacatgaagagcaacaaatacttaacggtgaacaagcggctgccggccctgctggagaagaacgccatgcgggtgacgctggacgcgacgggcaacgagggctcctggctcttcatccagcccttctggaagcttcggagcaatggggataacgtggttgtgggggacaaggtgatcctgaaccctgtcaacgcagggcagcctctacacgccagcaactatgagcttagtgataacgttggctgcaaggaggtcaactctgtcaactgcaacaccagctggaagatcaacttattcatgcagttccgggaccatctggaggaggtgttgaaggggggagacgtggtgcggctgttccatgcagagcaggagaagttcctgacctgtgacgagtaccggggcaagcttcaggtgttcctgaggaccacgctgcgtcagtccgccacctcggccaccagctccaacgcgctctgggaggtggaggtggtccaccatgacccctgccgcggcggagcgggacactggaatggtctgtacaggttcaagcacctggccacgggcaactatctggcggctgaggaaaaccccagctacaagggtgatgtctcagatcctaaggcagcaggaccaggggcccagagccgcacaggccgcagaaacgccggcgagaagatcaagtaccgtctggtggctgtgccacatggcaacgacatcgcgtctctcttcgagctggaccccaccacgctgcagaaaaccgactccttcgtgccccggaactcctacgtgcggctgcggcacctctgtaccaacacctggatccagagcacgaacgcgcccatcgacgtggaggaggaacggcctatccggctcatgttgggcacgtgccccaccaaggaggacaaggaggcctttgccattgtgtcggttcccgtgtctgagatccgcgacctggactttgccaacgatgcaagctccatgctggccagcgctgtggagaaactcaacgagggcttcatcagccagaacgaccgcaggtttgtcatccagctgttggaggacttggtgttttttgtcagcgatgttcccaacaatgggcagaatgtcctggacatcatggtcaccaaacccaaccgagagcggcagaagctgatgcgggacgagaacatacttaagcagatctttggcatcctgaaggctccattccgtgacaaggggggtgaagggccattggtgcgtctggaggaactgtctgaccagaagaacgccccctaccagtacatgttccgcctgtgttaccgggtgctccggcactcccaggaggactaccgtaagaaccaggagcacatagccaagcagttcgggatgatgcagtcacagattggctatgacatcctggccgaagacaccatcacggccctgctgcacaacaaccggaagctgctggagaagcacatcaccaagaccgaggtggaaaccttcgtgagcctcgtgcgcaagaacagggagcccaggttcctggactacctctccgacctgtgcgtgtccaaccgcattgccatccccgtcacccaggagctgatttgcaagtgtgtgctggaccccaagaacagtgacatccttatccagactgagcttcggcccgtgaaggagatggctcagtctcacgagtacctcagcatcgagtactcggaggaggaggtgtggctcacatggacggacaggaacaacgagcatcacgagaagagtgtgaggcagctggcccaggaggcaagggccggcaacgcacacgacgagaacgtgctcagctactacaggtaccagttgaagctgtttgcccgcatgtgcctagaccgccagtacctggccatcgacgagatctccaagcaactgggtgtggagctgcttttcctatgcatggcggacgagatgctgccctttgacctccgcgcctcattctgccacctgatgctacatgtgcacgtggaccgtgacccccaggagctggtgacccctgtcaagtttgcccgcctctggacagagatccccacggccatcaccatcaaagactatgattccaatctcaacgcctcccgagatgacaagaaaaacaagtttgccagcaccatggagttcgtggaggattaccttaacaacgtggtcggcgaggccgtgccctttgccaacgatgagaagaacatactgacctttgaggtggtcagcctggcacacaacctcatctacttcgggttctacagcttcagcgagctgctgcgactcacacgcacgttgctgggcatcatcgactgcattcaggcaccagccgctgtgctgcaggcctatgaggagcctggcggcaagaacgtgcggaggtccatccagggggtgggacacatgatgtccaccatggtgctaagccgcaagcagtctgtatttggtgcctccagcctgcctactggagtgggtgtccccgagcagctggacagaagcaaatttgaggacaatgaacacaccgtggtgatggagaccaagctgaagatcctggagatcctgcagttcatcctcaacgtgcgcctagactaccgcatctcctacctgctgtcggtcttcaagaaggagtttgtggaggtctttcccatgcaggacagcggggcagacggcacagcccccgccttcgattcctctactgccaacatgaatctggaccgcatcggggagcaggcagaggccatgtttggagtagggaagaccagcagcatgctagaggtggatgacgaagggggtcgcatgttcctgcgagtgctgctgcacctcaccatgcacgactacccacctctggtctccggcgccctgcagctgctcttcaaacatttcagccagcgccaggaggccatgcacaccttcaagcaggtgcagctgctcatctcagcccaggatgtggagaactacaaagtgatcaagtcggaactggatcgactgcggacgatggtggagaagtcggagctgtgggtggacaagaaaggcagcgtcaagggcgaggagggggaggcgggcgccagcaaggataagaaggagcggccctcggatgaggagggatttctgcagccacacggggagaagagcagtgagaactaccagattgtcaaaggcatcctggagaggctgaacaagatgtgtggggtcggggagcagatgcgaaagaagcaacagagactgctgaagaacatggacgcccacaaggtcatgctggacctgctgcagatcccttatgacaagaacgacaacaagatgatggagatcctgcgctacacacaccagttcctacagaagttctgtgccgggaaccctggcaaccaggcccttctgcacaagcacttgcagctcttcctcacgcccgggctcctggaggctgagaccatgcagcacattttcctcaacaactatcagctgtgctctgagatcagcgagccggtgctgcaacacttcgtgcactgctggccgacacacgggcgccacgtgcagtacctggacttcctgcataccgtcatcaaggccgagggcaagtacgtgaagaagtgtcaggacatgatcatgaccgagctgaccaacgcaggcgacgacgtggtggtgttctacaatgacaaggcctctctggcccatctgctggacatgatgaaggcagcccgagatggcgtggaggaccacagccccctcatgtaccacatctccctggtggacttgctggctgcctgtgcagaaggcaaaaatgtctacacagagatcaagtgcacttccctgctgcctctagaggacgtggtgtcggtggtgacccacgaggactgcatcacggaggttaaaatggcgtatgtgaacttcgtgaaccactgctatgtagacacggaggtggagatgaaggagatctataccagcaaccacatctggacgctcttcgagaacttcaccctggacatggctctggtctgtaacaagcgggagaagcgcctgtcagaccccacccttgagaagtacgtgctcaccgtggtgctggacaccatcagcgccttcttcagttccccattttcagagaacagcacatccctacagacgcatcagacaattgtggttcagctgctgcagtccaccacccggctgctcgagtgtccttggctgcagcagcagcacaagggctcggtggaggcctgtgtccgcaccctcgccatggtggccaagagtagagccatcttgctgccgatggatctggatgcccacatgagcgctctgctcagcagtgggggcagctgctcagccgcggcccaacgcagcgctgccaactacaagacggccacgaggaccttccctcgggtcatccccaccgccaaccagtgggactacaagaacatcattgagaagttacaggacatcatcacggccctagaagagcggctgaagcctctggtgcaggccgagctctcggtgctggtggacatgctgcactggcccgagctgctctttctagagggcagtgaggcctaccagcgctgcgagagtggcggcttcctgtccaagctcatccgtcacaccaagggtctcatggagtcggaggagaagctgtgcgtgaaggtgctgcggacgctgcagcagatgctgcagaagaagagcaagtatggggaccggggcaaccagctaaggaagatgctgctgcagaattacctccagaaccggaagtccggtccccggggcgagctcactgaccccacaggctctggcgtggatcaggactggtccgccatcgcagccacccagtgccggctggacaaggagggggccaccaagttggtgtgtgatctcatcaccagcaccaagaacgagaagatcttccaggagagcatcggcctggccatccgcctgctggacgggggcaacactgagatccagaagtctttctacaacctgatgacaagtgacaagaagtcagagcgcttcttcaaagtgctgcatgaccgcatgaagcgtgcccagcaggagaccaagtccacagttgccgtcaacatgagtgacctgggcagccagcctcgtgaggaccgtgagccagcagaccctaccaccaaaggtcgcgtgtcctccttctccatgcccagctcctcccgatattcgctgggccctggcttgcaccgggggcacgacgtgagcgagcgtgcgcagaacaacgagatggggacctcggtgctcatcatgcggcccatcctgcgcttcctgcagctgctgtgtgagaaccataaccgggacctgcagaacttcctgcgctgtcagaacaacaagaccaactacaacctcgtgtgtgagaccctgcagttcctggacatcatgtgtggcagcaccacagggggcctggggctgctggggctctacatcaacgaggacaatgtgggcctggtcatccagaccttggagaccctcacagagtactgccagggcccgtgccatgagaaccagacctgcatcgtgactcacgagtccaacggcattgacatcatcacggcgctgatcctcaatgacatcagcccgctctgcaagtaccgcatggacctggtgctgcagctcaaggacaatgcctccaagctgctcctggctctgatggagagtcgacatgacagcgagaatgcagaacgcatcctcatcagccttcggcctcaggagctggtggacgtgatcaagaaggcctacctgcaggaggaggagcgggaaaattccgaagtgagcccacgtgaagtgggccacaacatctacatcctggcactgcagctttccaggcacaacaagcagctacagcacctgctgaagccggtgaagcgcatccaggaggaggaggccgagggcatctcttccatgctcagcctcaacaacaagcagctctctcagatgctcaagtcctcagcccctgcccaagaggaggaggaagacccgctggcctactatgagaaccacacctcgcagattgagattgtgcggcaagaccgaagcatggagcagatcgtgttcccggtacctgccatctgccagttcctgacagaggagaccaagcaccggctcttcaccaccacggagcaggacgagcagggcagcaaagtgagcgacttcttcgaccagtcctccttcctgcacaacgagatggagtggcagcgccggcttcgcagcatgccgctcatctactggttctcccgccgcatgacgctgtggggtagcatctccttcaacctggcagtgttcatcaacatcatcattgccttcttctacccctacgtggaaggcgcgtccacgggcgtgctgggctccccactcatctcgctcctcttctggatcctcatctgcttctccattgccgcgctgttcaccaagcactacagcgtccgtcccctcattgtggcactggtccttcgctccatctactacctgggcattgggcccacgctcaacatcctgggtgctctcaatctgaccaacaagatcgtgtttgtggtgagctttgtgggcaaccgcggcaccttcatccgtggctataaagcaatggtcatggacatggagttcctgtatcacgtgggctacatcctgacgagtgtcctgggcctctttgctcatgagctcttctacagtatcctgctctttgacctcatctaccgagaggagacgctgtttaatgtcatcaagagcgtgacccgcaatggccgctccatcctgctaactgccctgctggccctcatccttgtctacctcttctccatcgtgggcttcctcttcctcaaggatgacttcatcctggaggtggaccggctgcctgggaaccactccagagccagcaccctggggatgccacacggagctgccacatttatgggcacatgtagtggggacaagatggactgtgtctctgaggtctcggtgcctgagatcctagaagaggacgaggagctggacagcacagagcgggcctgtgatactctgcttatgtgtattgtcaccgtcatgaaccacggactgaggaacggtggcggcgtgggcgacatcctccgcaagccctccaaagacgagtcgctcttcccagccagggtggtgtacgacctcctgttcttcttcattgtcatcattattgtcctgaacctcatctttggggtgatcatcgacaccttcgccgacctgcgcagcgagaagcagaagaaagaggaaatcctcaagaccacgtgcttcatctgtggtctggagagggacaagtttgacaacaagacagtgtcctttgaagagcacatcaaactggagcacaacatgtggaactacctgtacttcattgtgctggtccgtgtcaagaacaagacagactacacgggccccgagagctacgtggctcagatgatcaagaacaagaacctggactggttcccacggatgcgcgccatgtccttggtgagcggcgagggcgagggcgagcagaacgagatccgcatcctgcaggagaagcttggctccaccatgaagctggtctcgcacctcaccgcccagctcaatgagctcaaggaacagatgacggagcagcggaagcggaggcaacgtctgggcttcgtggacgtgcagaactgcatgagccgctgagcagagcggagcctcggaggcccccacgggaggccggcttgcccacagctgccgcccttccttcaggtcaggtagaagccaggtgcctgccccatcttcagctcagctgccaccctccctccccaagccaggctctggccagcgggagtgccagagcagagcacggtcctgcttagtaagtacccttgaagagactcggtttaccttagtgccttaggggatgcaagttctccagactgctgtccttcgaagcagtgactggcatttctcagtggccctggcaggtggttaaaagtgggctggctctcacctccaagcactacattgtggctgtcccctgcctgccaccctggctaggaaggtggtagcctgctgttattagcttcctagggctttgatatttaacttattctgggggccatcccaacctcctgtggcctgctggggacagtgtggccccgtcccaggagcctcatgactcaggtggaccttgctcccaggactttctctaggctttgtaggcaagcctcacaagcccagcaacaggcctgggctgtgtgacagtggcttctctctttttggtgtaatgttttacatgtcctgtgtcctggagactaatgtgttaattgccttaaataaattaatagactccaaaaaaa

SEQ ID NO: 1613 - DNA, 1500 bp, Rattus norvegicus
  Genbank Accession No. NM_013144
cgccgagcacaaacccagcgagcattgaacactgcacacggccatctgcccagagagctgtgaccaccacttccgctactatctactcagaaagtcgtgactactgagccactgctgcctgcccagattctcatccaccgcctgctgcgtctggttgcgatgccggagttcctaactgttgtttcttggccgttcctgatcctcctgtccttccaggttcgcgtagtcgctggagccccccagccatggcactgtgctccctgcactgctgagaggctggagctctgtccacccgtgcctgcttcgtgccccgagatttctcggcctgcgggctgtggctgctgcccgacatgtgccttgccactgggtgctgcctgtggtgtggccactgcgcgctgcgctcagggactcagctgccgtgcgctgccaggggagcctcgacctctgcatgccctcacccgtggccagggagcctgtgtactagaacctgccgcacccgccacgagcagcttgtccggttctcagcatgaagaggcaaaggctgctgtggcctctgaggatgagcttgccgagagcccagagatgacagaggaacagctgctggatagcttccacctcatggccccatcccgtgaggaccagcccatcctgtggaatgccattagcacctacagcagcatgcgggcccgggagatcactgacctcaagaaatggaaggagccctgccaacgggaactctataaagtgttagagagattagctgccgctcaacagaaagcaggagatgagatctacaaattttatctgccaaactgcaacaagaatggattttatcacagcaaacagtgcgagacatctctggatggagaagctgggctctgctggtgtgtctacccatggagtgggaagaagatccctggatctctggagaccagaggggaccccaactgccaccagtattttaatgtgcaaaactgaaagttgtttcctccctccttcttcacacaaaatatttaagtatatagtgtatttatactccggagcacaccattttatatatgtgtatatgtatatatccaggaactagtttttatactccacatgctgcttgatgtacaagtgggtttgtatttattcactctaagtttatttttttctaccctgtccttgtgctgtattaatttatataactgaagcttttctcatctccatacatgtaaatactaccatctcagctcttccagagttctgctttgaaagggcagcgcggtagtgcctagaacgagcacaagtcagtctgaggtaggggcctttcagtgggttcagggaggaaggttagccctggctcggggagacttcctcatcgaatcccacaggtctgtgtctgatgcctattggctgggaaggttccgatgttggttgtgtaatcaaagctaaacgtggaaagctgcgtcccatgcactgttaaacacacgtctggaataaaacattctacctgga

SEQ ID NO: 1614 - DNA, 1200 bp, Rattus norvegicus
  Genbank Accession No. NM_013154
catgagcgccgctcttttcagcctagacagcccagcacgcggcgcaccctggcccacagagcccgcggccttctacgagccaggcagggtgggcaagccaggacgagggccggagcctggggatctgggggagccgggctccacgacccctgccatgtatgacgacgagagcgccatcgacttcagcgcctacattgattccatggctgccgtgcccaccctagagttgtgccacgacgagatcttcgccgacctcttcaacagcaatcacaaagcggccggcgcgggcagcctggagctgctgcagggcggccctacgcgacccccgggtgtggggtcaatcgccaggggcccgctgaagcgcgaacccgactggggcgacggcgacgcgccgggctccctgctgccggcgcaagtggcagtgtgcgcgcagacagtggtgagcttggcggccgcggcacagcccacaccacccacttcgcccgagcctcctcgaggcagccctggaccgagccttgcgcctggccccgtccgagagaagggcgccggcaagaggggtccggaccggggcagccctgagtaccggcagcgacgcgagcgcaacaacatcgctgtgcgcaagagccgggacaaggccaagcgccgcaaccaggagatgcagcagaagctggtggagctgtcggccgagaacgagaagctgcatcagcgtgtggagcagctcacccgggacctggccagcctccggcagttcttcaaagagctgcccagcccgcctttcctgccgcccaccggcaccgactgccggtaacgcgcggtgtgggccttagagactccgaacgaccgatacctcagaccccgacggcggggagcagacgccgcccgaattgctacagtttcttgggcactggactgcgagagaagctatatgaatcccccttaaattatttttttataatggtagcgttttctacgtcttattaccattgcagctaaggtacattgtagaaaagacttttccgacagacttttgtagataagaggaagagactgcgcatgctttttatattcatttttacagtatttgtaagaataaagaagcatttaaattgcaaaaaaaaagaggcaccagctctgactggcctctttctaggctacggtgatcctgagcatcttttgttacctgctggtagaaatgatcct

SEQ ID NO: 1615 - DNA, 1386 bp, Rattus norvegicus
  Genbank Accession No. NM_013156
aattccgcggcgacctccggggatccgagtttgcagactacgtgtgtgcgcagctagccacctcaggtgtttgaaccatgacccctttactcctcctggctgtcctctgcttgggaacagccttagccactccaaaatttgatcaaacgtttaatgcacagtggcaccagtggaagtccacacacagaagactgtatggcacgaatgaggaagagtggaggagagcagtgtgggagaagaacatgaggatgatccagctacacaatggggagtacagcaacgggaagcacggctttaccatggagatgaacgccttcggtgacatgaccaatgaggaattcaggcagatagtgaatggctatcgccaccagaagcacaagaagggaaggttatttcaggaacctctgatgctgcagatccccaagactgtggactggagagaaaagggttgtgtgactcctgtgaagaatcagggccagtgtggttcttgctgggcttttagcgcatcgggttgcctagaaggacagatgttccttaagactggcaaactgatctcactgagtgaacagaaccttgtggactgttctcacgatcaaggcaatcagggctgtaatggaggcctgatggattttgctttccagtacattaaggaaaatggaggtctggactcagaggagtcttatccctatgaagcaaaggatggatcttgtaaatacagagctgagtatgctgtggctaacgacacagggtttgtggatatccctcagcaagagaaagccctcatgaagcctgtagcgacggtggggcctatttctgttgccatggatgcaagccatccgtctctccagttctatagttcaggtatctactatgaacccaactgtagcagcaaggacctcgaccatggggttctggtggttggctatggttatgaaggaacagattcaaataaggataaatactggcttgtcaaaaacagctggggtaaagaatggggtatggatggctacatcaaaatagccaaagaccggaacaaccactgcggacttgccaccgcagccagctatcctatcgtgaattgatggacagcgataataaggactgacggacactacatccgaaggagttcatcttaaaactgaccaaacccgtctctgagtgagaccatggtacttgaatcgttcaggatccaagtcacgatttaaattctgttgacatttttacatgggttaaatgttaccactacttaaaactcctgttataaacagctttataatattggacacttaatgcttaattctgattctggaatatttgttttataaaagttgtataaaactttctttaccttttaaaaataaattttagctcagtgcaaaaaaaaaa

SEQ ID NO: 1616 - DNA, 4276 bp, Rattus norvegicus
  Genbank Accession No. NM_013159
gcggctgcgcggggtatgcggaacgggctcgtgtggctgctgcaccccgcgctgcccagcaccttgcactccatcctcggcgctcgcccgcctcccgtgaagcgactgtgtggattcccaaaacaaatttacagcacaatgaataatccggccatccagagaatagaagaccatattgtcaagtctcctgaagacaaacgggaatatcgtggactagaactggccaatggtatcaaagtgcttctcatcagtgatcccaccacggacaagtcatcagcagcactcgacgtgcacatagggtcactgtcagaccctccaaatattcctggcttaagccatttttgtgagcatatgctgtttttgggaacaaagaaatatcctaaggaaaatgaatacagccagtttctcagtgaacatgctgggagttcaaatgcatttaccagcggagaacacaccaattattatttcgatgtttcccatgaacacttggaaggagccctggacaggtttgcccagtttttcctgtgccccttgtttgatgcaagttgtaaggacagagaggtgaacgctgtcgattcagagcatgaaaagaatgtgatgaatgatgcctggagactcttccagctggaaaaggctacagggaatcccaagcaccccttcagcaaattcgggacaggaaacaaatatactctagagactcgacccaaccaagaaggcatcgatgtaagggaagaactcttgaaatttcactctacgtattattcgtccaatctgatggcgatttgtgttttaggtcgagaatctttagatgacctgactaatctggtggtgaagttattttctgaagtagagaataaaaatgtccctttgcctgaatttcctgagcaccctttccaagaagaacatcttaaacaactttataaaatagtacccattaaggatattaggaatctttatgtgacatttcccataccagaccttcaacagtactacaaatccaatcccggtcattatctcggtcatctgatcgggcatgaaggtcctggaagcctgttgtcagagctcaagtcaaagggctgggtaaacaccctggttgggggacagaaggaaggagcccgaggttttatgttttttatcattaatgtggacttaactgaagaagggttattacatgttgaagatataattttgcacatgtttcaatacattcagaagctacgtgctgaaggacctcaagaatgggttttccaagagtgcaaggacttgaacgctgtcgctttcaggtttaaagataaagagaggccacgaggctacacatctaagattgcagggaaattgcactattatcccctaaatggagtgctcacagctgaatatttactggaagaatttagacccgacttgatagacatggttcttgataaactcagaccagaaaatgtccgggtggcaatagtttctaaatcatttgaagggaaaactgaccgcacagagcagtggtatggaacccagtacaagcaagaagctatcccagaggacgtcattcagaaatggcaaaatgctgacctgaatgggaaatttaaacttccaacaaagaatgaattcattcctacaaattttgagattttggcattagaaaaagatgcaacaccataccctgctcttattaaggatacagccatgagtaagctgtggttcaaacaagatgataaatttttcttgccgaaagcttgtctcaactttgaatttttcagcccgtttgcttatgtggaccccttgcactgtaacatggcctatttgtaccttgaactcctcaaagactcactcaacgagtatgcatatgcagcagagctagcaggcctgagctatgatctccaaaacaccatctatgggatgtatctctcagtgaaaggttacaatgacaaacagccaattttgctaaagaagatcaccgagaaaatggctacttttgagattgataaaaaaagatttgaaattatcaaagaggcgtacatgcgatctcttaataatttccgggctgagcagcctcaccagcacgccatgtactacctccgtctgctgatgactgaagtggcctggaccaaagatgagttaaaagaagccctcgatgatgtgaccctcccccgtcttaaggccttcatacctcagctgctgtcccggctgcatattgaagcccttctccatggcaacataacaaagcaggctgccttaggagttatgcagatggtagaagacacccttattgagcatgctcacaccaaacctctccttccaagtcagctagtccggtacagagaagttcagctccccgaccgaggatggtttgtttaccagcggaggaacgaagtccacaataactgtggcattgagatttactaccagacagacatgcagagcacctcggagaacatgttcctggagctcttctgccagattatctctgagccttgcttcaacactctgcgtaccaaggagcagcttggctatattgtcttcagtggacctcgtcgggccaacggcatccagggcttgcgattcatcatccagtcagaaaaaccacctcactacctggaaagcagagtggaagccttcttgatcaccatggaaaaggccatagaggacatgacagaggaggctttccaaaaacacattcaggcgttagcgattcgccgactcgacaaaccaaagaaactctctgcagagtgcgcgaagtactggggggagatcatctcccagcagtacaattatgacagagataacatagaggttgcatatttaaagacactcagcaaggatgatatcatcaaattctacaaggaaatgttggctgtggacgcaccaaggagacataaagtatccgtccacgttcttgccagggaaatggattcttgtcctgtggttggagagttcccctctcagaatgatataaacctttccgaagcgccacccttgccacaacctgaggtgattcataacatgactgaattcaagcgcggcctgccgctgttcccccttgtgaagccacacattaacttcatggcggcaaaactctgaagaagcagctgcgcccctgtgccttccggggccaggaaagcagtctcagctttgagtagtttctggcttgcaattagagagacaaacagaaaagagttatcaggcattattatgtagaatgttaaaaacccaaagtaataaaattataaagtcttatagatgtagaatatttttaaaatctcttaaatattttaatgtttttctttttattcctaaaagaaatttccttatattaactgcttaatctgaagaaagatatctcagtacaatctttcttccttattctgtaaaatagtcacttgtctgaaaaaaaaataagagcttttttttcttaaaggcttcagaacacttagaaaggattacctttttaagacgcgatcaagctcagatctgcttctgtcgatggttcctgtgaaccagcagagcatcgcggtgggcagatagtgcacaaagcggttccgcgttcctttactagtgaacctgctgattaactaaggcatggttttaatgtttttataaaacttgggtatgttttttaaccttcttagtcaaatgctagaaaacccagaatacccaatttacagtgctagaaatgcagattaaccttgaatcaagttcggaatttctcaggattcctgtgggttctctctcatcgaattctgttgacatttctgtttctcgtagttggtctgctgggttccatcagcagacacatactgctgtacagcgtgtgagacatgctgtgctgacatcagctgttgtgactccccgtaactcctagggtgaagttgtgatccgtgtgtgaactaaaacatttgcccctttagggactcaaaaggcagcaaatacaaagccacctccttggaggatacaaaactgtggcgttcttaaacagccagtctccgtaagactctaaactccccactgcttccggtctcatcttgccttaagtgttattttttgaatatatgaatataaacatacagatgatgactggagtggacttttaaaaaatatttttttcacaagatactattttaggtgaaaatgttactgtagatttaacagctgttttaaagtatttgctattattaaaacttcttcaagaacaagcgtggctatgctcccacacacaggcaatagtaacagaaagtgctcctgtttgtccaccagctcaggcaaagtacagaatggcgtttcc

SEQ ID NO: 1617 - DNA, 2633 bp, Rattus norvegicus
  Genbank Accession No. NM_013174
gccaagcagcgttgggcgatatcagatatccgttctatttatttttacctaaggaaaaactccagctctcttcccactcccagctgccttgccacccctcccaaccctcggcttgccctccacctggcctgctgggagtcagagcccggcagaacctgtttagacatatggacaagaatcccagcgctacacagcacacagtccgctacttcgtcccggggttgccagcgcttcctgggagtcctgaagctcacacagcgcagtgagttcatgcaccctcttgccaagcctcagtctttgggatctggggaggacgcctggttttcctccccctttctactggggtctcctccttgccaggcctccccagtcccctggcctcgttcctgggttcacacatgaagatgcacttacaaagggctctggtggtcctggccctgctgaacttggccacagtcagcctctctctgtccacttgcaccaccttggacttcggccacatcaagaagaagagggtggaagccattaggggacagatcttgagcaagctcaggctcaccagcccccctgagccgtcggtgatgacccacgtcccctatcaggtcctggcactttacaacagcacccgggagttgctggaagagatgcacggggagagggaagaaggctgcactcaggaaacctcggagtcagagtactatgccaaagagatccataaattcgacatgatccaggggctggcggagcacaatgaactggcagtctgccccaagggaattacctctaaggttttccgtttcaatgtgtcctcagtggagaaaaatggaaccaatctgttccgggcggagttccgggtcttgcgggtgcccaaccccagctccaagcgcacagagcagagaatcgagctcttccagatacttcgacctgatgaacacatagccaagcagcgctacataggtggcaagaatctgcccacgagaggcaccgcagagtggctgtccttcgatgtcactgacactgtgcgcgagtggctgttgcggagagagtccaacttgggtctggaaatcagcatccactgtccatgtcatacctttcagcccaatggagacatactggaaaatgttcacgaggtgatggaaatcaaattcaaaggagtggacaacgaagatgaccatggccgtggagacctggggcgtctcaagaagcagaaggatcaccacaacccgcacctgatcctcatgatgattcctccacaccgactggacagcccaggccagggcgggcagaggaagaagagggccctggacaccaattactgcttccgcaacttggaggagaactgctgtgtgcgccccctctacattgacttccggcaggatctaggctggaaatgggtccacgaacctaagggttactatgccaacttctgctcaggcccttgcccttacctccgcagctcagacacaacccacagcacggtgcttggactatacaacaccctgaacccggaggcatcggcctcgccatgctgtgtgccccaagacctggagcctctgaccatcttgtactatgttggcagaacccccaaggtggagcagctgtccaacatggtggtgaagtcgtgtaagtgcagctgaggccagtctgcaacagaggaggggaaactgccaccaccgactgctgctccttggaaaaccaaagcaacagacctcaccctagagcctggagcccacaagccctggctcccgatggcgaaaggccgagagggaggcttccttctggaacatttctttctgctagctctgagaatcactgtggtaaagaaagtgtgggttggttaggggaaggcaaactggtgagaacatggatttctgtggtgcaggcagaggtggtggggtagagaagagataatgagtggacgttgtgagtggcaaggctccggctaccctagggaagatgaagggcagagtggtcaggtgaaggccagactggaaggcacttcagatatgaggtcagctttgctcatggcagtacatctgctctagggaatcgggatgttgttaaaggcaacagcatttttcttcagtttaccaagccaaagtcccctggaattgtatcttgaactgcctggaattaaggacaatctgttcttttgcaaacagtcttttcacctcgatcagcatcatgagtcattacagataatgtaattagtttctgggccagcaactagctatctcaggtccctcagagatgctggactcaaaggcagaggtcagaattggttctctcatgtattccctcgggccccctccttctgccttccttcttggccgtatttccccttggacatttggctagacaccttccgggtcagggtgcattctctggattctggatcccacacagcctggggcatcagacatcgtttccctcctaccctagaccccgtgcctccccgggtgttcctggaagcaggtgctacatgcaggagttatccggggagcctcccatgtctgacatgatgactcggccccagatgcacagactgaagtatacagacaaatacaaatattactctcagaatctttgtataaataaatatttttggggaatcaaaaaaaaaaaaaaaaaaa

SEQ ID NO: 1618 - DNA, 1433 bp, Rattus norvegicus
  Genbank Accession No. NM_013181
ggcgttgagggaggcagacgcgaggaggaacggaggagaggcggagatcaccgaacagcagaacaatctagaggatccctcgacacctgagaaccatggcgtctggcagtatggcagccagtgaggaagagcggagtctccgggaatgcgagctctatgtgcagaagcacaacatccaggccctgctgaaggactccatcgtgcagctgtgcactgctcggcccgagaggcccatggcattccttcgggaatactttgagaggctggagaaggaggaggcaagacagattcagagcctacagaaatccggcattcgtacagactcgagggaggatgagatctctcctccacccccaaatccggtggtgaagggccgtcggcgccgcggtgctatcagcgctgaggtttacactgaggaagatgctgcgtcctacgttagaaaggttataccaaaagattataagacaatggctgctttagccaaggccatcgaaaagaacgtgttattttcacaccttgatgacaatgagagaagtgacatttttgatgcaatgtttccagtctcctttattgctggagagacagttattcagcaaggggatgaaggggataacttctatgtgattgatcaaggagaaatggatgtgtatgtcaataatgaatgggcaaccagtgttggggaaggagggagctttggagagctggctttgatttacggaacacccagagcagccactgtcaaagcaaagacaaacgtgaaactgtggggcattgaccgagacagctaccggagaatcctcatgggaagcactctgcgaaagaggaagatgtatgaagaatttcttagtaaagtgtctattttagagtctctggacaagtgggagcgtctcacagtagctgatgcactggagcctgtccagtttgaagatggacagaagattgtggtgcaaggagaaccgggggatgagttcttcattattttagagggcacggccgctgtgctgcagcgtcggtcagaaaacgaagagtttgttgaagtgggacgcctggggccttctgactattttggtgaaattgccctgctgatgaatcgtcctcgggctgccactgtggttgcgcgtggccctttgaagtgcgttaagttggaccgacctcggtttgaacgcgtccttggcccatgctcagatatcctcaagcgaaacatccagcagtacaacagctttgtgtcactgtccgtctgagatccgcctcctgtgcctctcctccccagtctatgcttcactcacgcagactgctttctcctccctctctgcagcgccaagtggccactggcttcacagcttcttgtctctgtatactaaaggttgctttattgcaccattttccattggagcgttactgaatgctcactcacaataaatagagttgtatgg

SEQ ID NO: 1619 - DNA, 2290 bp, Rattus norvegicus
  Genbank Accession No. NM_013183
gagcttgcaactttgaaagccacagtatggatgcccggcattggccctggtttctggtttttgccacatttctcctggtttctggcttgccagctccagaaaagtttgtcaaagacatagatgggggaatcgatcaagacatattcgatatcaatgaagatttaggactggaccttttcgagggagacatcaaactggaggcaagtgggaggaattccatcattggagacaactacagatggccacataccattccatatgttctagaagacagcttggaaatgaatgctaaaggagtaatcctcaatgcgttcgagcgctatcgccttaaaacgtgcattgacttcaagccctggtctggagaagagaactatatatcagtgttcaagggcagtgggtgctggtcttcagtgggaaacattcacgctgggaagcaagagttgtccatcgggacaaactgtgacagaatagcaacagttcaacatgagttcctccacgccctgggattctggcacgagcagtcgcgtgctgaccgagatgattacatcactatagtttgggacaggatcttgtccggcaaggaacacaatttcaacatctacaacgacagtgtgtctgattccctgaatgtcccatacgactacacctcggtaatgcactacagcaaaaccgctttccagaatgggacagagtctaccatcattacgaaaatctcagactttgaggatgtgattggccaacgaatggacttcagtgactatgaccttctgaagctgaaccagctgtacagctgcacttcttccttgagttttatggactcctgcgattttgagctggagaatatctgtggcatgatccaaagttcacaagatagcgctgactggcagcggctttcacaggttctcagtggtccggagaatgaccactccaacatgggccagtgcaaagactctggcttctttatgcacttcaacactagcactgggaatggggggatcacagcgatgctggagagcagagtgctgtaccccaagagagggtttcagtgcgtggagttttatctgtataacagtggaagtggaaatggccaactgaacgtctacacccgggagtacactgcaggccaccaggatggcgttttgacccttcagagagaaataagagacatacccactgggagctggcagctttactatgtaacactgcaagtgactgaaaaattccgagtggtgtttgaaggcgtcggaggccctggcgcatcatcgggtggtctgtctatcgatgacatcaatctctcggaaacaaggtgtccccaccacatctggcacatacagaatttcactcagcttcttggaggccagaccactgtatacagtcctccattttattcctctaaaggttacgcttttcagattaacctggatctaacatccccgaccaatgtagggctttatttccacctgatctccggggccaatgacgatcaattacagtggccgtgtccttggcagcaagccacaatgacactcttggatcagaatcctgacatccggcagcgtatgtccaaccagcggagtataaccacagacccaaagatgaccgatgataatggaagctatctttgggacaggccttccaaggtgggagtggaggcttttttccctaatggaactcagtttagcagaggcagaggctatggaaccagtgtcttcataacccaagagaggctgaagagcagagagttcttaaaaggagatgacgtttacatcttactgacggttgaagatatatctcacctcaattctacagcggctgtcccagggccagtccccaccacctcgactgtccataatgcctgctctgaggtcgaatgtcagaacggcggcatctgcactctccaagaaggcagagctgagtgcaagtgtcctgcaggagaagactggtggtacatgggcaaaaggtgtgagaagagagggtccaccaaggacacgattgtcattgctgtgtcttccacggtcaccgtgtttgccgtgatgctgatcatcacccttatcagcgtctactgcacccggaggaaatatcgtaagaaggctagtgcaaagacagcagccatgaatctagaaaaccaacatgcgttttgaatattaactcgtgccagcaggtgaaacaaaaagaaaccttctgtcgtcgtagaagaatatttcgcccaggctgtgcgacgacattcacagcatttcaaaccagaccatctctgtaaatagctgagtgcctaataaaccattattttggt

SEQ ID NO: 1620 - DNA, 2740 bp, Rattus norvegicus
  Genbank Accession No. NM_013190
ggcgacagccgcgcggaacgcagagcggcgggagaggagctcgggctcctggtctctgctgccgtcatggctaccgtggacctggagaagttgcggatgtcgggggctggcaaggccatcggagtgctgacaagcggcggtgacgcgcaaggtatgaatgctgctgtcagggctgtgactcgtatgggcatatatgtgggggccaaagtcttcctcatctacgagggctacgagggcctcgtggaaggaggcgagaacatcaagccagccaactggctcagtgtctccaacatcatccagctgggcggcaccatcattggcagtgcccgctgtaaggccttcactacgagggaagggcgcctggcagcggcctacaatctgctccaacacggcatcaccaacctgtgtgtcatcggtggggatggcagcctcacgggggccaacatcttccgcaacgagtggggcagcttgctggaggaactggtgaaggaaggcaagatctcagagtccacagctcagaactacgcacacttgagcatcgccggtctggtgggctccatcgacaacgacttctgcggcaccgacatgaccatcggcacggactcggccctgcaccggatcatggaggtcatcgacgccatcaccaccactgcccagagccaccagaggacctttgtgttggaggtgatgggacggcactgcgggtacctggcgctggtgtctgcgctggcctccggggctgattggctgttcatccctgaagcgcccccggaggatggctgggagaacttcatgtgtgagaggctgggggagactcggagccgggggtctcgactgaacatcatcatcatcgcggagggtgccatcgaccggcatggaaagcctatctcatccagctacgtgaaagacctggtggttcagaggctgggcttcgatacacgagtgaccgtgctgggccacgtacagcgaggagggacaccctcggcctttgaccgagtcctgagtagcaagatgggtatggaggccgtgatggcgctgctggaggccacgccggacacgccggcctgcgtggtcagcctctccgggaatcagtctgtgcggctgcctctcatggagtgtgtgcaagtgacgaaggatgtgcagaaggccatggatgagaagaggtttgacgaggccatccagctccgtggcaggagcttcgagaacaactggaaaatttacaagctcctcgcccaccagaaggtgtctaaggagaagtccaacttctccctggccatcctgaatgtgggagctccagcggccggcatgaacgcagccgtgcgctccgcggtacgcactggcatctccgagggacacacagtgtacgttgtgcatgatggctttgagggcctggccaagggtcaggtgcaagaagtgggctggcatgatgtggcaggttggctaggacgtggtggctcaatgctggggaccaagaggaccctgcccaagccccacctggaggccattgtagaaaatctccgtacctacaacattcatgccctgttggtgatcggtggctttgaggcctacgagggtgtgctgcagctggtggaggctagggggcgctacgaggaactctgtatcgtcatgtgcgtcatcccagccaccatcagcaacaatgtccctggcactgacttcagcctgggctcggacacggccgtcaacgctgcaatggagagttgtgaccgcatcaaacaatcggcctcggggacaaagcggcgtgtgttcattgtagagaccatggggggctactgtggctacctggccactgtgacaggcattgctgtgggcgccgatgccgcctacgtctttgaggaccctttcaacatccacgacttgaaggccaatgtggagcatatgacagagaagatgaagacagacatccagaggggcctggtgctccggaacgagaagtgtcacgaacactacaccacggaattcctatacaacctatactcctcggaaggcagaggtgtgttcgactgcaggaccaacgtgctgggccacctgcagcagggtggcgctccaacccccttcgaccggaactatgggaccaaactgggggtgaaggccatgttgtggatgtcggagaagctgcgtgatgtctaccgcaaagggcgggtgtttgccaatgctccggactcagcctgtgtgatcggcctgaggaagaaggtggtggccttcagttcggtcacagaactcaagaaagagacagattttgagcaccgtatgccgcgggagcagtggtggctgaatctgcggctgatgctgaagatgttggcacactaccgcatcagcatggccgactacgtgtctggggagctggagcacgtcacacgccgcaccttgagcatagacaagggtttctgagcttaccgatcaccctcgttcctgctctcccggactctctctccctcccagtgctagccacagatcccagcactaaggggaactcacatggaactcggagcctgtggttggttgaaggatttgggggtctactgtgctgctctgggactcctcccttagccacccccacccccccaccccctcagaacagagcacctgtggggcccttacattccagttctggctgggcagacccacatcaccactccctcactggtcagctggctgcctcaccacacggccgaaaagagcctcatggtttttttttttagaaataaagtcacctgtttag

SEQ ID NO: 1621 - DNA, 1899 bp, Rattus norvegicus
  Genbank Accession No. NM_013197
gactttgggctcaggatggtggcagcagctatgttgctacggtcctgtccagtgctctctaagggccccacaggcctcctaggcaaagtggctaaaacttaccagttcctatttggtattggacgctgccccatcctggccactcaaggaccaacctgttctcaaatccatcttaaggcaaccaaggctggagcagactctccgtcttggactaagagccattgtcctttcatgctgtcagaactccaagacaggaagagcaagattgtgcagagggcagctccagaagtccaagaggatgtcaagactttcaagacagacctgctgagcttcatggagtcaactacccgaagccaatcagtgcctcgtttccaggatccagagcagactggaggggcacctcccctgctgattcagaataatatgactggaagccaggcttttggttatgaccaattttttagagacaagatcatggaaaagaagcaggaccacacataccgtgtgttcaagactgtgaatcgctgggctaatgcctacccctttgcccaacacttctccgaggcatctatggactcaaaggatgtttctgtctggtgcagtaatgactatttgggcataagcaggcaccctcgtgtcttgcaggccatagaggagaccctgaagaatcatggagctggagctgggggcactcgcaatatctcaggtacaagcaagtttcatgtggagcttgaacaggagctggctgaactacatcataaggactcggctctgctcttctcctcctgttttgtggccaatgattctactctctttacactggccaagcttctgccagggtgtgagatctactcagacgcaggcaatcatgcctccatgatccaaggcattcgtaacagtggtgcagtcaagtttgtcttcagacacaatgacccaggccacctgaagaaacttcttgagaagtccgatcccaagacaccaaaaattgtggcttttgagactgttcactccatggatggtgccatctgtcctctggaggaattgtgtgatgtggcccaccagtacggggccctgaccttcgtggatgaagtccatgccgtaggactatatggaacccggggtgcagggatcggggagcgtgatggaattatgcacaagcttgacatcatctctggaactcttggcaaggcctttggctgtgtcggtggctatatcgccagcactcgggacttggtggacatggtgcgctcctacgctgcaggcttcatctttaccacttcactgcctcccatggtgctctctggagctctagagtctgtgcgtctactcaagggagaggagggtcaagccctgaggcgtgcacaccagcgcaacgtcaaacatatgcgccagctactaatggacaggggctttcctgttatcccctgtcccagccacatcatccccataagggtgggtaatgcggcactcaacagcaagatctgtgatcttctgctcgccaagcacagcatctatgtgcaggccatcaactacccaactgtgcctcgtggtgaggagctgctgcgcttggccccctccccccaccacagccctcagatgatggaaaactttgtggagaagttgctgctggcctggactgaggtggggttgcccctccaagatgtgtctgtggctgcatgcaacttctgccgtcgtcctgtgcactttgagcttatgagcgagtgggagcgatcctactttgggaacatgggaccccaatatgttactacctatgcctaaggagccagctgccttagatgccaaccccacctgcactccccctggggatggtcttcctcctactctctgctttgctgtgtgcttctagctgacttgattctaaaaataaagagcaacctg

SEQ ID NO: 1622 - DNA, 2826 bp, Rattus norvegicus
  Genbank Accession No. NM_013200
gacagaagcaaacctgagctgtgctgactaaaccccaggatggcggaagcacaccaggcagtagctttccagttcactgtgaccccagacggggtcgacttccggcttagtcgggaggctctgagacacatctacctgtctggaatcaactcctggaagaaacgccttattcgaatcaagaatggtatccttaggggtgtgtaccctggcagccctaccagctggctggttgttgtcatggcaacagttggttccaactactgcaaagtggacatctccatggggctggtccattgcatccagagatgcctcccgacaaggtatggctcctacgggaccccacagaccgagacacttctcagtatggtcatcttctccaccggagtctgggcgacaggcatttttttattccgacaaaccctgaagctgctgctttcctatcatgggtggatgttcgagatgcacagcaagaccagccatgccaccaagatctgggctatctgtgttcgtctcctgtccagccggcggcccatgctctatagcttccaaacatcactgcccaagcttcctgtccccagtgtgccagccacaattcaccggtacttggattctgtgcggcccttgctggatgacgaagcctatttccgcatggagtcgttggccaaagaattccaggacaagattgcccccagactgcagaaatacctggtgctgaagtcatggtgggcaaccaactatgtaagtgactggtgggaagagtacgtctacctccgaggcaggagccccatcatggtggacagcaactattacgccatggattttgtgcttattaagaacacgagccaacaagcagcacgtttgggaaacaccgttcacgccatgatcatgtatcgccgcaaactggaccgagaagagatcaagccggtgatggcactgggtatggtacccatgtgctcctaccagatggagaggatgttcaacactacacgcatcccaggcaaagagacagacttgctacagcacctctcagagagcaggcacgtggctgtctaccacaaaggtcgcttcttcaaggtttggctctatgagggctcgtgcctgctcaagccccgagacctcgagatgcagttccagagaatcctcgatgacacctccccgcctcagcctggagaggaaaagctggcagccctcaccgcaggaggaagggtagagtgggcagaagcacgtcagaagttctttagctctggcaagaacaagatgtccctggataccatcgaacgtgctgctttctttgtggccctggacgaagactctcactgttacaaccctgatgacgaggccagtctcagcctctacggcaaatccctgctgcacggcaactgctataacaggtggttcgacaaatctttcactctcatctcctgcaagaatggccagctgggcctcaacacagaacactcatgggcagatgctcccatcatcggtcacctctgggagttcgtcctggccactgatacctttcacctgggctacacggagacaggacactgtgtgggtgaacccaacaccaagttgccgccgcctcagcggatgcagtgggacattcccgagcagtgccagacagccatcgagaattcgtaccaagtagccaaggccctggctgatgatgtggagttatactgcttccagttcttacccttcggcaaaggcctgatcaagaagtgtcggaccagccctgatgcctttgtgcagattgccctgcagctggctcatttccgggacaaaggcaagttctgcctgacctatgaggcctccatgacaagaatgttccgagaggggcggacagagactgtgcgttcctgtactagcgagtccacggcctttgtgcgggccatgatgacggggtcccataaggaacaagacctccaagacctcttccggaaagcctccgaaaaacaccaaaacatgtaccgcctagccatgacaggggctgggatcgacaggcacctcttctgcctctacatcgtctccaagtacttaggggttaggtctcctttcctggacgaggtgctttcggaaccctggagcctctccaccagccagatcccccagttccagatctgcatgtttgacccaaagcagtaccccaatcatctgggtgctggaggtggctttggtcctgtggccgaccacggatacggggtttcctacatgatcgcaggcgaaaacacaatgttcttccatgtttccagcaagttatcgagttcagaaacgaacgccctgcgcttcgggaaccacatccgtcaagcactgttggatatcgccgaccttttcaaaatttccaagactgacagctgagaccaggagacacaccagctgccctttggtccccacctggtggaggaagaggtctgtggccagttcacaggcataaggggtggcatgcacacgtgcccagttctgagaccagctccagcgcaggggctccccaggcagacactgctcctccaggcccggtcgaggtgggattggagtggtgagggaactttgatctttttttttcccccggtcttggtagatgctaataaaaataaggctgtataattctctctcagcccttaggtgcctatgtttggttagagaactagaaggcctttcccctgcccctgctcaggttagggtggtggcgactgaagggccgggtgaatgttcataatggctttttacctgctttgaaatgtgtgcttttcctgaataatgcggacttcgagagtgctgtccaacctctcatgtgcacttggaataaattcttactttagaaccttt

SEQ ID NO: 1623 - DNA, 1523 bp, Rattus norvegicus
  Genbank Accession No. NM_013214
acttctacatcaagatccgtcctggggagtatgagcagttcgagagcaccatcggcttcaagctccctaaccttcaccttcattgcgccacggcggctttcggacgagcctctgactcgcgcacgcgttagactccttggtccgtgttacaagacgggtcgggtgggtagccgacatcgccgccgaccccgtgccgtcgcagccaagatgtccggtcccaccaccgacacgccggccgccatccagatctgccggatcatgcgtccggatgatgccaacgtggccggcaatgttcacggagggaccattctaaagatgatcgaggaggctggggtcatcatcagcacccggcactgtaacagccagaatggggagcgctgtgtggctgccctggcccgggtggagcgcactgacttcctgtcgcccatgtgcatcggtgaggtggctcacgtcagcgcagagatcacctatacttccaagcactctgtggaggtccaggtccacgtgttgtcggagaacatcctcacaggtaccaaaaagctgaccaataaggccaccttgtggtatgtgcccctgtcattgaagaatgtggacaaggtccttgaggtgcctcctattgtgtatttacggcaggaacaggaggaggagggtcggaaacgctatgaagcccagaagctagaacgcatggagaccaagtggaggaacggagacattgtccagcccatcctgaacccagagccgaacacagtgagctacagccagtccagcctgatccacctggtggggccctcagactgcactcttcatggcttcgtgcacggaggtgtcaccatgaagctcatggatgaggtggccgggattgtggctgcgcgccactgcaagaccaatatagtgactgcctctgtggatgctattaatttccatgacaagatccggaaaggctgtgtcatcaccatctctggacgcatgaccttcacaagcaataagtctatggaaattgaggtcctggtggacgctgaccctgtggtggacaactcacagaagcgctaccgggctgccagtgccttcttcacctacgtgtccctgaatcaggagggcaagccgctgcctgtgcctcagcttgtgccggagacggaggacgagaagaagcgttttgaagaaggcaaaggccgctatctgcagatgaaggcgaagcgacagggccatacagagcctcagccctagatgtcttcctccctcccatcctgtcccgtcctgggtcagcacagttgtggcagtagtcctgtgtgcagtcacttagaagtcgcccccttggccaaaccccgatttcctttgagagctggtgttgtgaagtaccgtgtgacagtgttacctgtggcctgttcccaaaacctgtgcaccaaagctttatttatatccctccagtccctgtcccatgttgtcccaaaggccatcgtggacaccagagcacactgactggcctggagaagccagcaccactaataaagctgctgtctggctgg

SEQ ID NO: 1624 - DNA, 1272 bp, Rattus norvegicus
  Genbank Accession No. NM_013215
gaattcgactgctggaaccaacgtcctctcttaccctccaccttcttctgccacctctaccacggtcaccatgtcgcaagcccggcctgccactgtgctgggtgccatggagatgggtcgccgcatggatgtgacctccagctccgcgtcggtgcgcgccttcctgcagcgcggccacacggagatagacaccgccttcgtgtatgcgaacggtcagtctgagaccatcctaggagacctggggctcggactgggccgcagcggctgcaaagtaaaaattgccaccaaggctgccccaatgtttgggaagacactgaagccagccgatgttcggttccagctggagacgtcactgaagaggctgcagtgtccccgggtggacctcttctatttacactttccagaccacggcactcctatagaggagaccctgcaggcctgccaccagctgcatcaggagggcaagtttgtggagcttggtctgtccaactatgtctcctgggaagtggctgagatttgtaccctctgcaagaaaaatggctggatcatgccaactgtgtaccagggcatgtacaacgccatcaccaggcaggtggagactgagctcttcccctgcctcagacacttcggactaaggttctacgccttcaaccctttggctgggggcctgctgactggcagatataaataccaggataaggatgggaagaatcctgagagccgcttctttgggaatccattttctcaactgtacatggaccgctactggaaggaggaacacttcaatggcatcgccttggtggagaaggctctgaagactacctatggccccactgcccccagtatgatctcagctgccgtacggtggatgtaccatcactcacagctcaagggcacccaaggggatgcagtcattctgggcatgtccagtctggaacaactggagcagaacttggccttggtcgaggaagggcctctggagccagctgttgtggatgcctttgaccaagcctggaacctagttgcccacgagtgtcccaactatttccgctaagatacatctgccttggggatggcgcagcttactgcctgccccgccttgtcctgggctcgatctgatctggttctttcctttttagacaggtcactgtctttttcttccctgctttctatacagccagttgctttcaaagtgagagctggctgagccccaatacctcctgctgaataaaactgttccctgtcacagcctgggctacaactggcggccga

SEQ ID NO: 1625 - DNA, 5957 bp, Rattus norvegicus
  Genbank Accession No. NM_013217
cttgcacactgccgtggtttggaagaagcgaacactgaagacgctactgttgttaatgaccatcttcctgctgtcagggtaacctggtccctgacataaggagaccccaggcagggaacgtctccctagagggcagttccccttctggaaggcagaaagcgagcggctgaacgcccgggacacgcagcgggaccgggacagcatcgcggagccagcgggatggagggcgggaggacgcgcggcggctgcggcggcggcggtggtggtggtgaggcggcctgaggtgttccggcccagcgggtcgcggagaggagccgccgcgatcatgtcggcgggcggccgcgacgaagagcggcggaagctggccgacatcattcaccactggaacgccaaccggctggacctgttcgagatcagccagccgaccgaggatttggagtttcatggagtcatgagattttattttcaagataaagctgctggaaactttgcaacaaaatgtattcgggtctctagcacagcaaccactcaagatgtcattgaaacactggcagagaagttccgccctgatatgcgcatgctctcctctcccaagtactccctctatgaagtgcatgtcagtggagaaagaagattggacattgatgagaaacctctagttgtacagttgaattggaacaaagatgatcgggagggtagattcgtccttaagaacgagaatgacgccattcctgccaagaaggctcagagtaatggacctgagaagcaggagaaagaaggtgttattcagaacttcaaaagaactctgtcaaagaaagaaaagaaggaaaaaaagaagagagagaaggaggctttgagacaagcctctgataaggaagaaaggccttctcaaggggatgacagtgagaattctcgtctggctgctgaagtttacaaagacatgcctgaaaccagctttactcgaacgatttctaatcctgaagttgttatgaaacggcggcggcagcaaaaactggagaagagaatgcaagagtttcggagctcagatgggcggcccgactcgggtggaacactgagaatctatgcagacagtttaaaaccaaatattccatacaagacaatcctgctgtctactacagatcctgcagactttgctgtagcagagtccttagagaagtatggtctggaaaaagagaaccccaaggactactgcattgctcgggttatgcttcctcctggagcccagcattctgatgagagaggtgctaaggaaataattcttgatgacgatgaatgccctttacaaatcttcagggaatggccaagtgacaaagggattttagtctttcagttgaagaggagaccaccggactacattccaaagaaaatgaagaaacatgttgaaggcaagccattgaaggggaaagatagagctgacgggtctggctacggctctgctcttcctcctgagaagctgccctacttagtagagctcagcccagggagaaggaatcactttgcctactacagctatcacacttacgaagatggctctgactccagagacaagccaaagttataccgccttcagttaagtgtgactgaagttgggacagagaagttcgatgacaattctattcagctgtttggtcctggaattcagccccatcactgtgatctcaccaacatggatggagtggtcactgtgacacccagaagtatggatgcagagacctatgtggatggtcagcgcatctcagagaccacaatgctacagagtggcatgagactgcagtttggcacctcgcatgtgtttaagtttgtggaccccatccaggaccacgttctttccaagagatctgtggatggaggcctgatggtcaagggcccaagacataaacctggagccgttcaagagacaacctttgaattgggaggagatatccacagtgggacagcattgccggcaagcaggagcactactagattggacagtgacagggtgtcctctgcctctagcacagctgagcgagggatggtgaagccaatgatccgactggaccaggagcaggactaccggcgaagagaaagcaggactcaggatgctgctgggcctgaactgatgctgcctgccagcattgaattccgggaaagctctgaagactcttttttatctgccattataaactataccaatagctctacagttcattttaagttgtcacctacatatgtgttatacatggcatgccggtatgtattgtccagccagcacaggcccgacatcagtcctacagagcggacacataaggccattgctgttgtgaacaagatggtgagcatgatggaaggggtcatccaggaagtagaccaggttgatcagaaacagaagaacattgcaggagcacttgctttctggatggcaaatgcatctgagcttctcaacttcatcaagcaggaccgagaccttagtcggattactctggatgcccaggatgttctagcacacttggttcagatggcatttaagtacttggttcactgccttcagtcagaacttaataactacatgccagcctttctggatgatcccgaggagaacagtctgcagagaccaaaaatagatgatgtgctgcatacgctcacaggagccatgtccttgttgcggcgctgcagagtcaatgccgccttgaccatccagctgttctctcagcttttccacttcatcaatatgtggctattcaacagactggtgactgacccagattcaggcctgtgttcccactactggggcgcaattatccgccagcagctggggcatattgaagcttgggcagagaagcagggactagagttggcagctgactgtcacttgagcaggatcgtgcaggctactacgttgcttacaatggataagtatgtacctgatgacattccaaatataaacagcacatgctttaagttaaattctctgcagcttcaagccctcttacagaattaccactgtgcacctgatgagccttttattcctacggatctcatagaaaatgtcgtggctgttgctgagaacacagctgatgagcttgcccgcagtgatggcagagatgtgcagttagaggaggaccctgatctacaactgccctttcttctgccagaagatggctattcctgtgatgttgtcagaaacattccaaatggtttacaagaatttttagaccctctgtgccagagaggattttgcaggttggttcctcacacacgttctccaggtacctggacaatatattttgaaggagcagattatgaaagtcacctcatgcgtgagaacacagaactgacccagcctctgaggaaggagcctgaggtaatcactgtgaccctgaagaagcagaatggaatgggcctcagcattgttgcagcaaagggtgctggccaggataaactgggaatctacgttaagtccgttgtcaaaggaggtgctgcagatgtggatggacgcctagctgctggtgaccaactccttagtgtggatggacgaagtctggttggactttctcaggaaagggcagcagaactcatgacaagaaccagttccgtggtaacactggaagttgcaaagcaaggcgctatctatcacggactggccactctccttaaccagccatcacccatgatgcagagaatttcagatcgtcgtggctcaggtaaacccagaccaaagagcgaaggttttgagctctataataattcagctcaaaacggctccccagagagtcctcagatgccttggacagagtacagtgagccaaagaagctgcctggtgacgacaggctgatgaaaaacagagctgaccaccgttccagccccaatgtggcaaatcagccccctagtcctggagggaagagtccatatacctctggaacagcagctaaaataacatctgtctctactggaaacctctgcactgaggagcagacccctccacctagacctgaagcctatcctatccctactcagacatataccagagagtattttacctttccagcttcaaagtcgcaggatcggatggctcctgttcaaaaccagtggccaaattatgaggaaaaaccacacatgcacacagaaagtgatcatgccagtattgcaatccagcgtgttacccgttcccaggaagagcttcgggaagagaaggtttaccaacttgagcgtcatcgagtagagtcaggcatggatcgcaagtgtgacagtgatatgtggatcaatcagagctcctcagtggaatctagcacgtctagccaggagcacctgaaccattcctccaagtcagttacccctgcttccactctgaccaagagtggtcctggtcgttggaaaaccccagcagctgtgctccccacccctgtggctgtctcccaacccattcgaacagacctccctccaccaccacctccaccacctgcccactacaccagtgattttgatggtatttcaatggatttgcccctcccacctcctcctgccaaccaagcagctccccagtctgctcaggtggctgctgcagagaggaaaaagagagaggagcatcagaggtggtatgaaaaagagaaggcccgcctggaggaggaacgagagagaaagcgcagggagcaagagaggaagttggggcagatgcgcactcagtccctgaaccctgcttccttctctcctttggccacacaggccaagccagaaaagccttccacactgcagaggccccaagaaacggtcattcgggagctgcagccccagcagcagccccgtactattgagcgcagggatctgcagtacataaccatcagtaaagaggagctgtcctctggggatagtctgtctccagacccatggaaacgagatgccagggagaagctggagaagcaacagcaaatgcacattgtagacatgctaagcaaggagatccatgagctgcaaaacaagggggaccgtactgcagaggagagtgaccgcctgcggaagcttatgctggagtggcagttccagaagagactacaggagtccaagcagaaggatgaggatgatgatgaagaggaagatgatgatgttgacaccatgctgatcatgcagcgactggaggcggagcggagagccaggttgcaggatgaagagcgcaggcgccagcaacagttggaagagatgcgcaaacgagaagttgaagacagagtaagacaagaggaagatggacgccatcaggaggaggagcgagtaaagagagatgctgaagaaaagaggcgacaggaagaagggtattacagccgcctagaagctgagaggcgcagacagcatgaagaggcagcacgcaggttgctggagcccgaagaacccgggctgagccgacctccacttccacaggactacgagcccccatcccagtcctcagcacccagtgcccctcctcccccacctcagcgaaatgcctcctacctcaaaacacaggtcctctccccagactcgctgttcactgccaagtttgttgcgtatgatgatgatgatgaggaggagaactacgtcccagcaggaccaaactcttattcgggatctgctggcacaactgctggaacttatgatgctcctcgggacacaagagaaaaactcagtagaagccaagatgcagacttacctggcagttctggagcccctgaaaacctgacatttagagagcgtcagcgcctcttttcacaaggtcaagatgtgtcagacaaagtgaaagcttctcgtaaattaacagagcttgagaatgaactcaacaccaagtgagaagagagaggtcacctgtactcaagcaggtctgaccttggcagtggatttgtggggtgggcctgaagaggaaggaacaattgtacttctaagtgatgtttaatttctttctgaaatggttgcaattgagagatgttccaaa

SEQ ID NO: 1626 - DNA, 1226 bp, Rattus norvegicus
  Genbank Accession No. NM_013222
cgcgcgctggcggtggcatgcgcgctgctctgtcccgtctcctgcacgccctcttggccccgctgctcgtacgccagcaatatggcggcgcccagcgaacccgcaggtttccctcgcggcagtcgcttctccttcctgccgggcggcgcgcactcggagatgaccgacgacctggtgactgacgcgcggggccgcggcgcaaggcatagaaaagacaacgcccctgccgcggccccggcgccgaaaggtttggagcacgggaagcgaccgtgccgggcctgcgtggacttcaagtcgtggatgcggacccagcagaagcgggacatcaagtttagggaggactgtccacaggatcgggaagaattgggtcgcaacacctgggctttccttcatacgctggccgcctattacccggacatgcccacgccagaacaacagcaggatatggcccagttcatacatatattttccaagttttacccctgtgaggagtgtgcagaagacataaggaagaggatagacaggagccagccagacacaagcactcgagtgtccttcagccagtggctgtgccgccttcacaatgaagtgaaccggaagctgggcaagcctgattttgactgctcaagagttgatgagcgatggcgtgacggctggaaggacggctcctgtgactaaggattaccacagaccgtgcagggcaacgccgggttctatgggcaacagcctgactgacgattaaagtgcatctgagccaaagcttgtttctgtggtgggggtgggatcccctagaacactgcctatgggaaccctacccacagactcagaaacggaggtgcccactatagacagttgggtggcttcctcaggtcttaaagccccatgggactgaagatgagaggcaggagtggtccagggcaccccataccccttatgatacccattatacatttgggacatagttgcctcaaaggaaggtgggctagaccattgccttcctactacatatccccagctgcctacagaactgtgacccaggcaactctgccatttcagaattgaagcagggttccagctctagttgggtttttctcttagggtaaaccaaccatggtgcccactgtcagcctggcacatggtcttctgcagccaggacaaacatgtcagcagaggatcctgggaagggcttccttagcgtttgagaccaaaataaaatgaagtgactt

SEQ ID NO: 1627 - DNA, 435 bp, Rattus norvegicus
  Genbank Accession No. NM_013224
ctctttcgagtcttggctccaatatgaccaaaaaaaggagaaacaacggtcgtgccaaaaagggccgcggccatgtgcaaccaattcgctgcacgaactgcgcccggtgcgtgcccaaggataaggccattaagaagtttgtcattcggaacattgtagaagccgctgcagtcagggacatatctgaagcaagcgtcttcgacgcttacgtgcttcccaagctctatgtcaagctgcactactgcgtgagctgtgccattcatagcaaggttgtcaggaatcgatctcgtgaggcccggaaggaccgaacacccccaccacgattcagacctgctggcgctgcaccacgacctccaccaaagcccatgtaaagaggtgatttcatgaagacagaaagaaaaataccatggaaaaataaaactgaagttatacttt

SEQ ID NO: 1628 - DNA, 465 bp, Rattus norvegicus
  Genbank Accession No. NM_013226
ggcatcatggctgcccttcggcctctggtgaagcccaagatcgtcaaaaagaggaccaagaagttcatcaggcaccagtcggaccgatatgtgaaaattaagcgaaactggcggaaacccagaggcatcgacaacagggtgcggagaagattcaagggccagatcctgatgcccaacattggttacgggagtaacaagaaaaccaagcacatgctgcctagcggcttccggaagtttctggtccacaatgtcaaggagctggaagtgctgctgatgtgcaacaaatcttactgtgctgagattgctcacaatgtgtcctctaagaaccgaaaagccatcgtagaaagagcagcacagctggccatcagagtcaccaatcccaacgccaggctacgcagcgaagagaatgaatagatggcttgtgtgcctgttttgtgttcaaataaaaccacaaaaactgccaaa

SEQ ID NO: 1629 - DNA, 1866 bp, Rattus norvegicus
  Genbank Accession No. NM_016986
agagccaacagagcaggaaggcatcatggcagcagcgctccgcagaggctacaaggtcctgagaagtgtctctcattttgagtgtcgagcacaacacacaaaaccatctctcaagcaggagccgggactagggtttagcttcgagttgacggagcagcagaaagagtttcaaacaattgctcggaagtttgccagagaggaaataatcccggtcgccccagactacgataaaagcggggaatacccgttccctctcatcaagagagcctgggaacttgggttgatcaacacacacattccggagagttgtggtggtcttggcctgggaacttttgatgcgtgtttaattacggaagagttggcatatgggtgtacaggggtgcagactgctattgaagcaaattctttggggcaaatgcctgtgattattgctggaaatgatcaacagaagaagaagtatttggggaggatgacggagcagccgatgatgtgtgcctactgcgtgacagaaccctcagcaggctctgatgtggcgggcattaagaccaaagcagagaagaagggtgatgaatatgtcatcaatggccagaagatgtggataaccaacgggggaaaggccaactggtattttgtattgacgcgatctaacccagatcctaaagtacctgctagtaaagccttcaccggattcatcgtggaggccgacaccccgggaatacacatcggaaaaaaggaactaaacatgggtcagcggtgctctgacaccagaggaatcaccttcgaagatgtcagagtgcctaaggaaaatgtgttaattggtgaaggagcaggtttcaagattgcaatgggggcttttgatagaaccaggccgacggtcgcagctggtgctgtcgggctagcccagagagccctggacgaagctactaagtatgccctggacaggaaaacatttggaaagctgctagtggagcaccaaggagtttcatttctgctcgcagaaatggcgatgaaagttgaactggccagactcagttaccagcgagcagcctgggaggttgactccggccgccggaacacgtactttgcctctattgcgaaggcctttgctggagatattgccaaccagctcgctaccgatgctgtgcagattttcggaggctatggattcaacactgagtacccagtagaaaagctgatgcgggacgccaagatctatcagatttacgaaggtactgcacaaattcagaggctgatcatagctcgtgagcacattgaaaagtataaaaattaacagaaattactatcgaacgatgcttcaccctcatgtaactacgctcagagcactgttgctgcttcagggggaaagggctttacttgtcttcccacagaaatgagataaaagacgcgtgtcacagatctgtgcaatggggtcccacggcggagggtgcctctgttgagttccacagtgaccctttctagataggtttggttttggacagtgagtggtcagtccttggccccgaattgtgttaatttgctccttgatcacttgagatggagaaataccctggagttctaatgctcattcaagtgacaagaaaggtagcctgtcacgaaagaactcaggattctacacagacactgaggaatgtggcggattggacccatcacactgtgaagagagagcatttctgtgctgagctgtttcataattttgattatatttcccttgtattgcagaagagtaaaaaagtttatatgcattttctcccattataaaactaaaaactttctggaaaatcttaattctgaactggcattttatttgtcttgattacaatgattcaataaagctagccttaactt

SEQ ID NO: 1630 - DNA, 2009 bp, Rattus norvegicus
  Genbank Accession No. NM_016988
ccggtgatggccggcagacagtctggttggagccaggcggctcttctccagttccttcttggcatgtgcctaatggtgatgccacccatacaagcccggagtctgcgctttgttaccttgctgtatcgacacggagatcggtcaccagtgaaggcatatcctaaggacccctatcaggaagagaaatggccccagggatttggtcagctaaccaaggaagggatgctacagcattgggagctgggccaggccctgcggcaacgctaccatggctttctgaacgcctcttaccacaggcaagaggtttacgtgcgaagcacagactttgaccgtactctcatgagtgcagaggccaacctggccggactcttccctcccactgaagttcagcacttcaacccgaacatttcatggcagcctatccctgtccacaccgtgcccattactgaagacaggttgctgaagtttcctttgggtccatgtccccgttatgagcagttgcagaacgagactcggcagacaccagagtatcagaacatgagtattcagaatgcacaatttctggacatggtggccaatgagacagggcttatgaacttgaccctagagaccatctggaatgtgtatgacacactcttttgtgagcaaacacatgggctgctcctgccaccctgggcctctccccaaaccgtgcaggctctgagccagctaaaggacttcagcttcctcttcctcttcgggatccacgatcaagtacagaaggcccggcttcaggggggagttctgctggctcaaatattgaagaatctgaccctaatggcaactacctctcaattccctaagcttctggtttattctgcgcatgacactaccctggttgctctgcaaatggcactgaatgtctacaatggtaaacaagccccctatgcttcctgccacatatttgaactgtaccaggaagataatgggaatttctcagtcgagatgtactttcggaatgacagtaagaaggcaccctggccactgaccctgcctggctgtcctcaccgttgcccactgcaggacttccttcgcctcacagaacctgtcatacccaaggactggcagaaggagtgccagctagcaagcgatactgcagacacagaggtgattgtggcactggctgtctgtggctccatcctcttccttctaatagtgttgctcctcactgtcctcttccggatgcaggcccagcctcctggctaccaccatgttgcagacagggaagaccatgcttgacaaccactcagtccccttccctctgcctcctaggggatgtgggctgagtccttgctcctgactattgccgatcccagagggacaggtttagccttcctgattacctacgcccaaatgaatgagtgaggctgggctggtcgcacgtcacctgtgacttaccatcctcatgcctgatgtttaccatgtactgtgttggacactggctttctctaaatgggatttgcctcttctatactccctaaggacttgagatacagacaagcattcaggttttactcaagaccttgggattaaaaaaacaaaacaacaacagaaaaaaaaccccaaaccctgaagaagctggtacttgatctgtctagctcttcccccaagccttgctctttgtcttctagcccatatctttggcaaatggcttggagacattgtcccttggtacttttgcagttcatataaatggctcattttatatggatcacccaacagcaaagtttccctctgactgaggcctgccgtcagtgtcaacctcaggcaggttgaaggacactggtgctgcacctggatgacagtgggaggacacaggagtgaaacacatggaatcatgacgtgactctccctcagctgggctggactcttcagggacttgaagtaaatgcagctggtgaactgtacaccttgactgtggcccgaaacagagctgaagtaactccgaggaaatgaaggttttgactgag

SEQ ID NO: 1631 - DNA, 2681 bp, Rattus norvegicus
  Genbank Accession No. NM_016989
tttattggatatgaattttacaaatattacgtcaattagcggtaacggtggagctgaagagtgttgcgccttctccaggctgcacggcgagacccaccaatggtgtggtggaacttgtggccctttccaaggccacggctcttgcggccagcagatgtcagcccacgcatctccctgtgcttgtggactggtttggtaatccattgggtgtcgggatttcttctgatagctttatggaatggatcaatgaggataacctcaaaaaatttatatgtggaatcttcaccaacccagtaggaattcaggactctcaaagctccacaatggcgcccagctctctcctcagcaacagactgaaggcttcggctagttttgtgcgtctacaaagctttgagcggaattttagcttcggcaaacaagtccccccagctcctccagctaattcccgcgacttctctccagacaccagctccagacagtgactgatgcctctctggttgtgattccagcgcagaaactcgaaggagccctttgcccgccgtcctatttagtcaactctttcctagccgcgaatgaccatgtgtagcggagcaaggttggccctgttggtctacgggataataatgcataacagcgtctcctgttcacctgccgccggactcagcttccctgggatcagaccagaagaagaggcttacgatcaggacggaaacccgctgcaagacttctacgactgggaccctccgggcgcagggagccccgcctccgcgctgcgtgacgcctacgccctttactacccagccgacaggagagatgtcgcccacgaaatccttaacgaagcctaccgcaaagtcttggaccagctgtccgccaggaagtacctgcagtccatggtggccaggggcatgggcgagaacctcgccgccgccgcggtggacgaccgggcaccccttaccaaacgccactcggacggcatcttcacagacagctatagccgctaccgaaaacaaatggctgtcaagaaatacttggcggccgtgctagggaaaaggtataaacagagggttaaaaacaaaggacgccgaatagcgtacttgtagcgatgagttgccagctaccgtgtgtataaaatgaaaagtcgttttccaaattgactgaccagtcatcactcatgtgttctttccaaacatgtatttatgtatcaagtaaagccattaaatgactattttgataataatattgtttttctttttacgaagcactggagaatgcacagatatactttgtggaccaattattgatatatattataagtatatattaagaatatatataggtatagcagagagcaattcataagcgtgcacaaagattgaaaattcgcctgagctgtttatgtttttatataaaatgaatagagaaaatagacaaccattgttttgaatattactcctatttttgtaaactggaattaaaggatagtatttttatccacaaccggcttgaagataccaataatggccatttgtacaaaaaaatgatgccctgctccaggagaattctgaggtaatgacttcccaaattgctgaagggctttctttccttgtgagtctctggggcaggctgcttgaaccccagcctaactaactcaagtgggcattgtcccactggttgcgggacaattccaacactttcattttctttgactatacctttatgtgtatctgtctctcctcagagtcccagcccataaggaaattctaattactgaacagctcgatccaaattgtgcttctccccaaaattcatgtcatttccttggagaagagtcgaggaactgtacagaagagaccagcttggagagaaagcgctcttttttgtacttcctgattcttcagggaactgactatcctaaagctagggcaattggaacaaagtgaaagataaagagaggactggaaggggcagagcatggggtgtggaggaggaccctgtagagggactgatttgagagttgcctcaggtctgagaatctgggggcaagtctagtccctctgcaggttccactgcctgacagatcaggtgctggtgttggaatgaatgaatgcaaagtacaatgtgtttttctccagtgctgtccatgcttttcatgtcgtgaaatgaccaggatcctcccctttgaacactgctctgcagaagccacccctattctttgtggtttttctggagaacctccttcctacccttgccctcctgcactgtttaagaatctcgtatgccattttccactcacttatcttaaatttgtgaatgctagttattttttgttgttgtttgatgcaagcagttactgtgaagtttaggaacccctgtttagctaccacagagtgagtatgcactaaatatgaaccttttgtttcttgtttattgagtttgtaggtaaaatgtatttttctatattatggcttattgcttagtaaagcaagcccagcttcctgaggggccttttgtcctgttagcaattgaggcatttgcagaacactgtacagaccccgctctcccctgtacattcctccctggtggtgcccggtccccacttggggatgggagttttgtagactgtacagaaatcggcaccctattttcttgcagctctcagattttgttaatctggattatac

SEQ ID NO: 1632 - DNA, 4113 bp, Rattus norvegicus
  Genbank Accession No. NM_016996
cgggactctccaggccggctcaggcaccggactgtaggtgtatttggagggatttggaggctggagaccccaggaagcacgcaggcgggagcaggcaaggggcggagccccgggcccggccaaggtggccgtcagagggtctgcggggaggcagtagcttgacccaaggcgaccagggaacttcagacggtagcacgccactcaaacaaattaacttgacatcgcaagctgggcgggctggtacgacatcctgacttcagcatccagctgttcctgggcagacagagggccaacaggtgttcctgtggaagaagccaggacaaggactccagaaaacatctcgggcagcctctacatgatgtcacttctcaggactcgaggaccagccaccctacacctctactacagagaaggcagaaatggagacccaaaggccatcactcctgctctgtcactaaccactctgtaatcatgtctccccaccagaaggtgtgaaccgcaccagggccgtggagttctcgggctcccaatccactgacacctttacctgtcccctgaagagaaggcaacgctatggcatcgtacagctgctgtttggccctattggctcttgcctggcactcctctgcctatgggcctgaccagcgagcccaaaagaagggggacattatcctaggaggtctctttcctatccattttggagtagcagccaaagatcaagatctgaagtcaagaccagagtctgtggagtgcattaggtataacttccgtggattccgatggttacaagccatgatattcgccatagaggagataaacagcagcccctcccttcttcccaacatgacactgggatataggatatttgacacctgtaacaccgtctccaaggcgctggaagccaccttgagttttgttgcccagaacaaaatcgattctttgaacctggacgagttctgcaactgctctgagcacatcccttcgaccattgccgtggtgggagccaccggctccggtgtctccacggcggtagccaacctgctgggacttttctacatcccccaggtgagctacgcctcctccagcaggctcctcagcaataagaaccagtacaaatccttcctccgcaccattcccaatgacgaacaccaggcaaccgcgatggccgacatcatcgagtacttccgctggaactgggtgggcacaattgcagctgatgacgactatggcagacctggcattgagaagttccgagaggaagccgaagagagggatatctgcattgattttagcgagctcatctcccagtactctgacgaggaagagatccagcaggtggtcgaagtgatccaaaactctacggccaaggtcattgtcgttttctccagcggcccggacctagaacctctcatcaaggagattgtgcggcgtaacatcacaggcaggatctggctggctagcgaggcctgggccagttcctcgctgattgctatgcctgagtatttccatgtagtcgggggcaccattgggttcggtctgaaggctgggcagattccaggcttcagagaattcctacagaaagttcatcctaggaagtctgtccacaatggttttgccaaagagttttgggaagaaacttttaattgccacctccaagaaggcgcaaaaggacctttacctgtggacaccttcgtgagaagtcacgaagaaggtggcaacaggttactcaatagctctactgccttccgacccctctgcacaggggatgagaacatcaacagtgtggagaccccttacatggattacgaacatttacggatatcctacaatgtgtacttagccgtctactccattgcgcatgccctacaagatatatacacctgcttacccggaagagggcttttcaccaacgggtcctgtgcagacatcaagaaggttgaggcctggcaggtcttgaagcacctacggcacctgaacttcaccaacaacatgggggagcaggtgaccttcgatgagtgtggtgatctggtggggaactattctatcatcaactggcacctctccccagaggacggctccattgtgttcaaggaagttgggtactacaatgtgtatgccaagaagggagaaagactcttcatcaatgaggagaagatcttgtggagtgggttctccagagaggtgcctttctccaattgcagccgggactgtcaggcagggaccaggaaggggatcatcgagggagagcccacctgctgctttgagtgtgtggagtgtcctgatggagagtacagtggagagacagatgcgagtgcctgtgacaagtgcccggatgacttctggtccaatgagaaccacacttcttgcattgccaaggagattgagtttctggcgtggaccgagccctttggaatcgctctcactctctttgcggtgctgggcattttcctgaccgcctttgtgctgggtgtcttcatcaagttccgaaacacacctatcgtcaaggccaccaaccgagaactgtcctacctcctgctcttctccctactctgctgcttctccagctccttgttcttcattggggagccccaggactggacgtgccgcctgcgacagcctgctttcggcatcagctttgtgctctgtatctcgtgcatcttggtgaagaccaatcgcgtcctcctggtatttgaagccaagatacccaccagcttccaccggaagtggtgggggctcaacctgcagttcctgctggttttcctctgcaccttcatgcagatcctcatctgcatcatctggctctacacggcgcccccctctagctaccgcaaccatgagctggaagacgaaatcatcttcatcacgtgccatgagggctcactcatggcacttggctccctgatcggctatacctgcctgctggctgccatctgcttcttctttgccttcaagtccaggaagttaccagagaacttcaacgaagccaagttcattaccttcagcatgctcatcttcttcatcgtctggatctccttcattccagcctatgccagcacctacggcaagtttgtctctgccgtagaggtgatcgccattttggcagccagctttggcttactagcctgcatcttcttcaacaaggtctacattatcctcttcaagccttcccggaacaccattgaggaagtccgctccagcaccgcagcacatgctttcaaagtagcagcccgcgccactctacgccgtcccaacatctcccggaagcggtccagcagccttggaggctccaccggctccattccctcctcctccatcagcagcaaaagcaacagcgaagaccggttcccgcagccagagaggcagaagcaacagcaaccgctgtccctgacccagcaagaacagcagcagcagcccctgaccctccacccacagcaacagcagcagccacagcagccgagatgcaaacagaaggtcatcttcggcagtggtacggtcaccttctctctgagttttgacgagcctcagaagaatgccatggcccacaggaactccatgcgtcagaactccctggaggcccagaggagcaacgacaccttgggcagacaccaggccctgcttcccctacagtgtgcagatgcggactcagaaatgaccattcaggaaacgggcctgcaagggcccatggtgggggaccaccagccagaaatggaaagctcagatgaaatgtccccagcgctggtcatgtccacctctcggagcttcgtcattagtggtggaggtagctctgtgacggaaaacgtattacactcctaatggagggaaaggctatccagttgagaggtttttcttagagccctgagcaaaaggatgggtccttcctttcttcccaggaagccagggagagtaggtacgtcaaagcctgtactcagttgcactgctttgaatgacagtgaactgactggtgtgctctttagagttaaaagaagagccatgttttggggtcgttttccagagctcagtatcacacctgggtttgctgaagtcttttcctctgctctatccaccatcagttcagacgaaagcaaggctctaagctacccatctgcttccctc

SEQ ID NO: 1633 - DNA, 2462 bp, Rattus norvegicus
  Genbank Accession No. NM_016999
gatggctgcaccatgagcgtctctgcactgagctccacccgcttcacgggcagcatctctggcttcctccaagtggcctccgtgcttggtctgcttctgctgctggtcaaagcagtccagttctacctgcaaaggcaatggctactcaaggctttccagcagttcccatcacctcccttccactggttctttgggcacaagcagtttcaaggtgacaaagaactacagcaaattatgacatgtgtggagaatttcccaagtgcctttcctcgatggttctggggaagcaaagcctacttaattgtctatgaccctgactacatgaaggtgattctcgggcgatcagatccaaaggccaatggcgtctacagattgctagctccttggatcggatatggtttgctcttgctgaatggacaaccgtggttccagcaccggcgaatgctaaccccagccttccactatgacattctgaaaccctatgtaaaaaacatggctgactccattcgactgatgctagacaaatgggaacagctggcaggtcaagactcctctatagaaatctttcaacatatctccttaatgaccctagacactgtcatgaagtgtgccttcagccacaatggcagtgttcaggtggatggaaattacaagagctatatccaggccattgggaacttgaatgacctctttcactcccgtgtgaggaacatctttcatcagaatgataccatctataatttttcttccaatggccacttgttcaaccgtgcttgtcaacttgcccatgatcacacagatggtgtgatcaagctaaggaaggatcagctgcagaatgcgggagagctggaaaaggtcaagaagaaaagacgtttggattttctggacatcctcttacttgccagaatggagaatggggacagcttgtctgacaaggacctacgtgctgaggtggacacatttatgttcgagggtcatgacaccacagccagtggagtctcctggatcttctatgctctggccacacaccctaagcaccaacaaagatgcagagaggaagttcagagtgtcctgggggatgggtcctccattacctgggatcacctggaccagattccctacaccaccatgtgtatcaaggaggccctgaggctttacccacctgttccaggcattgtcagagaactcagcacatctgtcaccttccctgatgggcgctctttacccaagggtatccaagtcacactctccatttatggtctccaccacaacccgaaggtgtggccaaacccagaggtgtttgacccttccaggtttgcaccagactctccccgacacagccactcattcctgcccttctcaggaggagcgaggaactgcattgggaaacaatttgctatgagtgagatgaaggtgattgtggccctgaccctgctccgctttgagctactgccagatcccaccaaggtccccatccccttaccacgacttgtgctgaagtccaaaaatgggatctacctgtatctcaagaagctccactaattccgttgtggagctccgaaatctgaaatgagtttcactggcagaaagctgagttggtggtgtgactagccttcttcagaagagtgcttcagagagtcctctcctcctctcttcagtacagatcacccttctcagcactggaatattcctctgctttaaagccagcacccttcccataccccctcttctaaaagccttcccttttacaaatgttcttatgacatcatcaagaccactgaaaaactccaagataatttcccatctcaatattccttactccatctaacctactaagtcccttttgaattatgaggaataattcaatttgttccatgggctccaaaactcaaggcctgagcattattgtgaaacctttattcagcctaatatcatcttcacaagactgttacctggtacgttcatctaaatctcccctgcatagtctctctacctgactattcctcacacaagtttctttaccttccctcctttctccaataaagtgtccagtgtcctgcacaaaaagctcaaggagaactgattatcaccttctgattcgttcattgatgcattcaaattaaacctccacatagtagagactttttcaactattataaaaaccatcctgagccagacctgcagtcaacagcaagagcaggaagcgcataggaactacacctgcaaccaagctggcacaaagaccaagaattctgaagcagcccaaactcaagatgacatatttttacaagttagagaaaaatcaagatctgagttatcttgacaaactcgggatggaaagtaggagggaggggaaagcaaataaatacttccttattgtgtagcataaaaaaaccgaattcgtaggagggaggggaaagcaaataaatacttccttattgtgtagcataaaaaaaccgaat

SEQ ID NO: 1634 - DNA, 1396 bp, Rattus norvegicus
  Genbank Accession No. NM_017000
tgggccaatacaatcagggctcttctcaccgccatggctccagaagttgggggcggatcgtagtgtcaagcgctgattggctgagcagagaggacatcattcaactatgccatgaaggaggctgctgtggaggctctgaagaagaaaggatgggaggtggtcgaatctgacctctatgctatgaactttaaccccctcatttccagaaacgacatcacaggggagccgaaggactcggagaactttcagtaccctgttgagtcatctctggcgtataaggaaggccgcctgagcccggatattgtagctgaacagaaaaagctggaagctgcagacctagtgatatttcagttcccattgtattggtttggggtgcccgccattctgaaaggctggtttgagagagtgcttgtagcaggattcgcctacacgtatgccaccatgtatgaccaaggtcctttccagaataagaagaccttgctttccatcaccaccgggggcagcggctccatgtactctctgcagggtgtccacggggacatgaacgtcattctctggccaattcagagtggcattctgcgcttctgtggcttccaggtcttagaacctcaactggtgtacagcattggccacaccccacccgatgcccgcgtgcaggtcctggaagggtggaagaagcgtctggagaccgtctgggaggagtcaccactctactttgctccaagcagcttgtttgacctaaacttccaggcaggattcttactgaaaaaagaggttcaagaggagcagaaaaagaacaagtttggcctttctgtgggccatcatttgggcaagtccattccagccgacaaccagatcaaagctagaaaataaggttttccataccatgtagttagacccaggtttctttttccccagtttgcctggcttgctttcagttttcgcctttgttccacaaggataggaaaaggaggaggctcgcctcatgcgtttttggatagttctgccacggctgtgacagcaaaatgaacgaggtcagattaggggcctcaggtggcctgggatatgaatcagggagaggtgtagccgcgagcggggaaaatactcttctaggtcttttgtacactataagcttttttcttcgggctagccttggctaaatggcatccaatcctccacccacttgttgctattagttacctctctgtggtttagggcaggagggaattgctcaaacaatggctgagggactaacttgtttagcagttagctaaagcctgtttatgatccatcctggtttcaattactgtgcagtgactgacaagcctcgggggattgctctccagctcttctctgccttgtacatagcacacccaggtcctgggaaatgaataca

SEQ ID NO: 1635 - DNA, 2324 bp, Rattus norvegicus
  Genbank Accession No. NM_017006
gtgaacgtgtttggcagcggcaactaaattcagaaaacatcatggcagagcaggtggctttgagccggacccaggtgtgtgggatcctgagggaagagttgtaccagggtgatgccttccaccaagctgatacacacatatttatcatcatgggtgcatcgggtgacctggccaagaagaagatttatcctaccatctggtggctgttccgggatggccttctacccgaagacaccttcattgtaggctatgcccgctcacgactcacagtggatgacatccgcaaacagagtgagcccttctttaaagtcactccagaagaaagacccaagctagaggagttctttgcccgtaactcctatgtagctggccagtatgatgatccagcctcctacaagcacctcaacagccacatgaatgccctgcaccagggaatgcaggccaaccgtctgttctacctggccttgccccccactgtctatgaagcagtcaccaagaacattcaagagatctgcatgagtcagacaggctggaaccgcatcatagtggagaagcccttcgggagagacctgcagagctccaatcaactgtcgaaccacatctcctctctgtttcgtgaggaccagatctaccgcattgaccactacctgggcaaagagatggtccagaacctcatggtgctgagatttgccaacaggatctttggacccatctggaatcgagacaacattgcttgtgtgatccttacatttaaagagccctttggtactgagggtcgtgggggctattttgatgaatttgggatcatcagggatgtcatgcagaaccacctcctgcagatgttgtgtctagtggccatggaaaagcctgcctctacagattcagatgatgtccgtgatgagaaggtcaaagtgttaaaatgtatctcagaggtggaaactgacaacgtggtccttggccagtatgtggggaaccccagtggagaaggagaagctaccaatgggtacttagatgaccccacagtaccccatgggtctaccactgctacctttgcagcagctgtcctctatgtggagaatgaacggtgggatggagtacccttcatcctgcgctgtggcaaagctctgaatgagcgcaaagctgaagtgagacttcagttccgcgatgtggcaggtgacatcttccaccagcagtgcaagcgtaacgagctggtcatccgtgtgcagcccaatgaggcggtatacaccaagatgatgaccaagaagcctggcatgttcttcaaccctgaggagtctgagctggacctaacctatggcaacagatacaagaatgtgaagctccctgatgcctatgaacgcctcatcctggatgtcttctgtgggagccaaatgcactttgtccgtagtgatgaactcagggaagcctggcgtatcttcacaccattgctgcacaagattgatcgagagaagccccagcccatcccgtatgtctatggcagccgaggtcccacagaggcagatgagctgatgaagagagtgggcttccagtatgagggtacctacaagtgggtgaaccctcacaagctctgagccctggaaacttacaccatctgcactctgcctcttctggccaccctttctgcatctgcccttctcaccatctaaccctctattaggactattgacctcatattggaaagactttgggaccataggccttagctacacattctagtccctgggcttaggccaccattctgtcctatgctgctgccactgccactaccactaagcccagctacattcctcagataccaggcattcaaaacgcattgcaatgctttcaggaccaccactgtccctatctgagccacccatctttccacaagacctgaatcacctcctcccctcaatcccctgcagaaagaacgcctatcagtctgtccctggactccttaagataggagttaggaacaattgggaggagccttgggccttggagggacaatgaccaaaccacacttccctgagactgtgggcaagctcctcaaaacttaaagtgatcaaggacacccatctgagaggacctgcccatagccacactagccttagtgctacttgacattcctcctcaccagctggaagaactctcatgctgcctagcaatattttgggggccatagatatctcctaaacaattccatagtccatagtcagcctcatccaacccatgggcagcctccttaccaaaggaaggtaagagcagcagctagaattttcctaccccaaccctgccattaaatcctcaaaaaaaaaaaaaaaaaa

SEQ ID NO: 1636 - DNA, 2704 bp, Rattus norvegicus
  Genbank Accession No. NM_017009
caggagccagcagaagcagggcaagatggagcggagacgtatcacctctgcacgccgctcctatgcctcctccgagacgatggtcaggggccatggtcctaccagacacctgggtaccattccgcgcctctccctgtctcgaatgacgcctccactccctgccagggtagacttctccctggccggggcgctcaatgccggcttcaaagagactcgggccagcgagcgcgcggagatgatggagctcaatgaccgctttgctagctacatcgagaaggtccgcttcctggaacagcaaaacaaggcgctggcagctgagctgaaccagcttcgagccaaggagcccaccaaactggctgacgtttaccaggcagaacttcgggagctgcggctgcgtctggaccagcttactaccaacagtgcccggctggaggtggagagggacaatctcacacaggacctcggcaccctgaggcagaagctccaagatgaaaccaacctgaggctggaggcggagaacaacctggctgtgtacagacaggaggcggatgaagccaccttggctcgtgtggatctggagaggaaggttgagtcgctggaggaggagatccagttcttgaggaagatccatgaggaggaagttcgagaactccaggagcagctggcccagcagcaggtccacgtggagatggatgtggccaagccagacctcacagcggctctgagagagattcgcactcagtacgaggcagtggccaccagtaacatgcaagaaacagaagagtggtatcggtccaagtttgcagacctcacagacgttgcttcccgcaacgcagagctcgtccgccaggccaagcacgaggctaatgactatcgccgccaactgcaggccttgacctgcgaccttgagtccttgcgcggcacgaacgagtccttggagaggcaaatgcgcgaacaggaggagcgccacgctcgggagtcggccagttaccaggaggcactcgctcggctggaggaggagggccaaagcctcaaggaggagatggcccgccacctgcaggagtaccaggatctactcaacgttaagctagccctggacatcgagatcgccacctacaggaaattgctggagggcgaagaaaaccgcatcaccattcctgtacagactttctccaacctccagatccgagaaaccagcctggacaccaaatctgtgtcagaaggccacctcaagaggaacatcgtggtaaagacggtggagatgcgggatggcgaggtcattaaggagtcgaagcaggagcacaaggatgtgatgtgaggtgtgcccagctgggcggcccttgccatacagtgtgagggcctaaagctccctcctcagatagtcttgtttgctaggcccaattcccatccacaccagtgctccccttgcttctgttttagtgcccacggctcggtcagtgcggagtctcatggacggcacagaccaccctgcatctccaactaacaggataccaccccaaaggcaatcaggaggggaggacccccctcccccagctggttagaactggaagaaagaggaaagacaggggcagggagacttaacaaatcccttccttcatccttcttgttatggaaaccgttgccagagctggaggtctctgggaactggacttttgaagttttcataggcatgctggagcaagacaaacattcagacagaaaggaaaagatcccgaggcaaagaatctctagccagaggcctaggcatctggaagaaccctgacgatgtaggagtgggtagggcagacttgctacctggaatggccactaaggcagtcctgaagggcccccctcttgaggatgaccctcgtgtatcggcccactgagcagccctgcaggttgatgccagagcgtgtgaaacttggttcttggcatgtggcaggctctatagcataagctggagagggaaggtgtactggagggtatagaggaggctctctggcccctaagtatggatgagtcgagaggggggagcccaggaaggctaccccgctcaggctgcaggggtgccatggcggaggaaccggtggagataacttggacaatggagttggaagggtgtgtaggaactagttactcttggctctgaatccttggaatcaaggaaatgacctgtctctcaaagacctgaaacaggagagagggatttcatcactgggcagggtacaggcgcgtctcagttgtgaaggtctatcctggttgctcagtcccaactgcgcatcaccctgggcttctcaacctggaagagtcacaaccatccttctgaggctccatcccacaaccactagctgttgttctctagccaaggccccattccctttcttatgcatgtacggagtatcgcctagacttaagcgtccatcctgtttgaagttggaactgacacgttgtgttcaagcagcctggtgtggagtgccttcgtattagtgtaccctctcggaagctggttggtgggcaggtgaggaagaaatggagctgaaagtgtcccctcagttgtcctttcctccccctctaaggtccctccttttccccaggacatcgtacactcccccccttgtcacctctgctaaccttcagagcagtactgtcacctttactcactgggcaggaaataaagacagtgtcagaggctaaaaaaaaaaaa

SEQ ID NO: 1637 - DNA, 830 bp, Rattus norvegicus
  Genbank Accession No. NM_017013
agttgggagctgagtggagaagaagccacgattctcgctagacagtgaagcacagttgctgctatgtctgggaagccagtgcttcactacttcaatgcccggggcagaatggagtgcatccggtggctcctcgctgcagcaggagtggagtttgatgagaagtttatacaaagtccagaagacttggaaaagctaaagaaagacgggaatttgatgtttgaccaagtgcccatggtggagattgacgggatgaagctggcacagaccagagccattctcaactacatcgccaccaaatatgacctctatgggaaggacatgaaggagagagccctgattgacatgtacaccgaaggcattttagatctgactgaaatgattatgcaattggtaatatgtcccccagaccaaaaagaagccaagaccgccttggcaaaagacaggaccaaaaaccggtacttgcctgcctttgaaaaggtgttgaagagccatggccaagactaccttgtaggtaacaagctgacccgggtagacatccacctgctggaacttctcctctatgttgaagagtttgatgccagccttctgacctctttccctctgctgaaggccttcaagagcagaatcagcagcctccccaatgtgaagaagttcctgcagcctggcagtcagagaaagcttcccatggatgcaaaacaaatcgaagaagcaaggaagattttcaagttttagcggagctgcactgtccaatttctttatgttttgcaaaaaatgagaagcaattgttgatcctaggtatttttgaaataataaacacgaaaaaatactct

SEQ ID NO: 1638 - DNA, 1055 bp, Rattus norvegicus
  Genbank Accession No. NM_017014
gctgaagcaaattgagaagaccacagcgccagaaccatgcctatgatactgggatactggaacgtccgcgggctgacacacccgatccgcctgctcctggaatacacagactcaagctatgaggagaagagatacgccatgggcgacgctcccgactatgacagaagccagtggctgaatgagaagttcaaactgggcctggacttccccaatctgccctacttaattgatggatcgcgcaagattacccagagcaatgccataatgcgctaccttgcccgcaagcaccacctgtgtggagagacagaggaggagcggattcgtgcagacattgtggagaaccaggtcatggacaaccgcatgcagctcatcatgctttgttacaaccccgactttgagaagcagaagccagagttcttgaagaccatccctgagaagatgaagctctactctgagttcctgggcaagcgaccatggtttgcaggggacaaggtcacctatgtggatttccttgcttatgacattcttgaccagtaccacatttttgagcccaagtgcctggacgccttcccaaacctgaaggacttcctggcccgctttgagggcctgaagaagatctctgcctacatgaagagcagccgctacctctcaacacctatattttcgaagttggcccaatggagtaacaagtaggcccttgctacactggcactcacagggaggacctgtccacattggatcctgcaggcaccctggccttctgcactgtggttctctctccttcctgctcccttctccagctttgtcagccccatctcctcaacctcaccccagtcatgcccacatagtcttcattctccccactttctttcatagtggtccccttctttattgacaccttaacacaacctcacagtccttttctgtgatttgaggtctgccctgaactcagtctccctagacttaccccaaatgtaacactgtctcagtgccagcctgttcctggtgggggagctgccccaggcctgtctcatctttaataaagcctgaaacac

SEQ ID NO: 1639 - DNA, 2069 bp, Rattus norvegicus
  Genbank Accession No. NM_017023
caatcacacaactccactcgagttagccattgaaagccaatgcaagtaaatgtcattccaaagcttaagattcattaaggtgggcctaaaagaagacagctgctgtgcagacaacgtcgaacaagcaccacttgcttgctttgcccagcatgggcgcttcggaacggagtgtgttcagagtgctgatcagggcactgacagaaaggatgttcaaacacctccgaagatggtttatcactcacatatttgggcgttcccggcaacgggcaaggctggtctctaaagaaggaagatgtaacatcgagtttggcaatgtggatgcacagtcaaggtttatattctttgtggacatctggacaactgtgctggacctgaaatggaggtacaaaatgaccgtgttcatcacagccttcttggggagttggttcctctttggtctcctgtggtatgtcgtagcgtatgttcataaggacctcccagagttctacccgcctgacaaccgcactccttgtgtggagaacattaatggcatgacttcagcctttctgttttctctagagactcaagtgaccataggttacggattcaggtttgtgacagaacagtgcgccactgccattttcctgcttatcttccagtctattcttggagtgatcatcaattccttcatgtgtggtgccattttagccaagatctctagacccaaaaaacgtgctaaaaccattacgttcagcaagaatgcggtgatcagcaagcgtggcgggaagctctgcctcctcatccgagtggccaatcttaggaagagccttctgattggcagccacatatatggcaagcttctaaagacaaccatcactcctgaaggcgagaccatcattttggatcagaccaacatcaactttgtcgtcgacgctggcaatgaaaatttgttcttcatatccccactgacgatctaccacattattgaccacaacagccctttcttccacatggcagcagaaactctttcccaacaggactttgagctggtggtctttttagatggcacagtggaatccaccagtgcaacctgccaggtccgcacgtcatacgtcccagaggaggtgctttggggctaccgtttcgttcctattgtgtccaagaccaaggaagggaaataccgagttgattttcataacttcggtaagacagtggaagtggagacccctcactgtgccatgtgcctctataatgagaaagatgccagggccaggatgaagagaggctatgacaaccctaactttgtcttgtcagaagttgatgaaacggacgacacccagatgtagcagtggcttttccacctacaaaaagcctcccaaggacctaagggttgactgtgttcagaagcatctgacgggggtctgaaagcaggatgagaacatgcgaaatctgctagcacagtcacccctgaaccccagggctatggttctacaagacacatagctctataaggctgcatacggtgcatgcatgtgaatgaaactgtggaagccaaaggggcccacttggatcctcactatgactgtgtaagctcatatcgtgttgatggaaacaaagtcattcaaggacaaaacttaggagctttagaaagcttcaggaactagccacatttcctgtttgattctatggatgagaaagatgccatttttatcttaaagtagacttctatcaatggaaaatctgccctctgcgctgggaagtgagccagccaatcagtgacaataagagactgtcatacaaagaatcagtaaagactctaaccttctcaagctctggtgtttgaagcctttgtctgagtctgggtccatgcttcagaaggggtaaggtgacatccactgactgtacctctctgaacccaaggtacagaagaacaggaagccccaatcaacttcataatcaacccagatgctgcagcccatacagaatttggcctgaatgatttcctgtggagcattaaatggaggccaagtccactctttagatattaaatgaatattcttttgcaaaggaaaaaaaaaaaaaaaaaaaaa

SEQ ID NO: 1640 - DNA, 1609 bp, Rattus norvegicus
  Genbank Accession No. NM_017025
gtgtgctggagccactgtcgccgatctcgcgcacgctactgctgctgctcgcccgtcgtcccccatcgtgcactaagcggtcccaaaagattcaaagtccaagatggcagccctcaaggaccagctgattgtgaatcttcttaaggaagaacaggtcccccagaacaagattacagttgttggggttggtgctgttggcatggcttgtgccatcagtatcttaatgaaggacttggctgatgagcttgcccttgttgatgtcatagaagataagctaaagggagagatgatggatcttcagcatggcagccttttccttaagacaccaaaaattgtctccagcaaagattatagtgtgactgcaaactccaagctggtcattatcaccgcgggggcccgtcagcaagagggagagagccggctcaatttggtccagcgaaacgtgaacatcttcaagttcatcattccaaatgttgtgaaatacagtccacagtgcaaactgctcatcgtctcaaacccagtggatatcttgacctacgtggcttggaagatcagcggcttccccaaaaacagagttattggaagtggttgcaatctggattcggctcggttccgttacctgatgggagaaaggctgggagttcatccactgagctgtcacgggtgggtcctgggagagcatggcgactccagtgtgcctgtgtggagtggtgtgaacgtcgccggcgtctccctgaagtctctgaacccgcagctgggcacggatgcagacaaggagcagtggaaggatgtgcacaagcaggtggttgacagtgcatacgaagtgatcaagctgaaaggttacacatcctgggccattggcctctccgtggcagacttggccgagagcataatgaagaaccttaggcgggtgcatcccatttccaccatgattaagggtctctatggaatcaaggaggatgtcttcctcagcgtcccatgtatcctgggacaaaatggaatctcagatgttgtgaaggtgacactgactcctgacgaggaggcccgcctgaagaagagtgcagataccctctggggaatccagaaggagctgcagttctaaagtcttcccagtgtcctagcacttcactgtccaggctgcagcagggtttctatggagaccacgcacttctcatctgagctgtggttagtccagttggtccagttgtgttgaggtggtctgggggaaatctcagttccacagctctaccctgctaagtggtacttgtgtagtggtaacctggttagtgtgacaatcccactgtctccaagacacactgccaactgcatgcaggctttgattaccctgtgagcctgctgcattgctgtgctacgcaccctcaccaaacatgcctaggccatgagttcccagttagttataagctggctccagtgtgtaagtccatcgtgtatatcttgtgcataaatgttctacaggatattttctgtattatatgtgtctgtagtgtacattgcaatattacgtgaaatgtaagatctgcatatggatgatggaaccaaccactcaagtgtcatgccaaggaaaacaccaaataaaccttgaacagtg

SEQ ID NO: 1641 - DNA, 1843 bp, Rattus norvegicus
  Genbank Accession No. NM_017040
ggcacgagcgccgagagaaccgcggccagagcgcggagaggcctgcgggcggcgacggcagcgggagggcgggcgccgtcgggccggagcctcccccgagccgcgccgcgctctggctccgagccgtgagccctttttgccgcgccccgagcgcgtggccgggggccgggcggggcgggcgctcccggaggccggggccggcggctgcccgctgggcttgggcggggcgcgggctgcccgctccgcggctcggtggtcccgccgggggccggcggcgggggaggcggcggggacgcgcggctcgccgccatggacgacaaggcgttcaccaaggagctggaccagtgggtggagcagctgaacgagtgtaagcagctgaacgagaaccaagtgcggacgctgtgcgagaaggctaaggaaattttaacaaaagaatcaaatgtacaagaggttcgctgtcctgttaccgtctgtggagatgtgcatggccaattccatgaccttatggaactcttcagaattggtggaaaatcaccagacaccaactatctattcatgggtgactatgtagacagaggatattattctgtggagaccgtgactcttcttgtagcattaaaggtgcgctatccagagcgtatcacaatattgcgaggaaatcatgaaagccggcagatcacacaagtatatggcttttatgatgaatgcctacgaaagtatgggaacgccaacgtgtggaaatactttacagatctctttgattatcttccacttacagctttagtagatggacagatattctgcctccacggtggcctctctccatccatagatacactggatcacataagagccctggatcgcttacaggaagttccacatgagggcccaatgtgtgatctcttatggtcagatccagatgaccgtggtggctggggcatttctccacgtggtgctggctacacatttggacaagacatttctgaaacatttaaccatgccaacggcctcacactggtgtcccgtgctcaccagcttgtaatggaaggatataattggtgccatgatcggaatgtggtcaccatttttagtgcacccaattactgctaccgctgtgggaaccaggctgctatcatggaattagacgacactttaaaatactcttttcttcagtttgacccagcacctcgtcgtggagagcctcatgtgacccggcgcaccccagactacttcctataaattcctccccaggacctgtctttgtatgttgaagtatacctggctttttaaaaaatatatatacatatatatatttaaaaacaacagttatctgtgtgtctctgtaacaaattgtgctatgtcttgacgttaaaacacatcatggaccaaaacgtgccatactaatggtgagccatcagcacggtgtgaacttgagtccactgtcctagccgagtcaaccaggcagccgcctgcccgcctgcctgctgtagtagccgtccttcgtgactggttaagggaaagggtcactggtggcttcatctcctttgcgcttacttggaaatttagttacaagtttaactggcatggattatagagttggagttttatttttaagaattgacaagctgacttccacttaaattcataaccctttattttgttgaaatgtatgactaactgaagaagagattcttggagtatgttgtcataacactaagatttcctttcaagtttcctgaactgaattactgttggatgttgacctgcacattctgtatatttgtcctgacagtgttgcatcctccttgctgtactgaacaaataaacttcccaatttagagag

SEQ ID NO: 1642 - DNA, 4057 bp, Rattus norvegicus
  Genbank Accession No. NM_017048
aaaagagttgggagaagttgggagcggcgggggcgcgccccggggtgggcaccgggaaatcgtcgggagcgcgcgagggttccggaggatcaggggagacccggagacccccgggacacgaaatctagagctagcgggttatgcctccaccttgttgccctgaaagccgaagcgacagtgagaagggctaagatttggccatgagcagcgcccccaggcgccccgcctcgggcgcagattctttgcacacgccagagccagagagcctgagccccggaacacctgggttccctgagcaagaggaggaagatgaacttcgtaccttaggtgtggagcggttcgaggagatcctccaggaagctggatccagaggaggagaagagccaggccgcagctatggggaggaagactttgaataccaccgccagtcctcccaccatatccatcatccactctccacccacctgcctcctgacgcccgccgtcgcaagactccccagggcccaggacggaaacctcggaggcgccctggagcctctcccactggagagacccccactattgaggaaggggaggaagatgaggatgaagtcggtgaagctgaagggttcagagctcccccgcaacaaccatctcctgcctcttcaccctctgcagttcagttttttctccaagaggatgaaggtacagataggaaggcagagagaaccagcccatctccccctacacagacgccccaccaggaagcagctccccgggccagcaaaggggcacagacaggaactctggtggaggagatggtggccgtggccagcggcacggctggaggtgacgacggaggtgctgcagggcgccccctgaccaaagcccagcctggacatcgaagttacaaccttcaggagagaaggcgaattggcagtatgacaggggtggagcaggccctgctgcccagggtccctactgatgagagtgaggctcagacgctggccacagctgacctcgacctcatgaaaagtcaccggtttgaggacgttccgggggtacggcgacatttggtgaggaagaatgccaaagggtctacacaggctgcccgggaaggccgagagcctggccccacacctcgggcacgaccacgggccccccataagcctcatgaggtgttcgtagagctgaatgaattgcagttggacaaaaaccaggagcctcagtggcgggagacagcccggtggataaaatttgaggaggacgtggaagaggagactgagcgctggggcaagcctcacgtggcatcactgtccttccgcagcctcctggagctccgcaggacactggcccatggagctgtgctcttggacctcgatcagcagaccctgcctggggtggcccatcaggtggtcgagcagatggttatctctgaccagatcaaagcagaggacagagccaatgtgctacgagcccttctgctgaaacacagccacccaagtgatgagaaagaattctccttcccccggaacatctcagcgggctctctgggctctctcctggggcatcaccacgcccaggggactgagagtgatcctcacgtcactgagcctctcatcggtggtgttcctgagacccggctggaggtggatagagagcgtgagctgccgcccccagccccacctgcaggtattacccgctccaagtccaagcatgagctgaagctgctggagaagatccctgagaatgcagaggccacagtggtcctcgtgggctgtgtggagttcctctcccgccccaccatggcctttgtgcgcctgcgggaggctgtggaactggatgcagtactggaggtgcctgtgcctgtgcgcttcctcttcctgctgctggggcccagcagcgccaacatggactaccatgagattggccgatccatctccaccctcatgtctgacaagcaattccacgaggcagcctacctggcagatgaacgggatgacttgctgactgctatcaatgccttcctggactgcagtgttgtgctaccgccttctgaagtgcagggcgaggagctgctgcgttctgttgcccatttccagcgccagatgctaaagaagcgagaggagcagggccgcctgctgccccctggtgctgggctagagcccaagtctgcccaagataaggcactcctgcagatggtagaggtggcaggtgcagctgaagatgatccccttcggaggacaggccggccctttggggggctgatccgtgacgtgcggcggcgctacccgcactacctgagtgacttccgagatgcactagacccccagtgcctggctgctgtcattttcatctactttgccgccctgtcgcctgccatcacttttggggggctactgggggagaagacacaggacctgataggagtgtcagagctgatcatgtccacagcgctccagggagtgatcttctgcctgctgggcgcccagccactgctggtgatcggcttctcggggcctctgctggtcttcgaggaggccttcttctcgttctgcaagagcaaccagttggagtacttggtgggccgagtttggattggcttctggctggtgctcctggccctgctcatggtggctctggaggggagcttcctggtccgctttgtctcccgattcacccaggagatctttgccttcctcatatcactcatcttcatctatgagaccttctataagctgatcaagatctttcaggagcaccccctccatggctgctcagtctccaacgactcagaggcagacagcagcagtaacaatatgacttgggcagcaaccacactggcaccagacaacagcagtgcgtctgggcaggagaggccccggggccagcctaacactgccttgctatcactggtgctgatggccggcactttcttcatcgccttcttcctgcgcaaattcaagaacagccggttcttccctggccggatccggcgggtaattggggactttggggtgcccatcgcgatcctcatcatggtgcttgtggattacagtattgaggatacctacacccagaagctaagtgtgcccagtgggttctcagtgacagccccagacaagcggggctgggtcatcaacccccttggagagaagactcctttccctgtgtggatgatggtggccagcctgttgcctgccgttctggtgttcatcctcatcttcatggagacacagatcaccacgttgatcatctccaagaaagagcggatgcttcagaagggctctggcttccaccttgatctgttgctcattgtagccatgggtggcatctgtgccctctttggcctgccttggttggctgctgccactgtccgctctgtcactcatgccaatgcactcactgtcatgagcaaggctgtggcacctggtgacaaacccaagattcaggaagtcaaggagcagcgggtgaccgggctgctggtggccctgcttgtgggactctccatggtcattggggacctactgcggcagatccccctggctgtgctctttggcattttcttatacatgggagttacttcccttaatgggatccaattctacgagcggttgcacctgctactcatgccgcccaaacaccacccagatgttacctatgtcaagaaggttcggaccatgcggatgcacctgttcactgccttgcagctgctctgtctggccctgctttgggcggtcatgtccacagctgcttccctggccttccccttcatcctcatcctcacagtgcctttgcgcatggtggtacttacccggatcttcactgagcgagaaatgaaatgtctggatgctaatgaggcagagccagtgtttgatgagtgtgaaggtgtggacgagtacaacgagatgcccatgcctgtgtagctgctgtccagaggcatagcagagggactaaggggcaggggctggggggctggggagctggggctcccctcctcctgtccctcctcatttttatttaagtgaataatttaaagcccccttgtccccaccctgcagtaaagtgcttcaacccc

SEQ ID NO: 1643 - DNA, 3877 bp, Rattus norvegicus
  Genbank Accession No. NM_017049
tagtgactgagactcctaagtcttcagcccaaccatggctaatggggtgatcccaccgcccggggggccctcccccctaccccaggtccgggtgcccttggaggagcccccactgggtccagatgtagaagaggaggatgatgacttgggcaagaccttggctgtgagcaggtttggggacctcatcagcaagaccccggcctgggaccctgagaagcctagccgcagctacagcgagcgcgactttgagtttcaccggcacacatcccaccacacccatcacccgctctcagcccgcctgcctccaccccacaagctacggcgactgccccccacctctgctcggcacgccaggaggaagaggaagaaagagaaaacctctgctcccccctcagaagggacaccccctatccaggaggaggggggagctggagcagaagaggaggaggaggaagaggaggaagaagagggagagtctgaggcagagcctgtggagcctccacccccagggccaccacagaaagcaaagttctccattggaagtgatgaggatgacagcccaggtctttctatcaaggctccctgtgccaaggccctgccttccgtgggcctgccgtctgaccagagtccccagcgctccggcagctcccccagtccccgggcccgggcttcccgaatctctacagagaagagtcgaccctggagtccatcagccagctatgacctgcgggagcgattgtgcccaggcagtgccctgggcaaccctgggccagagcagcgggtgcccactgatgaggcggaggctcaaatgctgggttctgccgatctggacgacatgaagagtcatcggctggaggacaaccccggagtgcggcgacacttggtgaagaaaccatcccggatacagggtgggagaggcagccccagtggcctggcgcccatcttgcgcaggaaaaagaagaagaagaagctggatcggaggcctcatgaggtgttcgtggagctgaatgaactgatgttggaccggagccaggagccacactggcgggagacagcacgctggatcaagttcgaagaggatgtggaggaggagacagagcgctgggggaagcctcatgttgcttcgctctccttccgtagcctcctggagcttaggaggaccattgcccagggagcggctctcctggacctggagcagaccaccctgccgggcatcgctcaccttgtggtggagaccatgattgtatctgaccagatccggcccgaggacagggctagcgttctgagaactctgctcctgaaacacagccatcccaacgatgacaaggacagtggctttttccctcgaaatccgtcaagctccagtgtgaactcagtcttggggaatcaccacccaactcctagtcatggccctgatggtgcagtacccaccatggctgatgacctaggggagccagccccattgtggccacatgaccctgatgcaaaggagaagcccctccacatgcctgggggagacggtcaccgggggaaaagcctgaaactgctggagaagatccctgaggacgctgaggccactgtcgtgcttgtgggcagcgtgcctttcttggagcagccagcagcagcttttgtgaggctcagcgaggctgttctcttggagtctgtgctggaggtccccgtgcctgttcgcttcctcttcgtgatgctggggcccagccataccagcaccgactatcacgagctagggcgctccattgccacgctcatgtctgacaagctgtttcacgaggctgcctaccaggcagatgaccggcaggaccttttgggtgccatcagcgagtttttggacggtagcattgtgattcccccatcggaggtagagggccgagacctactccgttccgtggctgccttccagcgagagctgctgaggaagcgacgggagcgggaacagaccaaagtggagatgaccacccggggaggctatgtggcccctggcaaagaactgtctttggagatgggaggctccgaggcaacctctgaagatgatcccctgcagcggacaggctcagtgtttggggggctagtacgggatgtgaagcgccggtacccacactaccccagtgacctacgggatgcactgcactctcagtgtgtggctgccgtgctgttcatttatttcgcagccctcagccctgctattacctttgggggtctgctaggagagaagactgaggggctgatgggtgtgtcagagctgattgtgtccacggctgtgcttggggttctcttctctctgctgggggcccagccgctgctcgtggtgggcttctctggccctctgctggtcttcgaagaagctttcttcaagttctgccgagctcaggacctggaatacctcaccggtcgagtgtgggtgggcctctggctggtggtcttcgtcctggccctggtggcggctgagggcagcttccttgtccgctacatctcgccatttacccaggagatcttcgctttcctcatctcactaattttcatctatgagactttccacaagctctataaggtgttcacagagcatcctttgctgcccttctacccaccggaggaggccctggagcctggcttggaactgaatagtagtgccctgccccccacagagggaccaccaggtccccggaaccagcccaatacagctctgctgtccctcatcctcatgctggggactttcctcattgccttcttcctgcgaaagttcaggaacagccgcttcctggggggcaaggctcggcgcgtcatcggggacttcggcattcccatctccatcctggtgatggtccttgtggattactctatcacagacacctacacacagaagctgacggtgcctacagggctctcagtgacttccccgcataagcgcacgtggttcatcccacccttgggcagtgcccgccccttcccaccatggatgatggtggctgctgctgtccctgcactcttggtcctcatcctgatattcatggagactcagatcactgcgctcatcgtcagccagaaggcacggaggctactcaagggttccggcttccatcttgacctgctgttgattggctctttgggtggcctctgtgggctcttcggcttgccctggctcacagccgccactgtccgctctgtcacccatgtcaacgcgttgacggtgatgcgtactgccattgcacctggtgacaagccccagatccaggaggtgcgggagcagcgagtcaccggggtgctcattgccagcctcgtgggtctgtctatcgtcatgggagctgtgctgcgcaggatcccgttggccgtgctctttgggattttcctgtacatgggagtcacatcactgtctggtatccagttgtcccagcgtctgctgctcattttcatgccagccaagcatcaccccgagcagccctacgtgaccaaggtgaagacatggaggatgcacctgttcaccttcatccagctgggctgcatcgcgctcctctgggtggtcaagtcaacggtggcctcactggcctttcccttcctgctcttgctcacggtgcctctgaggcgttgccttttgccccggctcttccaggacagggagctgcaggcgctggactctgaagacgcagagccaaactttgatgaggatggtcaggatgagtacaatgagctccacatgcctgtgtgaccctcaagatggtggccctccgagaccccaccttggtgactcacctcaggacccagggatgtgcctggagtcactgcccatgccaggacagtggccccttgactttcacagcccagacggcaccggctttgaagtcattataacacactccttgtcttg

SEQ ID NO: 1644 - DNA, 650 bp, Rattus norvegicus
  Genbank Accession No. NM_017050
gttttgcaccttcgtttcctgcggcggcttctgtcgtctccttgctttttgctctcccaggttccgaggccgccgcgcgtctcccggggaagcatggcgatgaaggccgtgtgcgtgctgaagggcgacggtccggtgcagggcgtcattcacttcgagcagaaggcaagcggtgaaccagttgtggtgtcaggacagattacaggattaactgaaggcgagcatgggttccatgtccatcaatatggggacaatacacaaggctgtaccactgcaggacctcattttaatcctcactctaagaaacatggcggtccagcggatgaagagaggcatgttggagacctgggcaatgtggctgctggaaaggacggtgtggccaatgtgtccattgaagatcgtgtgatctcactctcaggagagcattccatcattggccgtactatggtggtccacgagaaacaagatgacttgggcaaaggtggaaatgaagaaagtacaaagactggaaatgctggaagccgcttggcttgtggtgtgattgggattgcccaataaacattccctatgtggtctgagtctcagactcatctgctgtcctgctaaactgtagaaaaaaaccaaaccattaaactgtaatcttaacagtt

SEQ ID NO: 1645 - DNA, 579 bp, Rattus norvegicus
  Genbank Accession No. NM_017059
atggacgggtccggggagcagctcggaggcggcgggcccaccagctctgaacagttcatgaagacaggggcctttttgttacagggtttcatccaggatcgagcagagaggatggctggggagacacctgagctgaccttggagcagccgccccaggatgcatccaccaagaagctgagcgagtgtctccggcgaattggagatgaactggacaataatatggagctgcagaggatgattgctgacgtggacacggactccccccgagaggtcttcttccgggtggcagctgacatgtttgctgatggcaacttcaactggggccgcgtggttgccctcttctactttgctagcaaactggtgctcaaggccctgtgcactaaagtgcccgagctgatcagaaccatcatgggctggacactggacttcctccgtgagcggctgcttgtctggatccaagaccagggtggctgggaaggcctcctctcctacttcgggacccccacatggcagacagtgaccatctttgtggctggagtcctcaccgcctcgctcaccatctggaagaagatgggctga

SEQ ID NO: 1646 - DNA, 4557 bp, Rattus norvegicus
  Genbank Accession No. NM_017061
cttctacttcagacactgtgcgctctcccggaccgtcgtgcgccgctccccgtcgccttccaggactgggaaaggggagaggaggacggtgccacgtccgacggcctcctgggctgggggcagggtctgccgctcgcccttggcaccagtccctgcgacccatccccgagcctcgccctcctcctccctgctcgaagaggtctccctccttcgcgggatctgagtccctgtcttcatttttctcctagccacgtccctccccgagaagggacgagccgggagcatcatgcgtttcgcctggaccgtgctctttctgggacagctgcagttctgtccccttctccgctgcgccccgcaggccccgcgcgagcctcccgccgcccccggtgcctggcgccagacaatccaatgggagaacaacgggcaggtgttcagtctgttgagcctgggggcgcagtaccagcctcagcgacgccgcgactccagcgccactgccccgagagccgacggcaacgctgcagcacagccacgcacgcccattctgctgctgcgtgacaaccgcactgcctctgcccgtgcgaggactccaagcccatctggggtcgccgcgggtcgtccccggcccgcagcccgccactggttccaagttggtttctcgccgtcgggggccggcgatggagcctcaaggcgcgcagcgaaccggactgcgtcgccacagcctccgcagctcagtaatctgaggccacccagccacgtagatcgcatggtgggcgacgacccctacaatccctacaagtactccgacgacaacccctattataactactatgacacttatgagagaccccggtccgggagcaggcaccgacctggatatggcaccggttacttccagtacggtctcccggacctggtacccgatccctactacatccaggcatccacgtacgtacaaaagatgtctatgtacaacctgagatgcgctgcggaagaaaactgcctggccagttcagcatatagggcggatgtcagagactatgaccacagggtactgctacgatttcctcagagagtgaaaaaccaagggacgtctgacttcttaccaagccgcccccgctactcctgggagtggcacagctgccaccaacattaccacagcatggatgaattcagccactacgacctgctggatgccagcacacagaggagagtggccgagggccacaaagcaagcttctgtctggaggacacttcctgtgattatgggtaccacagacgatttgcctgtactgcacacacacaggggttgagtcccggatgttatgatacttatgcagcagacatagactgccagtggattgatattacagatgtacaacccggaaattacattctaaaggtcagtgtaaaccccagctacctggtgcctgaatcagactacagtaacaatgtcgtacgctgtgaaattcgctacacaggacatcacgcctatgcctcaggctgcaccatttcaccgtattagaaagaagctcaccttcccaaaggatgaagcagtacctggtgtttggacctatgaaaaccgtagattagcttaagtaggaagacttagatattttaaaaggcaaacggaaaaacaacaaagaaggttttgtttggactctttcacaacaaatcacataactggattttgagtgtttaaatcagcattagattggcacattttaaatacttattcatgttgctttatgaagtaatggtgtttcaattctgtgggtgcatagtgggctctttcaaagaattctgaatttcttaccttcttttgaaattatagtgcaaaaagaagaggatattttaatgaatgagccacaatttgaactgattactttctaaattgccagacccatgagacaatgatgatgggtttgtatttgcctcaacatagattcgctttttaaaaagggtgttcctattgtataggcaaaaatggatacacttggtgctgaggaagggtcaaatactaactattgttgtcacgaaatataggtctacagcagagagatggtgagtatatattcagatagttacatccctatataaactatgtttacattttagatgcttttctttctgttaattgcttaatctcactctgacttgaggtacaacttctgttttggaatgaattagataattccagattctggtttgataattgttgacattcccccatgctactttttctgagggcagaaacgtctaatgtgacgactcttcacattaccattacgaggatacacagcacagcgaaatcattccgatgacaggtgtgatagatggagagctaacatgcaactgccgagtgtttcactgttagccagaactaagtcactgcccacacagcaattacaccatgaatctctaacatcacaaccttctttcaaatactgtaaaaaaaaaaatactggaaaacctttttagatttgtttcaatctaccacgcttctgaaatgttcagctattaaggggaatgtcaatatatatatacagcccaaattagcgaagcccaaattagggaagcacatagcatggcatacttgagaggttggcaaacaagagggaagcaggtactttctgcaaaaacagggactgtgcgccacaatgagaccgctgtgaccttacttcaaactgtgaaactgtgtgcagcagtaggatttggagtcttaaattcagaaggagcagaaagaaagagagttagacgtttgaattcctggtgcttatgctgacgttttctctcatttgccagcattaaaatctcaagtaaggtgtctcctgtgccaggacgtgtcaggtagacctttctcagtgagctggaatcctgccttctgtgtcatagagttgtaagagcagcagtttctacccatcatgctgtgtactcactgctgcagagcaagtgggaggggccagagatgggccgtccccaggggcggatagcgcggtacacttaattctcttctgcctgaaagcacacttccccgtaagcgaatacagacagaactttgattgagctggtatctgaccgataggattgcttctttgatgtacctctttgacctagctagcatttcagctttgatactgcagaacgatcttttcaaattataatcattctgatagagatatcttaatagacgtgcttttaaaaacaaaacggaaactactgtcagtatgaatactgagccagactggcattcatagatttaacaacttgtatttctaagattcttaactctataaaagtaatatggcttttagatatataggataataatttcagtgagaccgttatctctttactcaacattatgttagggacagtataagccaagcacttacctgttacacattggagactaaaacgactgcccccaaccttagtaagtatgaaaactagactcacattatttcatttttaactgctaaaagtatgtctatagaatttaaaatttaagcactactatttgtcctggccacatttttcaaaaattaagttaaaagttattaattatatacaggtgtgtatttctaataattaaaatacctttcaaatccatggaatgtctgccttttaaatgtaatttgggcttttttgtttgattctttttcacttaactagctgtttatttgtaaacatttctttccacgatttaaaaacacttccaatcggctttacttcctgatttagcacttcctattttgacccttgggcatctgttcttcgtttaattggtgtagaataatgataaaaatcccaagctagtctaaccaaactgcattcttaagagtactaagtgggaatgatgcaaagttcatcaagaattgaaaagaagccggtctttgcactaaggaagacagcataattaagtcttctcgttgccatctgagtaatatcatgatatggggaccgcagaatccatctccggtgggatgatggtatagctttcctagttccagaaaaaatctccttcacattttatataataatttaatcacaatgtccatcgaattcttccttaggcattctttgtaacagtagtgtgctgctctttaaaatattaacctctgacacatgtgtgaacctcattccctgtggtcactaaaatttcttccccactgagcatcaatctttagcagattttaggaaaatactgaattcttagtcaggaaatattttaggaataatcttgctaacagtatattaagtaataaaattacccactctatgtgtgtttcattttttttaatttacatagacaatggtttttataaagcaatgatttcaatttttcccagctacccaaagtcctggttaatttgtgaacacaaattttgttagccttcaagtttaaacggtgctgaattgtcttaacttgaatgtaaaaatggattaaggcttatctcatgggacacaaacatgtcccatatgactgcttgctgcgtactaggggacatgccatttggtgttaaattgtctataataaagttcggtttctcccaaaaa

SEQ ID NO: 1647 - DNA, 1246 bp, Rattus norvegicus
  Genbank Accession No. NM_017066
gacagaacggaattgagtgaaggcaggatcaggttccccgccttcccgtccaaaaatcccgccaaggaagccccagagcacaagaaaatccaaagtggagagaggggaagaaagaaagcactgagtcatccatccagaaggggggagagcgcagccgcccaggcaggagcagcagccagcgatacctggagtccgttgcagaaacctcgccctgcactttgcaacaaaggcagcctgctgtcagcgaggacatctgccaagccaaaaaatgtcgtcccagcaataccagcagcaacgtcgaaaatttgcagctgccttcctggctttgattttcatcctggcagccgtggacactgctgaggccgggaaaaaagagaaaccagaaaaaaaggtgaaaaaatctgactgtggagaatggcaatggagtgtgtgcgtgcccaccagcggggactgtggtctaggcacccgggagggcactcgcactggtgccgagtgcaaacaaaccatgaagactcagagatgtaagatcccttgcaactggaagaagcagtttggagctgagtgcaaataccagttccaggcttggggagaatgtgacctcaataccgccttgaagaccagaactggcagtctgaagagagctctgcacaatgccgactgtcagaaaactgtcaccatctccaagccctgtggcaaactcaccaagcccaagcctcaagcggaatcaaagaagaagaaaaaggaaggcaagaaacaggagaagatgctggattaaaagaggccaccttttgtggacaaggaaaaggacatcagcaagcaggatcagttaactattacatttatacctactgtaggctttttattcaacagttatctgtagcttaagtacatgataggcaaaaacaaagagaaaagaaatgtttttgtagtagcatttttttaatgtataccatagtaccagtaggggtttataataaaggactgtaatactatttaggaagttgagttgtagtacatgatagatggtaggattgaggtaagttttttttttttgtttttgttttgttttggttttggtttgttttgcttttcaaagttatgtgatatttcacatttaaatctttttttttacatttccaaaccttgtgcatcaatttaaatgttacaaccatgtaaactacttcccttattagatagattttcacctagacttttttttcccaattcagaagaaaatatacactaa

SEQ ID NO: 1648 - DNA, 1548 bp, Rattus norvegicus
  Genbank Accession No. NM_017068
gtcggtggtcgcccgtgctttcgctttctcagggctgtgagggtgttcgttggaattgtcggtccagtcgtcacttgtcctgagggatcacgatgcgccttcctctctccggttacggctcgaagctcgtcctgctctttctgttcctgggagcagttcggtccgatgcattgaaacttaatttgacagattcaaagggtacttgcctttatgcagaatgggagatgaatttcacaataacatatgaagctctaaaagtcaatgaaactgtaaccattacagtgcctgacaaggtgacatacaatggaagcagttgtggcgatgataagaatggtgccaaaataatgatacaatatggatccactctctcttgggctgtgaatttcaccaaggaagcatctcagtattttattaacaacatcacgctttcttacaacactaatgataccaaaacatttcctggtgctgtacctaaaggaatccttactgttatcattcctgtgggatcccagcttccattgggtgtcatctttaagtgcagtagtgttttaactttcaacctgagtcctgttgttcagcactattggggcattcacctgcaagcttttgtccaaaatggtacagtgagtaaacatgaacaagtgtgtaaggaggacaaaactgctaccactgtagcacccatcattcacaccaccgtgccatcgcctactacgacactcactccaacttcaatacccgttccaactccaacggttggaaactacaccatttctaatggcaatgctacctgtctgctggctaccatggggctgcagctgaacatcaccgaggagaaggtgcctttcatttttaacatcaaccctgccacaaccaacttcaccggcagctgtcagccccaaacagctcaacttaggctgaacaacagccaaattaagtatctcgactttatctttgctgtgaaaaatgaaaaacggttctatctgaaggaagtgaatgtcaacatgtatttggctaatggctcagctttccatgtttcaaataacaaccttagcttctgggatgctcctctgggaagttcttatatgtgcaacaaagagcaggtggtttccgtgtctcgaacatttcagataaatacctttaacctgaaggtgcaaccttttaatgtgacgaaaggagagtattctacagctcaagactgcagtgcagatgaagacaacttccttgtgcccatagcggtgggagcagccctgggaggagtacttattctagtgttgctggcttattttattggtctcaagcgccatcatactggatatgagcaattttagcacctacaatctgattgaatatattacaaaatacatacaaataacaaagttgtcttacctgtcagtttatgaaacactttgctacttaagacagactccttggaacttttatttggaaatcagtccccacaatttgagataaggctttttttgaaaaaaaacaaaaaacaacaaaaaaacaaaaaacaaaaaaatcattctctgatctgcttaaaatgca

SEQ ID NO: 1649 - DNA, 2793 bp, Rattus norvegicus
  Genbank Accession No. NM_017073
acagccgagaatgggagtagggcggagtgtttgagcagcacacccatttcctctccgctcttcgtctcgttctcgtggcctgtccacccatccatcatctgccggccaccgctctgaacaccttccaccatggccacctcagcaagttcccacttgaacaaaggcatcaagcagatgtacatgaacctgccccagggcgagaagatccaactcatgtatatctgggttgatggtaccggggaagggctacgctgcaagacccgtactctggactgtgaccccaagtgtgtagaagagttacccgagtggaactttgatggttctagtacgtttcagtctgaaggctccaacagcgacatgtacctccatcctgtggccatgtttcgagaccccttccgcagagaccccaacaagctggtgttctgcgaagtattcaagtataaccggaagcccgcagagaccaacctgaggcacagctgtaagcgtataatggacatggtgagcagccagcgcccctggtttggaatggaacaggagtatactctcatgggaacagacggccaccctttcggctggccttctaatggcttccctggaccccaaggaccctattactgcggtgtgggagctgacaaggcttatggccgagatatcgtggaggctcactaccgggcctgcttgtatgctggaatcaagatcacagggacaaatgccgaggttatgcctgcccagtgggaattccagataggaccctgcgaagggatccgcatgggagatcatctctgggtagcccgttttatcttgcatcgggtatgcgaagactttggggtgatagcaacctttgaccccaagcccattccagggaactggaatggggcaggctgccacaccaactttagcaccaaggccatgcgggaggagaatggtctgaggtgcattgaggaggccattgataaactgagcaagaggcaccagtaccacatccgtgcctacgaccccaaggggggcctggacaacgcccgccgtctgactggattccacgaaacctccaacatcaacgacttttccgctggcgttgccaaccgcagcgccagtatccgcattccccggattgtcggccaggagaagaagggttactttgaagaccgtcggccttctgccaattgcgacccctatgcggtgacggaagccatcgtccgcacgtgtctcctcaacgaaactggcgacgagcccttccaatacaagaactaagcggactcgacttccagtgatcttgagcccttcctagttcaccccactcccaactgttccctctcccactggtccccactgtaactcaaaaggatggaataccaaggtctttttattccttgcgcccagttaatttttgcctttattggtcagaatagaggggtcaggttcttaatctctacacacccaaccccttctttcctagctagctttccagtgggggaacgggagggggtggggaagggtaacccaccgcttcatctcagcgggaatgcatgtcctgtaggcatagctgtcacaaatcgggtgtacttgtggtgagggaggactggttttttttttccttcaggataattgaaagggcaggcccaacagcttagattaacattttctctgtcagtagagagctgttatttcttccggtgaaaccagctttctattgaagtctggtgaggagttggaggttggtctcttggcttccttagcttagggaaggggagttcaccctcccttcatgaaacacagttcacctgacaaatggccctactgtaaaggaagaaaaaagtttcttggtcctccatttataactcaaagcagagtagtatttttatatttaaatgttaaaaacaaaaaagttatatatatgggtgtgtggatatatatgtcttttctaattgagaaaaccatcctattccctgggtgccaagtttgagtgaggagctcggtgtagaagtgaggcactcttgaggtaggggtggggatgcagtactgggaaagttggttatcttgggggttcagcttcattactacttagggtttccctgcccactctgcaggagcagatgttggacaggtagccagtgggatgccactgcttgccgccactgtccctgggcttagtttaaggggacgtgtatacctaatccacacacgagttagaagtatgagttggctggtcaacttgaacattgttacaggcgggtgggtgttagtggggggttattttttggtgggactagcatgtcactaaagcgggccttttgatatattaaattttttaaagcaaaacaagtttagattttaatcaagttcgtagggtttctaactttacagaattgcctgtttgtttcaatgactccttccacttggctcttaggggaactgaggacaggcctggagttaatacacttgtcattctgtgtcctagtgtcctcttcctccggcagactgtccccttccttctgaaaaagccgatagagtcttgttttatttttcttttataataaacacaccccacctccatcccagcttgttgccttgcagttttctggatgtttgtgtcggcagcaggcagctgtggtttttttctcttgccacgatgactctaattaccatgtatagtatgttcagttagataactcactgtaaacagactgtaactgagagcagagcttgtaaatcaacctaacgtttataagatttcctctgacttgtttctttgtggttccaaaaaaaaaaaaaaaaaaaaaaacctcaaaaact

SEQ ID NO: 1650 - DNA, 2171 bp, Rattus norvegicus
  Genbank Accession No. NM_017076
ccttgccgctcgctgctagcttggatccgcgtggactacagggactgaatcggacccggaaccacatggccccactcgccggtgcctctcgctcccgggtgtggtcagcggggctactgaggctgctgctgctgtcctgctttacgctccagaaagcgggtggggagatagctgtgcaggtgctctccaattcgaccggcttcttgggagggtctacagtcttgcactgtagtctggcttccaaagacaatgtgacaatcactcagctaacatggatgaagagggatccagatggatcccacccttccgtgcctgtcttccaccccaagaaggggcccagcatctctgatccagagagggtgaagttcttggttgccaaggtgtacgaggatctgaggaacgcatctctggccatctcgaacttgcgtgtagaagacgaaggcatctatgagtgtcagattgccacgttccccacaggcagtaagagcgccaatgtctggctgaaggtgttcgcccgacctaaaaacacagcagaggccctggagccctctcccaccttgatgccgcaggacgtggccaaatgcatctctgctgatggtcaccctcctggacgaatcacgtggtcctcgaatgtgaatggaagctaccgtgaaatgaaggaaacagggtcccagccgggcaccaccacagttatcagctacctctccatggtgccttctagccaggcagatggcacgaacatcacctgcacagtggaacatgaaagcttccaggagccggaccagcagccattgatcctttccctaccttatccacccgaagtgtccatctctggctatgaaggcaactggtacattggcctcactaacgtgaacctgacctgtgaagctcgcagcaaaccaccgcccaccaactatagctggagcacggccacgggtccccttcccaactccactcatttccaggaaaacggcagtcacctgctaatctccaccgtggatgacctcaataacacgatctttgtgtgcaaagccatcaatgccctagggtctgggcagggccaagtgaccatcctagttaaagaggcatctgagattctgccgccaaagacaagcttaggcactggctacatcattgccatcgtcttttgtgtcctgatcatcggagtagtagcaggcattgtattctggaaatacaggcgtggttgtggtcggcagtccaggaccttagacagggagaacgtccgctattcagcagcgaatggcgtctctgtcccaaacgtggagacgaacaacttgaggtgatggtgctggggtagacagaactaaggaacttgaagacataacaactggaaccctacttccacaaaagaaaaagcctccagagagacttgactgtccagtgtggcgaacatagcaaggttgggggtctccttggccgctgccgaattccgcattgtcgaaaggactcatggaacccggtgtgctgactcacacttgacatctcagcaagcgagggccacataaagcaaggttgagtctagcacggctgtagagagaagccctgtctatacacaggcaagctaaggggctttgagacagtcagaaactgaagtctttctttgggtaaggtaaatcctctacctcgtgtatgtgacaaacttgaaagacttctacctctgagactcaagtgcggactctctttatagctgactcagctggggctaacccctctctcctctctggacaaggtctcagagtgtagccaaagctagaccgaaactcacagaggtccgtctgtctctacctcccaagtgctgcagttaaaggtttgtgtgtgccacactcctttgctaggtctttttaataaagtaaatatttaataaagtaatatatttataaaaaaactagttataatatatattttttgagacagtgtttcctgtagcccaggctgacctcaaacttactatgtagccaagaatgatagtaaactaatttattttaatttgtcttcaagcttaaacatagcccaacccctgctcctttccctctcttctctcaatccattttcgtcttctttttcttcccagacactattctgatgtatgtcttcattgcaaacattttattgaccttcgtaaaaatgtgtgaaccacagataaaaaaaag

SEQ ID NO: 1651 - DNA, 1835 bp, Rattus norvegicus
  Genbank Accession No. NM_017079
ggtaggctcagtgcctaaaagccacagagccccatcaggcggggagcagggtaaagtgcagaagtcggagcccagggctgtgtagaccgccggcactatgctgtacctaccgtgcctgttgctgtgggcattcccacagttctggggacaatccgaagtccagcagaattacaccttcggctgcctgcagatctcttccttcgccaaccgaagctggtcccgcacagacagtgtggtctggctgggggatctgcagacacaccgttggagtaatgactcagacaccatcagcttcacaaagccgtggtcccagggcaaattcagtaaccagcagtgggagaagttgcagcatatgtttcaagtgtatcgaaccagctttaccagggacatcaaggaaatagtcaaaatgatgtcacctaaagaagactatcctatcgaggtccaactgtctgctggctgtgaaatgtaccctgggaatgcttcagaaagctttttacacgtagcatttcaaggagaatatgtcgtgagattccatggaacatcctggcagaaggtcccagaggccccatcttggttagatttgcccatcaaaatgctcaacgctgatgaaggaacgagagaaacagtgcagatactcctgaacgacacctgcccccagtttgtccgtggcctcctagaagcagggaagccagacctagaaaagcaagagaagccagtggcctggttatcccgtggccccaaccctgcccatggccatctgcagctggtatgtcatgtctctggcttccacccaaagcctgtgtgggtgatgtggatgcggggtgaccaggagcaagggggtactcacagaggtgacatcctgccaaatgcggatgagacatggtatcttcaagcaaccctggatgtggaggctggagacgaggctggcctggcctgcagggtgaagcacagcagtctagaggggcaggacatcatcctctactggggtggcagacaagtatccccggtgttgatcttcttgatagtaggcgtactggttctagtggtgtgtgctgtggcctactatatcatcaggaaaaggagacgctcctatcaagacatcatgtgagatttttacccctgcctctcctgaagttcagaccttccaggttctaggacttcagtccttgtctgctcagaaactgaggataaaaaagaggaatcctgaagaaatgaagagcaaccagtacacccttttaatattaattataagaaatcaattatttaaatgatttttataagcttgggtagttcagaacaaacacaactgcacatgtgtgtacctgccagaaacaagctgtgagcagtgtctcgtgggatttgtactgaactagacagcacgcttcctgcccaaacagacactttgggggttgttggcaagtgtaaagtccaacaccaacacgactgtactctgtatttttcaagataacgagaaaaatggatttgtgtgtgtgtgtgtgacatatagctttggggtttgttggcaagtataaagtccaacaccaacacgactgtactctgtatttttcaagataactagaaaaatagattttgtgtgtgtgtgtgtgtgatacaagtattttaaaaagtaaactcaaatatttacaaatgattactaccttaaatacaaagctgctgactgatgattaccccaaaggcttcttccagtgtgtggtctttttacaatgtttgttctaattgtcataatggccactttagggcacagtctccattgaaaatgtgcattaatgactgaaaggtggtttctctttaaaataaaattaggatgtacgatg

SEQ ID NO: 1652 - DNA, 1265 bp, Rattus norvegicus
  Genbank Accession No. NM_017080
cggcctgggaggttgtagaaagagctgcaggttttctttgtgtgtcctacagagctccctgagccaggtccctgttggacggcagttatgaaaaaatacctcctccccgtcctggtgctctgcctgggttactactattctacaaatgaagagttcagaccagaaatgctccaggggaagaaagtgattgtcactggggccagcaaagggatcggaagagaaatggcatatcatctgtcaaaaatgggagcccatgtggtattgactgcaaggtcggaggaagggctccagaaggtggtgtctcgctgccttgaactcggagcagcctctgctcactacattgccggcactatggaagacatggcttttgcagagcgatttgttgttgaggcaggaaagctcttgggtggactggacatgctcattctcaatcacatcacacagaccactatgtctctcttccacgatgatatccactctgtgcgaagaagcatggaggtcaacttcctcagctatgtggtcctgagcacagcagccttgcccatgctgaaacagagcaatggcagcattgccatcatctcctccatggctgggaaaatgacccaacctctgattgcttcctactctgcaagcaagtttgctctggatgggttcttttccaccattagaaaagaacacttgatgaccaaggtcaacgtgtccatcactctctgtgtcctcggcttcatagacacagaaacagctttgaaagaaacctctgggataatcttgagtcaagctgctcccaagcaggaatgcgccctggagatcaaaggcacagttctgcgcaaagatgaggtatactatgacaaatcatcttggactccacttctgcttgggaatccaggaaggaggatcatggaatttctttcattacggtcatataacagggacctatttgtaagcaactaggaactcctgaggcctggtgaagggtcttggaacagtcctgcctgatatttctgtgagccctacccacaaatttctctgagcccctttccagagatacacaaattttggggtacacctcaccatgagaaattcttgcaacacttgcacagtaaaaatgtaattgtaataaatgtcacaaaccactttgtagcctgcagttgtgaacttgattgtaactatggatttaagcacacagttgtatcaattttacctcatacagaatgaaacaatgatgcctaatgtaacattaaataaaataaaggtaatatcaaccg

SEQ ID NO: 1653 - DNA, 1864 bp, Rattus norvegicus
  Genbank Accession No. NM_017081
ggaaagcgagtatccctcccaccccaggctggtgttcctctgcactccgtgtcctggcccagagtccctctcggcgctccccaacccggcccccgcccctccctagaccggccgggccccgaagtcatggagcgctggccttggccgtcgggcggcgcctggctgctggtggctgcccgcgcgctgctgcagctgctgcgctcagacctgcgtctgggccgcccgttgttggcggcgctggccctgctggccgctctcgactggctgtgccagcgcctgctgcccccgccggctgcactcgtggtgctggctggtgctggctggatcgcgttgtcccgcctagcgcgccctcctcgcctgccggtggccactcgcgcggtgctcatcaccggttgtgacactggttttggcaaggagacagctaagaaactggatgccatgggcttcacggtgctggccactgtgttggatttgaatggccctggtgctctagaactgcgtgcccgatgttcccctcgcctgaagctgctgcagatggacctgaccaagccagaggatatcagccgtgttctggaaattaccaaggctcacacggccagcactggcctgtggggtctggttaacaatgctggcctcaacatggtagtggccgatgtggaactgtctccagtggtaactttccgcgaatgtatggaggtgaacttctttggtgcacttgagctgaccaagggcctcctgccactcctacgtcactcaaggggacgtattgtgaccgttggcagcccagcaggagacatgccatacccctgcttggcagcctatggaacctccaaggcagctattgcactgctcatggacacattcagctgtgaactgcttccctggggtatcaaggtcagcatcatccagcctggctgcttcaagacagaggcagtgactaatgtgaacctctgggagaagcgcaagcaactgctgctggccaacttgcctagagagctgctgcaggcctatggtgaagactacattgagcacttgcatgggcaattcctgaattcactcagaatggcattgcctgaccttagccccgttgtagatgccatcattgatgcactgctggcagctcagccacgcagccgctactacacgggccgtggcctggggctcatgtatttcatccaccactacctgccaggaggcctgcggcgccgcttcctacagaacttcttcatcagtcaccttctaccccgagcactgaggcctggccaacctggccctgttcatgacacaacccaggacccaaacccttcccccacagtatcagctctgtgaaccacaaacttaggtgtttcagcaggagaggcttcttgagcccttggccctctcccctggccattatagacccctcaacctttccctagagtctctgttaagaaaagcccagcctctactgctgatgccgagtccaggcccgggaggtggaatttgctagtgatcctctggacctctcctctgcttcatgagaccatgtataccctaccaggcacgacccttcagcttggagagcccagatggatggagagtttagcgtgagatgtggctgcaacctttgagaggatgctacagaccacttctgtgctgactttagaatgattagacatgtggggcctcctcagaattctttgggtacccactgtctcagtgctgcagtccagagtaaatccctcttgactggctcaagatttaggttcccaaccactggctcccagccacatggaagctgtatgctgtatttgtctggttgttggcattttaaaataaagatacatttttttatttctcctagaatgggagagatagtgtttgg

SEQ ID NO: 1654 - DNA, 2227 bp, Rattus norvegicus
  Genbank Accession No. NM_017082
ggaattccgggcagagcacaaaggatggggcagctgctctctttgacctggctgctgctggttatggtggtaactccctggttcactgtagctggagccaatgactcaccagaagcaagaaggtgttctgaatgccacgacaatgccacctgtgtgttggatggggtggtcaccacatgctcctgccaggcaggcttcactggagatgggctggtgtgtgaggacatagatgagtgtgccaccccgtggactcacaactgctccaacagcatctgcatgaacacactgggctcctacgagtgctcctgtcaggatggctttcgtctgacgcctgggctgggctgcattgatgtgaatgagtgcacagagcaggggctcagtaactgtcattccctggctacctgtgtcaacacggaaggcagctactcatgcgtgtgtcccaagggctatagaggggatggttggtactgtgagtgctcccctggcttctgtgagccagggctggactgcttgcctcagggtcccagtggaaagctggtgtgccaagacccctgcaatgtctatgaaaccctgactgagtactggcgcagcacagactatggtgccggctactcctgtgactcagatatgcacggctggtaccggttcacaggccagggtggcgttcgcatggctgagacctgtgtgcccgtactgaggtgcaacacggctgcacccatgtggctcaatggctcgcatccttcgagcagagagggcattgtgagccgcacagcctgcgcacactggagcgaccactgctgcctgtggtccacagagatccaggtgaaggcctgccctggtggcttctatgtttacaacttgacagagccccctgagtgcaatctggcttactgcaccgatcctagctccgtggaggggacttgcgaagaatgcggggtagatgaagactgcgtatctgataacggcagatggcgctgccagtgtaaacaggacttcaacgttacagatgtctccctcctggagcacaggctggagtgtgaggccaatgaaatcaagatatccctcagcaagtgccagctacagagtttgggctttatgaaggtcttcatgtacctgaatgacagacagtgctcaggcttcagtgagaggggtgaacgagactggatgtccatagtgactcctgccagggatggtccctgtgggacagtattgaggagaaatgaaacccacgccacctacagcaacaccctctacctggcaagtgagatcatcatcagggatatcaacatcagaatcaactttgaatgctcttaccctctggacatgaaagtcagtctgaagacctccctacagcctatggttagtgccttgaacatcagcttgggtgggacaggcaagttcactgtgcagatggcactgttccagaaccctacctacacacagccctaccaaggtccttctgtgatgctctccactgaggcttttctgtatgtgggcaccatgctggatgggggtgacttgtcccggtttgtactgctaatgaccaactgctatgccacacccagtagcaactccacggaccctgtaaaatacttcattatccaggacagatgtccacatacagaagatacaaccattcaggtgacagagaatggcgagtcctctcaggcccggttctctattcagatgttccggtttgcaggaaactccgaccttgtctaccttcactgcgaggtgtacctgtgtgacactatgagtgagcagtgtaaacctacctgttctggtactagatatcgaagtgggaacttcatagatcagacccgtgtcctgaacttgggtcccatcacacgacaaggtgtccaggcctcagtgtccaaggctgcttccagcaacttggggttcctgagcatctggctgctgctgtttctctcagctactttgaccctgatggttcattgatggaaaacagaaaacctggtgtggctcccagttcacttcctgctggccaggagtggggatgcaggctggtaagcagccaggagagagggagctcacactgcctccagcttgcacttacccttttcctttaaccctcaccatcaaaaccgagttgatatctttcaatgctgctgattcttcaactggaacttgtaatgtgtctgtacatgaagcccctgtctctttaaggaatgtatcaaaataataagtttaaaacaatccggaattc

SEQ ID NO: 1655 - DNA, 988 bp, Rattus norvegicus
  Genbank Accession No. NM_017084
caggatggtggacagcgtgtaccgtacccgctccctgggggtggcggccgaagggatccccgaccagtatgcggatggggaggccgcacgtgtgtggcagctgtacatcggggacacccgcagccgtactgcagagtacaaggcgtggttgcttgggctgctgcgccagcacgggtgccaccgggtgctggacgtggcctgtggcacaggagtggactcgattatgctggtggaagagggctttagcgtcacgagtgtggatgccagcgacaagatgctgaaatacgcactgaaggagcgctggaaccggaggaaggagccagcctttgacaagtgggtcattgaagaagccaactggttgactctggacaaagatgtgccagcaggagatggctttgacgctgtcatctgccttgggaacagttttgctcacctgccggacagcaaaggtgaccagagtgagcaccggctggcgctaaagaacatcgcaagcatggtgcggcccgggggcctgctggtcatcgaccaccgcaactacgactacatcctcagcacgggctgtgcacccccagggaagaacatctactataagagtgacctgaccaaggacattacgacgtcagtgctgacagtaaacaacaaagcccacatggtaaccctggactacacagtgcaggtgccaggtgctggcagagatggcgctcctggcttcagtaagtttcggctctcttactacccacactgtttggcgtctttcacggagttggtccaagaagcctttgggggcaggtgccagcacagcgtcctgggtgacttcaagccttacaggcccggccaggcctacgttccctgctacttcatccacgtgctcaagaagacaggctgagcctggctccggctcccaccctaagaccatcgcctaccacagatattgcagagatgtggggggcaggcaaacagggagtcgacaatacagccttcccttgcc

SEQ ID NO: 1656 - DNA, 2446 bp, Rattus norvegicus
  Genbank Accession No. NM_017087
ccaggagtgagcagctgctcccggttggccctgacggacagacaaaccgacagcctgacatcctagtccaccaactaaccagcctgtacctggctgcttccccctccccaggaacattgaccatgcgtcccctgtggctactcaccttgctgctggctctgagccaggccttgccctttgagcagaagggcttctgggacttcaccttggatgatgggctgctcatgatgaatgatgaggaggcttcaggctcagacaccacttcaggtgtccctgacctggactctctcacacctaccttcagtgccatgtgtccttttggctgccactgccacctgcgggttgttcagtgctctgacttgggtctgaagactgtgcccaaggagatctcacctgataccacactgctagacctgcagaacaatgacatctctgaactccgcaaggatgacttcaaaggcctccagcacctctatgctctggtcctggtaaacaataagatctccaagatccatgagaaggcctttagccctctgcggaagctgcagaaactctacatctccaagaaccacctggtggagattcctcccaacctgcccagctccctggtagagctacgaatccatgacaaccgtatccgcaaagtgcccaagggcgtgttcagtgggctccggaacatgaactgcattgagatgggtgggaatcccctggagaacagtggctttgaacccggagcctttgatggcctgaagctcaactacctgcgcatctcagaggccaagctcactggcatccccaaagatctccctgagaccctgaatgaacttcacttggaccacaacaaaatccaggctatcgagttggaggatctacttcgctactccaagctgtacaggctgggcttaggacacaatcagatccgaatgattgagaatgggagcctgagttttctgcctaccctgagggaacttcacttggacaacaacaagctgtcccgggtgcctgctggcctcccagatctcaaactcctccaggttgtctatctgcactccaacaacatcaccaaggtgggcatcaacgatttctgccccatgggctttggagtcaagagggcctactataatggcatcagcctcttcaacaaccctgtgccctactgggaagtgcagcctgccaccttccgctgcgtcactgaccgcctggccatccaatttggaaattataagaagtagaagcagtggtagccaccatggctcgttggtgagagtctctgaggaacatagccagttgttccacaggggaaggggaacaaagaagcaacacctttgttccccaatattaactcactgcccaccacagcttcctctggctcctaagcatgcacatatgcacatggcctggcctctcccattcccctcagcctttgagatttaacactcacccaccatgtccactcagagactccctataaatcttttttcttgctcatcctgaaactcagatgtttgtgggaagaatggacagagcacatggccacagttactgttccatccgggcatgtattcctcctcttccttacccatgtctgacttctagctctcctgggctctgctgctgcccttatcctctggtgatctctcttcaacaagttcactacctgtccatccaagccgccacctggctctactaactcctggatccttccctctctccaactctgttatgcttcctggcacttttcttccttctggggttatagatctgtccctgccatctctggacctggttcatatctttctgtctttgtctctttctgtatttctttgcctatatctctgtctgtctctatttctgtttctgtctctctgtctttatatctgcctctctctctctctctctctctctctctctctctctctctctctcacacacacacacacacacacacaaacacacaaacacaaacacacacacacacacacacacacacacacacacacacacacacacacacacaccgtcttctccaggctgctttctgtttcacaggtctctggccagtccctgcacaaacaaatatagggaaactattttcctgactgccctacctggcacttgatctcccatccctggaggaagctggaagctggaggcccagaatcctatccatattgtccaggaaagggtccatactctgttatcaagatgaggatcaggaagcttcctagcccctggagaggctcagcaggccaccagaggcccccaccccgaaccagtttgcattggcccctgccctctccccaagatggctaggtcccctccctcacccctgggtccctgctgtggcaggaggtggtggtcagttgtacccagcaggagggagtgctgcttatgaggtcagttgtctctcaattaaagaaacactgtgcaataaaaaaaaaaaaaa

SEQ ID NO: 1657 - DNA, 4775 bp, Rattus norvegicus
  Genbank Accession No. NM_017090
gaattccggattacagacacgtatgtcatatggatgttggagatttgaactcaggtcctcatgtttgggtggtaagtggttctaaccactgagctgtctcaccagtctcagtggggtacccacactgaccactctccgcccactcctgaaatgccctttgttctccccatccctacgctatctctgagagctcacccccatacccttctgttctcacacacagccttccaggcgtctctcagtgcctgccagccgaccccaaggcgaaggagcatgcagtgctcagcccggggagtcctcgaagcgaagacacctgcaccggatgcccctggcctcccgtgaccgcatcatgatgctgggccactcgtgtctttgagtcagtagaagcagatcttcatcagtccacatcaacaccggctaataaggaggaaaccactgccaagctccaggaacaccatgttctgcaggaagttcaaagatctcaagatcacgggggagtgtcctttctccttactggctcctggtcaggttcctacggagccaatagaggaggtggccggagtctctgagagctgccaggccactctgcccacctgccaggagtttgctgagaatgcagaagggagtcacccccaaagaaagacaagccgcaacagagtctacctacacaccctggcagagagtattggcaagctcattttcccagagtttgagagactgaaccttgcacttcagagaacattggcaaagcacaaaataaaggaaaacaggaattcttcagaaaaagaagaccttgaaagaataattgcagaagaagcaattgcggcaggtgtcccagtggaggtgctcaaagactctctgggtgaggaactgttcaagatctgttatgaggaagatgagcacatcctgggcgtggttggcggcaccctgaaggactttctcaacagcttcagcacgctcctgaagcagagcagccactgccaggaggcggagaggcgggggcgactggaagatgcctccatcttgtgcctggacaaggaccaggactttctaaatgtttactacttcttcccgaagagaaccacagccctgcttctccccggtatcattaaagcggctgctcgcatactgtacgaaagccacgtggaggtgtccctgatgcctccctgcttccgaagtgagtgtaccgaattcgtgaaccagccctatttgctctactcggtccacgtgaagagcaccaagccttctctgtccccaggcaaaccccagtcctcgctagtgatccctacttcgctcttctgcaaaactttcccattccacttcatgctggaccgtgacctggccattctgcagctgggtaatggcatcagaaggctggtgaacaagagggacttccaagggaagcccaactttgaagagttctttgaaattctaactcccaaaatcaaccagacatttagcggcatcatgacaatgttgaatatgcagtttgtcatacgggtgaggagatgggataacttagtgaagaaatcttcaagggttatggacctcaaaggtcaaatgatctacatcgttgaatccagtgccatcttgttcttagggtcgccgtgtgtggacagattggaagatttcacaggacggggtctctatctgtctgacatcccgattcataatgccctgagggatgttgtcttgataggggaacaggcacgggctcaagatggcctcaagaagaggttgggaaagctgaaggcaaccttggagcatgcccaccaagccctggaggaggagaagaagaagacggtagatctcctgtgttctatctttccctctgaggttgctcagcagctctggcaaggacaaattgtgcaagccaagaagttcaatgaggtcaccatgctcttctcagatatcgtagggttcactgccatctgctctcagtgttcacctctgcaggtcatcaccatgctcaacgctctctatactcgctttgaccaacagtgtggagagctggatgtctacaaggtggagaccatcggagatgcatattgtgtggcagggggattgcacagagagagtgacacacatgctgtccagatagcactgatggccctgaagatgatggagctctccaatgaggtcatgtctccccacggagaacctatcaagatgcgaatcggactgcattctgggtcagtgtttgctggagttgtcggagtgaagatgccccgatattgcctgtttggaaacaatgtcactctggctaacaaatttgagtcctgcagtgtgcctcggaaaatcaatgtcagccccacgacatacaggttactcaaagactgtcctggctttgtgttcaccccgagatcgagggaggagcttccaccaaacttccctagtgacattcctggaatctgtcactttctggatgcttatcaacatcaaggacctaattctaaaccatggttccagcagaaagatgcagaagatggaaacgctaacttcttaggcaaagcatcaggggtagattagtgagccgcatgtttctgtgtttgatgcctttgaggggtgctcagaatctctgaaatgactttaggattgcagaagataaaaaactgtgttaaaattgcaggggtgaaacccagtttcctctgtttcccatttaagatggaaaaaaaaaagtattcaatgcttcagcgctttcaaccttcttctctatttaagaaacaaacctcaaaagtgacttgtgacttttggggacatagctttgttctagagcagtcactacctgcactcgaaatccaacacagtgtacatattccagacaattgtagtcaagtttaagtgtcaaagtaatgtactcacctgtggcctgtgaccagtgcaaactgtggttattacagtgtgtctgtggtagtgttgcctgtaaatctctgaatagaaatgacagtgtttaattctgcaagagcttccagcctcttgactctacattcaattaggtttccttattctatcctggcgtatgtaacacaataggccagcgccttcttcccagctacatctttgtgcctatgtacgtgttttcctttcctttcctttcctttcctttttttttttaagaaaataagcaattagacataggataaaatgtgatataaagtagttcagtaagtgtcaaagaatattttcatgttttgtcattaaagatattatctatagcacaatatataatacaacaaatacttttcattttgatcctatctgtgataaaacattttaattaatagtaacaatgtactccctactaatccatgtaaaatttactaatagcaaaactttcagagtaaaagtatttacatacattgttaaaatgcaataacattcaaatttaattaaggcatagaattaatatttgcacacagagagcctactgtagaggacagtggcaaagtgttcacaaacacacgtgtttaaatgatcctctactgccgtgttgagccataaaagccaaggggaaaagttttaagttagaagtagaaaaatagacttcattttgtctttttttgataccttcttaagtatttctactgaccatttagtgtatgtgtatgtgttaagaatcaaaatttttattactcagtgtacacctgtgagtattattctactttaaatatactaatattttctacagaaaccactagtatcattgaagaaaatgtctatgatttcattatagagatcctgatacgtttttttttttcttctggagtttaaactaatgtcctttccttcccctgccctcctccgcagtcctctttcttcctctcccattaggcatgtttgtgtgattctgtgggctgacacaggaaactgtgcatgctgggtaaagactgttactgagtaacttcctcaccatgaggcttcagttttattgctaatggtgacagtttacattcccgagtgttaatttggtaaaaggaagtgactttaaaagaagaccaacttcaaagccaagagagatagacataattgaatttttcaatcagtattagtagaacgctagacattctgaatttctatgtgtgtagttgaaaagaaactcagtttaaaagtcattttctacctccaatagtcttcaagcatccagagcaacagacatcttttacctagctctagtttccaagggggacaactaaaccacccaatggatttctttaaaggcggatattgtctcattaaacagtcacactgatgttggatagtgtcacgggccctgcaaaggtgtatttaggatgtcacaatgatgtggaattcaatgaatatttattaaggaggtaaagaggtaaataccccctctttctggaactaatattcaatacaggggaactagtaggaatcacagacaattagaaagcgtaaaacaggatgtcatcctcttaagctgtgcagttaggtggttgctacattagtaataatctgattcagaagcttgcacattaattagaattaattctcccactgtcttttagggatggtgatagaactcaatgacaaagcacctgcctagcatttaggcagtcctgttctgacccaagcagcatgaaggaattacatgtatctctcatgtgcatatgatgtatgatcacactcacctgtgtcacctgtgtacacacctggggcaaatggaggaactgtatctaattcaaggcaaactaccggagctccatgtacggttcctataacttttctattattttgtcattttagcaaaaaaaaaa

SEQ ID NO: 1658 - DNA, 2950 bp, Rattus norvegicus
  Genbank Accession No. NM_017094
gaattccggagagaccacaagatagaggattattaatttatggggattttttggagatttatatacccaagcaacaactcctagatgctacagaccaagacaccaagaaataaccacgaaattctactttcaaccctagcttctctaccagattttaactaaacaagatcttcttgcaaaggtctcaggtatggatctttggcgggtgttcttaaccctggcactggcagtctccagcgacatgtttcctggaagtggggctacaccagctactcttggcaaagcttccccggttctgcaaagaattaatccaagcctgagggaaagttcctctggaaagcctcgattcaccaagtgtcgttcccctgaactggagaccttttcatgctactggacagaaggggatgatcataatttaaaggtcccgggatctattcagctatactatgctagaagaattgctcatgaatggaccccggaatggaaagaatgccctgattatgtctctgctggagcaaacagctgttacttcaactcatcgtatacctccatttggataccctactgcattaagcttactacaaatggtgatttgttggacgaaaagtgtttcactgttgatgaaatagtgcaacctgatccgcccattggcctcaactggactttactaaacatcagtttgcctgggatccgtggagatatccaagtgagttggcagccaccgcccagtgccgatgttctgaagggatggataattctggagtatgaaattcagtacaaagaagtaaatgaaacaaaatggaaaacgatgagcccgatatggtcaacatcagtcccactgtactcactgagactggataaagagcacgaagtgcgtgtgagatccagacaacggagcttcgaaaagtacagcgagttcagtgaagtactccgtgtaacgtttcctcagatggacacactggcagcatgtgaagaagatttccggtttccatggttcttaattattatctttggaatatttggagtagcagtgatgctatttgtagttatattttcaaagcagcaaaggattaagatgctgattttacccccagtaccagttccaaagattaaagggattgatccagatcttctcaaggaaggaaaattggaggaggtgaacaccatcttgggcattcatgataactacaaacccgacttctacaatgatgactcctgggttgagttcattgagctggatattgatgatgcggatgagaagactgaagagtcagacaccgacagacttctaagcgatgaccaggagaaatcagctggtatccttggagcaaaggatgacgattctggacgtaccagctgttatgaccctgacattttggataccgatttccacaccagtgacatgtgcgatggtacctcggagtttgctcagccgcagaagttaaaagcagaagctgatctcttgtgccttgaccagaagaatctgaagaactcgccttatgatgcttcccttggctctctgcacccctccattaccctgacaatggaagacaaaccacagccacttctgggcagtgaaactgagtcaacccaccaactcccctctacaccaatgagcagtcccgtgtcactggcaaacattgacttttatgcccaagtaagcgacattacaccagcaggtggtgtagtcctttctccaggccaaaagattaaggcagggttagcccagggcaacacccagctggaggtggccgcgccctgccaagaaaattacagcatgaacagtgcctacttctgtgagtcagatgccaaaaagtgcatcgctgcggcccctcacatggaggccacgacatgtgtaaaaccaagctttaaccaagaggacatttacatcaccacagaaagccttaccactactgcccgaatgtccgagacagcagataccgctccagatgctgagcctgtcccagactacaccacggttcacaccgtgaagtccccaaggggccttatactcaacgcgactgctttgcctttgcctgacaaaaagaagtttctctcctcatgtggctatgtgagcacagaccaactgaacaaaatcatgcagtagcctttcctatctttaatggcaaaagaaatgactgggcacgaacgcctaaaccaaaactatgttttaaatctgtgttgggagagcgtgagagtgaatgtggattcaaaaataccttttctggaaacgtcgaaacattatcataacgtggaaaatcaagaatatgtaatcagatagatactcccattgtgaattttaaatattttaagatcgtctttaagactgtttgtggcagtgattgtctgtgctgtgggtcttaactttgtgatactaagttattaaatagctacgtttttcatgtatgtagatcattgctttttttgaaaaagcaaaacaatcaggtggcttttgcagttcaggaaattgaatgcagattttagcacagactgatttctttttcctttttaaatagctaggagctaaaactctaggggagaaggtaaaactagtttggatatgcaaaacatttattttgacataaaattgataaagatatttttaataatttacactgtaagcatgagtattttataatacactacagatatattgttagttcacaacaatccatctacggatgtaacaactacaatgtgtagaggggttgatgctttggtcaatgaacctaaagaaaaatgaacaagttagatttttacaaagcccttttttataactcccaaaacttcttaaatctaaaaatgtctgcattattggaacaaacccattttaaatttgtaaatgaatatttttttaattttgaaaactttaattttttatacaaattaacgtatcatacaccaaacagtaacagaagtgattataataatggaagaaacagtttcttcc

SEQ ID NO: 1659 - DNA, 743 bp, Rattus norvegicus
  Genbank Accession No. NM_017101
ctttgcagacgccgctgtctcttttcgccgcttgctgcagacatggtcaaccccaccgtgttcttcgacatcacggctgatggcgagcccttgggtcgcgtctgcttcgagctgtttgcagacaaagttccaaagacagcagaaaactttcgtgctctgagcactggggagaaaggatttggctataagggttcctcctttcacagaattattccaggattcatgtgccagggtggtgacttcacacgccataatggcactggtggcaagtccatctacggagagaaatttgaggatgagaacttcatcctgaagcatacaggtcctggcatcttgtccatggcaaatgctggaccaaacacaaatggttcccagttttttatctgcactgccaagactgagtggctggatggcaagcatgtggtctttgggaaggtgaaagaaggcatgagcattgtggaagccatggagcgttttgggtccaggaatggcaagaccagcaagaagatcaccatctccgactgtggacaactctaatttctttgacttgcgggcattttacccatcaaaccattccttctgtagctcaggagagcacccccaccccatctgctcgcaataccctgtaatctctgctctcactgaagttctttgggttccatattttcctcattccccttcaagtctagcaggattgcaaagttaagtttatgattatgaataaaaactaaatgagaagtgtt

SEQ ID NO: 1660 - DNA, 2758 bp, Rattus norvegicus
  Genbank Accession No. NM_017111
catgagtgtacttctctcttggctaagaaagacagcaaagcaaagacttttaaagcgaagaagctggaaacaatcagaagaacaccatggaagaaacagagaaaaagattgcaacacaagagggtagattgttttccaagatgaaggtgtttctgctgtcattaacatgtgcatgtttaaccaaatcactatcaggagtatatatgaattccatgctcacacaaatagagagacaatttgatatctccacatctgtagctggattaatcaatgggagctttgagattggaaacctttttttcattgtatttgtgagttattttggaacaaaactgcacagacctgtggtgattggtattggatgtgtgattatgggcctggggtgtctcttaatgtcattacctcatttcttcatgggcagatacgaatatgaaacaacgatctcacctacaggcaacttgtcctcaaacagcttcttgtgtatggagaaccgaacacagaccttaaagccaacgcaagacccagcagaatgtgtgaaagaaatgaaatcattaatgtggatatgtgtaatggtaggaaatattatacgtggaattggtgaaactcctattgtgcccttgggtatctcttacatcgaagactttgccaaatcagaaaactctcctttatacattgggattttagaaatggggaaggttgctggcccaatttttggacttttgttgggatcttactgtgcacaaatttatgtagacattgggtctgtgaatacagatgacctgaccataacacccagtgatacacgctgggttggtgcttggtggattggctttttggtctgtgcaggagtgaatatcctgaccagcatcccctttttctttttgccgaaagcacttccaaagaaaggacaacaggagaatgttgctgtgactaaagatggcaaagttgagaaatatggaggacaagccagagaggaaaatcttggaatcactaaagatttcttgacgttcatgaagaggctcttctgcaatccgatttacatgcttttcatccttacaagtgtgctccaggtgaatggctttattaataaatttacgttcttgcccaaatacctggaacagcagtatggaaaatctactgcagaggcaatattcctcataggtgtttatagcttacctcccatatgcctcgggtatctaattggtggctttattatgaagaagtttaagattactgtcaagaaagctgcatacctagcattttgcctatcggtgtttgaatatcttctttttctttgtcactttatgttgacctgtgacaatgcagcagttgctggattaaccacctcttacaaaggagttcagcaccaactacatgtggagagcaaggtccttgctgactgcaacacaaggtgtagctgctcaacgaacacatgggatccagtgtgtggagacaatggtgtagcatacatgtcagcttgccttgcgggctgtaagaagtttgttggaactggaaccaacatggtgtttcaggattgcagctgcattcagtcattaggaaactcgtctgcagtcctgggtctgtgtaaaaaaggtcctgagtgtgccaacaggctgcagtactttttaatcttaacaataattatcagtttcatctactcacttacagccatacctgggtacatggtttttttgaggtgtgtcaagtctgaagagaagtcacttggagttggattacatacattttgcataagagtatttgctggtattcccgcacctgtttactttggcgctttgatagacagaacctgtttacattggggaaccctgaaatgtggtcagcgaggggcatgcaggatgtatgacataaacagtttcaggcacatttacctggggttgcctatagcactaagaggatcaagctatctgcctgccttcttcattctgatacttatgaggaaattccagttccccggggacattgactcttcagcaactgatcatacagagatgatgctcggagagaaggaaagcgagcacacagatgtgcatggaagtcctcaggtcgagaatgacggagaactgaaaacgaagctgtaatgagttttctactgccctgttcaaggccatgaacagaatgcacacttcccttcctcggaatcctgagagatacaataggaaccttctctttaaggacctcaacaattgtttttctcactataaaaataattgctgatatcatttttatagtgagaaaaacaataaaaataattgctgatatcattttcagaatttcaggtgatatttaagatttccctggggaagacttttatggtgacccccacactacactttaaagcttccttcattttcacataacattttctcttaactcaatcaagggaaatatgtgtttcccacacatctttaaatgagtataaaactttcctattcctgaaacagtatttaatttcattgaatttatggttcacagttggaagtatttagagctgaaaagatacattctcattaagccacattgaaaagttaacttttctatgttcaggatgtctccatatgtctatatgtaggagttctcaaatattattattattgtagacatgatgctcctagattagacttctcactcctgtgtcatttcctgtttctagtcccttctttcattactcctgtcacacagttgaatgttttgtttagagcactgacaaacttaatcaggttattaaaaatcacattag

SEQ ID NO: 1661 - DNA, 2113 bp, Rattus norvegicus
  Genbank Accession No. NM_017113
gcgcaggcaagaccatgtggatcctggtgagctggctggccttagtggcaaggctggtggctggaacacagtgcccagatggtcaattctgccctgttgcctgctgccttgaccagggaggagccaactacagctgctgtaaccctcttctggacacatggcctataataacgagccgtcgtctagatggctcctgccagatccgtgaccactgtcctgatggctactcttgtcttctcactgtgtctgggacttccagctgctgcccgttctctgagggtgtatcttgtgatgatggccagcactgctgcccccggggcttccactgtagtgcggatgggaaatcctgctctcagatatcagatagcctcttgggtgctgtccagtgtcctggtagccagttcgaatgtcctgactccgccacctgctgtattatgattgatggttcctgggggtgctgccccatgccccaggcctcttgctgtgaagacagagtgcattgctgtccccacggggcctcctgtgacctggttcacacgcgatgcatttcacccacgggcacccaccccttactaaagaaattccccgcacaaaggaccaacagggcagtggcttccttttccgtggtgtgccctgatgctaagacccagtgccctgatgactctacctgctgtgagctacccactgggaagtatggctgttgtccaatgcccaacgccatctgctgttccgaccacctgcactgctgcccccaggacactgtatgtgacctgatccagagcaagtgcatatccaaggactacaccacagatctcatgaccaagctgcctggatacccagtgaatgaggtgaagtgcgacttggaggtgagctgtcctgatggctacacctgctgccgcctcaacactggggcctggggctgctgtccattcaccaaggctgtgtgttgtgaagaccacattcactgctgcccagccgggtttcagtgtcacacagagacaggaacctgtgaactgggagtccttcaggtaccctggatgaaaaaggtcacggcctccctcagcctgccagacccacagatcttgaagaatgatgtcccctgtgatgacttcagtagctgtccttctaacaatacctgctgcagactcagttctggggactggggctgctgtcccatgccagaggctgtctgctgcttagaccaccagcattgctgccctcagggtttcaaatgtatggatgaggggtactgtcagaagggagacagaatggtggctggcctggagaagatgcctgtccgccagacaactctgctccaacatggagatattggttgtgaccagcataccagctgcccagtagggcaaacatgctgcccaagcctgaagggaagttgggcctgctgccagttgccccatgctgtgtgctgtgaggaccggcagcactgttgcccggctgggtacacctgcaacgtgaaggcgagaacctgtgagaaggatgcaggctctgtccagccttccatggacctgacctttggctctaaggttgggaatgtggaatgtggtgccggacatttctgccatgataaccagtcctgttgtaaagacagccaaggaggctgggcctgctgtccctatgtaaagggtgtctgctgtagagatggacgtcactgttgtcccattggcttccactgttcagccaagggaaccaagtgtttgcggaagaagacccctcgctgggacatacttttgagggatccagccccaagaccgctactgtgaggaagggctaacgactaaagaactccacagtcctgggaaccctgttctgagggtatccaccactcaggcctccctggcacctcttcctttagtctccccggcctactcattctgagtcaccccatcaccatggaaggtggggcctcaaactaagaccttctcttatggaaagaaggctgtggcaaaagccccgtatcaaactgccatttcttatgatttctgtggaccttgtggccaggtgctcttctcgatccacaggtgttgtgtgagcttgcttttgtgtgtgtgtgtgtgcgcgcgtgcgagcgtgttgctccaataaagtttgtacc

SEQ ID NO: 1662 - DNA, 1561 bp, Rattus norvegicus
  Genbank Accession No. NM_017122
gagtgtgtggtctggggccacctctctctttttgggtcaaatgagagtttggggtatcttgtgtctgagggcccttctggagtagtgtcaagggactaaaaggatgtaaccattgctctctcctttcacttcctttggttggggggaacccaggtgggacttggctcttctgccatgggcaagcagaatagcaagctgcggccagagatgctgcaggacctgcgagagaacaccgagttctctgagctggagcttcaggagtggtacaagggcttcctgaaggactgcccgactggcatcctcaacgtggatgagttcaagaagatctacgccaacttcttcccctacggcgatgcctccaagttcgccgagcatgtcttccgcacttttgacaccaacagcgacggcaccatcgacttccgggagttcatcatcgctctgagcgtgacctcgcgtggccgcctggagcagaagctcatgtgggccttcagcatgtacgacctggacggcaatggctacatcagccgggaggagatgctagaaattgtgcaggccatttacaagatggtttcgtccgtgatgaagatgcctgaggatgagtctaccccggaaaagaggactgagaaaatcttccgccaaatggacacaaacaatgacggcaagctgtcactggaggagttcatccgcggggccaaaagcgacccatcgatcgtgcgcctgctgcaatgcgatcccagcagcgcttcccagttctgagctgagaggagccagctcgcctccctgccttcaccggccctccggctctcagcttcctctccctcgtgtctatccaggctggggaatccccttctgggtctgcactgtgggggggcctctggagaagcgaaccctgcaaggaaggggctaagcaaggcagccgttagtccccacggcctaagaggcagaatctcccttagtggaccgagattacccccgggtcaggttctgtatctttccccagacagctgatcaccttccacgccacccacaacccgaggctcttccacaacacgggaagaggggctaggtccttcttgggtggtcctcagcctggagggaggtggggatttgtgccaaggtgaagagtctttttgtttgttttggtggggaagaccggaggattactgggctgtgggactttgaagaagttccctgatctacttccctgcagaagaacacttcctgtcccagctcttgctgctggaggcatggtaaaaagaagatctcccaggattccaactgggggtccccaaacccagcctgcctctttgcacttggataacacagatttacccgtctgtcctctgtatttctctctccttccccacctcacacacgcacggggccgcgcgacatgcgcgcgcaacacacacacacacacacacgcacgatatgcacgcacacatgcacagcacccgcgcacacagaggccggcagacagatgagcagagcccctccacagcgttctgtgtgggaaagaagtgcagcccctgccaagccccatgtccctctgcatgcgccg

SEQ ID NO: 1663 - DNA, 1158 bp, Rattus norvegicus
  Genbank Accession No. NM_017124
ggccaacacctcttctgtctgggttcctcaagctgctcgctccccatctaggcgaagatgtccgcccaagagagttgcctcagcctcatcaagtacttcctcttcgttttcaacctcttcttctttgtactaggaggcctgattttctgctttggcacctggatcctcattgacaagaccagcttcgtgtcctttgtgggcttgtccttcgtgccactgcagacctggtccaaggtcctgtcggtctcgggtgtcctcaccatggccctggctctcctgggctgtgtgggggctctaaaggagctgcgctgtcttctgggcctgtatttcggaatgctgctgctcctgtttgccacacagattaccttggggatcctcatttccactcagcgagtccggctggagcgaagggtgcaggaattggtgttacggaccatccagagctaccgcacgaatccggatgagacagctgctgaggagagctgggactatgcgcagtttcagctgcgctgctgcggttggcaatctccgcgggactggaacaaggcccagatgctgaaagcaaacgggtccgaagagctctttgtgccctgctcctgctacaattccaccgcgaccaatgactcctccggctttgataagctctttctctcccagctaagccggctggggccgcgggcgaagctgaggcagactgctgacatatgtgcactccccgcaaaagcccatatataccgtgagggctgcgcgcggagcctccagaagtggctgcacaacaatatcatctccatagtgggaatttgtctgggagtcggtcttcttgagctcggcttcatgacactctcgatattcctgtgtagaaatctggatcacgtctatgaccggctggcccggtaccgctaggccccaacccaccggttggcacccacgcacctccatgcagtcaggaactgtttccttcctggttggttacaggcttggagccctgtgcctcaggcctcattctctggggacccagatgtctgccctaagacagccttcacttcccccacagggccagggactttcgagcccagcttccttccctgctccctcctccccacaccatctgtctgccacctcccacatgacacctcaaataaatccccttcttttttg

SEQ ID NO: 1664 - DNA, 1018 bp, Rattus norvegicus
  Genbank Accession No. NM_017138
gctggaacgggtccgtacggcgttgttcttggttcccatcgtaacttaaaagggaaacttacacaatgtccggaggccttgacgtcctgcagatgaaggaggaggatgtcctcaaattccttgctgcaggaacccacttaggtggcaccaaccttgactttcagatggagcagtacatctacaaaaggaaaagtgacggtatctacatcatcaacctgaagaggacttgggagaagctgttgttagccgctcgagctattgttgccattgagaaccctgctgatgtcagcgtcatctcctccaggaacactggccagcgagctgtgctgaagtttgccgctgccacaggagccactccaattgctggccgcttcacacctgggaccttcactaaccagatccaagcagccttcagggagccccggcttctagtggtgactgatccccgggctgaccaccagcccctcacagaggcctcttacgtcaacctgcccaccattgctctttgtaacacagattctcccctgcgctatgtggacattgccatcccatgcaacaacaagggagctcactcagtgggtctcatgtggtggatgctggccagggaagtactccgcatgcgaggaaccatctcccgggagcacccatgggaggttatgcctgatctttacttctacagggacccagaggagattgagaaggaggagcaggctgccgctgagaaggctgtgaccaaggaggaattccagggtgaatggacggcaccagcgcctgagttcactgctgctcagcctgaggtggccgactggtctgagggtgtgcaggtgccctctgtgcccattcagcagttccccacagaagactggagtgcacagccggccactgaggactggtcagcagctcccacagcacaggctactgagtgggttggagccaccactgagtggtcctgagctcctctgcaggtgcctgagcgaagggaaaaaaggtggaaggaaaataaagttcctgaaagctg

SEQ ID NO: 1665 - DNA, 1039 bp, Rattus norvegicus
  Genbank Accession No. NM_017147
gaaacatggcctctggtgtggctgtctctgatggagtcatcaaggtgttcaatgacatgaaagttcgcaagtcttcaacgccagaagaagtgaagaaacgcaagaaggcagtgctcttttgcctgagtgaggacaagaagaacatcatcctggaggagggcaaggagattctggtaggagatgtggggcagactgtggacgacccctacaccacttttgtcaagatgctgccagacaaggactgccgctatgctctctatgacgcaacctatgagaccaaggagagcaagaaggaggacctggtattcattttctgggcccccgagagtgcaccccttaagagcaaaatgatctatgccagctccaaggatgccatcaagaagaaactgacaggaatcaagcacgaattacaagctaactgctacgaggaggtcaaggaccgctgcaccctggcagagaaactaggtggcagcgccgtcatttccctggagggcaagcctttgtgagccacctccagccccctgcctggagcatctagcagccccagacctgctcttgggtgttgcaggctgcccttttcctgccagaccggaggggctgggggggttccagcagggggagggttttcccttcaccccagttgccaaacatccctcccaccccctggaccgtccttttccctccatccctgacggttctggccttcccaaactgcttttgatcttctgattcctcttgggttgaagcagaccaagtcccgtcctaggcacccagtttggggggagcctgtatttttttttttaacgacacccctactcctgatctgtcccatcccatgctgccaacttctaaccacaatagtgactctgtgcttgtctgtttagttctgtgtgtaaatgaactgtggaaatgaccctccctgcaccagctggttgccctcccctttccctttgatcttggccactcatggaagcaggaccagtaagggaccttcaatttaaaaaaaaaaaaaaacacaataaaaaggctaattaacaaa

SEQ ID NO: 1666 - DNA, 1403 bp, Rattus norvegicus
  Genbank Accession No. NM_017148
gctgtcgcccgtgcgcctcctagcagctgccagaatgccaaactggggaggaggcaagaaatgcggggtgtgccagaagacagtctactttgctgaggaggtccagtgcgagggcaacagcttccacaaatcctgcttcctgtgcatggtttgcaagaagaatctggacagcaccactgtggcagtgcatggagaagagatctattgcaagtcatgttatggcaagaagtatggaccaaaaggctacggctacgggcagggtgcaggcacgctgagcatggacaagggggagtctctgggcatcaagcatgaggaagcccccggacacaggcctaccaccaaccccaatgcatccaagtttgctcagaagatcggcggctctgagcgctgtccgcgatgcagccaggcagtctatgcagcggagaaggtgatcggtgccgggaagtcctggcataagtcctgcttccgatgtgccaaatgtggcaaaggcctcgagtcgaccaccctggcagacaaggatggtgagatctattgcaaaggatgctatgccaaaaactttgggcccaaaggttttggctttggacaaggagctggcgccttggtccattcagagtgaggctgccgctgcgtaccctgcctactcctgcactctcataagcagtccgttcctggaagccatggacacctccaagatcctctctctcactcagccctgctgcacatcactaatgccttggacttgggtgttctttggcttaggggtctgcctgagttccttccccactaagggcttcctcctgcctggcattcgatacccttatctttaggagacatctgtctagtcaccccttcccagataccaggtccctctcccccacaccttacccctacagacctctgtggccaggacactctctactggccaggacacctgaccccacatctttggagcccaaaagagcaaggcggaagacctgcgctagggaaggctgtggtctattgtatccagagtctctctctgggtaggatgctgagcttcttggtgcctctcagtctggaagtccccgtgagaggcagagaggtgcggataggattgtggggtcatcagaaggagcttgttctctgacctcttgcctttgaatgtggaaataataacttttcacttagggatgaagaagaacgcaggtcagaggaccccaaaatctagaggttgcctgacctcaagttccctgttccatgggcaagggagagcctaatgcataccttgaacaaggcattgacatggatcagtggtccagatcttagagtggtcagttctggttctaagcttgggtctggtggctgggatggacagcttctgttgcagcatagcccagggtagagctgtgttctagccactcctg

SEQ ID NO: 1667 - DNA, 630 bp, Rattus norvegicus
  Genbank Accession No. NM_017150
tcttccggtcccaggcgctcggggagccgcggcttaccgtgcagacatggccaagtccaagaaccacaccacacacaaccagtcccgcaaatggcacagaaatggcatcaagaaaccccggtcacaaagatacgaatctcttaaaggggtcgaccccaagtttctgaggaacatgcgctttgccaagaagcacaacaagaaaggcctgaagaagatgcaggccaacaatgccaaggcagtgagtgcacgagcagaggccatcaaggccctcgtgaagcctcaggctgtcaagcccaagatgccaaagggctccagccgcaaactcagccgtctggctttcatcgctcaccccaagcttgggaagaagattcgaagctacatggccaagggtcgtaggctctgccaaccaaagcccaaggttcaaaccaaggcagaggccaaagctccagctaaggcccaggccaaagctccagcccaggctcccaagggtgcccaggcccctgtgaaggccccatagaacaggctcctgccagtgtgaagacagacagactgctgtgacacacccacctacacactatctgcagatgaccagtgtcctatgctgtttttacaaataaacttgagacaaga

SEQ ID NO: 1668 - DNA, 487 bp, Rattus norvegicus
  Genbank Accession No. NM_017151
tttttcccagcagccgccaagatggccgaagtggagcagaagaaaaagcgaaccttccgcaagttcacctaccgtggcgtggacctcgaccagctgctggacatgtcctatgagcagctgatgcagttgtacagcgcccggcagagacggcgcctgaaccgaggcctgcggaggaagcagcactcactgctcaagcgcctgaggaaggccaagaaggaggcgccacccatggagaagccggaggtcgtgaagacccaccttagggacatgatcattctgcccgagatggtcggcagcatggtgggtgtgtacaacggcaagaccttcaaccaggtggagatcaaacccgagatgatcggccactacctgggcgagttctccatcacctacaagcctgtgaagcacggccggcccggcattggtgccacccactcctcccgatttatccccctcaagtagtggggacaataaagactcgttttcagcc

SEQ ID NO: 1669 - DNA, 466 bp, Rattus norvegicus
  Genbank Accession No. NM_017152
cctcttttaccgagacccgtcaacatgggccgcgttcgcaccaagactgtgaagaaggcggcccgggtcatcatcgagaagtactacacgcgcctgggtaatgactttcacaccaacaagcgcgtgtgcaaggagatcgccatcatccccagcaaaaaccttcggaacaagatagccggctatgtcacgcatctgatgaagcggattcagagaggtcctgtgagaggcatctccatcaagttgcaggaagaagagagggagaggagagataattatgttcctgaggtctcagccctagatcaggagatcattgaggtagatcctgacaccaaggaaatgctgaagcttctggactttggcagtctctccaacctccaggtcactcagcctacggttgggatgaatttcaaaacaccacgtggagctgtttaatccattatgccatattttcaataaacctgaaaac

SEQ ID NO: 1670 - DNA, 880 bp, Rattus norvegicus
  Genbank Accession No. NM_017153
ccttttggctctcagagcggcaccatggcggtcgggaagaacaagcgcctgacgaaaggtggcaagaagggagccaagaagaaagtggttgatccattttctaagaaagactggtatgatgtgaaagctccagcaatgttcaatattaggaacatcgggaaaacactagttacaaggactcaaggaaccaaaattgcatcagatggcctcaagggtcgtgtgttcgaagtgagtcttgcagatctacagaacgatgaagttgcatttagaaagttcaagctaattactgaggatgttcagggcaaaaactgtctgactaacttccatggcatggatcttacccgggacaaaatgtgctccatggtcaaaaagtggcagaccatgattgaagctcatgttgatgtgaagacgaccgatgggtatttgctccgacttttctgtgttggtttcactaagaaacgtaacaaccagattagaaagacatcctatgcgcagcaccagcaggtccgccagatccgcaagaagatgatggagatcatgacccgagaagtgcagacaaatgacttgaaggaagtagttaataaactgattccagacagcattgggaaagacatagagaaggcttgccagtccatctatcctctccatgacgtttttgttaggaaagtcaaaatgctgaagaaacccaagtttgaattgggaaaactcatggagctccatggtgaaggcggtagttctggcaaaacaactggtgatgagacaggtgctaaggttgaacgagctgatggctatgaaccaccagtccaagaatccgtttaaaatccagatttttaatagcgacaaataaaaagtcctatttgtgaaaaaaaaaaaaaaaaaa

SEQ ID NO: 1671 - DNA, 801 bp, Rattus norvegicus
  Genbank Accession No. NM_017160
gtcggctgtgtcaagatgaagctgaatatctccttccctgccactggctgtcagaaactcatagaagtggatgacgaacgcaagcttcgtacgttctatgagaagcgcatggccacagaagtagctgctgatgctcttggtgaagagtggaagggttatgtggtccggatcagcggtgggaatgacaaacaaggttttcccatgaagcaaggcgttttgacccatggcagagtgcgcctgcttttgagtaaggggcattcttgttatagacctaggagaactggagagaggaagcgcaagtctgtccgaggatgcattgtggatgccaacctgagtgttctcaacttggttattgtaaaaaaaggagagaaggatattccaggactgacagataccactgtgcctcgtcggttgggacctaaaagagctagtagaatccgaaagctttttaatctctccaaagaagatgatgtccgccagtatgttgttagaaagcccttaaacaaagaaggtaagaagcccaggaccaaagcgcccaagattcagcgtcttgttactccccgtgtcctgcaacacaaacgccgacgtattgctctgaagaagcaacgcactaagaaaaacaaggaggaggctgcagaatatgctaaacttttggccaagagaatgaaggaagccaaagagaagcgccaggaacagattgccaagagacgtaggctgtcttcgctgagagcttctacttctaaatctgagtccagtcaaaaataagtctttaaagagtaacaaataaataatgagaccttg

SEQ ID NO: 1672 - DNA, 872 bp, Rattus norvegicus
  Genbank Accession No. NM_017165
gactcggcctcgcgcgtccattggtcggctgcgtgaggggaggagccgctgcccgccgagatgagctggggccgtctgagccgcttattgaagccagcactgctgtgcggggctctggctgtgcctggcctggctggcaccatgtgtgcatcccgcgatgattggcgctgtgcgcgctccatgcacgaattctcagccaaggacatcgatgggcacatggtttgcctggataagtacaggggttgcgtgtgcatcgtcaccaacgtggcctcgcaatgaggcaaaaccgacgtaaactacactcagctagtcgatctgcatgcccgatacgccgagtgtggtttacgaatcctggccttcccttgcaaccagttcgggaggcaggagccaggaagtaatcaagaaatcaaggagtttgcagccggctacaatgtcaggtttgacatgtacagcaagatctgtgtaaatggggacgatgcccacccactgtggaaatggatgaaagtccagcccaagggcaggggcatgctgggaaatgccatcaaatggaactttaccaagtttctcattgataagaacggctgcgtggtgaagcgctatggtcccatggaggagccccaggtgatagagaaggacctgccgtgctatctctagccctacaagtgttggcccctgcaccgagcccccctgccctgtgacccctggagccttccaccccggcactcatgacggtctgcctgaaaaccagcccgctggtggggcagtcccgaggacctggcgtgcatccccgccggaggaaggtccagacgctgtggccccgggctcgaggcttcaccttggctgccttgtgggaataaaatgtagaaatgtgc

SEQ ID NO: 1673 - DNA, 1054 bp, Rattus norvegicus
  Genbank Accession No. NM_017166
ggtccgagccgcctggcttaggcggaggcgacggcagggtagggagcagccgggaacgcggcgagcccctagccggggacacgggacgggcggagacctcgagccctgggctttccttgccagtggattgtgtagagtgtacagccagtctcttgtcttctgtccaacatggcatcttctgatattcaggtgaaagagctggagaagcgagcttccggccaggcttttgagctgattctcagccctcgatcaaaagaatctgtccccgagttccccctttcccccccaaagaagaaggatctttccctggaggaaattcagaagaaattagaagctgcagaagaaagacgcaagtctcatgaagcagaagtcttgaagcagctcgctgagaagcgggagcatgaaaaagaagtgctccagaaagccattgaggagaacaacaacttcagcaaaatggcagaggagaaactgacccacaaaatggaggctaacaaagagaaccgggaggcgcaaatggctgccaagctggagcgtttgcgagagaaggacaagcacgttgaagaggtgcggaagaacaaagaatccaaagaccccgcggacgagaccgaggctgactaagttgttccgagaactgactttctccccgaccccttcctaaatatccaaagactgtactggccagtgtcatttactttttcctccctgacaaatattctagaagctgatgtaggaaccgtataggtagatccagaccgtgagatgttttaggggctcaaggggagaaactgaaagtgttttgctcttttttaaagtgttggtctttctaacgtagctatttttctcgttgcatcttttcctctcgggcacactcggtgtgctgggttaatggctagtgctgtattgactgtggaagacgttcgtgaagagtatgtagtggcttcttccaacccattagatgctgagtatctgttcactttgcgatcccaattctgtcccaatctcaccagatgctactgtactggaatggttaataaactgcacagtgctgttggtc

SEQ ID NO: 1674 - DNA, 1679 bp, Rattus norvegicus
  Genbank Accession No. NM_017177
gactgataggcgtgtcgggcgggaccagagcgcgccccactcagcgaaagctgccgtccctctttgccttgagcgccgcagccctgagaatcgcatctggcttggaaacagtcctaagactggagtctcgaagaaagccggagacagtcgcgaagaacggaggacgcccagagactcttcggcttcccggaagtggaaccgagcatacccggaaggagctaatcccacctgaagattgctgagcacccgcaggcgttaagcctaacggagtccacgtcatggcggcggatgggacaggtgtagtcggaggaggggctgtcggcggccccctgtccaaggacggtttgctggatgctaagtgcccagaaccaatccccaatcggcggcgctcttcctcgctgtcccgtgacgcgcagcgccgagcctatcagtggtgccgggagtacctgggcggagcctggcgcagagcgcggccggaggagctgagcgtttgccccgtgagcggaggcctcagcaacctgctcttccgatgctcgctaccgaaccacgtgcccagtatgggcggggagccccgggaggtgctgctacggctgtacggggctatcttgcagggtgtagactccttggtattagaaagcgtgatgttcgccattcttgcagagagatctctagggccccaactttatggagtgtttccagagggccgcttggaacagtacctcccaagccggccattgaaaactcaagagctccgggacccagtgttgtcaggagccattgcaacaaagatggcccgtttccatggtatggagatgcccttcaccaaggagccccgctggttgtttgggaccatggagcggtacctaaagcagatccaggacctgccgtccactagccttccccagatgaacctggtggagatgtacagcctcaaggatgagatgaatcacctcaggacgttgctagacgctacaccgtccccagtggtcttctgccacaatgacatccaggaaggaaacatcttactgctctcagagccagacagtgatgacaacctcatgttggttgatttcgagtacagtagttacaactacaggggctttgacattgggaatcatttctgtgagtgggtttacgattacacttacgaggagtggcctttctacaaagcaagacctgcagactaccccactagagaacagcagctccttttcatccgtcattatctggcggaggttcagaaaggtgaggtcctctccgaagaggagcagaagaaacaggaagaagatttgctgatagagatcagccggtatgccctggcctctcatttcttctggggcctatggtccaccctccaggcttccatgtccactatagagtttggctacttggaatacgcccaatctcggttccagttctacttccagcagaaggggcagctgaccagcttcctatcaccttgaggatccaacccccacctcagatttctcctggagcctccggggcaggccctcggagggaggggcaaagagcagaagcccccagagcttgggctgtgcctctaagtgagactgtcgttgaagtagctgacctccgtactcctttcttagtacttgcccaaggggggcatctgacagcccctggggctgtgcacctaaataaatgaacttcacaaatac

SEQ ID NO: 1675 - DNA, 1353 bp, Rattus norvegicus
  Genbank Accession No. NM_017180
gagcgcctctcggagctgggttttcccccgcggcgcgggagccaggagccgccttttccgctgggtgtcactcgggggtggggagggtggcccattgaaaagcgctgcgaggggccccggccagtgcccttcagtgagcgctccgcggaagacggcagagagcagcccgctcacggctccgggatcttgtggcgggtcaggactcgcctgtccctctgccgggaccccgagccaccgccgccaccgccaccgctctgtctcctgcgagtcagccttctctgtgcgctccgggcaggcggccgcggaagccgctggagcgaggacagcgcacggctgctactgctacccccagccggagcgtctggaagcctaaaggccgagcggagcagcagcaccccttatgccggaaggatgctggagagcagcggttgcaaggcgctgaaggaaggagtgctggaaaagcgaagcgacgggctgctgcagctctggaagaaaaagtgctgcatcctcactgaggaagggctactgctcataccgcccaagcaggtacaacatcagcagcagcaacagcagcagcaacagcccgggcaggggacagccgaaccgtcccaacctagtggccccgccgtcaccagccttgagccaccagccaagctgaaggaattgcacttttccaatatgaagactgtagactgcgtggagcgcaagggcaagtatatgtacttcactgtggtgatggcggagggcaaagagatcgactttcggtgtccccaggaccagggctggaacgcagagatcacgttgcagatggtgcagtacaaaaatcgtcaggccatactggcggtcaagtctacgaggcagaagcagcagcacctggtccagcagcagcctccgcagacgcagcagatccaaccccagccccagcagccgcagatccaaccccagccccagccgcagatccagcctcaaccccaaccccaaccccaacctcagccccaaccccagcagcagccccagccccaacagctccactcctacccgcacccgcatcctcatctttaccctcaccctcaccctcacgcgcactcgcacccgcacccgcaccctcaccctcatccacaccaactccagcatgcgcaccagcctctccactcgcagccacagggccaccggcttctccgcagcacctccaactctgcctgaagagggcggcacccgggccactcaaggttttgaggacttcgggaagtgggaagagtgcattactatttaagttcacttggatcaaaaccaacggaggtctccccgccctgtgccagatcaagtagtttggacatcaccctacggataacg

SEQ ID NO: 1676 - DNA, 1072 bp, Rattus norvegicus
  Genbank Accession No. NM_017187
ggcacgagggaaggaagtctctctgtggaggtctgagggaagagctcgcgccaggtagacgctgcgccgtcatcatgggcaagggggaccccaacaagccgcggggcaagatgtcctcgtacgccttcttcgtgcagacctgccgggaggagcacaagaagaagcatcccgactcgtcggtcaacttcgccgagttctcgaagaaatgttcggagagatggaagaccatgtctgccaaggaaaagtcgaagtttgaggatttggccaagagcgacaaagctcgttatgacagggagatgaagaactatgttcctcccaaaggtgataagaaaggaaagaaaaaagatccaaatgctcccaagagaccaccgtctgccttcttcctgttttgctctgaacatcgcccaaagatcaaaagtgaacaccccggcctgtctattggagatactgcaaagaaactgggggagatgtggtctgagcaatctgccaaagataaacaaccgtatgagcagaaagcagctaaactaaaggagaagtatgaaaaggatattgctgcataccgtgccaagggcaaaagtgaagtaggaaagaagggtcctggtaggccaacaggctcaaagaagaagaatgaaccagaagatgaggaagaggaggaggaggaagaagatgatgaagatgaagaggaggaagatgaggatgaagaataagtatctgtcctaaagtgtggagtatatgtgctcaggcaattattttgctaagaatgtgaaattcaagtgcagctcaacattagcttcagtataaaaactgtacagatttttgtatagctgatgagattctttgtagagaaaatactttttaaaaagggtttgtagctttttcaggggctacaacgtacagttagatttaaagcttttgatgttgaatgtttctaaatatttaatggtttctttaatttcttatgatagcaaaaaaaaaaacttcataggaatttctattaccagtaaaagaattttttttttaggatgttgcatttttgtttttttttaaaatttgtaataaaataatgtatatt

SEQ ID NO: 1677 - DNA, 2474 bp, Rattus norvegicus
  Genbank Accession No. NM_017190
cagaagccagaccatccaaccttctgtatcagtgctcctcgtcgcctcactgtacttcacggaagagacttggttgactggccacttggagcggaatcaggagacattcccaactcagggagactgaggtgagggccctagctcgcccacttgctggacaagatgatattccttaccaccctgcctctgttttggataatgatttcagcttctcgaggggggcactggggtgcctggatgccctcgtccatctcagccttcgagggcacgtgtgtctccatcccctgccgtttcgacttcccggatgagctcagaccggctgtggtacatggcgtctggtatttcaacagtccctaccccaagaactacccgccagtggtcttcaagtcccgcacacaagtggtccacgagagcttccagggccgtagccgcctgttgggagacctgggcctacgaaactgcaccctgcttctcagcacgctgagccctgagctgggagggaaatactatttccgaggtgacctgggcggctacaaccagtacaccttctcggagcacagcgtcctggacatcatcaacacccccaacatcgtggtgcccccagaagtggtggcaggaacggaagtagaggtcagctgcatggtgccggacaactgcccagagctgcgccctgagctgagctggctgggccacgaggggctaggggagcccactgttctgggtcggctgcgggaggatgaaggcacctgggtgcaggtgtcactgctacacttcgtgcctactagagaggccaacggccaccgtctgggctgtcaggctgccttccccaacaccaccttgcagttcgagggttacgccagtctggacgtcaagtaccccccggtgattgtggagatgaattcctctgtggaggccattgagggctcccatgtcagcctgctctgtggggctgacagcaacccgccaccgctgctgacttggatgcgggatgggatggtgttgagggaggcagttgctgagagcctgtacctggatctggaggaggtgaccccagcagaggacggcatctatgcttgcctggcagagaatgcctatggccaggacaaccgcacggtggagctgagcgtcatgtatgcaccttggaagcccacagtgaatgggacggtggtggcggtagagggggagacagtctccatcctgtgttccacacagagcaacccggaccctattctcaccatcttcaaggagaagcagatcctggccacggtcatctatgagagtcagctgcagctggaactccctgcagtgacgcccgaggacgatggggagtactggtgtgtagctgagaaccagtatggccagagagccaccgccttcaacctgtctgtggagtttgctcccataatccttctggaatcgcactgtgcagcggccagagacaccgtgcagtgcctgtgtgtggtaaaatccaacccggaaccctccgtggcctttgagctgccttcccgcaacgtgactgtgaacgagacagagagggagtttgtgtactcagagcgcagcggcctcctgctcaccagcatcctcacgctccggggtcaggcccaagccccaccccgcgtcatttgtacctccaggaacctctacggcacccagagcctcgagctgcctttccagggagcacaccgactgatgtgggccaaaatcggccctgtgggtgctgtggtcgcctttgccatcctgattgccattgtctgctacatcacccagacaagaagaaaaaagaacgtcacagagagccccagcttctcagcgggagacaaccctcatgtcctgtacagccccgaattccgaatctctggagcacctgataagtatgagagtgagaagcgcctggggtccgagaggaggctgctgggccttaggggggaacccccagaactggacctcagttattcccactcagacctggggaaacgacccaccaaggacagctacaccctgacagaggagctggctgagtacgcagaaatccgagtcaagtgaggaagctgggggctggccctgtggctcaccccccatcaggaccctcgcttggcccccactggccgtgggctccctttctcttgagagtggtaggggtgggggcgggaaggggcggggcaggaaacagtgaggtcttaggggcccggcctcccctccttcccggctgctcctctctgccaacatcctgcacctatgttacagctccctctcccctccttttaacctcagctgttgagaggggtgctctgtctgtccatgttatttattgttatcctggtctcctgtccccttacccggccccaggacctgtacaaaagggacatgaaataaatgtcctaatgacaagtgccagtctagacccatcctttggaggaaaggggcatattagtaatacttttctcgttgctgtaacaaaatactggacaaaaaca

SEQ ID NO: 1678 - DNA, 1828 bp, Rattus norvegicus
  Genbank Accession No. NM_017193
gtggcactccgcagcactacccggagacagctaacagtgcagcccgagtgatctgggaagccgttctcagtgaccgacttttctagtcctgttccacgcgaccagcagagacatgaattactcaaggttcctcactgcaacgagcctggccagaaagacatcccctatcagagctacagtggagataatgagtagagcacccaaagacatcatctccctggctcctggatctccgaacccgaaagtgttcccctttaagtcagctgtcttcactgtggagaacggaagcaccatccggtttgaaggagagatgtttcaaagggccctccaatattcctcaagctatggaattccagaacttctgtcctggctaaaacagttgcaaataaaattgcataatcctccgactgtcaactactcacccaacgaaggacagatggacctctgcatcacatctggctgtcaagacggtctctgtaaggtgtttgaaatgctcatcaatcctggagacactgttctggtcaatgaaccactgtattcaggagccctttttgcaatgaaaccactgggctgcaattttattagtgtccccagtgatgactgtgggattattccagagggtctcaaaaaagtactttcccagtggaaaccagaagattccaaggatcccacaaaaaggactccaaaatttctgtatactattccgaatggcaacaaccctacaggcaactcgttgactggtgaccgcaagaaagaaatctatgagcttgcaagaaaatatgacttcctcataatagaagacgatccttactattttctccagttcaccaagccttgggaaccaacctttctctccatggatgttgatgggagagttatcagagctgactccctttcaaaagttatctcctcagggctgagagtggggtttataactggccccaagtccttgatacagaggattgttctccacacacaaatctcatcactgcatccctgtactttatcacagctcatgatatcggagcttctataccagtggggagaagagggtttcctggcccatgttgacagagctattgatttctacaagaaccagagggattttatattggcagctgcagacaagtggttacgtggtttggcagagtggcatgttcccaaagctggcatgtttctatggattaaagttaacggaatctctgatgcaaaaaaactaattgaagaaaaggctattgaaagagagatcttgttagttcctggaaatagtttcttcgtcgataattcagccccctcctccttcttcagagcatccttctctcaggttactccagcgcagatggacttagtcttccagagattggcccaactcataaaagacgtttcataaagaaatcaaactcagcattgaacttataattttaaaataaatttcctatactttgctgaagaaatggctgacaggatggatccagtttgtgaaatatctgtggcaatttcactgaacaactttgaagccccttaaaatccaccgcattgccaaaataactttctgatatacttttgccctttgattaattatgaactaacaaaacatcaaatttcattgttaaagacctctgtagctgcttaataatgtccaataaatttttttgagcctaacatagactaactaacatagtaaattgcaagggaattagttaaaatggcctataatatgcaggtttttttctactttaaggaaatttcatgagcatttactgcaaaaattgttgtaatttgacaattataaattactttgtaaccgaaaaaaaaaaaaaaaaaaaaa

SEQ ID NO: 1679 - DNA, 696 bp, Rattus norvegicus
  Genbank Accession No. NM_017202
gctcttccggtgcgggacccgctcttccggtcgcgagcacccggggtgtagagggcggtcgcggcggtcgcctgggcagcagtggcagaatgttggctaccagggcacttagcctaattggcaagagagccatttctacttcggtgtgccttcgggcacatgggagtgttgtgaagagtgaagactatgctctcccatcttatgttgatcggcgtgactaccccttgcctgatgtggcccacgtcaagctgctgtctgccagccagaaggccctgaaggagaaggagaaggccgactggagcagcctttccagggatgagaaagtccaattgtaccgcatccagtttaacgagagcttcgctgagatgaacaagggcaccaatgagtggaagacagtggtgggcctggccatgttcttcatcggcttcactgcgcttgtgctgatctgggagaagagctacgtgtatggccccatccctcatacctttgatcgtgactgggtggccatgcagaccaagcggatgctggacatgaaggtcaaccccattcagggcttctccgccaagtgggactacaacaagaatgaatggaagaagtgagagcctgctgctgtgggctcctccctccctccctccctcagcatgctggaagctgctgtgtccaatggtccatgttaataaatgaccagtttacgtg

SEQ ID NO: 1680 - DNA, 2451 bp, Rattus norvegicus
  Genbank Accession No. NM_017213
tgagttctcaccttcttcgcacgccaggcagccctcaggtttaaaccctaatagtcttcggcccgctattcttcccgggtggggcctgggcatgctggtcgttgtcctcctttcagtgacgtgccccctcactgtcctgccgcgccctccacctgcctcctggcggcgcactcggcaccccgcaggtcgctcagcctctcctgtctccctccctcccactttggcaggacagttgctgtgcgacttggacagtagaggagcgcctcccaagttttcatccaactgccacccccaaagcttccaccctcctcccctcagagagaggacgtttgatgcccggcccctgagattctcattggcaagcccctctgggtccccctgagcagagcctgccgacccaattgcccaactttgcggctttgatgcttagccatgtctgcctcatcctcaggcggctcccccaggtttccatcgtgtgggaagaacggagtaacgagtctcacagagaaaaaagtcttgagaacaccttgtggcgcacccagtgtaactgtgacgaaatctcataagcgcggaatgaaaggggacaccgtgaatgtacggcggagtgtccgggtgaaaaccaagaatccacctcattgcctggagatcacaccaccatcttcagaaaagctggtctcggtgatgcgattgagtgacctttctacagaagacgacgattctggtcactgtaagatgaaccgttacgataagaagattgacagtctaatgaacgcggtcggttgtctcaaatctgaggtcaagatgcagaaaggtgaacgccaaatggccaaaaggttcctggaggagaggaaggaagaactggaggaggtagcacatgagcttgcagagacggagcatgagaacacagtgctcagacacaacatcgagcgcatcaaggaggagaaggacttcaccatgcttcaaaagaaacacctccagcaggagaaggaatgcctcatgtccaaactggtggaggctgaaatggatggggcggctgctgccaaacaagtcatggccttgaaggataccatcgggaagctgaaaaccgagaaacagatgacttgcaccgacatcaacaccttaacgaggcagaaggaacttctcctgcagaagctgagcacctttgaagagaccaaccgcaccctccgagatctgttgagggagcagcactgcaaagaggattccgagagactaatggagcaacaaggtgcattactgaaacgtctggcagaggccgactcagagaaagcgcgcctgctgttactactgcaagacaaggacaaggaagtggaagaactcctccaggagatacaatgtgagaaggctcaagcaaagacagcgtctgagctctccaagtccatggagtccatgcgggggcatttgcaggcacagcttcgctgcaaagaggctgagaacagccgcctgtgcatgcagatcaagaatttagagcgcagtgggaaccagcacaaggcggaagtagaggccatcatggagcagctaaaggaactgaagcaaaagggagaccgagacaaagagaccctgaagaaggccatccgagcccagaaggagcgagctgagaagagtgaggagtatgccgagcagctacatgtgcagctggccgacaaggacctttatgttgctgaagctttatctactctggagtcatggaggagccgttacaaccaagttgtgaaagacaaaggagaccttgagttggagatcattgtcctaaatgaccgggtgacagatcttgtaaaccaacaacagagcttggaggagaagatgcgggaagaccgggacagcttggtagagagactgcaccggcaaactgctgagtattctgccttcaagctagagaacgagaggctcaaggctagctttccccctatggaggacaagctcaatcaggctcacttggaggtccagcaactgaaggcatcagtgaagaactacgaggggatgatcgacaactacaagagccaggtgatgaaaacaagattggaggctgacgaagtggctgcgcagttagagcgctgcgacaaagagaacaagatgcttaaagacgagatgaacaaagaaatcgaggcggcccgtcggcagttccagtcacagctggctgacctacaacagctgcctgacatcctcaagatcacggaggccaagctggctgagtgtcaagaccagctgcagggctacgagaggaagaacatcgacctcacagccatcatttcagacctgcgcagccgggtaagggactggcagaagggatcccacgaactggcccgagcaggggcccgcttaccgagatgagctgcacgccccccaagggaggaccacttcctttttcttggctgccgatttctgaaaggagtgagctatcatcagtgctgtgaaataaaagtctggtgtgcc

SEQ ID NO: 1681 - DNA, 2305 bp, Rattus norvegicus
  Genbank Accession No. NM_017216
ctactggaaagcactgggaagagctgcaccggatagacatgaatgaggacaaagacaagagagactctatccagatgagtatgaagggatgccggacgaataacgggtttgtccaaaatgaagacatccaggagcaggacccagactccagggacactccacagtccaacgctgttagtatccctgctccagaggagcctcaactaaaggtggtgcggccctatgcagggatgcccaaggaggtgctgttccagttctctggccaggctcgctaccgggtgcctcgggagatcctcttctggctcaccgtggtctccgtgttcctgctcatcggagccaccatagccatcatcatcatctctccaaaatgccttgactggtggcaggcaggtcccatgtaccagatctacccgaggtcttttaaggacagtgacaaggatgggaatggagacctgaaaggtatccaagagaagctggactacatcactgctttaaatataaagaccatttggatcacttccttttataaatcacctttgaaagattttagatatgctgttgaagatttcaaagaaattgaccctattttcggaacaatgaaagattttgagaatttggttgctgcggtccatgacaaaggtttaaaattaataattgacttcataccaaaccacaccagtgacaaacatccttggttccaatcgagtaggacacggagcgggaaatacactgattattacatctggcacaactgtacccacgccaacggtgtaaccacccctcccaacaactggctgagcgtgtatggaaactccagctggcagtttgatgaagaacgaaagcaatgttattttcaccagtttttgaaagagcagccggatcttaatttccgaaatcctgctgttcaagaagaaataaaggaaataataaagttctggctctcaaagggtgttgatgggtttagtttcgatgcagttaaatttcttctggaagcaaaggacctgagaaatgaaatccaagtaaatacatcccaaattccggacacagtgacccgctactcagaactgtaccacgacttcaccactacccaggtgggaatgcatgaccttgtccgggacttccggcagaccatgaaccagttcagccgggagcctggcagataccggttcatggggacggaggtgtcagctgagagcaccgagaggaccatggtgtactatggcctgtcatttatccaggaagctgacttccctttcaacaagtacttagccacactagacactctttccgggcatactgtgtacgaagctatcacatcctggatggaaaacatgccggaaggaaaatggcccaactggatgattggcggaccagagacttctcggctgacttctcgagtagggagcgagtatgtcaatgccatgaacatgcttctgttcacactcccaggaacccccataacttactatggggaagaaatagggatgggagatatttccattacaaacctcaacgagcgctatgacactaacgcccttctctccaagtcaccgatgcagtgggacaatagttcaaatgcggggtttactgaggccaaccacacctggctccccacaaactctgactaccacacagtgaatgtggatgtccaaaaaacccagccgagctcagcactgaggctatatcaggatctgagtctactccatgccagagagctgcttctcagcagaggctggttttgccttttgagggacgacaatcactctgttgtgtacaccagggagctggatggcatagataaagtcttccttgtggttctgaattttggagaatcatcaactgtgctaaatctacaggaaactatttcagatgttcctacaaaactgagaataagattaagtaccaatccagcctccaaaggcagtgatgttgatacccatgccgtttctctggagaagggagaggggctcatcttggaacacagcatgaagactctcctccatcaccagaaagctttcagagacaaatgttttatttccaaccgtgcatgctactccagcgtgctggaccttctgtatagctcgtgctaggcagctctgtaagaggtggccaccctgcgtctggtatgcttgccatcacacatgcaagggcctcaggaatggcatcagttcttagatatttctgtagcacgaatgcattgttttaggtaagattctcaaatgtttggaaggacaataaaatgtttaaaagattacccccaaaaaaaaaaaaaaaaaaaaaaaaaaaaaaaaaaaaaaaaaaaaaa

SEQ ID NO: 1682 - DNA, 1176 bp, Rattus norvegicus
  Genbank Accession No. NM_017220
cggtcccggaagccggaacccgtagcttgtgggtctttggtctgaagaccatgaacgcggcggttggccttcggcgccgcgcgcgattgtcgcgcctcgtgtccttcagcgcgagccaccggctgcacagcccatctctgagtgctgaggagaacttgaaagtgtttgggaaatgcaacaatccgaatggccatgggcacaactataaagttgtggtgacaattcatggagagatcgatccggttacaggaatggttatgaatttgactgacctcaaagaatacatggaggaggccattatgaagccccttgatcacaagaacctggatctggatgtgccatactttgcagatgttgtaagcacgacagaaaatgtagctgtctatatctgggagaacctgcagagacttcttccagtgggagctctctataaagtaaaagtgtatgaaactgacaacaacattgtggtctacaaaggagaatagatcttaggtttaatattgtagaaaagctaatttcttttcttactagaaaaagctctttgtccttttaaagtacacagcagtcatcacctacccgtgtctccatgttgtgttctggtgtgcctgagcgttaaagggattgtgaggtctgtatgtaaatgcattaagaagcaaattcgaagtgcatcctgagtgtattcttggtgagaaagcaggggagaactgaggattgaagcccgggcctcacacatgtgaaacatatactctgctccgacatgcatcccagtccgccaaggccgtttagaggatctttacctagagatagagattgttttatcttcagctggagagacagctcagtggttaggagcactgactgcttctccagaggtcctgagttcaaatccaccagacggtggtggctcacaaccatctgtaatgggatccgatgctctcttctggtgtgtaggtgtacatacagacaaagcattcctacatttaagaaaatacataaataagtttcaaaaattatttcatctggggctggggatttagctcagtggtagagcgcttacctaggaagcgcaaggccctgggttcggtccccagctccgaaaaaaagaaccaaaaaaaaaaaaattatttcatctgagcaaaatgttttgatgtggaattatgtaaaggtaaaataaac

SEQ ID NO: 1683 - DNA, 2227 bp, Rattus norvegicus
  Genbank Accession No. NM_017224
gagctgtccagacccccgaagtgaagaaaagaggcgagggcaagggagggccagaaccgagggagagagaaaggaggggcagcccaccagcccgctgtcctgccacagaaccggctcagctccagctccaggagtcactcagctgcagaggcagtggcagccccactcctcaggcaaagggcagcagacagacagacagaggtcctaggactggaggtcctcagtcattgaccactcagcctggcccagccccatggccttcaatgacctcctgaaacaggtggggggcgtcggacgcttccagttgatccaggtcaccatggtggttgctcccctactgctgatggcttcccacaacaccttgcagaacttcactgccgctatcccccctcatcactgccgcccacctgccaatgccaatctcagcaaagatggaggtctggaggcctggctgcccctggacaagcaaggacaacccgaatcgtgcctccgctttacttccccccagtggggaccacccttttacaatggcacagaagccaatggcaccagagtcacagagccctgcattgatggctgggtctatgacaacagcaccttcccttcaaccatcgtgactgagtggaaccttgtgtgctctcatcgggctttccgccagctggcccagtccctgtacatggtgggagtgctgctgggagccatggtgtttggctacctggcggacaggctgggccgccggaaggtgctgatcttgaactacctgcagacagctgtgtcgggaacctgtgcagcctatgcacccaactatactgtctactgcgttttccggctcctctcgggcatgtctttggctagcattgcaatcaactgcatgacactaaatgtggaatggatgcctatccacacccgtgcctatgtgggcaccttgattggctatgtctacagcctgggccagttcctcctggctggcatcgcctatgctgtgccccactggcgccacctgcagcttgtggtctctgtgccttttttcattgccttcatctactcttggttcttcattgagtcagcccgctggtactcctcctcaggaaggctggacctcaccctccgagccctgcagagagtggcccggatcaatgggaaacaagaagaaggggctaagctaagtatagaggtgctccggaccagcctgcagaaggaactgactctaagcaaaggccaagcctcagccatggagctgctgcgctgccccacccttcgacacctcttcctctgtctctccatgctgtggtttgccactagctttgcctactacgggctggtcatggacctgcagggctttggggtcagcatgtaccttatccaggtgattttcggtgccgtggacctgcctgccaagtttgtatgcttcctagtcatcaactccatggggcgccggcctgcacagatggcctccctgctgctggcaggcatctgcatcctggtgaatggcataataccgaagagccatacgatcattcgcacctccctggctgtgctagggaagggctgcctggcttcctctttcaactgcatcttcctgtacaccggagagctgtaccccacagtgattcggcagacaggcctgggcatgggcagcaccatggcccgggtgggcagcattgtgagcccgctggtgagcatgactgcagagttctacccctccatgcctctcttcatcttcggcgctgtccctgtggtcgccagtgctgtcactgccctgctgccagagaccttgggccagccgctgccagatacagtgcaggacctgaagagcaggagcagaggaaagcagaatcaacagcagcaggaacagcagaagcagatgatgccgctccaggcctcaacacaagagaagaatggactttgagaacggaagggcttcacacagcactaaagggagtggggttctacaggtcctgccgtctacatgaggagggggagtgagtagagggactggaccatccaaatgtggaggctgccattcagagaaatccctccccaaaggtcatgtcagtagacccactaggaacaaaagctctgactatgtgcagcttcttaagcagaatgttctcgtcaccggccatcttcctgctcatggtcactccgccacctccaggaccttgcaaagaatctcagacaattaaatgaatctcttctaaaaaaaaaaaaaaaaaaaaaaaaaaaa

SEQ ID NO: 1684 - DNA, 4387 bp, Rattus norvegicus
  Genbank Accession No. NM_017228
ggcacgagggggagccgggcatgggggccgccctccgggggggccggggccgccgccgccgccgccgcggcagcgactgaagccgcgcaacaaggaggggcggggagtggtcgccgccgtccccgggaggcgccggagctcgactgcactcgctgccagccagccgtcccgagccgctcgcagattccctgagaacacccggcaagtaccacgtgcctacaactgcttccccggtcacagctgtggggagcttggggtgcggcagacaaatttctgtattcagctgcccaggcagaggagaatgggggctccacagcttgaagaatgaagacacgacagaataaagactcgatgtcaatgaggagtggacggaagaaagaggcccccgggccccgggaagagctgagatcgaggggccgggcctcccctggaggggtcagcacgtccagcagtgatggcaaagccgagaaatccaggcagacagccaagaaggcccgagtagaggagacctctaccccaaaagccaacaagcagggccggagcgaggagatctcagagagtgagagcgaagagaccagtgcgcccaaaaagaccaagaccgaggagcttccgcgcccacagtctccctcggatctggacagcttagatggccgcagcatcaatgatgacggcagcagtgaccctagagatatagaccaggacaaccgaagcacatcccccagcatctacagccctggcagtgtggaaaatgactcggattcatcctctggcctgtcccagggcccggctcgcccctaccacccacctccactctttcctccttcccctccaccaccagacagcattccccgacagccagagtctggctttgaaccgcacccttctgtgccgcctactggatatcatgctccaatggagccccccacatctcggttattccagggcccacctcctggagctcctcccccacacccacagctctaccctgggagtgctggtggaggtgttttatctggaccccccatgggtcccaaagggggagcagccgcctcctcagtgggtccccctagtgggggcaagcagcaccccccacccactaccccaattccaatatcaagctctggggccagtggcgctcctccagcaaagccccccaatactccagtgggtgctgggaacttaccttctgctccaccaccagctactttcccccacgtgacaccaaacctgcctcctccacctgccctgagacccctcaacaatgcctcagcctctcctcctggcatgggggctcagccaatccctgggcatctgccctctccccatgccatggggcagggtatgagtggacttcctcctggcccagagaagggcccaaccctggccccctctccccaccctttacccccggcttcttcctccgctcctgggcccccaatgcggtacccgtattcatcctgctccagtagctctgttgcagcgtcttctagttcctccgccgccacctcccagtacccagcttcccagaccctgcccagttaccctcactccttccccccaccaacaagtatgtctgtctctaatcagccacccaagtacacccagccttctctcccatcccaggctgtgtggagccagggcccacctcctcctcctcctccttatggccgcctcttgcccaacaacaacactcatccgggccctttccctcctaccgggggtcaatccacagcccacccgccagcccctgcacatcaccatcaccagcagcagcagcagccacagccacagccacagccgcaacaacatcatcatggaaactctgggccccctccacctggggcatatcctcaccccctagagagcagtaactcccaccatgcacacccttacaacatgtcaccctccctggggtctttgaggccctacccaccagggccagcacacctgcctccgtctcatggccaggtgtcttatagccaagcaggtcccaatggtcccccggtttcttcttcttccaactcttccgggtcttcgtctcaagccgcctattcatgctcacacccttcttcatcccagggcccccaaggggcatcctaccccttcccaccagttcctccaatcaccacctcctcagctactctttccactgtcatcgccaccgtggcttcctcgccagcaggttataagacagcctcaccacctggcccccctcagtacagcaagagagccccatccccagggtcctacaagacagccaccccgcctggatacaagccagggtcaccaccgtccttcagaacagggaccccacctggctatcgaggcacctctccgccagcaggcccagggaccttcaagccaggttcacccaccgtggggccggggcccctaccacccgcggggccttcaagtttgtcatctctgcctccaccacccgcggccccgactacagggccgcccctgactgccacgcagatcaaacaggaaccagctgaagagtatgaaacccccgagagtccggtgcctccggctcgcagcccctcgccccctcctaaggtggtggacgtgcctagccatgccagccagtcagccaggttcaataagcacctggaccgtggcttcaactcgtgcgcgcgcagcgacctgtactttgtgccgctggagggatccaagctggccaagaagcgcgcggacctggtggagaaagtgcggcgcgaggccgagcagcgcgcgcgcgaagaaaaagagcgcgagcgcgagcgggaacgtgagaaggagcgcgagcgcgagaaagagcgcgagctggagcgcagtgtgaaattggcccaggagggccgtgctccagtggagtgcccgtccctgggtccagtgccccatcggcctccctttgaacctggcagcgctgtggctaccgtgcccccttacctgggtcctgatactccagccctgcgcactctcagtgaatacgcccgacctcatgtcatgtctcctggcaatcgcaaccacccattctatgtgcccttgggggcagtggacccggggcttctgggttacaatgtcccagccctgtacagcagcgacccagctgcccgagaacgggagcgggaagcccgtgaacgtgacctccgtgaccggctcaagcctggctttgaggtgaaacctagtgagctggaacccctacatggggtccccgggccaggcctggatcccttcccccgacacgggggcctggctctacaacctgggccacctggcctgcatcctttcccttttcatccgagcctggggcccctggaacgagaacggctagcgctggcagctgggccagccctgcgtcctgacatgtcttatgctgagcggttggcagctgaaaggcagcatgcagaaagggtggcagccctgggcaatgacccactagcccggctgcagatgctcaacgtgactccccatcatcaccagcactcccacatccactctcacctacacctgcaccagcaggatgccatccatgcggcctccgcctcggtgcaccctctcattgaccccctggcctcagggtctcaccttacccggatcccctacccagctgggaccctccctaatccccttcttcctcaccctctgcacgagaacgaagttcttcgtcaccagctctttgctgccccttaccgggacctaccggcctctctatctgcgccaatgtcagccgcccatcagctgcaggccatgcacgcacagtcagccgagctgcagcgcttggcactggaacagcaacagtggctgcacgctcatcacccattgcacagcgtgccgctgcctgcccaggaggactactacagtcacctgaagaaggagagtgacaagccgctgtagaacctgccatccagacagcacccactgctccttcatccagaccttggaggaccacccccgaccttttgaccccatcccacccccaagccgaggacagggtgctgcccacttgcagagcttctgcagccgggcagagggagggagggaagaagggacagacaaggtcagggcccggggaagtggcaagggtggggacagaaagtggacagtatcttggaccaggtccctcctcccatcccctgcttttcttctgtatgcccaatccttggtggccactgctcctcccctaacccgttggtgtgatttttttcatctgttagatgtggctgttttgcgtagcattgtgtgctgcccctgccccatccctgtgtgtgcaccccctcggcgatatgtgccccttgcccgtcccacattaataatttatatatataaatatctatatgatgctctttaaaaacatcctgaccaaaacatcccaacaaaaacatcctcacggtgccccaaaaaaaaa

SEQ ID NO: 1685 - DNA, 1623 bp, Rattus norvegicus
  Genbank Accession No. NM_017234
atccatcgtcccttcggttcctcggctcctcggctcctcggcattttccgccgttgggccgtatgcagctttcctctaaaccactgactgtaatttcccaggtttctttcagccacttccgggtcttccgtcgttccggaagcccgcgaattccggaagcgagggctacccagattcggctaggaaaagcccagcttgccagagaatgtttgagaaaagtttgcgcggcgctggtgtgttccgcagaccctgcagctcttgacaagtatgaggcaaaagcctcttgaagcagatgtgcagcagaattctccaccaccttttgataggccgctgagtgctgaggggaccacaggatccaaggaaagacagcatcagagaagatatggctgccagagaagagagtacacaaagtgccaacagagtgctgaggataagtcagctggatgcactggaactgaataaggccctggagcagctcgtgtggtcccagtttactcagtgttttcatggatttaagccaggactgttagctcgctttgagccagaagtgaaagcatttctgtggcttttcctgtggaggttcaccatctattccaaaaatgccactgtggggcagtcggttttaaatattcagtacaaaaatgattcttctcccaacccagtataccaaccaccaagtaaaaatcagaaactgttgtatgctgtgtgcactattggggggaggtggttagaagaacgatgttacgatttgtttccaaaccgacatttagcatctttcgggaaagccaaacagtgcatgaattttgtggttggacttttaaaattaggtgagttgatgaacttcttgatttttctacaaaaaggaaagtttgcaactttgacagaacgcctccttggcattcattctgtattttgcaagccccagagcatgcgtgaagttggcttcgagtacatgaatagggaacttctctggcatggctttgccgaatttctggttttcctcttaccgctcatcaatatccagaagttgaaagccaagttgtcttcctggtgcatcccccttaccagcactgctggtagtgacagtacactaggcagcagtggaaaagagtgtgctctatgtggagagtggcccacaatgcctcatactattggatgtgagcatgtattttgttactactgtgttaagagtagcttcctatttgacatgtactttacgtgccctaagtgtggcacagaagtgcacagtgtgcagccactgaaatcaggaattgaaatgtcagaagtgaatgctctttaaaaccaagttgtttcctctgaggaaagtgtattgtatccaattccttggaattcgtcatcttcagtgtcatctgtaggtggcttttagcaggagtgtgctgtgcggccactctcttcctttccaagcacaactcagttctaatcactggaaaccaagtgattctagagaatcttataaatcctcatgttattttttgatccctaatacaatttttaatgtcaagaataatggaaaattttgtcagatgaatactaagaatgactaagaatgctccttcatagaaaaaggtcagactctaaaaataaaacatttttgaggctctg

SEQ ID NO: 1686 - DNA, 2626 bp, Rattus norvegicus
  Genbank Accession No. NM_017245
cgcttccctgttcacctctgtatttgagaatccgacgccatctgccaccatggtgaacttcacagtagatcagatccgtgccatcatggacaagaaagccaacatccggaacatgtcagtcatcgctcacgtggaccacggcaagtccacgttgaccgactcccttgtgtgcaaggctggcatcatcgcctctgcccgagccggtgagacacgcttcactgacactcgaaaggatgagcaggagcgctgcatcaccatcaagtccactgccatctccctcttctatgagctctccgagaacgacctgaacttcatcaagcagagcaaggatggctctggcttcctcatcaacctcattgactctccaggtcatgtggacttctcctcagaggtgaccgctgctctgcgtgtcactgatggagcactggtggtggtggactgtgtgtctggtgtctgtgtgcagacagagacagtgctgcggcaggccatcgctgagcgcatcaagcccgtgctgatgatgaacaagatggaccgggccctgctggaactgcaactggagcctgaggagctctaccagaccttccagcgcatcgtggagaacgtcaatgtcatcatctccacctatggcgagggcgagagtggacccatgggcaatatcatgatcgatcctgtcctgggcactgtaggctttggctctggcctgcatgggtgggccttcacactgaagcagtttgcagagatgtatgtggccaagtttgcagccaagggtgagggccagctgggtgcagctgagcgggccaagaaggtagaagacatgatgaagaagctgtggggagaccggtattttgacccggccaacggcaagttcagcaagtcagccaatagcccagacgggaagaaacttccccgcaccttctgccagctcatcttggaccccatcttcaaggtgtttgatgccatcatgaacttcagaaaggaggagacagccaagctgatcgagaagctggacatcaagctggacagtgaggacaaggacaaggagggcaaaccactgctgaaggctgtgatgcgtcgctggctccctgctggtgacgccctgctacagatgatcaccatccacttgccgtccccggtcactgcacagaagtaccgttgtgagctgctgtacgagggcccacctgatgacgaggccgccatgggtattaagagctgcgaccccaaaggccccctaatgatgtacatctccaagatggtgccaacatctgacaaaggccgcttctatgccttcggtagagtgttctctggggtggtgtccacaggtctgaaggtccggatcatgggccccaactatacacctgggaagaaggaggacctgtacctgaagcctatccagaggaccattctgatgatgggccgctatgtggaacccattgaggatgtgccctgtggcaacattgtggggttggtcggggtggaccagttccttgtgaagaccggcaccatcactacctttgagcacgctcacaacatgcgggtgatgaagttcagcgtcagccctgtagtcagggtggcagtggaggccaagaacccagctgacctgcccaagctggtggaggggctgaagcggctggctaagtctgaccctatggtgcagtgcatcatcgaggagtctggggagcacatcattgctggtgctggagagctgcacctggagatctgccttaaggacctggaggaggaccatgcctgcatccccatcaagaaatctgaccctgtcgtgtcctaccgggagacagtcagtgaggagtccaacgtgctctgtctttccaagtccccaaacaagcacaacaggctgtacatgaaggccaggcccttccctgatggcctagcagaggacatcgataagggtgaggtatctgcccgccaggagctcaaggcgcgtgcccgttacctggccgaaaagtatgagtgggatgttgctgaagcccgcaagatctggtgctttggacctgatggcactggtcccaacattctcaccgacatcaccaagggtgtgcagtacctgaatgagatcaaggacagtgtggtggctggattccagtgggccactaaggagggtgctctttgtgaggagaacatgcgtggtgtgcgatttgatgtccatgatgtgaccctgcatgctgatgccatccaccgaggaggtggtcagatcatccccacagcgcgccgctgcctctatgccagtgtgctgactgcacagccccgcctcatggagcctatctacctggtggagattcagtgtcctgagcaagtggtgggcggaatctatggtgtcctcaacaggaagcgtggccatgtctttgaggagtcccaggtagctgggacccccatgttcgtggtcaaggcctacctgcctgtcaatgaatcctttggcttcactgccgaccttcgatccaacactggtggccaggccttcccccagtgtgtgtttgaccactggcagatcctgcctggggacccctttgacaacagcagccgccccagccaagttgtagctgagacccgcaagcgcaaaggcctgaaggagggcatcccagcgctggacaacttcctggacaaactgtag

SEQ ID NO: 1687 - DNA, 1696 bp, Rattus norvegicus
  Genbank Accession No. NM_017248
cgctgaacgctctcatcatcctaccgtcatgtctaagtcagagtcccccaaggaaccggaacagctgcggaagctcttcattggagggctgagcttcgaaacaaccgacgagagtctgaggagccattttgagcaatggggaacactcaccgactgtgtggtaatgagagatccaaacaccaaaagatccagaggctttgggtttgtcacatatgccactgtggaggaagtggatgctgccatgaatgcaagaccacacaaagtggatggaagagttgtggaacctaagagagctgtgtcaagagaagattctcagagaccaggtgcccacttaactgtgaagaagatctttgttggcggtattaaagaagacactgaagaacatcacctacgagattattttgagcagtatgggaaaattgaagtgattgaaattatgactgacagaggcagtggaaaaaagaggggatttgcgtttgtcacctttgatgaccatgactctgtggataagattgttattcagaaataccatactgtgaatggccacaactgtgaagtaagaaaggctctgtgcaaacaagagatggctagtgcttcatccagccagagaggtcgaagtggttccggaaactttggtggtggtcgtggaggtggtttcggtggcaatgacaattttggtcgaggagggaacttcagtggtcgtggtggctttggtggcagccgtggtggtggtggatatggtggcagtggggatggctataatggatttggcaatgatggaagcaattttggaggtggtggaagctacaatgattttggcaattacaacaaccagtcatcaaattttggaccgatgaaaggaggaaactttggaggcaggagctctggcccttatggtggtggaggccagtactttgctaaaccacgaaaccaaggtggctatggaggttccagcagcagcagtagctatggcagtggcaggaggttctaattacagccaggaaacaaagcttagcaggagagccagagaagtgacagggaagctacaggttacaacagatttgtgaactcagccaagcacagtggtggcagggcctagctgctacaaagaagacatgttttagacaatactcatgtgtgtgggcaaaaactccaggactgtatctgtgactaattgtataacaggttattttagtttctgttctgtggaaagtgtaaagcattccaacgaagggttttactgtagacctttttcacccatgctgttgattgctaaatgtaaaagtctgatcatgacgctgaataaatgtgtcttttttttttttttttaatgtgctgtgtaaagttagtctactctgaagccatcttggtaaacttccccaacagtgtgaagttagaattccttcagggtggtgccaaattccatttggaatttatttatggttgcttgggtggagaagccattgtcttcaaaaaccttggtgttgctaaactgccagttactgttgtaacttaatgagtttcaccatttaaagggtcatccaagcaagatcacaatttggttataaaatggttgttggacacctatgaagagaaaattgaataacggtctcagataaaataagagatgggaatgaagcttgtgtatcatccattatcatgtgtactcaataaacgatttaattctcttgaatgg

SEQ ID NO: 1688 - DNA, 1464 bp, Rattus norvegicus
  Genbank Accession No. NM_017258
atgcatcccttctacactcgggccgccaccatgataggcgagatcgccgccgcggtgtccttcatctccaagttcctccgcaccaaggggctcacgagcgagcgacagctgcagactttcagccagagcctgcaggaactgctggcagagcattacaaacatcactggttcccagaaaagccgtgcaagggatcaggttaccgttgtattcgcatcaaccataagatggatcctctgattggacaggcagcccagcggattggactgagcagtcaagagttgttcaggcttctcccaagtgaactcacactctgggttgacccctacgaagtgtcctacaggattggagaggatggctccatctgtgtgctgtatgaagcctcaccagcgggaggtagctctcaaaacagcaccaacgtgcaaatggtagacagcagaatcagctgtaaggaggaacttctcttgggcagaacaagcccttccaaaaactacaatatgatgactgtatcaggttaagatatagtctatggatggatcatcttataatggatggatagatttgattttttgctttgggtgggctcctcttggggatggattatggaataaccatgtcacagctgtgaagatctggcacaagatagagtggtaataatttttttttttaaagtgacagtgccatagtttggacagtacctttaagtgatttaagtagcctgtgagtccaagtaaaggatcactttatttggtagggagtgaagtcgcagggtggtttcagtttctcccagaccttatacccaatttgtcacaccagtccctttaaggaaattctgtatttcaaagaaccctcttttgcagtcagtcaaccttgcaggggaatttgcactatttacacttgaaagttaccagtaacttttttttggcagctcaataggaaagctcaatgttctaagcatggtagtactggaaatattacacggagacttttacctagcacttaaaaatgtataaatgtacataaagacacttagtacgcatgacctgggggaaatggtcagaccttgtgtttttggctttgagagtagcaagtgaccggaatctgccatgacaacaggcttttaaaagacccttacaaagacactgtctcaactgtggttagcaccagccagctctctgtacattcgcttgtagttttctaagattgagtgagtaaacttcttatttttagaaagtggaggtctggtttgtaactttccttgtactcaattgggtaagagtctttttccacaaaccgccatctattttgtgaactttgttagtcatcttttatttggtaaattatgaactggtgtaaatttgtacagttcatgtatattgattgtggcaaagttgtacagatttctatattttggatgagaaatttttcttctctctataataaattgtttcttatcttggcatttt

SEQ ID NO: 1689 - DNA, 2519 bp, Rattus norvegicus
  Genbank Accession No. NM_017259
agagcccgtgaggcggccggaccatcatcgtcctgctaatacagctacttcctcaaccaccggtatgagccacgggaagagaaccgacatgctcccggagatcgccgccgccgtaggtttcctcaccagtctcctgaggactcggggctgcgtgagcgagcagagactcaaggttttcagtagggcgctccaggacgcactgaccgatcattacaaacaccactggtttccagaaaagccatccaagggctccggctatcgctgtatccgcatcaaccacaagatggaccccatcatcagcaaggtggccagccagatcggactcagccagccccagctgcaccagctcctgcccagcgagctgaccctgtgggtcgatccctacgaagtgtcctaccgcatcggggaagatggatccatctgcgtgctgtatgaggaggcgccggtggccacctcctacgggctcctcacctgcaagaaccagatgatgctgggcaggagcagtccatcgaagaactacgtgatgactgtctccagctagagaggagccgccccgccctggcactctactgttctcatgctgccctgacaacaggccaccgtatacctcaacctggggaactgtatttttaaagtgaagagctatttatacatgttatttttttttttaagaaaagaggaggaaaaaaaccaaaagtttttttttaaaaaaacaaaaaagaaaaaacaattcgttaacgggagctgcttggaagtggtctccccaggtgcctttggagagaactgttcttgattgagtctatgagccagtgtttgcctaggggagtgggttggggattggcctagccaaggtaaaaggggattcttggctgatcccccaggaggtggtggaagggagcaaggttagcaactgtgaacgagaggggtcagggtctgctctgggttaccgttcccgctgggatgcctgtattcctggtccctctcttactcaggggcattcaagcctggtctcaaataatactacattgcctaatcttctcttttgtttttctgctgagatcctgggcacacggaaaggcctctcctgtcccttccgtctgagcagagtttcttgaaactgtgtctcgtttctgatcctaccctcggggtcctgaagaggtggtttcccggcctagaatctatctaaacgtttttggagggtgggctataaggcagatataatggaggggaaccgcacaaaccctttgctttgctctgtgctgctttgtatggatggatggttaataacttagggatgatttgcaatggaattttgggacccaaagagtatccaatgggggtgggtgttttggacctaagccctccttttgggaaccacgtgacagtctgaatgctgctaccattattcctttgagaggtggctcaaagctccagggaactccaggtcctttcttactgccttctcttcaagagcaacctcccccatttcttttccctctttcctgcggttgggtcctggagggccccatttcctaggacaagagttctcaatcactgtgcaatagtcccaggaagctctggaactgggcctcccagcccctcctgattcctggtgggttttaggaccccgccttccccgttcttctgactggctggtgggccttgaggagatctccctcggccgcagggagggcacctgtgcactgcaggactacctggtactcctgtggggctgccacggagagccaaaccttaggcatagctttgtctcctcggtgctcagagcacctgcagggggaggttgcccccctcagtaaaaatccaaatttatttgtagatgtgtgcaatatttactgttctgggttggagaaaatcgggaaacactgggaagaagtggccttccttcaggttcagtgacactgatgagggcttctcagaaggcctcgagtctctcaaaccaaaggacagagctagagccagccagtcacccttagtgaggatccccttccccatgtctctccactgccgtggcatcccatgtcctggatttctcaattcctcagtttctactcaaaggtgctacttaccaaacactctgcccgtcccgctctccccagcttcgcacagccgtcccaggtggcttcgtctctcctgctttaaagttaactttgggcccacagacccgagagctgtgggttgaagcaaagctgtgaatcgctccagatggtccctgtgttctgtccacacacaggtccccgcctttttagaagcagcctcctggtctcatgcttaaatctgttcctcactgcccgtgttcactttagaaatggcagaaccacagagctggactgttgagcaggcctgtctctctcattaaatagaaataagtaagtttgtaagctattccgacagaagagacaaaggttactgattgtacaatagcgcttttatatggaagactgtacagctttatggacaaatgtaaaacttttttgtttttaataaaaatgtagcagacc

SEQ ID NO: 1690 - DNA, 921 bp, Rattus norvegicus
  Genbank Accession No. NM_017264
ctcgcgtgcggcgttcagccccggctctggccatggctacactgagggtccatcctgaagcccaagccaaggtcgatgtgtttcgtgaggacctgtgtagtaagacagagaacctgcttgggagctattttcccaagaagatctcagagttggatgccttcttaaaggagccagctctcaacgaagccaacctgagcaatctgaaggctccattggacatcccagtccctgatcccgtcaaggagaaagagaaggaggagcggaagaagcaacaggagaaggaagagaaggacgaaaagaagaaaggggacgaagacgacaaaggtcctccctgtggtccagtgaactgcaatgagaagattgtggtcctcctgcaacgcctaaagcccgagatcaaggatgtcattgagcaactcaacctggttactacctggttgcagctacagatacctcggatagaggatgggaataattttggcgtggctgtccaggcaaaggtgtttgagctgatgaccagccttcataccaagctggaaggcttccaaacgcagatctctaagtacttctccgagaggggtgatgccgtggccaaagcagccaagcagcctcatgtgggtgattatcggcagctggtgcatgagctggacgaggcggaataccaggagatccggctgatggtcatggagatccgtaacgcttatgctgtgttatatgacatcatcctgaagaactttgagaagctcaagaagccccgtggagagacaaaggggatgatctattgagccccctctctcgttctatgatgggtataacagaaaccttcctactcttgactaggaactctagactgcacccagtcttcttcctgctggggtctcctccctcactctgccttccaaacacaataaatacatagttgcc

SEQ ID NO: 1691 - DNA, 897 bp, Rattus norvegicus
  Genbank Accession No. NM_017280
cgttctgtggcctgccgggtcagcaccatgagctccattggcactgggtatgacctgtcagcctctacattctctcctgatggaagagttttccaagttgaatatgctatgaaggctgtggaaaacagtagtacagctattgggatcagatgtaaagatggtgttgtgtttggggtagaaaaattagtcctttctaaactttatgaagaaggctccaataaacgtcttttcaatgttgatcgacatgttggaatggcagtggcaggtttgttggcagatgctcgttccttggcagacatagcaagagaagaagcgtccaactttaggtctaactttggctataacattcctctaaaacatcttgcagacagagtggccatgtatgtacacgcgtatacactctacagtgctgttagaccttttggctgcagtttcatgttggggtcttacagtgtgaatgatggtgcacagctctatatgatcgatccatcaggtgtttcatatggttactggggctgtgccattggcaaagccaggcaagctgcaaagacagaaatagaaaagcttcagatgaaggaaatgacctgccgtgatgtagttaaagaagttgcaaaaataatttacatagtacatgatgaagttaaggataaagcttttgaactagagctcagctgggttggtgaattaactaaaggaagacatgaaattgttcccaaagacgtaagagaggaagcagagaaatatgccaaggaatctttgaaggaagaagatgaatcagatgacgacaatatgtaacatttcaccatcctctggtgtccatttctgtgacagttgcatatggctagcaccatggattatatatacccactgaccaattttcattaaattttgtcttat

SEQ ID NO: 1692 - DNA, 1121 bp, Rattus norvegicus
  Genbank Accession No. NM_017281
cttggccatccgggttggttcttctccagctgagtaaagcggcgctgatctgcaccctcactgtcttcctccggatccacataaaattcagaagccatgtctcgaagatatgactccaggaccacaatattttctccagaaggtcgcttataccaagtggaatatgccatggaagccattggacacgcaggcacttgtttgggaattttagccaatgatggcgttctgcttgcagcagagaggcgcaacatccacaagcttcttgatgaagtctttttttctgagaaaatttataaacttaacgaggacatggcttgcagtgtggcaggcataacatctgatgccaacgttctgactaatgaactcaggctcattgctcaaaggtacttattacagtatcaggagccaattccctgtgagcagttggttacagcactgtgtgatatcaaacaggcgtacacacagtttggaggcaaacgtccctttggtgtttctttgctgtatattggctgggataagcactatggctttcagctctatcagagtgacccaagtggaaactacgggggatggaaagccacatgcattggaaacaacagtgctgcagcggtatcaatgctgaaacaagactacaaagaaggagaaatgactctgaagtcagcgctggctctggctgtcaaggtgctaaacaagacaatggatgttagtaaactgtcagctgaaaaagtggaaatcgccacactaacaagagagaatggaaagaccgtgatcagagtcctcaagcaaaaggaagtggaacagttgatcaaaaaacatgaagaggaagaagcgaaagctgaacgggagaagaaagaaaaagaacagagagaaaaggataaatagacagaatcatggattttataactccttagaggcgccagttcacttaggagctgtcctggccttcccctggaagtgttttcttgtattttcttccttaccttggccatcggggaaatgggacattgcatactgaattgggtccatgtctgtccagctggatgctttattgtaatgatggacatctttataaacatcttaatctcgacacataatttttggaataaaacctggaaagattg

SEQ ID NO: 1693 - DNA, 932 bp, Rattus norvegicus
  Genbank Accession No. NM_017283
gtgtgtgtgcgctacggggtgwagactgtgtctgaaatagcgggaacgccatgtcccgtggttccagcgccggttttgaccggcacattactattttctctcccgagggccgactctaccaagtagaatatgcttttaaggctattaaccagggtggacttacatctgtagctgtcagaggaaaggactgcgcagttattgtcacacagaagaaagtacctgacaaactactggattccagcaccgtgactcacttattcaagataacggaaaacattggctgtgtgatgacaggaatgacagctgacagcagatcccaggtacagagggcacgctatgaagcagctaactggaaatacaaatatggctatgagattcctgtggacatgctgtgtaaaagaattgctgatatttctcaagtctacacacagaatgctgaaatgaggccacttggttgttgtatgattttaattggtatagatgaagagcaaggccctcaagtgtacaagtgtgatcctgcaggctactactgtggctttaaagccaccgcagcaggagtgaagcagacagagtcaaccagcttcctcgaaaaaaaagtgaagaagaaatttgattggacatttgaacagacagtggaaactgcaatcacatgcctgtctactgttctgtcgattgatttcaaaccttcagaaatcgaagttggagtagttacagttgaaaatcctaaattcaggattcttacagaagcagagattgacgctcaccttgtggctctagcagagagagactgaacactcttatcagcttaccagatccatgatgccatgtgcctatgtgtttagtaacaacaaaccgacatcttagaggccctggattgaagatggaaactctcccactcctcctgccactgactggttaggactctgtataaa

SEQ ID NO: 1694 - DNA, 5648 bp, Rattus norvegicus
  Genbank Accession No. NM_017290
cggagccgtccccgacgccacctcccgtctcctccgccgcagtttcctccgccgctgtcgggggtgcagagctgaggggctcgggcagcgcgccgcgcagctcctctccagtcgcccgcctcgccgtcctccccaccgagggctcgcccgggcgcccctcctcagccgcgccgggtctcctcgcgcagcgccgcggcctgcgctacctgcggccggctggcaacagaggcaacgcacactcgcggcggggcgggaggctcgcagcccctcgggcgggctcggcgaggcccggccgcgtgcggcggtttctgggggagggggctcgggtgattcagcgcccggtcaggcggaagcggccgccgccgcggaggaggaggagaaagaggaggggacagctgtccgcgcccgggcgcccgcggtggcacgagcccgcggcccgagtgcgaggcggaggcgaggaggccgcggggacgcgaggcgaggccggccggggcccccgcagccatggagaacgctcacacaaagaccgtggaggaggtgctgggccacttcggcgtcaacgagagcacggggctgagcctggagcaggtcaagaagctcaaggagagatggggctccaacgaattgccggctgaagaaggaaagaccttgctggaacttgtgatcgagcagtttgaagacttactagttagaattttattgctggcagcatgtatatctttcgttttggcttggttcgaagaaggtgaagaaacgattacagcctttgtagaaccttttgtaattctgcttatattggtagccaatgcaattgtgggtgtatggcaggagagaaacgctgaaaatgcaatagaagctcttaaggagtatgaacctgaaatgggcaaggtgtatcgacaggacagaaagagtgtgcagcggattaaagcgaaagatatagttcctggggatatagtggaaattgctgttggtgacaaagttccggctgacattagattgacatccatcaagtctacaactctgagagttgaccagtcgattcttacaggtgaatctgtctcggtcatcaagcatactgaccccgtccctgacccacgagctgttaatcaagacaaaaagaacatgctcttttctggcacaaacatcgctgctggcaaagctatgggagtggtggtggcgactggagtcaatactgagatcggcaagatccgggatgaaatggttgcaacagaacaggagagaacacccctacagcagaagctggacgagtttggggaacagctttccaaagttatctccctcatttgcattgcagtctggatcatcaacatcgggcatttcaatgacccagttcatggtggctcttggatcagaggtgccatctactactttaagattgcagtggccctggctgttgctgccatccctgagggtctgcctgctgtcatcaccacctgcttggctcttggaactcgaaggatggcaaagaaaaatgctattgttcgaagtctgccttctgtggaaacccttggttgtacttctgttatctgctcagacaagaccggcacacttaccacaaaccagatgtccgtctgcaggatgttcattctggacaaagtagaaggtgatacttgttcccttaatgagtttaccataactggatcaacctatgcacccattggagaagtgcaaaaagatgacaagccagtgaaatgccatcagtatgacgggcttgtagagttagcaacgatctgtgctctgtgtaatgactctgctttggattacaatgaggcgaagggtgtgtatgaaaaagttggagaagccacagagactgctctcacgtgcctggtagagaagatgaatgtattcgacacggagctgaagggactttctaaaatagaacgcgccaacgcctgcaactcggtcataaaacagcttatgaagaaggaattcacgctagagttttcacgtgatagaaaatcaatgtccgtctactgtacaccaaacaaaccgagccggacgtccatgagcaagatgtttgtgaagggtgctccagaaggtgtcatcgacaggtgcacccacatccgagttggaagtaccaaggtccccatgacgcctggtgttaaacagaagattatgtctgtcattcgggagtggggcagtggcagcgacacactgcggtgcctggctctggccactcatgacaacccgctgaggagagaggagatgcacctggaagattctgcgaacttcatcaaatatgagaccaatctgactttcgttggctgtgtgggcatgctggaccctcccaggattgaagtggcctcttctgtgaagctgtgccggcaagcgggcatccgagtcatcatgatcactggggataacaaaggcactgctgtggccatctgtcgccgcattggcatctttgggcaggatgaggatgtgacatcaaaggcttttacagggcgagaatttgatgaattaagcccctcagcccagagagacgcctgcttaaatgcccgttgttttgctcgagttgaaccttcccacaagtctaagatcgttgagttcctgcagtcctttgatgagatcacagctatgactggtgatggtgtgaacgacgcgcccgctctgaagaagtcggaaatcgggattgccatgggctcagggactgcagtggctaagacggcctctgagatggtgctggccgacgacaacttctccaccatcgtggccgctgttgaggaggggcgcgccatctacaacaacatgaagcagttcatccgctacctcatctcctccaacgtgggggaggtggtctgtatcttcctgacggcagcccttgggtttcctgaggctttgattcctgtccagttactctgggtcaatctggtgacggatggtctgcctgccactgcgctggggttcaatcctccagatctggacatcatgaacaaacccccacggaacccaaaagaaccgctgatcagcgggtggctctttttccgttacctggctattggctgttatgttggcgctgccaccgtgggtgctgctgcgtggtggttcatcgctgctgacggtggtccgagagtctccttctaccagctgagtcatttcctgcagtgtaaggaggacaacccagacttcgaaggagtggattgtgcaatctttgagtccccgtatccgatgacaatggcactttctgttctagtcaccatagagatgtgcaatgccctcaacagcttgtctgaaaaccagtccctgctgaggatgcccccctgggagaacatctggctcgtgggctccatctgcttgtccatgtcccttcacttcttgatcctctacgtggaacctttgccactcattttccagatcacaccgctgaatctgacccagtggctgatggtgctgaaaatctccctgcctgtgatcctcatggacgagacgctcaagtttgtggcccgaaactacctggagcctggtaaagagtgtgcgcagcctgccaccaaaccctcctgctccctgtcggcatgcaccgacggcatttcctggccctttgtgctgctcattatgcccctggtggtctgggtctacagcacagacactaactttagtgatatgttctggtcttgactgacagcgctacatgcagaagatgtttaacttaatcaattaattttttattgtttaaagcaactgtctatttctgctgaattttcacatgaacatattggctggtgaaggaggtttcatatctagattttgttttgctttttctgactccagtgggacaagattttccttttttttatacacataattaaagtgtccattgacatgtacagagaactaacactattttatgcagatatttttttgtagatgaaaaaagcatgtacagtgttctgtttcatactcatacttgtacaaagatcgttgagccagcagacattgtcagcaagttaattggcagcagacttaggaaatgaatgtgtgtggtttttaaaagaaaaaaaactaaatagcatgtattgtgtcttttgcatgattctctggatttaatttggtatcacagtctaatttttattcataagccaatttttctgcactgagcagagtcctgctacctcagtcagtatttttggtttgccactccctgcaccctcagcctctgtcacccccagcccaccctggcccgctcggctgcttctgtaggtctgatggttctgtttacatctgtcttcacgaggtttgcctgtctcgcttgtgcagaaaacattgctccagatccaatcgactgggtttctgtcccttcgcctagtttttaaggttatttatttaaatgtctaatgtattttattgtaacagacattgttttgccaacattgcctattcagtggcacttcacaatctagtttaaaagaaaaataaaacattttaaatggacagaggaaaataactgtcttgttcttaatggccttgaactacccatgatcagttcaaattcctgagcttctcagctcggagccttagtttcctgttcctgagaagaacgtgtactgctgcacagtagggattatctataatgtacaggcacgatcgtcatgtgacaaacatttactcaagtttctgctggcctggtgtatgtaggctggtgtaagggcaagtgtgtgtgtgtatgtgtgtgtgtgttctgtaaaatctgtaaatagcacatgaccaaatgaactgtatagaaatatttttatttgaatatggcactaaccaccaccaccatgactgaccggacgtttgcgcatgttcaaggtcagtcttaacggcagtgtgagtcattaacagtcctaactgtggtgttttcctccaatgccttccaacatccatcaactaaccaatactggagtaaccgcttcctaaacattgcagaaatgtaagggtgttcgggtgcgtgcatgtgcgttgttagcaacacatcttccagccctctgcatgactgagcttggggaaagagaaatagaacagcccccagctcactgtgtgatgtggaggaaatgtgtattacaagtggggttttagctgttgagtcaaaataataacaagtgtacaatttagcataaggaatcggagagcctctccagagaagtcggtttctttgctgcaagaagaatgaggttctgaacccttatccaagaacagaagccatcagccaagtctccacatttctctgcaaaatgttgtagcctctataactgtatgatagtgtaatgcatgccttcagttgtaagtggccagatcgcgctacagtgacattgaaacctgctctctaattggccctgtacagtttgcttatttataaattcatttaaaacactacagctgttgaatggttacaacctaggcctccggtcctaacttcagttgttctcctcggtgtgcagccagctgttccacactgtattattgtaacttatttagtgaagtcagaagcagtagacagatgttggtgcaatacaagtattgtgtgcatttatcgtaataaagtgctccgcgtcggttcagttcctcacagcttctcacagtgcatgtctgactgtagtctgtaaatagaggtcagtgtccgtgctgctaacaggtatcgatcgcacaga

SEQ ID NO: 1695 - DNA, 7986 bp, Rattus norvegicus
  Genbank Accession No. NM_017298
gaggggaccaagccaattctcctttgcagcaaaaaaaagagaaaaaagaaaaaaaagaaaaatttacatgtatatattactaagataatatatacatctgattttattttttacaaaaagtttattttgctccatttttcaaaaaaagaaggagcgtgggtggcaggcggtttttataaattattcttatttttgattatttgtctctgtccttccccaccccctgctgaagcgaaaataagggcagggaccgcgggctcctacctatcagtaacctcccatacccgttcctccccctccctaacgctgagcatagtgccctgcacacagtaggcgctcaataaatgttcgtggatgatgatgatgatgatgatgaaaaaaatgcagcatcaacggcagcagcaagaggaccacgcgaacgaggcaaactatgcaagaggcaccagactccctatttctggtgaaggaccaacttctcagccgaacagctccaagcaaaccgtcctgtcttggcaagctgcaattgatgctgctagacaggccaaggccgcccagaccatgagcacgtctgcacccccacctgtaggatctctctcccaaagaaaacgtcagcaatacgccaagagcaaaaaacagggtaactcgtctaacagccgacctgcccgtgccctcttctgtttatccctcaataaccccatccgaagagcctgcattagtatagtggattggaaaccatttgacatatttatattattggctatttttgccaattgtgtggccttagctatttacatcccgttccctgaagatgattctaattcaacaaatcataacttggaaaaagtagaatatgccttcctgattatttttacagtggagacatttctgaagattatagcgtccggactgctgctgcatcctaatgcttccgttaggaacggatggaacttactggattttgttatagtaatagtaggattgtttagtgtaattttggaacaattaaccaaagaaacagaaggcgggaaccactctagtggcaaatcaggaggctttgatgtcaaagccctccgtgccttccgagtgttaagaccgcttcgacttgtatcaggagtgcccagtttacaagttgttctgaactccattataaaagccatggtccccctcctccacatagcccttttggtgttattcgtaattatcatctatgcgattatagggttggaactttttattggaaaaatgcacaaaacctgtttttttgctgactcagatatagtagctgaagaggacccagctccatgcgcgttctcagggaatggacgccagtgtgccgccaatggcacggaatgtaggagcggctgggtcggccccaatggaggcatcactaattttgacaactttgcctttgccatgctcactgtgttccagtgcatcaccatggagggctggacagatgtgctctactgggttaatgatgcgataggatgggagtggccatgggtgtattttgttagtctgatcatccttggctcatttttcgtccttaacctggttcttggtgtccttagtggagaattctcaaaggaaagagagaaggctaaagcacgtggagatttccagaagcttcgggagaagcagcagctggaagaggatctcaagggctacttggactggatcacccaggcagaagacatagatcctgagaatgaagaggagggtggagaggagggcaaacgaaacactagcatgcccaccagtgagaccgaatctgtgaacacagagaacgtaagtggtgaaggcgagacccagggatgctgtggaagtctctggtgctggtggaaaagaagaggcgcggccaagactgggccctctgggtgtcggcggtggggccaagccatctcgaaatccaagctcagatcgcacggggcccgcgaggctttgtgtgtgtgccggtgcagccttgaatctctcgtgaaactatggacgtctaggttctcagcccacttgcaggctgcatatgtcagaccctacagccgtcggtggcgtcgctggaaccggttcaatcgcaggagatgcagggcagctgtgaagtctgtcacgttttactggctggtgatcgttctggtgtttctcaacactctgacgatttcctctgagcactacaatcagccagactggctgacgcagattcaagatatagcgaacaaagtgctcttggctttgttcacctgtgagatgctggtgaagatgtacagcctgggcctccaggcctacttcgtctctctcttcaaccgcttcgattgctttgtggtgtgtgggggaatcaccgaaaccatcctggtggaactggagctcatgtctcccctgggcgtctctgtgttccggtgtgtacgtctcctgaggatcttcaaagtgaccaggcactggacttccctgagcaacttggtggcgtccctgttaaactccatgaagtccatcgcctctctgctgttgctgctcttcctcttcatcatcatcttctccctgctggggatgcagctgttcggagggaagttcaatttcgatgagacacagaccaagcgaagcaccttcgacaacttcccacaggcgctcctgactgtgttccagatcctgacgggcgaagactggaatgcggtgatgtatgacggcatcatggcctacggaggcccgtcctcctctggaatgattgtctgtatttacttcatcatccttttcatctgtggtaactatatcctgctgaagctcttcttggccattgctgtagacaatttggctgatgctgaaagtctgaacactgctcagaaagaggaagccgaagaaaaagaaaggaaaaaaattgccagaaaagaaagcctagaaaacaaaaaaaacaacaaaccagaggtcaaccagatagccaacagtgacaacaaggttactattgatgactatcaagaggaggctgaagataaggacccttatccaccctgcgatgtgccagtaggtgaagaggaagaggaggaggaagaggacgagcctgaggttcctgctggtccccgtcctcgaagaatctcagagttgaacatgaaggagaaaattgcgcccatccccgaaggaagcgcattcttcattcttagcaagaccaacccgatccgtgtgggttgccacaaactcatcaaccaccacatcttcaccaacctcatcctggtcttcatcatgctgagcagcgctgccctggccgcagaggatcccatccgcagccactccttccgcaacactatactgggctactttgactatgctttcacagccatctttacggttgaaatcctgttaaagatgacaacttttggagcgttcttgcacaaaggggctttctgtaggaactacttcaatttgctggacatgctggtcgttggggtgtctctggtgtcatttgggattcaatccagtgccatctcggttgtgaagattctgagggtcttaagggtcttgaggcctctcagagcaatcaacagagcaaaaggacttaagcacgtggtccagtgtgtctttgtggccatccgaaccatcggcaacatcatgatcgtcacgaccctgctccagttcatgtttgcttgcattggggtccagctgttcaaggggaagttctaccgttgcacagatgaggccaaaagtaaccccgaggagtgcagggggcttttcatcctttataaggacggcgatgtcgacagtcccgtggtccgtgagaggatctggcaaaacagtgatttcaatttcgacaatgtcctttcggctatgatggcgctcttcacggtctcgacttttgagggctggcccgcgttgctgtacaaagctatcgactcaaacggagagaacgttggtcctgtctacaactaccgtgtggagatctccatcttcttcattatctacatcatcatcgtggccttcttcatgatgaatatcttcgtgggcttcgtcatcgtcaccttccaggagcagggagaaaaggagtataagaactgtgagctggacaaaaatcagcgtcagtgtgtggaatatgccttgaaggcccgccccttaaggagatacatccccaaaaacccataccagtacaagttctggtacgtggtgaactcctcgcctttcgaatatatgatgtttgtcctcatcatgctcaacacgctctgcctggccatgcagcactatgagcaatccaagatgttcaatgacgccatggacattctgaacatggtcttcacgggggtcttcaccgttgagatggttttgaaagtcatcgcatttaagcccaaggggtattttagtgacgcctggaacacgtttgactccctcatcgtaatcggcagcattatagacgtggcactcagcgaagctgacaactctgaagagagcaatagaatctccatcacctttttccgtcttttccgagtgatgcggttggtgaagcttctcagcagaggggaaggcatccggactctgctatggaccttcattaagtccttccaggcactcccatatgtcgccctcctcattgccatgctcttcttcatctacgccgtcattggcatgcagatgtttgggaaggttgccatgagagataacaaccagatcaataggaacaacaacttccagacgtttccccaggcagtgctgctgctcttcaggtgtgcaacaggggaggcctggcaggagatcatgctcgcctgcctccctgggaagctgtgtgacccggactcagattacaacccaggagaggaatatacttgtgggagcaactttgccattgtctacttcatcagcttttacatgctctgtgcgttcctgatcatcaacctcttcgtggctgtcatcatggacaattttgactatctgacgagggactggtctattctggggcctcaccacttggacgaattcaaaagaatatggtctgaatatgaccccgaggcaaagggaaggataaaacaccttgatgtggtcactttgctccgacgtatccagcctcccctgggatttggaaagttgtgtccacaccgagtggcgtgtaagagattggtcgccatgaacatgcctctcaacagtgatgggacagtcatgttcaatgcaactctgtttgctttggtacggacggctctcaagatcaagactgaaggcaacctggagcaagctaatgaagagctccgcgctgtgataaagaaaatctggaagaagacaagcatgaagctacttgaccaagttgtccctccagctggtgatgatgaggtaaccgtggggaagttctatgccactttcctgatacaggactactttaggaaattcaagaagcggaaagagcaaggcctggtggggaaataccctgcgaagaacaccacgatcgccctacaggcgggattaaggaccctgcatgacattgggccagaaatccgacgggctatatcctgtgacttgcaagatgacgaaccagaagactccaaaccagaagaggaagatgtattcaaaagaaatggtgccctgcttggaaactatgtcaatcatgttaatagtgataggagagagtcccttcagcagaccaataccacccaccgtcccctgcatgtccaaaggccttcaattccacctgcaagtgatactgagaaaccgctgtttcctccagcaggaaattcggtgtgtcataaccatcataaccataattccatagggaagcaagttcccacctccacaaatgccaatctcaataacgccaatatgtccaaagctgcccacggaaagcggcccagcattggggaccttgagcatgtgtctgaaaacggccattactcctacaagcacgaccgagagcttcaaagaaggtccagtattaaaagaacccgctattatgaaacttacattaggtctgagtcaggagacgagcagcttccaaccattttccgtgaagaccctgagatacacggctacttccgagacccccgctgcttcggggagcaggaatatttcagtagcgaggagtgctgtgaggatgacagttctcccacctggagcaggcaaaactacagctattacaacaggtacccaggcagctccatggactttgagaggccccgaggctaccatcacccccaaggtttcttagaagatgacgactctcccattggctatgactcacggagatctccaagaagacgccttctacctcctaccccaccatcccatcggaggtcctccttcaactttgagtgtctgcgcaggcaaaacagccaagatgacgtccttccgtcgcctgccctgcctcaccgcgctgccctgcccctgcaccttatgcagcagcagatcatggccgttgcaggcctagattccagtaaagcccagaagtactcgccgagccactctacccggtcatgggccacccctccagcaacccctccgtaccgagactggaccccatgctacacccctttgatccaggtggatcgctcagagtctatggaccaggtcaatggcagcctgccgtcgctacaccgcagttcctggtatacagatgaacccgacatctcctataggactttcacaccggccagcctgaccgtccccagcagcttccggaacaaaaacagcgacaagcagaggagtgcagacagcctggtggaagcagtcctgatatccgaaggcttgggacgctacgcaagggacccaaaatttgtctcagcaacaaaacatgagatcgccgatgcctgtgacctaaccatagacgagatggagagcgcggccagcaccctgctcaatggaagcgtgtgtcctcgagccaacggggacatgggccccatctcacaccgccaggactatgagctccaggactttggtcctggctacagtgacgaggaaccagaccctgggcgagaggaagaggacctggcagatgaaatgatttgcatcaccaccttgtagcccagcgagagcaggcttggctccagcctgggatgggcacaggagggccagggataaagtgccacataattaggaaagtttaggcactagttgggaggaaaatgctcaattagacttttgtacgagtgatttcacgcctcaaggaagccataaacctggtaggagcaggttctcagcggccaggcatgtgcgtacgcatgccacatgctcgggcccagccccagaagacagaatgtctggccccaccgagaggatgggcgagagcagcagcctggcctgcacagagaccaggactgcccaggagtccatgtctgccacccagggctcatgcccacgcccctttgcctgcagacacgagagaggtcaaaggtgatgacagtcaccatgcctgtgtcgttacctcaaccatcggtctagcatatcagacgctcgctgggcccggcatatccgtgtctgagcccccctcccccagagcactggttcctggtttctgtgcagccgttctgagtggcgcacaccagaacccagccgctagtggtcgcgatgaggggagtgggaccggaaccgttttgttaagcgatgccagtttacataaagagaacatcactcagacggtcagttctgtcacattaagggcaattgtaaactggaagggtagcgcacttgcaaaccaggtaaaacttagatacattagtttgtttaaaaattatagatttactgtacatgacttgtaatatacgatttgtatttgtaaagagatggtctatattttgtaattatcgtaccgtatttgaactgcagcaatatcccacgggtcctaacaatcgtagtttcccaccaaaacctagaaattattagtatttttactcgggctaaacagaactaggagaattagaggcaattctcacatattcagtaaaaagaatcttttggggataaacttttgagttcataagaacttgacacttcagaactttttctaaagtattttgagttactataaacctatctttacataag

SEQ ID NO: 1696 - DNA, 2402 bp, Rattus norvegicus
  Genbank Accession No. NM_017299
acgccggctgctggttgaactaggtacgggcctgtgggacgcagagctggggatccattgtgagtgcctagggagccacaaggtgcggtcctgttccttccggcatcctgaagatgaaagcggactgaattctatctgcagtcctggcgcaactgcagagctccggcaggttgagcgtgccaagagcctgcgaagtggagtgtcatctttgcttaccaggtccatgaggacctggccaacatggtgcccactggccaggtcggagaaaagcaagcctgtgaagagcccaggcaggaccgagaacttaagtcctggcgatggctcgtgttctacctctgcttctttggcttcatggcacagttgcgacctggggagagcttcatcacaccctacctcctggaacgtaacttcaccaaggagcaggtgaccaacgagatcattccgatgctgccctactcccacctggccgtgctggtccccatcttcctgctcaccgactacctacgatacaagccagtcctggtcctacagtgcctgagcttcgtgtgcgtgtggctgctgctgctcctggggacctccgtcgtgcacatgcagctcatggaagtcttctacagcatcaccatggcggcgcgcatcgcctactcctcctacatattctccctggtgcagccctcccgctaccagcgcatggccagctactcgcgggccgcagtcctactgggcgtcttcatcagctccgtgctgggccaggtgctggtcaccctaggaggcatctccacctatatgctcaactgtatctccctgggcttcatcctcttcagcctgagcctctccctcttcctaaagcgtcctaagcggagcctctttttcaaccggagcgcacttgtgcaaggagccttgccctgtgagctggatcagatgcacccgggacctggccgtccagagcccaggaaactggagcgcatgctgggcacttgcagggactccttcctggtacgcatgctaagcgaactggtgaagaacgtccggcaaccacagctgcgtctctggtgcctctggtgggtcttcaactcggcaggctactacctgatcacctactatgtccatgtcctgtggaaaatcactgacagcagactcaactacaacggtgccgtagatgccgcctccacacttctgagcgccatcacggccttcaccgcgggcttcgtgaacatccgctgggctctgtggtcaaagctggtcatcgcgagtgtcatagccatccaggctggcctggttttctgtatgttccagatcccggacatctgggtctgctatgtgaccttcgtgcttttccgtggggcctaccagttccttgtgcccattgccacttttcagattgcatcttccctgtctaaagagctctgtgcattggtcttcgggatcaacactttccttgccactgcgcttaagacctcgatcacactcgtggtctctgacaagcggggtctgggcctccaagtccatcaacagttccgcatctacttcatgtacttcctgacgctgtccatcatctgccttgcctgggctgggctggacggcttgaggtactaccggcgtggtcgccaccagccgctggcccaggcccaggctctgagtcccttggaggattctgtgcaggcgataagcctacaggatggagacctaaggagaccgcagccctcggcaccacagctgctcccagaggatggcagcgtagaagacggcagggcagacttgagagtcgaagccaaggcctgacctgtcttcaccttcctggcttcatcccagttcagccgccggattcctgactcagtggcagcccctcctgtgtgcactccagcctgaatcagcccttctggggtcccagtgcctgagacatgtgggggcccccctgttgcctttcaggagccttcaggttaggccacagaactctctccttaggggccaccttttttaacagtggggcgacagacagcttgtccttccggtagcctctgaggaccctaagcccagcctacttcatgctttagcaatggctggagcctgctacagacactcaggaccgctccctggcttttgtgaaccacaatgtcaggccactacgagcctgggttgcctactgcttgccaagaagaacctgtgtaggggtcagctgtgcccaccaggctggtctgccctttgctctgggatgctcaggacaaatcacgtctgcccccagggctagtgaggtagcccagacaccggacaaggtccgctgagcctgcagggtactggttacctgtcctaggctcctggtgaagctgccatacctccactctcggaggtgcttgtttgtatggttgtctgattttttaaaacttgacattaaaatggagaactac

SEQ ID NO: 1697 - DNA, 1382 bp, Rattus norvegicus
  Genbank Accession No. NM_017305
gaattccggccttccctccgtggctccggcgctgcccggtcccctcgggcggcagctgccatgggcaccgacagccgcgcggccggagcacttctggcgcgggccagcaccctgcacctgcagaccgggaacctgctcaactggggccgcctgcggaaaaagtgtccgtccacgcacagcgaggagcttcgagactgtatccaaaagaccttgaatgaatggagctcccaaatcagccctgatttggtcagggagtttccagatgttttggaatgtaccatgtcccatgcagtggaaaagataaaccctgatgaaagagaagaaatgaaagtttctgctaaactgttcattgtaggatcgaattcttcatcatcaactagaaatgcagttgacatggcatgctcagtccttggagttgcacagctggactctgtcatcatggcttcccctccaattgaagatggagttaatctttccttggagcatttgcagccttactgggaggaattagaaaacttagttcagagcaagaagattgttgctataggcacctcggatctagacaaaacacagttggagcagctgtaccagtgggcacaggtaaaacccaatagtaatcaagttaatcttgcctcctgctgtgtgatgccaccagatttgactgcatttgctaaacagtttgacatacagctactgactcacaatgacccaaaagaactgctctctgaggcaagtttccaggaagctcttcaagaaagcatccctgacattgaagcccaggagtgggtgccactgtggctgctgaggtactcggtcatcgtgaaaagcagaggaatcatcaagtcaaaaggatacattttgcaagccaaaagaaagggttcttaactacagctcaagctcacaactcaggggccttgtatttatctggaacataagataaaaattcatgataaaattgagatgtgtaaaaaaaaatctagctctcgcctacaaaaagcgtcactgaggcgtgaatgtggtggtttggcaatgtgttgagtttaagtacctccctggcgtctgcagcagcgcactcacaggaagcattgtattctcttcattaaactcttggtttctaactgaaatcgtctataaagaaaaatacttgcaatatatttcctttatttttatgagtaatagaaatcaagaaaatttgttttaagatatattttggcttaggcatcagggtgatgtatatacatattttttatttctaaaattcagtaactgcttcttactctatacttctataactaagcaattacattacagttgttaagacatactggaagagatttttttcctgtcgtttgacaaaataatctatctcagagtcggaattc

SEQ ID NO: 1698 - DNA, 972 bp, Rattus norvegicus
  Genbank Accession No. NM_017306
cccaccgatatccaaaatggcgctggctgctgcgcgtcgcgttctgctgcaggccggatcccgcctcggccgcaggggggccgtggacggcgcgcgtcgcttctctaacaagcgggtgttggtggagaaggagggcgaggcaggaatcgcagtgatgaagttcaagaaccctccagtgaattccctcagcttggagtttctgacagagttcgtcatcagcctggagaagctggaaaatgacaagagcatccgaggtgtcatcctcacttcggagcgcccgggtatcttctcggctggcctggacttgatggagatgtatggccggaacccagcccactatgctgagtactggaaggctgtgcaggagctgtggctgaggctctacttgtccaacctgaccttgatatctgccatcaatggcgcctctccagctggaggctgcctcatggctctcacctgtgactacaggataatggcggacaactccaagtataccataggattgaatgagagcctgctgggcattgttgcccccttctggttaaaagacaactacgtgaacaccatcgggcaccgagcagccgagcgtgcccttcaactggggacgcttttcccaccagcagaggccctcaaggtgggtttggtggatgaggtggtacctgaggatcaggtacacagcaaggctcgctcagtgatggccaagtggttcaccattccggaccattctcggcagctgacgaagagcatgatgcggaaggccacggcggacaacctgatcaagcagcgagaggctgacatccagaacttcaccagtttcatctccagagactccatccagaagtccctgcacgtgtacttggaaaagctcaagcaaaagaagggctgacctaagggtgccacacgggtgtttagttacacgtgccttctaggacccatggtcccaaggattatcaataaggtatttttcaattt

SEQ ID NO: 1699 - DNA, 2545 bp, Rattus norvegicus
  Genbank Accession No. NM_017314
cttttgtgaggactgcagccaacaccgctgacaatgcagatctttgtgaaaaccttaactggtaagaccatcaccctggaggtcgagcccagtgacaccattgaaaatgtcaaggcaaagatccaggacaaggagggcatcccccctgaccagcagaggctgatctttgcaggcaagcagctggaagatggccgcaccctgtcagactacaacatccagaaggagtccaccctgcacctggtcctgcgcctcagagggggcatgcagatctttgtgaagaccctgacaggcaagaccatcaccctggaggtcgagcccagtgacaccattgaaaatgtcaaggcaaagatccaggacaaggagggcatcccccctgaccagcagaggctgatctttgcaggcaagcagctggaagatggccgcaccctgtcagactacaacatccagaaggagtccaccttgcacctggtccttcgcctcagagggggcatgcagatctttgtgaagaccctgacaggcaagaccatcaccctggaggtcgagcccagtgacaccattgaaaatgtcaaggcaaagatccaggacaaggagggcatcccccctgaccagcagaggctgatctttgcaggcaagcagctggaagatggccgcaccctgtcagactacaacatccagaaggagtccaccctgcacctggtccttcgcctcagagggggcatgcagatctttgtgaagaccctgacaggcaagaccatcaccctggaggtcgagcccagtgacaccattgaaaatgtcaaggcaaagatccaggacaaggagggcatcccccctgaccagcagaggctgatctttgcaggcaagcagctggaagatggccgcaccctgtcagactacaacatccagaaggagtccaccctgcacctggtcctgcgcctcagagggggcatgcagatctttgtgaagaccctgacaggcaagaccatcaccctggaggtcgagcccagtgacaccattgaaaatgtcaaggcaaagatccaggacaaggagggcatcccccctgaccagcagaggctgatctttgcaggcaagcagctggaagatggccgcaccctgtcagactacaacatccagaaggagtccaccctgcacctggtccttcgcctcagagggggcatgcagatctttgtgaagaccctgacaggcaagaccatcaccctggaggtcgagcccagtgacaccattgaaaatgtcaaggcaaagatccaggacaaggagggcatcccccctgaccagcagaggctgatctttgcaggcaagcagctggaagatggccgcaccctgtcagactacaacatccagaaggagtccaccctgcacctggtccttcgcctcagagggggcatgcagatctttgtgaagaccctgacaggcaagaccatcaccctggaggtcgagcccagtgacaccattgaaaatgtcaaggcaaagatccaggacaaggagggcatcccccctgaccagcagaggctgatctttgcaggcaagcagctggaagatggccgcaccctgtcagactacaacatccagaaggagtccaccctgcacctggtccttcgcctcagagggggcatgcagatctttgtgaagaccctgacaggcaagaccatcaccctggaggtcgagcccagtgacaccattgaaaatgtcaaggcaaagatccaggacaaggagggcatcccccctgaccagcagaggctgatctttgcaggcaagcagctggaagatggccgcaccctgtcagactacaacatccagaaggagtccaccctgcacctggtcctgcgcctcagagggggcatgcagatctttgtgaagaccctgacaggcaagaccatcaccctggaggtcgagcccagtgacaccattgaaaatgtcaaggcaaagatccaggacaaggagggcatcccccctgaccagcagaggctgatctttgcaggcaagcagctggaagatggccgcaccctgtcagactacaacatccagaaggagtccaccctgcacctggtcctgcgcctcagagggggcatgcagatctttgtgaagaccctgacaggcaagaccatcaccctggaggtcgagcccagtgacaccattgaaaatgtcaaggcaaagatccaggacaaggagggcatcccccctgaccagcagaggctgatctttgcaggcaagcagctggaagatggccgcaccctgtcagactacaacatccagaaggagtccaccctgcacctggtcctgcgcctcagagggggcatgcagatctttgtgaagaccctgacaggcaagaccatcactctggaggtcgagcccagtgttaacaccaagaaggtcaaacaggaagatactcgtacctttctcaccacagtatctagaaagagcccttcttgtgcttgttcttgggtttgatggggaggtgtcttagttttccctatcttttaagctgttaacaagtttcattgcactttgaataaagttcttgcattcc

SEQ ID NO: 1700 - DNA, 1330 bp, Rattus norvegicus
  Genbank Accession No. NM_017320
gggactctctcatgccgccatacggagatggctgttttgggtgcccctggtgtgctctgtgacaatggagcaactgcagagagacctaccctggaccaccactgggatctctggaagaaaactcgcatgagaaggaatacagatcagaatgaagaagacgtacgacgtctcatctgggaaaagaatctcaagtttataatgcttcacaatctggaacattctatgggaatgcattcatacagtgtgggcatgaaccacatgggagacatgacacctgaagaagtcataggttatatgggctctctgagaattcccaggccctggaatagaagtggcactctcaagtcaagctctaatcagacattgcccgactctgtggactggcgagaaaagggctgcgtcactaatgtgaaataccagggctcttgtggttcctgctgggctttcagcgccgagggggcccttgaagggcagctgaagctgaaaacggggaagctggtgtctctcagtgctcagaacctggtggattgctcaaccgaagaaaagtacgggaataaaggctgcgggggtggcttcatgaccgaagctttccagtacatcatcgatacgagcatcgactcagaagcttcctatccctacaaagccatggatgaaaagtgtctctatgacccaaaaaatcgagctgccacgtgttcaaggtacattgagctccccttcggcgatgaagaagctctgaaagaagcagtggccactaaagggcctgtctctgtgggcatcgacgacgccagccattcctccttcttcctctaccaaagtggtgtctatgatgacccctcctgtaccgagaatatgaatcatggtgttctcgtggttggctatgggactcttgatgggaaagactactggcttgtgaaaaacagttggggccttcactttggtgatcaaggatatattcggatggcgagaaataacaaaaatcactgcgggattgctagctattgctcttacccagaaatctaaaccgtttcttctttttctaatgggtcacaaagacggaatacactctaatttaattttgtctgctccatccggaggacccaagtgtgtcgtgatcagtgtgtacatactgtgctaactggcttacagcttgtttgttttataactttacctctctctgaaaagtctgtaagcaaggacgcgctgaggatggagctggcagtctgtcctagatattctttctatgcttgcaccctgtcgtctaatgtgtctaataaccctttgtaacacagatatccccaaagtgcctaataaaatctgtcatttcaagctc

SEQ ID NO: 1701 - DNA, 1112 bp, Rattus norvegicus
  Genbank Accession No. NM_017326
ttagtccgagtggagcgagcgagtcgagtggttgtctgttctggtctcggaaaccggtagcccttgcagcatggctgaccaactgactgaagagcagatcgcagaattcaaagaagctttctccctatttgacaaggacggggatgggacaataacaaccaaggagctggggacggtgatgcggtctctggggcagaaccccacagaagcagagctgcaggacatgatcaatgaagtagatgccgacggtaatggcacaatcgacttccctgaatttctgacaatgatggcaagaaaaatgaaagacacagacagtgaagaagaaattagagaagcgttccgtgtgtttgataaggacggcaatggctacatcagtgcagcagagcttcgccacgtgatgacaaaccttggagagaagttaacagatgaagaggttgatgaaatgatcagggaagcagacatcgatggggatggtcaggtaaactacgaagagtttgtacaaatgatgacagcgaagtagagaccctgtacagaaggtgttaaatttcttgtacagaactgttaatttgccttttctctgtttgtaacttatctgtaaaaggttccccaattgtcagaacatgcatgtatagtaattaggattcattcttccatgttttttccctatcttctgtcattgtccttcaaccttattttagaaaagtgatcaagtaccatgttgcatgtggcttctctggatatatctaagccttctgcacatctacacttagatggagttggtcaaagggaacatctgggttatgaccttttttacagtagcttttaggaaccgtcggcatgttgctgttgaagtgtggagttgtgagcgtggactgtggacagtcgacagcgtgtactaagagttgcactactgcaagcgggtgttctgtccggtactcactcgtacactatttttttgtactgctggtattgtaccagaaacattttcttttattgttacttgctttttaaactttgtttagccacttaaggaagatctgcttatggcacaatttgcctcaaatccattccaagttgtatatttgttttccaataaaaaaaaatgacaattt

SEQ ID NO: 1702 - DNA, 436 bp, Rattus norvegicus
  Genbank Accession No. NM_017334
actttattttggactgtggtacggccaacaagaccactctgtatgcaaaagcccaacatggctgtaactggagatgaaactgatgaggagactgaccttgccccaagtcacatggctgctgccacaggtgacatgccaacttaccagatccgagctcctactactgctttgccacaaggtgtggtgatggctgcctcaccaggaagcctgcacagtccccagcaactagcagaagaagcaactcgcaagcgggagctgaggctgatgaaaaacagggaagctgctaaagaatgtcgacgtcgaaagaaagagtatgtcaagtgtcttgagagtcgagtcgcagtgctggaagttcagaacaagaagcttatagaggagcttgaaactttgaaagacatttgctctcccaaaacagattagtagaaatatttaacta

SEQ ID NO: 1703 - DNA, 3741 bp, Rattus norvegicus
  Genbank Accession No. NM_017340
acacgggtcgttgctttggtgtctgtcacttctgtcgccacctcctctgccaacaccaacactgacctccgtcatgaaccccgacctgcgcaaggagcgggcctccgccaccttcaatccggagttgatcacgcacatcttggatggcagtccggagaatacccggcgccgtcgagaaattgagaacttgattctgaacgacccagacttccagcatgaggactataacttcctcactcgaagccagcgttatgaggtggctgttaagaagagtgccaccatggtgaagaagatgagggaatatggcatctcggaccctgaagaaatcatgtggtttaaaaaactatatttggccaattttgtggaacctgttggcctcaattactccatgtttattcctaccttgctgaatcagggcaccactgctcagcaggagaaatggatgcgcccgtcccaagaactccagataattggcacctacgcccagacggagatgggccacggaactcatcttcgaggcttggaaaccactgccacatatgaccccaagacccaagagttcattctcaacagccctactgtgacttccattaagtggtggcctgggggacttgggaaaacttccaatcacgcaatagttctggctcagctcatcactcaaggagagtgctacgggttacatgcctttgttgtccctatccgtgaaattgggacccacaagcccttgccaggcatcactgtcggggatatcggtcccaaatttggttatgaagagatggataacggctacctgaagatggacaattaccgtattcccagagagaacatgctgatgaaatacgcccaggtgaagcctgatggcacatatgtaaagcctttgagtaacaagctgacgtatgggaccatggtttttgtgaggtccttcctcgtgggaaatgcagctcagagtctgtccaaggcttgcacaatcgccatacgatacagcgctgtgaggcgccagtctgaaatcaagcaaagcgaaccagaaccacagattttggattttcaaacccagcagtataaactcttcccgctcctggccactgcctatgccttccacttcgtaggaaggtacatgaaggagacctaccttcgaattaatgagagcattggccaaggggacctgagtgaactgcctgagcttcacgccctcactgctgggctgaaggcttttactacttggacagccaatgctggcatcgaagaatgtcgaatggcctgcggcgggcacggctattctcacagcagtgggattccaaatatttacgtcacttttaccccggcctgcaccttcgagggagagaacactgttatgatgctgcagacagccaggttcttgatgaaaatctatgaccaggtgcggtcggggaagttggtgggtggtatggtgtcatacctgaatgacctgccgagtcagcggatccagccacagcaggtggcagtctggccaactatggtggacatcaacagcctggagggcctgacagaagcctacaagcttcgtgcagccagattggtagaaatcgctgcaaaaaaccttcagactcacgtgagtcacaggaagagcaaggaagtagcatggaacctaacctctgtcgaccttgttcgggcaagtgaggcgcattgccactacgtggtcgttaaggtcttctcagacaaactccccaagattcaagacaaagccgtccaagctgtgctgaggaacctgtgtctcttgtattctctctatgggatcagccagaaaggaggggactttcttgaggggagcatcatcacaggggctcagctgtcacaagtaaacgctcggatcctggagctgctcaccctgatccgccccaatgctgttgctctggtggatgcctttgactttaaggacatgacacttggctctgttcttggccgctatgatggaaatgtgtatgaaaacttgtttgagtgggccaagaaatccccactgaacaaaacagaggtccatgaatcttaccacaagcacttgaagcccctgcagtccaagctttgaagtttccctgggacacgtctgagctccacaagcagcagaaactctctcctctactcactaatccttgtgaaatcgtcatcaaatttgtgtagctacagagcaaatgatgggtttcttttcctccctataagtaaagagaaatgaacagactttagagattaaatgagaaattcggtgttgtaagtgcagtaatgcagacagagacgtaggaactcagaaagcttcagagctgtggtctgacttgcatttgtactgctgctaatctcagtaggccttgactctggagaattaacagagttttaactacaaatacttacttattttcacatttttactgctaatcactggatatatgttttttaaacaaaagtgttatatagagtggaattttccaggcattcgtgcctaccactttctgatctactgctaagagcaggagtttgggggccagaaactaatagaaaccttgatgtgggtgtgtggctgtcacacaggccgctgctgcctgccatgtgggtgtgtcacccctattaactgtcacattaacatagtcaacaagaggactccttcaacacccacccaccaagaaaccagagttcccgatgggcacaagcacccactccaggctcagccttcgtggtagtggcactactgtgcctttgaccccactttttgacacagttaagttacttgtcttacctccaggctttcagccattgcctggatttcagtcatggtggctgaccttccctttcttgcttgccttccttctcctgaaagagataaaagagatagtagtcagcctctcctcatagattaagtatatggagagccctcagctatggtattactgtattttggtgactttgttaagtaaatttcctgggacaatcctgatttgaaagattctgtattctgttgcacaagctattaaaatgctcagtggtcaccaaagtatttcacacacacacactcacaaatcactcaggtcaccttttacactagaaataacaggaaagccctggccacagccatctgctgagagtgttagttgagatgtttcgttgaagatggctgaagaaagtgcaggccctggggagtttctccttgctgagagccggctctgtggtgagcccctagcagccttacgaggcggtgaaacggccccttcagatgggagcagcctctacaatcattctgagcttaaaggtgaaatatgcaccttttgtcctataaatgtcctataaatgcttggggggaggggtaatgttttgttttttttttcttgaaacagagcccagaatggccttgaactctgatcctcacagcctggtaaatgctgggcctacaggtgtgcgccgacatgtctggctgatcggagctctttattcttaaaagcacagtagggagatgattgtaacattaagtctgtgtctgtggcattcgcattgtgagagcagttccttagaacagttctgagagcacagcatcaatgtagtgaaaacgatgtcgacgcctgacatgaaatcacaaccctccgggtcatcgacacaagccttaacctttctcctggaatgactggtaatcccttaagattgacagtacacagcatgtcaccttgttggggtttctattgacagtaattcatattctggaaaggaactaataaatataaatgaccg

SEQ ID NO: 1704 - DNA, 1139 bp, Rattus norvegicus
  Genbank Accession No. NM_017343
agatttgaaccgccaccatgtcgagcaaaaaagcaaagaccaagaccaccaaaaagcgccctcagcgcgcaacgtccaacgtgttcgccatgtttgaccagtcccagatccaggagttcaaagaggccttcaacatgatcgaccagaaccgggacggcttcattgacaaggaggacctacacgacatgctcgcgtctctggggaagaaccccaccgacgcctacctggacgccatgatgaacgaggccccgggccgcatcaatttcaccatgttcctcaccatgtttggagagaagctgaacggcaccgacccagaggacgtcatcagaaacgccttcgcttgcttcgatgaggaagccacaggcaccatccaggaggattacctgagggagctgctgaccaccatgggtgaccgcttcacagatgaggaagtggatgagctgtacagggaggcccccatcgacaaaaagggcaatttcaactacatcgagttcacgcgcatcctcaagcacggagcgaaagacaaagatgactgaagaggctgcagctgacattcctgttgagtttccttattcacttcatgtctcagacacagcccccataggacctactgtgtgccactttgtgtccctcagacaccccctcccataggcctactgtgtgccgcttagtccctcagacaccccctcccataggcctactgtgtgccacttagtccctcagacaccccctcccataggcctactgtgtgccatttgtccctcagacaccccctcccataggacctactgtgtaccacttggtttctcagacagccccacccccaaacccccctaaggacctactgcgggccacttagtttcacagcctttcctttttttaatgtatttattccagaccctttctgccacttagcatgtgtataatcagactggaatggggacaatgttgtaattgtactgaaaatgagatgcaaataaaaaaatcaaccaatgtgaaagcccaggaaaatatatcggcatttctggttttgctggatttttttacatttttatataataaaaatgttattttgaaataaagattatgctgactcaaggtggagtataaaacaaaaaaaaaaaaaaaaaaaaaaaaaa

SEQ ID NO: 1705 - DNA, 1272 bp, Rattus norvegicus
  Genbank Accession No. NM_017350
taacgaagaacccatgggcctcctgaggcggcggctgctgctgctggtggtggtagtgacgacctgtgtcccagcctcccagggcctgcggtgcatacagtgcgaaagtaaccaggactgcctggtggaggagtgtgccctgggccaggacctctgcagaaccacggtgcttcgggaatgggaagacgccgaggagctggaggtggtgaccagaggcctgtgccacaaggagaagaccaacaggaccatgagctaccgcatgggctcggtgatcgtcagcctcaccgagaccgtgagtgccacaaacctctgcaacaggcccagacccggagcccgagggcgaccttttccccggggccgttaccttgagtgtgcatcctgcacctctctggaccagagctgtgagaggggccgggagcaaagcctgcagtgccggtatcctacagaacactgtattgaagtggtgacgctccaaagcacagaacggagcgtgaaggacgaaccctacaccaaaggctgtggcagtcttcccggatgcccgggcacagcaggtttccatagcaaccagacctttcacttcctgaagtgctgcaacttcacccaatgcaatggtggcccagttctggatcttcagagcttaccaccgaatggcttccaatgttacagctgtgaggggaacagcacctttggatgttcctacgaagagagctccttcattgactgccggggaccaatgaatcagtgcttggaggctacaggcttagatgtgctgggaaaccggagttacaccgtaagaggctgcgccacggcttcctggtgccaaggttcccacgtggccgactccttccagacccacgtcaacctctctatctcctgctgtaatggcagtggctgtaaccgccctacagggggcgcccccgggccaggccctgctcatcttatcctcattgcctccctgctcctgaccctcagactgtggggcatccctctctggacctgaatcctgagccgtctgccctggctggacccaggaacttttgactcctccgcctctgctccatctttgaggacaggcgtgctgtattgtcttcttgggcctcaagaactggaagagaattgagaaaagggctgcgggccagcaggggggcctcttggttgagttaatattgttgctgttattattattatcattgttattaccctaatttattatgtaaatatatatataagatttttgtaccagtgaaaaaaaaaaaaaaaaaaaaagcggcc

SEQ ID NO: 1706 - DNA, 1392 bp, Rattus norvegicus
  Genbank Accession No. NM_017365
ccgggatccctgcgcgccgtggtgttctgtgccttgccggtctgttccctccgattgtgcctagcaatgaccacccagcagattgttctccagggcccgggaccctggggtttccgactcgtgggcggcaaggactttgagcaacctctcgccatttcccgggtcactcccgggagcaaggctgctatagctaacttatgcataggagatttgatcacagccattgatggggaagataccagcagtatgacacacttggaagctcagaacaaaatcaagggctgcgtagacaacatgacgctcacagtatccaggtctgagcagaagatttggtctcctctagtgaccgaggaggggaaacgtcacccctacaagatgaatttagcgtcggaaccccaagaagtcctgcacatcggaagtgcccacaaccgtagtgctatgccatttaccgcctcacctgctcctggcacccgggtcatcacaaaccagtacaacagccctaccggcctctactcatctgaaaacatctctaacttcaacaatgcagtggagtcaaagacctcagccagtggggaggaggcgaacagcaggccctcggctcagcctcatccctccggcggccttatcatcgacaaggaatccgaagtttacaagatgcttcaggagaagcaagagttaaacgagccccccaaacagtccacatcattcctggttctgcaggagatcctggagtcggatgggaaaggggaccccaacaagccatcaggatttagaagtgttaaagctccagtcaccaaagtggctgcatctgttggaaatgctcagaagctgcccatctgtgacaaatgtggaaccggcattgttggtgtgtttgtgaagctgagggaccatcatccccaccctgaatgttatgtgtgcaccgactgtggcatcaacctgaaacagaagggccatttctttgtaggggatcagatttattgtgaaaagcatgcccgggagagggtcacaccacctgagggctatgatgtggtcacagtgttccccaagtgatcgagaggacctgccctgtctgctgccctccagcctgcctgctgcacctggttgtcagaatgttctggttctctcctccctgacagtcctgtgcttagtgttagtcctgctcagtaaacattgagtttctcctgtactgactgaccctgactggcagtgtgacacctgcttttacattaccgggaggtggttttgtccctgtcccctcacccacaccacaatgcaccttcttcccttggagtcttccctgctgaaaatggacattggtcacattggaattaagccaaatgttttatctctgatgttactttgttttacttaataaatttagactttaaagcc

SEQ ID NO: 1707 - DNA, 1004 bp, Rattus norvegicus
  Genbank Accession No. NM_019131
cttagccgcagggggcgccggcgttgcaaagcgggcctgggcgggacgaaccggacctggctccgtaactgcaggagcccagcagtagcagctgcagagcgcggaggcagagcacagcctcagccgccgcctcgccatggcgggtagcagctcgctggaggcggtgcggagaaagatccggagcctgcaggaacaggcagatgccgcggaggagcgtgcgggcagcctgcagcgagagctggaccaggagcggaagctgcgggaaaccgctgaagctgacgtagcatctctgaacagacgcatccagctggttgaggaggagttggatcgcgctcaggagcgtctggccacagctctacagaagctggaggaggctgagaaggctgcagatgagagtgagagaggcatgaaagtcattgaaagccgagcccaaaaagatgaagaaaagatggagattcaggagatccagctgaaagaggccaagcacattgctgaagatgctgaccgaaagtatgaagaggtggcccgtaagctggtcatcatcgagagcgatctggagcgtgcggaggagagggctgagctctcggaaggcaaatgtgccgagcttgaagaagagttgaaaacggtgacgaacaacttgaagtcactggaggctcaggctgagaagtactctcagaaagaagacaagtatgaagaggagatcaaggttctctctgacaagctgaaggaggctgagacccgggctgagtttgcagagagatcagtaaccaaattggagaaaagcattgatgacttagaagataagtttctttgcttctctcctcccaagactccttcatcaagccggatgtcccacctctctgagctctgcatctgtctgctctccagctgacccaggtttctttctagtgcccacccaccctagggccaggcacagaccgtgctttctattgtacagaggtgatcctcccagtgtaaaataaacactgtacgctagtcctgtt

SEQ ID NO: 1708 - DNA, 4595 bp, Rattus norvegicus
  Genbank Accession No. NM_019134
cagaaggcggctgaatgggaggcagctttgggaatcattctgaagattacatgggagaccacatatcaacattacagcaggaatccagctatcgggtcgtctagatccaaaaccaagtgctcggtattgtaaccctacgattctctattttgaagcagaagtaggttaaaacaccaaccactgtaaaataggtagttcaaagtagattttggaagatgtcagtcaacatcccttccaactcagtgcccagtggtgccagtcgtttccaagtccatgttataaatgagggccatggcagtggtgcagccatgagtgacagcacggaccccccacattatgaagagacctctttcggggatgaagcccaaaacagactgaaaatcagctttaggcctgggaatcaggagtgctatgaaaattttctccaaactggagagactgctaaaacagacaccacgtttcacgcctatgactctcacacaaacacatattacctacaaacctttggccacaacaccatggacgccgtccccaagattgagtactaccgcaacaccggcagtgtgagcgggcccaaggtcaaccggccgagcctgcaggagatccacgagcagctagctaagaatgtggctgtggcccctggttcagctgacagggttgctaatggagatgggatgcctggagatgagcaagcagaaaacaaggaagaagacgtgactggtgttgtgaagtttggatgggtgaaaggtgtgctggtgaggtgcatgctgaacatctggggagtcatgctcttcattcgcctctcctggattgtaggagaagcgggaattggtctgggagtcatcatcattggcctgagcgtggtagtgacaacactcacaggtatctctatgtctgctatttgcacaaacggagtggtgagaggaggtggagcctactacctgatttcccggagcttagggcctgagttcggtgggtcaataggcttgatttttcgtttcgccaatgcagtgcgtgtcgctatgtatgtggtggggttcgcggagactgtggtagaccttcttaaggagagtgattcaatgatggtggatccaaccaatgacatccgaataatcggttccatcacggtggtgattcttctagggatctcagtagctgggatggagtgggaagctaaggctcaagtgattctcctggtcattctactcattggtatcgcaaacttcttcattggaactgtcatcccatccaacaacgagaagaaatccagaggcttcttcaactaccaagcatctatatttgcggaaaactttgggccaagcttcacagagggagaaggcttcttctcggtctttgctatctttttcccagctgctactgggattcttgctggtgccaacatctctggagacctggaggatccccaggacgccatccccagagggaccatgctggccattttcatcaccaccgtcgcctacataggtgttgctatttgcgtacgtgcctgtgtggtccgagacgccactgggagcatgaacgacactgtcgtttctgggatgaattgcaatgggtccgcagcctgcggactgggctacgacttctcaagatgtcagcatgagccatgccagtatgggttgatgaacaattttcaggtcatgagcatggtgtccgggttcggccccctcatcaccgcagggattttttcggcaacactgtcttcggccctagcctccctcgtcagtgcacccaaagtattccaggctctgtgcaaggacaacatcttcaaaggacttcagttcttcgcaaagggctatgggaaaaacaacgagcccctgagagggtacttcctcacttttgtgatagccatggcattcattctcatcgccgagctgaacgtcattgcacctatcatatccaacttcttcctggcctcatatgcgcttattaatttctcctgcttccatgcctcgtatgccaaatcgccaggatggaggccggcatatgggatttacaacatgtgggtatctctcttcggagccattttgtgctgtgcagtcatgtttgtcatcaactggtgggcggctgtcatcacctatgtcattgagctcttcctctatatctatgtgacttataagaagccagatgtgaactggggctcctccacacaggctctgtcctacgtgagcgctttagacaatgctctggaattaaccacagtggaagaccatgtgaaaaacttcagaccccagtgcattgtcttaacaggaggacccatgacaagacctgctctcctggacataacccatgcctttacgaagaatagtggcctctgtatctgctgcgaagtcttcgtgggacctcgcaagctgtgtgttaaagagatgaacagtggcatggctaaaaagcaggcctggctgatgaagaacaaaatcaaggctttttatgctgcggtggcggcagactgcttcagggacggtgtgcggagtctccttcaggcctcaggcctggggagaatgaagccaaacactctagtgattggatacaaaaagaactggaggaaagctcccttgtctgagcttgagaattacgtgggaatcatacatgacgcctttgactttgagattggtgtagtcatagtcagaatcagccaagggtttgacatctctccagttctccaggtacaagatgaactggagaaactggaacaggagagactggctctggaggccgcaatcaaagacaacgactgtgaggagggcaaggggggcatccgaggcttgtttaagaaggccggcaaactgaacattaccaagccggcccctaaaaaagacagcaacatcagcaccatccagtcgatgcacgtcggggagttcaatcagaagctggtagaagccagcgctcagtttaaaaagaaacagggaaaaggcacgatcgatgtttggtggttatttgatgatggagggttgacactgcttatcccatatatcttgactctcagaaagaaatggaaagactgtaagttaagaatctatgttggaggaaaaatcaaccgcattgaagaggaaaaaatttcaatggcttctcttctcagcaaatttaggataaaatttgcagacattcatataattggagacatcaacattaagccaaacaaagagagctggaaagtctttgaagagatgattgaaccttataggctccacgaaagccacaaagatttgaccactgctgagaaattaaaaagagaaagtccatggaaaattacagatgcagaactggaagcagtcaaggaaaagagttaccgccaagttcgactgaacgagctgttacaggagcattccagagccgccaacctcatcgtattgagccttccagtggcgagaaaaggatctatttcggatttgttgtacatggcgtggttagaaatcctgaccaagaacctccctcctgtgctactggttagaggaaatcacaagaatgtcctgacattttactcttaaagcgcgagggatgagaaatgttgtaccttggtgtccgaataattacaaaacgtgtctggtactttgtgttttaaaacctcatctatgaatatacaaacctctggagactatcccacctgattctacataaatttcatcttttttaaaaaagttattattaatgagagttttttcccaccagttttaaaaacatcgaaaacatttttcccttgtcgctggtgaataagaaattaataagagctggctgacatgcttgcaggatgtgctaatgtagatgagctccaggcaaacgcaatctcttgtttccgtggattcttctgcatggccccgtgcaggccacaggcccatagcgggctctctttaagttgttattgacagactggtgtggtgaaagcaggcggctatcatagggaaagacacactgggtcagtggcctgattctgcttggcctcctgagaagtttgtggagatttaaaaatcaatatccggaaactgtaagaaggactagagtctacaaagtgttcaaagcagttacctaaattaaggtttatttaatgcagccgataataagcttaacctctgatcacacgtagcttcgattcgctgctagccagaggtacactaggtaggtgagcaaagacacatgttccacttagacgaaatagagtcccaacatacaaatatcaattgtcttcctggttaaatgttttgaaatttctaccttaatactactttatcttttttctctgattaagtggtttgcatagacgaaataaaaatagacgatctcattgaaaaataatctcacaggtttccaatccactactaaaaatatatccagatcctacatttatttacttctctatatacaggtatatgggttttatagaataacaaggatataagtggagaacttgtaaaaatttttaaaaaccacaggtgttgatttttcttcttgttcgtgtgtgtataatatttaatcacagaaaaaatgcttatatgataaatggcttggttttggttttgttggcatattttgactgttctggggaagcttgtggggggcaaatcaacctgaaataaaattctact

SEQ ID NO: 1709 - DNA, 879 bp, Rattus norvegicus
  Genbank Accession No. NM_019166
cggcgcgcggtgcagccacgatggaagggggtgcgtacggagcgggcaaagccgggggcgccttcgacccctacaccctggtgcgacagccacataccatcctgcgcgtcgtgtcttgggtcttctccattgtggtcttcggctccattgtgaatgagggctacctgaacaacccggaggaggaggaggagttctgcatctacaaccgcaaccccaatgcctgcagctacggcgtgaccgtgggcgtgttggccttcctcacctgcctggtctacctggcgcttgatgtgtacttcccgcagatcagcagtgtcaaggaccgcaagaaagccgtgctgtctgacatcggtgtctcggccttctgggccttcttctggttcgtgggtttctgcttcctggccaaccagtggcaagtctccaagcccaaggacaaccctctgaacgaagggacagacgcagcccgggctgccatcgccttttcgttcttctccattttcacgtgggcgggtcaggccgtgctagccttccagcggtatcagattggcgccgactcggccctcttctcccaggactacatggatcccagccaggactccagcatgccttatgcaccctacgtggagcccagtgctgggtcggaccctactggcatgggtggcacctaccagcatccagccaacgccttcgatgctgagccccagggctaccagtcgcagggctactgagccccccctgatggtggtgacagtgaccgcctaccctgcccctgcccttacatcctagctcccctcccaagcaccctgctccctcccaggtgaccctgcctcgcacatgctcagcctccaagtgattccactgaggcccagtgcagctggggtg

SEQ ID NO: 1710 - DNA, 1018 bp, Rattus norvegicus
  Genbank Accession No. NM_019169
gtgtggagcaaagatacatctttagccatggatgtgttcatgaaaggactttcaaaggccaaggagggagttgtggctgctgctgagaaaaccaagcagggtgtggcagaggcagctgggaagacaaaagagggcgtcctctatgtaggttccaaaactaaggagggagtcgttcatggagtgacaacagtggctgagaagaccaaagagcaagtgacaaatgttggaggggcagtggtgactggtgtgacagcagtcgctcagaagacagtggagggagctgggaacattgctgctgccactggttttgtcaagaaggaccagatgggcaagggtgaagaagggtacccacaagagggaatcctggaagacatgcctgtggaccctagcagtgaggcttatgaaatgccttcagaggaaggctaccaagactatgagcctgaagcctaagaatgtcgttgcacctactgtcctaagatctgcccaggtgttcttccatggcgtacaagtgctcagttccaacgtgcccagtcatgaccttttctcaaagctgtacagtgtatttcaaagtcttccatcagcagtgatcggagtcctgtacctgcccctcagcatcccggtgctcccctctcactacagtgaatacatggtagcaggctcttgtgtgctgtggatattgttgtggcttcaaacctaaaatgttagaagaaacttaaaacacctaagtgactaccacttatttccaactcttcaccgtttttggttgctgttctcaagaagttgtgatttgctataagacttttagatgtccttaatgattctttctgtctaagaagaatgatgtgctgtgaaatttgttaatatatattttaaaatatgtgagcatgagactacgcacctataaatattaatttatgaattttacagttttgtgacgtgttttattaacttgtgtttgtatataaatggtggaaattaaaataaaataaaaacattatctcattgcaaaaaaaaaaaa

SEQ ID NO: 1711 - DNA, 1018 bp, Rattus norvegicus
  Genbank Accession No. NM_019170
cagctgcagagtttaccccaggttctttggtctccgacggcctttctacgcacacgcagccatgtcttccgacagacccgtggcactggtgactggtgctaacaaaggaatcggattcgcgatcgtacgtgatctctgtcgtaaattcttgggggacgtggtcctcacggcgcgggacgagtcacggggccacgaggcggtgaagcagctgcagaccgagggcctgagcccacgcttccaccagctggacatcgacaacccgcagagcatccgcgcgctgcgtgactttctgcttcaggagtacggaggactgaacgtgctggtcaacaatgcgggcatcgccttcaaagttgttgaccccacccccttccacattcaagcagaggtgacaatgaaaaccaacttttttggtacccaagatgtctgcaaggagctactccctataataaaaccccaaggcagagtggtgaatgtatcaagcagcgtgagtctcagggccctgaaaagctgcagcccggagctgcagcagaagtttcgaagtgagaccatcactgaggaagagctggtggggctcatgaacaagtttatagaggatgcaaagaaaggagtccatgcgaaagaaggctggcccaatagtgcatatggggtcaccaagataggggtgacagtcctgtccagaatctatgccaggaaactcaatgaggagaggagagaggacaagatcctcctgaatgcctgctgccctgggtgggtcagaaccgacatggcaggaccaaaagccaccaaaagcccagaagaaggagcagagacccccgtgtacttggcccttttgcctccaggtgcagaggggcctcacgggcagtttgttcaagataaaaaagttgaaccatggtgaatccaactctcacccccaccccttctatcctgacttggtgaaagccaagggacatttataatataccatcacttctggaaaaataaacataactaagtctttaagcacacaacaggtgtttgc

SEQ ID NO: 1712 - DNA, 1205 bp, Rattus norvegicus
  Genbank Accession No. NM_019174
ggcttcgttggtgctggaccccaggctgggcagcgtctatgccctcaagcaccatgcagctccttcttgctctactggcgctggcttacgtggccccctctactgaagattcacactggtgctatgagattcaagccaaggagcccaacagccattgctcagggcctgaacaatggactggagactgtaagaagaaccagcagtctcctatcaatattgtcactagtaagacaaagttgaaccccagtctgacacccttcactttcgttggctatgaccaaaagaagaagtgggaagttaagaacaaccaacactcagtggaaatgtcgctgggggaggacatctatatttttggaggagatctgcccacccagtacaaggccatacagttacacctgcactggtcagaggagtcgaacaagggttcagagcacagtattgatgggaaacattttgccatggagatgcatgtcgtgcataagaagatgacaacaggcgataaggtgcaggactcggactccaaggacaagattgcggtgctggcattcatggttgaggtgggaaacgaggtaaacgagggcttccagcccctggtggaggcactgtccaggctctccaaaccctttacaaactccacagtgagtgagagctgcctgcaggatatgcttcctgaaaagaagaaactgtctgcctacttccgttaccagggctcactgactacaccaggctgtgatgagactgtcatctggactgtgttcgaggaacctattaagatccataaagaccagttcctggaattctcaaaaaagctctactatgaccaagaacagaagttgaacatgaaggacaatgtgaggcccctgcagccactgggaaaccgccaggtgttcaggtctcatgcctcaggacgactgctgtctttgcccctgcccactctattggtccccacactcacctgcctggtggccagcttcctccactgatggtcaaattctggatatctggcctctgacctcaacctttagaggatatggcttctctttctcaatctttccaggttgaactttggggactattaaggtgtgctgtggtggtgcacacctttaatcccagccctggatggagagagcagagacctatggatctctgaccttcccctaacccctgattaaattaaataaaatatggatatgtttttactctta

SEQ ID NO: 1713 - DNA, 1067 bp, Rattus norvegicus
  Genbank Accession No. NM_019186
acggaggaccgtcagccagcaatcgcgtagctcgatcgatcacccaggaagagaaattgtaagcagataagaagaacgcgttcggtttgggacaccatttgcagctggaaatggggaatggactgtcagaccagacttccatcctatccagcctgccgtcctttcagtcctttcacattgttattctgggtttggactgtgctggaaagacaacagttttatacaggctgcagttcaacgaatttgtaaatactgtacctaccaaaggatttaacactgagaaaattaaggtaaccttgggcaattccaaaacagtcacttttcacttctgggatgtaggtggtcaagagaaattaagaccactgtggaagtcatatacccgatgcacagatggcattgtgtttgtggtggactctgttgatgttgagagaatggaagaagccaaaactgaacttcataaaataactaggatatcagaaaatcagggagtccctgtgcttattgttgctaacaaacaagacctgaggaactcactctctctctcagagatcgagaagttgttagcaatgggtgaactgagctcatcgactccttggcatttacagcccacctgtgcaatcataggagatgggctaaaggaaggacttgagaaactacatgatatgataattaaaagaagaaaaatgttgcggcaacagaaaaagaagagatgaatggcagtacttttatatcggtgtggaataggttttacttggtctgatttctgacaagctgaagagtgtctacagcctggtttgcctgtctgccctcacggatgctattaaagctttgttttgttgaacagtcagatacccaactctgttgccttgtggaagatgagtaaatgcaatgcttcttaaaggggtctcttctccgtgacccacaaatcttttggtactaccattttgggaagccaaaaaaggctagtaattgaccagaaaacaattttgtggaaatttgacctgaagttagtgaaataaaactttgaagagtgtaaaaaaaaaaaaaaaaaaaaaaaaaaaaaaaaa

SEQ ID NO: 1714 - DNA, 1053 bp, Rattus norvegicus
  Genbank Accession No. NM_019195
gcggcgaccccccggcggcgcggagatgtggcccttggcggcggcgctgttgctgggctcctgctgctgcggttcagctcaactcctgcttagtaaagtcaaatctgtagagttcacgtcatgcaatgacactgtggtcatcccttgcaaagtccttaatgtggaggcccaaagcaccgatgaaatgtttgtgaagtggaagttgaacaaatcgtatattttcatctatgatggaaataaaaatagcactactagagaacaaaactttaccagtgcaaaaatctcggtctcagacttgctcaaaggcattgcctctttgacaatggatacccatgaggctgtggtgggaaactacacctgtgaagtgactgagctttccagagaaggcaaaacagttatagagctgaaaaaccgcccagtttcgtggttttctacaaatgaaaagatcctcattgttattttcccaattttggctatactcctgttctggggaaagtttggtatattaacactcaaatacaagtccagccatacgaataagagaatcattctgctgctggttgccgggctggcactcacactcatcgtggttgttggcgccatccttttcatcccgggagagaagcccgtgaagaacgcttctggtcttggcctcattgtaatctccacaggaatattaatactgcttcagtacaatgtgtttatgacagcttttggaatgacctctttcaccattgccatattgatcactcaagtgctgggctatgtccttgctgtggtcgggatgtgtctctgcatcatggcttgtgaaccagtgcacggcccccttttgatttcaggtttgggaatcatagctctagcagaattacttggactagtttatatgaagtttgtcgcttccaaccagcgaactatacaacctcctaggaataactgaagggaagtgacggactgtaacttgaaagtcagaaatggaagaatacagttgtctgagcaccatggccttcacaactcacagctggaaggaacacacaacagtgactgactttcatc

SEQ ID NO: 1715 - DNA, 1356 bp, Rattus norvegicus
  Genbank Accession No. NM_019220
cccggagctgtcgatcggggacaaagcgcggccgcccgcgccccccgagccgcccgagccggggccagccccccgcgactgacatgatgtttccgcaaagccggcactcgggctcctcccacctcccccagcagctcaagttcaccacctccgactcctgcgaccgcatcaaggatgagttccagctgctacaagcgcagtaccacagcctgaagctggagtgtgacaagctggccagcgagaagtcagagatgcaaaggcattacgtcatgtactatgagatgtcttacggattgaacatcgagatgcacaaacaggctgaaattgtgaagaggctgaatgggatttgcgcccaggttctaccctatttgtcccaggagcatcagcagcaggtcctgggagctatcgagagagccaagcaggtcacggctcccgagctgaactccatcatccgacagcagctccaggctcaccagctgtcccagctccaggcgctggccctgcccctgacaccgctgcctgtcgggctccagccgccatccctccctgcggtcagcgcaggcacaggcctgctgtcactctctgctctgggctctcagacccacctctccaaggaggacaagaacggacacgatggggacacccaccaggaggatgatggagagaagtccgattagctcctggggagagggagggggaggggggataccaggggagacaggcacagagagcacagtgttctgagggccacactgcacacagctcggtccctacccaagcttccacctccagtcctggttccagctgtgcaccctgggcctaggagacgccagagggacagcccaggctacagggaaaattccccaccttcaacatttccccgggctacagccaccaatctcggcccagaatgtacacaacgctagccgcccctttccaccctgtgcaccccgaatttgccccctttccccttctctgcttcctgcactgcacacctgctaggcccagacccctccccccagctcacccagctctggttccctcaaccgcggaaagaaagcattggctcgggactgcagtgggggtgggcaccccacaaacttccctctccccttccccaaataaacgtgagggttaaaagtcggtttgtttattatttctttttcgtcccagtactctatagctaccatctaagagagaaaaagaaggaagccctggagcgagcgagggtctgtctgtgcatatagttagatttttctggtcgcctcgctttgcaccgagaggtggagggccgctgtactgagggtggggtctagctgtgccttcaaaataaaaacatgaaaaggtcaaaaaaaa

SEQ ID NO: 1716 - DNA, 3726 bp, Rattus norvegicus
  Genbank Accession No. NM_019229
atgcctcacttcaccgtggtgccggtggacgggccgcgacgcggcgactatgacaacctcgaggggctcagttgggtggactacggggagcgcgccgagcgggaagactcggatggacagggtaaccacagagagaatagtcccttccttagccctttggacgcctccagaggaaatgactactatgaccggaacctggcactgtttgaggaggagctggacatccgcccaaaggtatcatctctcctgggcaagcttgtcagctataccaacctcacccaaggagccaaggagcacgaggaagctgagagtggagaaggtggccgtcggagagccgccaaggcacccagcatgggcacccttatgggagtgtacctgccctgcctgcagaatatcttcggggtcatcctcttcctgcggctgacctggatggtgggcacagctggcgtgctgcaggctctcctcattgtcctcatctgttgctgctgtaccctgctgacagccatctccatgagtgccatcgccaccaatggtgtggttccagctggtggctcttacttcatgatttcccgctctttgggaccagaattcggaggtgctgtgggcctatgcttctacctggggaccacatttgcagcagccatgtatatcctaggagccattgagatcttgctgacctacattgctccaccagctgccatcttttacccatcgggcacacacgacatgtcaagcgccaccttgaataacatgcgggtgtacggaaccattttcctgactttcatgaccctagtggtgtttgtcggtgtcaagtatgtgaacaagttcgcctcactcttcctggcctgtgtgatcatctccatcctctccatttacgtgggaggcatcaagtccgcttttgaccctcctgtttttccggtgtgcatgctgggcaataggactctgtctcgggaccagtttgacatctgtgccaagacagttgtggtggacaatgagacagtggccacccggctgtggactttcttctgccacagccccaaccttactgctgactcctgtgacccctacttcctgctcaacaatgtgacagagattcctggcatacctggggcagctgctggtgtgctccaggaaaacctgtggagtgcttacctggagaagggtgaggttgtggagaagcatgggctgccctccacagatacccttggcctgaaggagagcctgtccctgtatgtggtggccgacatcgccacatccttcaccgtgctggttggcatctttttcccttctgtaacaggcatcatggctggctcaaaccgttccggggacctccgtgatgctcagaagtctatccctgtggggaccattctggctattgtcaccacttcactcgtgtacttcagcagtgtgattctcttcggtgcctgcatcgagggtgtggtgctccgggacaagtacggtgatggcgtcagcaggaacctggtggtaggcaccttggcctggccttcaccttgggtcatcgtggtcggctccttcttctcaacatgtggtgccggcctccaaagtctcactggggcgccacgtttactgcaagccattgccaaggataacatcatccccttcctccgggtgtttggccacgggaaagccaatggtgagccaacgtgggccctcctcctgacagcgctcatcgctgagctgggcatcctcatcgcctcccttgacatggtggcccccattctttccatgttctttctgatgtgttacctctttgtaaacttggcctgtgctgtgcagacacttctgaggacccccaactggcggccccggttcaagtactatcactgggcgttgtctttcctgggcatgagtctgtgcctggctctcatgtttgtctcctcctggtactacgccctagtggccatggtcatcgcaggcatgatctacaagtacatcgagtaccaaggggctgagaaggagtggggtgatgggatccgaggcctgtccctgagtgccgcacgatatgcactgctgagactagaggaagggcctcctcacacgaagaactggcggcctcagctcctggtgctgctgaagttagacgaagatcttcatgtgaagtaccctcggctcctcacctttgcctcccaacttaaggctgggaaaggcctgacaatcgttggctctgtcatccagggcagctttctggagagctatggggaagcccaggctgctgagcagacaatcaagaacatgatggagattgagaaagtaaaaggcttctgccaggtagtggtggccagcaaggttcgagaggggctggcccacctcatccagtcttgcggcctgggtggcatgagacataactccgtggtgctgggctggccctatggctggcgacagagtgaggacccacgtgcctggaagacctttatcgacactgtgcgctgcaccacagctgcccacctggccctgctggtgccaaagaacatagctttctaccccagcaaccacgagcgctacctggagggccacattgatgtgtggtggatcgtgcatgacggaggcatgctgatgctgctgcccttcctgctgcgccagcataaggtttggaagaagtgccggatgcgcattttcaccgtggcccagatggacgacaacagcatccagatgaagaaggatctggccatcttcctgtatcacctccgcctggaagctgaagtggaggtggtagagatgcacaacagtgacatctcggcctacacctacgagcggacactgatgatggagcagcggtctcaaatgctgcgacagatgaggctgaccaaaacagagcgggatcgagaggcccagctggtgaaggacaggcactcggctctgaggctagagagcctctactccgacgaggaggatgagtctgtgacaggcgctgacaagatccagatgacatggaccagagacaagtacatggctgaaccctgggaccccagccatgcccctgacaacttccgggagctggtgcacattaagccggaccagtccaatgtgcggcgtatgcacactgctgtgaagctcaatgaagtcattgtcacacgctcccatgatgcccgcctggtcctactgaacatgcccggcccccctaagaacagtgagggtgatgagaactacatggaattccttgaagtcctaaccgagggccttgaacgggtgttgttggtgcgtggtggtggccgggaagtcatcaccatctattcttgagcccgatggagtcttgtggcctggagttgggttgtctaagacaacagtgcccagccttgcacctacttgccagttctgccttgcccagccttgctttggactagctttgctaggtctccagggaaaccaagcttgggccttgcaatgggaatggatccgagggcccacgggacctggaggatttagggactttcccctcccatactccaagggaggcctctcctgactcgagatgactggtgagggctgatgtgggatttgaagtcccagactggctcacaagtgctatttattgtatatttattgtgtggatgtcatcatttcagaaaggggggagacaataaaagggggagccgagctgggcctgtctgcaggaagatctggctcaggctgctgtgggcagcatcaagccaagtggaatggagctggccaagctgagcctgacttttttcaataaaacctcgtgcc

SEQ ID NO: 1717 - DNA, 816 bp, Rattus norvegicus
  Genbank Accession No. NM_019233
agcagggcactgggtacccagcactgagcagatcaattcctggagctgagaatggcctgcaagcatctgcccttcctggctttggcgggggtactgctggcttacctctgcagccagtcagaagcagcaagcaactttgactgctgcctcacgtacacaaagaacgtgtatcatcatgcgagaaattttgtgggtttcacaacacagatggccgacgaagcttgtgacattaatgctatcatctttcacctgaagtcgaaaagatccgtgtgcgctgacccaaagcagatctgggtgaaaaggattttgcacctcctcagcctaagaaccaagaagatgtaaaaacggatgcttttctgggatggaattggacacagcccaaggaggaaatgatcacagctggggttggaggtttcacctgcacatcactgcacagacctgatttgtgtcccagtggtcttgtccaatggatgaagttgattcatattgcatcatagtgtgtcatatttaagctcatattagagttaagttgtatttggtgttatttatagatccgaattttctatgtttagctatttaatgttaatttcccacaatctatgaagggcgcttagtaaaaggttcaatattatgtttaaggcagtaagtttatatggcccttcttggaaacaataagctattgtaaaaatatttaatgttttctgtgtgcttaattgtttcttaaattgatacgatttacttataaaacagaaaggaattataagaatatattgaaaaaaaaaaaaatgaaaggcaaaaaaaaaaaaaaaaaaaaaa

SEQ ID NO: 1718 - DNA, 1547 bp, Rattus norvegicus
  Genbank Accession No. NM_019237
ctgctgctgctgctgctgctgctgttgctgctgctgctgtttccagcactccccctacacaatgctgcctgctgccctaacctccctgctggggccattccttctagcctgggtgctgcctcttgcccgaggccagacccccaactacacgagaccagtgttcctgtgtggaggggatgtgaccggggagtcgggttacgtggcaagtgagggtttccccaacctctaccccccaaacaagaagtgcatctggacaataacggtgcctgagggccagactgtgtccctgtccttccgagtctttgatatggaactccacccttcctgccgctatgatgctctggaggtctttgctggatccgggacctcaggccagcgacttggacgcttctgtggcaccttcaggcctgcgcctgtagttgcacctggcaaccaagtgactttaaggatgacaactgacgagggcactgggggacgaggattcctgctctggtacagcggtcgggccacctcaggcactgagcaccagttttgcggggggcggatggagaaggcgcagggaaccctgaccacgcccaactggcctgagtcggattaccccccaggcatcagctgttcctggcacatcattgcaccctcaaaccaggtgatcatgctaaccttcgggaagtttgatgtggagcctgacacatactgccgatatgactctgtcagtgtgttcaatggagctgtgagtgacgactcaaagaggctggggaaattttgcggagacaaggcccctagccccatctcttccgaagggaatgagctcctggtccagtttgtatcagatctcagtgtcactgccgatggcttctcagcctcctacaggaccctgccacgggatgccgtggaaaaggagtcagccccaagtccaggggaggatgcacagcatggtccccagtcccgctctgaccctaagacaggaactgggcccaaagtcaaaccacccagtaagcctaaagtccagcctgtagagaaacctgagggctctcctgctacccaggcaactccagttgctccagatgcccccagcatcacttgcccaaagcagtacaagcggtcaggcaccttgcagagcaacttttgctccagtagcctggtggtgacaggaacagtgaaggccatggtccggggcccaggggagggcctcactgtcaccgtcagtctcctgggtgtctacaaaaccggagacctggacctgccctctccagctagtggcacctctctgaagttctatgtgccctgcaagcagatgccccccatgaagaaaggagccagttacctgctgatgggtcaggtggaagagaacagaggccccatccttcctccggagagcttcgtggtgctctacaggcccaaccaggaccagatcctgagtaacctaagcaagagaaagtgcccctcccagcctaggccagatgcctgatgtcctcgccagatcagagtgtggtgcttttatccaaataaatgtttcttgactcaggaaggaaaaaaaaaaaaaaaaa

SEQ ID NO: 1719 - DNA, 1736 bp, Rattus norvegicus
  Genbank Accession No. NM_019242
tctcacccgcgccgctcctcgcctctcttgttagccggagactcgcctctcagccgcccgccgcacagacgcacgagtatacagtgcagctccatcggctgatccttgctgagctccaagtgtaggcggcaccgggcggcccacgatgccgaagaacaagaagcggaacgctccccaccgcggtggcgggggtggcggcggctccggggcagcgacgtcggcggccacgacaggtggcccgcatcggactgttcaacctttcagtgatgaagacgcatccattgaaacaatgagccactgcagtggctatagcgatccttccagtttcgcggaggatggaccagaagttcttgatgaggaaggaactcaggaagacttagagtacaagttgaagggattaattgacctaacccttgataagagtgcgaagacaagacaggcagctcttgaaggtgttaaaaatgcgctgtcttcaaaagtgctgtatgagtttgttctcgagagaagaatgactttaactgatagcattgagcgctgtctgaaaaaaggaaagagtgatgggcagcgcgcagctgcagcgctcgcgtccgttctttgtattcagttgggccctggattggaaagtgaagagattttaaagactcttggaccaatcctaaaaaaaataatttgtgatggaacagcgagtatccaggctaggcagacttgtgcaacttgctttggtgtttgctgttttattgccacagatgacatcactgagctgtattcaactctggagtgcttggaaggtatcttcaccaagtcctaccttaaagagaaagacacgaacgttccttgcagcactcctaatacagtgcttcacatcagctcgcttctcgcatggacgctactgctgaccatatgcccaatcagtgaagtgaagaaaaagctggagctgcatttccataaacttccaagcctcctttcttgtgatgatgtaaacatgagaattgctgctggcgaatctttggcacttctgtttgaattggccagaggaatggagagtgactttttttatgaagatatggattctttgacccagatgctccgggctctggctacagatggaaataaacaccgtgccaaagtggacaagagaaagcagcgctctgtcttcagagacgtcctgagggctgtggaggaacgggattttccaacagaaactgttaaattcggtcctgagcgcatgtatattgatagctgggtcaaaaagcacacctatgacacgtttaaagaggctcttggatcagggatgcagtaccacttgcagacaaatgaattccttcgcaatgtatttgagctggggccccctgtgatgctcgatgctgcaacacttaaaaccatgaagattcctcgttttgaaaggcatttatataactctgcagctttcaaagctcgaacaaaagcccgaagcaaatgccgagataagagagcagatgttggagaattcttctagatgtctgtctttgatgtctgttttctaatttcttcctttattattatttttgctacttctaatgtacataagcttttagagacttttttatcttggtcaacttagataatttttgatgtagggatgggttatattttaatttaatgtacagtgttacaaattaatgagttctttattctgtaaaaataactgataaccacaaataaaagtgtttgtgatgcttggtcaaaaaaaaaaaaaa

SEQ ID NO: 1720 - DNA, 1253 bp, Rattus norvegicus
  Genbank Accession No. NM_019247
gaattcgggcccccagccaccaccgggagtctgcctgctgcgggacacactagccctccctccatggagtttgggctgcttggtgaggcagaggctcgaagccctgcgctgtcattgtcagatgcaggcactccacaccctccgcttccagaacatggctgcaaggggcaggagcacagtgactcggagaaggcctcggcctcactgccggggggctcccctgaggatggctccctgaagaagaagcagcggcggcagcgcacgcacttcaccagccagcagctgcaggagctggaggccaccttccagaggaatcgctaccccgacatgagcacgcgcgaagagatcgccgtgtggaccaacctcactgaggcccgcgtgcgggtgtggttcaagaaccggcgcgccaagtggcggaagcgggagcgcagccagcaggcggagctgtgcaagggcggcttcgcagccccgctcgggggcctggtgccaccctacgaggaggtgtacccgggctacacgtacggcaactggccgcccaaggcgctcgccccgccgctcgccgccaagaccttcccgttcgccttcaactcggtcaacgtggggcctctagcttcacaacctgtattctcaccgcccagctccatcgctgcctccatggtgccctcggcggccgctgccccgggcaccgtcccaggtcccggagccttgcagggcctgggcggggcaccccccgggctggctccagccgccgtgtcctccggggcagtgtcctgcccttacgcctcggccgccgcagccgccgctgcagccgcctcctccccttatgtataccgggacccgtgtaactcgagcctggctagcctgcggctcaaagccaagcagcacgcctctttcagctaccccgccgtgcccgggccgccgccggccgctaaccttagtccctgccagtacgccgtggaacggccagtgtgaaccgcaggtctgtggatccatccccgagggcggggcagtaattcacagcctctctggacaggggtcgcctagactggcttgcccttcgtcccagggtctgaaaaggggtgccagagcacccgggaagaggcggctccgaagagggccttttccctcacagcccctgaggggtggtctgacccctatacggagaccgcggccctgggactaaggccaggaacagggaccagctcccccggggccaattcacccttggctcaccccgccttctccccgaattc

SEQ ID NO: 1721 - DNA, 1124 bp, Rattus norvegicus
  Genbank Accession No. NM_019259
cggcacgagccggtcgtccttccctttgcacgtgtccaccccgcgatgctccctctgctgcgctgcgtgccccgcgccctgggtgccgccgccacgggcctccgagcctccatcccggccccgccgcttcggcatttactgcagcccgcgccccggccatgcctccggcccttcggtttgctcagcgtacgagccggctccgctcggcgctctggcctcctgcagcccccaggttcctgcgcgtgcgctgcggctctgcacacggaaggagacaaggcctttgttgaatttttgactgatgaaattaaggaagaaaagaagatccagaagcataagtcccttcccaaaatgtctggagatggggagctggaagtgaacggcacggaggctaaattattgcgcaaagttgccggagaaaagatcactgtcactttcaacattaacaatagcatccctccaacctttgatggtgaagaggagccctcacaggggcagaaggccgaagagcaggagccagaactgacatcaactcccaattttgtggtggaagtgacaaagactgatggcaagaagacccttgtactggactgccactatcctgaggacgagatcggacaccaagatgaggccgagagtgacattttctctattaaggaagtgagctttcagaccactggtgactctgagtggagggatacaaactacacactcaacacagactccctggactgggccttgtatgaccacctaatggatttccttgcggaccgaggggtggataacacttttgcagatgagttggtggagctcagcacagccctggagcaccaggaatatatcacctttcttgaggacctcaaaagctttgtcaagagtcagtagaactgtgagactgagggctctaatataaacggccagctctcctgggcgagcaaaagctgccttgacctcacaactatgctttgccctggctgtcatcctaatatatgggggaaagcaagtttaaattatcgccgttacacctccatttacgattcctttgggctcttttcctgtacacatctattatttgtagatttttgtagtacatgatgatgaacaataaactgacttcctcgtgccga

SEQ ID NO: 1722 - DNA, 1136 bp, Rattus norvegicus
  Genbank Accession No. NM_019262
gggcttcttggacgtttttgggaggggacagcaagggaaggtccttctgcctctagggacccagacttccgctttctgcagacagcagcaggctctgggctctgggaatccactgctgtctggcctagaagcatcatagaacacgaggattccatacacaggaggcccctgaagctgagctgagctgatgaagacacagtggagtgagatcttgacacccctgttgctgctgctcctgggtttgctccatgtctcctgggcccaaagcagctgtactgggtcccctggcatccctggggtccctggcatccctggggtccctggctctgatggcaaaccaggcactccagggataaaaggagagaaagggctccccggactggctggagaccatggtgagttaggagagaaaggggatgcagggatccctgggatcccaggcaaagttggccccaagggtcccgtcggccctaagggtgctccaggcccccctggaccccgcggtcccaaaggtggctctggagactacaaggctacccagaaagtagccttctctgccctgaggacggtcaacagcgccctgcgaccaaaccaggccattcgcttcgaaaaggtgatcaccaatgttaatgataactacgagccgcgcagtggcaagttcacctgcaaggtacctggcctctactacttcacctaccacgccagttcccgcgggaatctgtgtgtgaacatcgtgcgcggccgcgaccgagaccgcatgcagaaagttctcaccttctgcgactatgcccaaaacaccttccaggtcaccacgggtggggtagtcttgaagctggagcaggaagaggttgttcacctgcaggccacagacaagaactccctgctgggcgtcgagggagccaatagcatcttcactggctttctgcttttccctgacatggatgtatgatcacggggtcaaatcactcctatccaaaacctcctccctgccagtaatcctccctggaccccagacactgccctttgactgcccaaagccctgaccagagccctgtagatgttacagaatgggtaaataaactcttcaaggccaagaaaaaaaaaaaaaaaaaaaaaaaaaaaaaaaaaaaaaaccc

SEQ ID NO: 1723 - DNA, 6586 bp, Rattus norvegicus
  Genbank Accession No. NM_019266
  misc_feature (1)..(6586): n = a or c or g or t
ccaagatggcgcccaccgcagtcccgcccgccgcagcctcggcgcctctgcagtccggccgcgcctcccgggccccgcgctagggccgctgccgcctcgcccgccgccgccgccgccagctgacctgtcccggacacataactaacgaagctgctgcaggatgagaagatggcagcgcggctgctcgcaccaccaggccctgatagtttcaagcctttcacccctgagtcgctggcaaacatcgagaggcgtattgccgagagcaagctcaagaaaccaccaaaggcggatggcagccaccgggaggacgatgaagacagcaagcccaagccaaacagtgacctggaggctgggaagagtttgcctttcatctacggggacatcccgcaaggcctggttgcggttcccctggaggactttgacccttactatttgacgcagaaaacctttgtagtattaaacagagggaaaactctcttcagatttagtgccacacctgccttgtacattttaagcccttttaacctgataagaagaatagctattaaaattttgatacactcagttttcagcatgatcatcatgtgcaccatcctgaccaactgtgtgttcatgacctttagtaaccctccagaatggtccaagaatgtggagtacacattcacagggatttacacatttgaatcactagtgaaaatcatcgcaagaggtttctgcatagacggcttcaccttcttgcgagacccgtggaactggttagacttcagtgtcatcatgatggcatatgtgacagagtttgtggacctgggcaatgtctcagcgctgagaacattcagggttctccgagctttgaaaactatctctgtaattccaggcctgaagacaatcgtgggcgccctaatccagtccgtgaagaagctgtcggacgtgatgatcctgacagtgttctgcctgagtgttttcgccctgattggcctgcagctcttcatggggaaccttcgaaacaagtgtgtcgtgtggcccataaacttcaacgagagctacctggagaacggcaccagaggctttgactgggaggaatatatcaacaataaaacaaacttttacatggttcctggcatgctagaacccttgctctgcgggaacagttctgatgctgggcaatgcccagagggattccagtgcatgaaagcaggaaggaaccccaactacggttacaccagctttgacaccttcagctgggccttcttggcattattccgccttatgacccaggactattgggagaacttataccagctgaccttacgagccgctgggaaaacgtacatgatcttctttgtcttggtcatcttcgtgggttctttctatctggtgaacttgatcttggctgtggtggccatggcttatgaggaacagaaccaggcaacactggaggaggcagagcaaaaagaggccgagttcaaggcaatgctggagcaactcaagaagcagcaggaggaggcacaggctgctgcaatggccacctcagcgggcactgtctcggaagacgccattgaagaagaaggggaagatggggtaggctctccgaggagctcttctgaactgtctaaactcagttccaagagcgcgaaggagcggcggaaccgacggaagaagaggaagcagaaggagctctctgaaggcgaggagaaaggggacccggagaaggtgtttaagtcagagtcggaagacggtatgagaaggaaggccttccggctgccagacaacaggatagggaggaagttttccatcatgaatcagtcgctgctcagcattccaggctcgcccttcctctcccgacataacagcaaaagcagcatcttcagcttccggggacccggtcggttccgggaccccggctctgagaatgagttcgcagacgatgaacacagcaccgtggaggagagcgagggccggcgtgactcgctcttcatcccgatccgcgcccgcgagcgccgcagcagctacagtggctacagcggctacagccagtgcagccgctcgtcgcgcatcttccccagcctgcggcgcagcgtgaagcgcaacagcacggtggactgcaacggcgtagtgtcactcatcgggcccggctcacacatcgggcggctcctgcctgaggtgaaaatagataaggcagctacggacagcgcaacgactgaggtggaaattaagaagaaaggccctggatctcttttagtttctatggaccaactcgcctcctacggacggaaggacagaatcaacagcataatgagcgtggtcacaaacacgctagtggaagagctggaagagtctcagagaaagtgcccaccgtgctggtataagtttgccaacactttcctcatctgggagtgtcacccctactggataaaactgaaggagatcgtgaacttaatcgtcatggacccttttgtagacttagccatcaccatctgcatcgttctgaatacgctatttatggcaatggagcaccatcccatgacaccacagttcgaacacgtcttggccgtaggaaatctggtgttcaccgggatcttcacggcggaaatgtttctgaagctcatagccatggacccctactattatttccaagaaggctggaacatttttgacggatttattgtctccctcagtttaatggagctgagtctcgcagatgtggaggggctctcagtgctgcggtctttccgactgctccgagtcttcaagctggccaagtcctggcccaccctgaacatgctgatcaagatcatcgggaactccgtgggtgccctgggcaacctgaccctggtgctggccatcatcgtcttcatcttcgccgtggtggggatgcagctgtttggaaagagttacaaggagtgcgtctgtaagatcaaccaggagtgcaagctcccgcgctggcacatgaacgacttcttccactccttcctcatcgtcttccgagtgctgtgtggggagtggatcgagaccatgtgggactgcatggaggtggccggccaggccatgtgcctcattgtcttcatgatggttatggtcattggcaacctggtggtgctgaatctattcctggccttgcttctgagctccttcagcgcagacaacctggcggccacagacgacgacggggaaatgaacaacctgcagatctcagtgatccggatcaagaagggcgtggcctggaccaaagtgaaggtgcacgccttcatgcaggctcacttcaagcagcgggaggcggatgaagtgaaacccctcgacgagctgtatgagaagaaggccaactgcatcgccaaccacacgggcgtggatatccaccggaacggcgacttccagaagaacgggaacggaaccaccagcggcatcggcagcagcgtggagaagtacatcatcgacgaggaccacatgtccttcattaacaacccaaacctgaccgtccgggtgcccattgctgtgggcgagtctgacttcgagaacctcaacacagaggatgttagcagcgaatcagaccctgaaggcagcaaagataaactggacgataccagctcctcagaaggaagtaccatcgacatcaagcctgaggtggaagaagttcccgtggagcaacctgaggaatacttggatccggacgcctgctttacagagggttgcgtccagcggttcaagtgctgccaggtcaacatcgaggaaggactaggcaagtcgtggtggatcttgcggaaaacctgcttcctcattgtggagcacaattggtttgagaccttcatcatcttcatgattctgctcagcagtggcgccctggcctttgaggacatctacattgagcagaggaagaccatccgcaccatcctggagtatgcggacaaggtcttcacctacatcttcatcctggagatgttgctcaagtggacagcctacggcttcgtcaagttcttcaccaatgcctggtgctggttggacttcctcattgtggctgtctctttagtcagccttatagctaatgccctgggctactcggaactaggtgccataaagtcccttaggaccctaagagctttgagacccttaagagccttatcacgatttgaagggatgagggtggtggtgaatgccttggtgggcgccatcccctccatcatgaatgtgctgctggtgtgtctcatcttctggctgattttcagcatcatgggagttaacctgtttgcggggaaataccactactgctttaatgagacttctgaaatccggttcgaaatcgatattgtcaacaataaaacggactgtgagaagctcatggagggcaacagcacggagatccgatggaagaatgtcaagatcaactttgacaatgtcggagcagggtacctggcccttcttcaagtggcaaccttcaaaggctggatggacatcatgtatgcggctgtagattcccgaaagccagacgagcagcctgactacgagggcaacatctacatgtacatctacttcgtcatcttcatcatcttcggctccttcttcaccctcaacctgttcatcggtgtcatcatcgacaacttcaaccagcagaagaaaaagtttggaggtcaggacatcttcatgacagaggaacagaagaagtactacaatgccatgaaaaagctgggctccaagaagccacagaagcccatcccccgacccttgaacaaaatccaagggattgtctttgatttcgtcactcaacaagcctttgacattgtgatcatgatgctcatctgccttaacatggtgacaatgatggtggagacagacactcagagcaagcagatggagaacattctttactggattaatctggtctttgtcatcttcttcacctgcgagtgtgtgctcaaaatgtttgccttgagacactactatttcaccattggctggaacatctttgactttgtggtggtcatcctctccattgtgggaatgttcctggctgatatcattgagaagtacttcgtctccccaaccctattccgagttatccgattggcccgtattgggcgcatcttgcgtctgatcaagggcgccaaagggatccgcaccctgctctttgccttaatgatgtcgctgcccgccctgttcaacatcggcctcctgctcttcctcgtcatgttcatcttctccatttttggcatgtccaacttcgcatacgtgaagcacgaggccggcattgacgacatgttcaacttcgagacatttggcaacagcatgatctgtttgttccagatcacaacgtctgctggctgggatggcctgctgctgccaatcctgaaccgcccccctgactgcagcttggacaaagagcacccagggagtggcttcaaaggggactgtgggaacccctcggtgggcatcttcttctttgtgagctacatcatcatctccttcctgattgtggtgaacatgtacatcgccatcatcctggagaacttcagcgtggccaccgaggagagcgccgaccctctgagtgaggatgacttcgagactttctatgagatctgggagaagtttgacccagacgccacccagttcatcgagtactgtaagctggcagactttgccgacgccctggagcacccgctccgagtacccaagcccaacaccatcgagctcatcgccatggacctgcccatggtgagcggagatcgcatccactgcttggacatccttttcgccttcaccaagcgagtcctgggagacagtggggagttggacatcctgcggcagcagatggaggagcggttcgtggcatccaatccttccaaagtgtcttacgagcctatcacaaccactctgcggcgcaagcaggaggaggtgtctgcagtggtcctgcagcgtgcctacaggggacacttggctaggcggggcttcatctgcagaaagatggcctccaacaagctggagaatggaggcacacacagagacaagaaggagagcaccccgtccacagcctccctcccctcttacgacagcgtcacaaagccagacaaggagaagcagcagcgtgcggaggagggcagaagggaaagagccaagaggcaaaaagaggtcagggagtccaagtgctagaggaggggaaaggaagcttaccccggctgaacactggcaagtgaaagcttgtttacaaacttccgaatctcacggatgcagagcagctgtgcagacgctcgctgtactggaagacctataccaaacatagtctgcttacatgtgacatggtggcatcctgagcggtgactgctggggacaaaggaccctgctccctggactcacagatctcctatcgcttgggcagacggttactgcatgttccacacttagtcaatgcaacttaggactaaactaaccaggatacaaaaccgaggcggctgccgggaccagcagatcaccgctgcagccaaatggattttattttttcattttgttgattctcagaagcagaaagcatcactttaaaagtttgtttgttcatncaaacaatatttgaattcttacattagttaagctaagcancaaaaag

SEQ ID NO: 1724 - DNA, 3115 bp, Rattus norvegicus
  Genbank Accession No. NM_019280
gttgaacagcagccagagcctgaagaagccaactccagggcggaggaaaggaagcagaaggctcagcaccagtctccaacacttggcaagatgggtgactggagcttcctgggggagttcctggaggaggtccacaagcactctacggtcatcggcaaggtctggctcaccgtcctgttcattttccgcatgctggtcctcggcaccgctgctgagtcctcctggggagatgagcaggctgatttccggtgtgataccattcagcctggttgccaaaatgtctgctacgaccaagccttccccatctcccacattcgttactgggtactgcagatcatctttgtgtccacaccatctctggtgtacatgggccacgccatgcacactgtgcgcatgcaggaaaagcagaagctgcgggaggctgagaaagctaaagaggccggtggcaccggcacctatgagtacttggcggagaaagccgagctgtcctgctggaaagaggtgaacgggaagattgtcctccagggcaccctactcaacacctatgtctgcaccattctcatccgcaccgctatggaggtggccttcatggtgggccagtacctcctctatgggatcttcctggacaccctgcatgtctgccgcagaagtccctgtccccaccccgtcaactgttatgtctcgaggcccacagagaagaacgtcttcattgtctttatgatggctgtggctggactgtctctgtttctcagcctggctgaactctaccacctgggctggaagaagatccgacagcgcctggccaagtcacggcagggtgacaagcaccagcttcttggcccctccaccagcctggtccagggcctcactcctcctcctgacttcaaccagtgcctaaagaacagcccagatgagaaattcttcagtgacttcagtaataacatgggctcccggaagaatccagaccctctggccactgaggaagtgccaaaccaggagcagatcccggaggaaggtttcatccacacacagtatggccagaagcccgagcagcccagtggcgcctctgcaggccaccgctttcctcagggctaccacagtgacaagcgccgccttagtaaggccagcagcaaagcaaggtcagatgacctgtcagtgtgaccctcctcttagggaggaccagtcccagaaggaagccaaggagggtgaggcaggacagaagcggtctctctgactgtataccttcctcagcaccttctctcccgggtctggatggtgttgctcattaatcctccaaatttcagttctgagccgtattctcaaagattgggctactcctcaaatccccaaccccacatcctctaccagtattcgcagtgaagactttcaagtgatttagtgatatggtgggagcaggaatgggaaccttggcaaaatctggtctgggtaggacagacatgaagattcgacattagcaacagataaaccctcaccccaaatcttgtcttcttcggtactaggcccatcctttttattttttaaaggaagaatccaaggttgagagtattcatcaaataatctgcattgtattgttcctttgaatctgtcgtttccatgtgccatacctcagagtgctggtgaggtaactgtgggttgcccttggctgcatctccctcctcccagtcttaaaggggtgtccttggtcctcggccagcatcagctttacaagtgccttggtatgtgcctttggaaaacactgcatgttgatgatgctgcagccttactgccaggctagacacccagctcagaagggtgccaagacctctagaagtcactgtgcacataagcattgctggaattgccaccagctgtcatcctgcagtcctttacagttcaacctagtgatagaaaccgtcctggacagctcacccagtgttcctctaaaatcttggttaacaggaatgtccaaagtcaccatcctctcttggaccctggccagattaccagccaccaagttcagtggaatttccccaggatttaatgaaacaaagagagcattgtgcttctcaggttccttggggggtgttgggggggattcttctgtggagatgaaaagagaggagggggaggacactggaaaactattttcccttctgcatatgccttccactgcctcccagcttggactgctgagaggtgtggtgatagatagcaacggaggcccaagatctctctcttagaggcatcaaggggacctggaagccgagatggagctccggttggttttgacacggcccttatttagtgcagatgctcctgtgtttccttgggacccttaggtacatcagggagggactgtagaaaattcctgccttcctcagggtctatcctgggctatctactgagaggatccacagtcggtgtctctccttatgcagatggaaagatgctcagcgtcagatatcaagacttacaaacacaatgctctgtgtgtgtgtgtgtgtgtgcatgtgtgtgtatgagtgtgtgcatactcaaccatctatgtgtgtatatgtgtgtgtgtgcatgctcaaccatctgtgtgtgtgtgtgtgtgtgtgtgtgtgtgtgtgtgtgtgtgtatacccgtgtatgcatgcagatagaatggtaaagaagagccctgaagaactgtaaggaaacatgtagaaaacttgggtttttctgcctccttttctgttgcccgacaggacagctgagcttgcttcctaatcagcctaaaggtcaaacctgggaagtcagtacaggagggtgaaggttcagaggtcaacccctgcccatgtgaccatctctgggtccctctgctggtatttggatggctgaagatacttgggaaaggctgactggctgtcccagccccagtgtatctcattcattcctgacaccgacgctatgattctctgcttttctagttatgggatgtgtgtttgtcttctgaaatggggccttttgagttagaaaatctgagaccagtcttcgatggtgaggtttttcagaagagaaagagaaagtaatatgtgtgactggttttaaataaaatacgtctctacatgttaaaaaaaaaaaaaaaaaa

SEQ ID NO: 1725 - DNA, 1131 bp, Rattus norvegicus
  Genbank Accession No. NM_019286
atgagcacagctggaaaagtaatcaaatgcaaagcggccgtgctatgggagcctcacaagcccttcaccatcgaggacatagaagtcgcaccccccaaggcccatgaagttcgcattaagatggtggccaccggagtctgccgctcagacgatcacgcggttagtggatccctgttcacgcctcttcctgcagttctaggccacgagggagctggcattgttgagagcattggagaaggggtgacttgtgtgaaaccaggtgataaagtcatcccgctgttctctccccagtgtggaaaatgcaggatctgcaagcacccggaaagcaacctctgttgccaaactaagaatctgacacagcctaagggagctttgctggacggcaccagcaggttctcctgcaggggaaagcccattcaccacttcatcagcaccagcaccttctcccagtacactgtggtagatgacatagcggtggccaaaatcgatgcggctgcaccgctggacaaagtctgcctcatcggctgtggcttctcgactggctatggctctgccgtccaagtcgccaaggtgaccccaggctccacctgtgccgtgtttggcctgggaggtgttggtctgtctgtcgtcattggctgtaaaacagcaggagcagccaagatcattgccgtggacatcaacaaagacaagtttgcgaaggccaaagagttaggtgccactgactgtatcaaccctcaagactacaccaaacccatccaggaagttctccaggagatgactgatggaggggtggacttttcatttgaagtcattggccgtcttgataccatgacttctgccctgttaagctgccattcagcatgcggtgtaagcgtcattgtcggggtgcctcccagtgcccaaagcctctccgttaaccccatgtcgctgctgctgggacgcacctggaaaggagcaatattcggcgggtttaagagtaaagatgccgtccccaaacttgtcgctgacttcatggctaagaagtttccgttggagccgctgattactcatgttttaccttttgaaaagataaatgaagcatttgacctgctccgtgctggaaagagtatccgtaccgtcctgacgttctga

SEQ ID NO: 1726 - DNA, 1430 bp, Rattus norvegicus
  Genbank Accession No. NM_019289
atggcttaccacagcttcctggtggaacccatcagctgccatgcctggaacaaggaccgtactcagatcgccatctgccccaacaaccacgaggtgcacatctacgagaagagcggtgccaagtggaacaaggtgcacgagctcaaggagcacaacgggcaggtgacaggcatcgactgggcccccgagagtaaccgcattgtgacctgcggcacagaccgcaatgcctatgtgtggacgctgaagggccgcacgtggaagcccacgctggtcatccttcggattaatcgagctgcccgctgcgtgcgctgggcccccaatgagaacaagttcgccgtgggcagtggctcccgtgtcatttccatctgttattttgagcaggagaatgactggtgggtgtgcaaacacatcaaaaagcccatccgctccactgtccttagcctggactggcaccccaacaacgtgctcctggctgcaggctcctgtgacttcaagtgcaggatcttctctgcctatatcaaggaggtggaggaacggccagcccctacaccgtggggctccaagatgccctttggggagctgatgtttgaatcgagcagcagctgtggctgggtgcatggtgtctgcttctcggccggtgggagccgagttgcttgggtcagccatgacagcactgtgtgcctggtagatgctgagaagaagatggccgtggcaaccctggcctctgagacattaccgctcctggccatcaccttcatcacagaaaatagtctcgtggcagcgggccacgactgcttcccggtgctgtttacctatgacaacgctgcggggacattgagctttggtggccggctggatgtgcccaagcagaactcccagcgtggcctgacagcccgagagcgcttccagaacctcgacaagaaggccagctctgaagggggtgcagccacaggggctggcctggattcactgcacaagaacagcgtcagtcaaatctcggtgctcagcgggggcaaggccaagtgctcgcagttctgcaccacaggcatggacggtggcatgagcatctgggatgtgaagagcttggagtcagccttgaaggacctgaagatcagatgagctgtgaggagtgctgtcctcatcccacatgctggggaggagggaaaggggttggggaggctaagggctgctttgctgaatgcttctagggtgtagtacaggtctgcaaaggggatgctctctctccaaagaggggaagaggaaggtggggaactttcctgcctatttaatgaaaatgtgccttttaaagagatgctttcattcattgcaaaccaaaaacaagacaaaaaacccaaagcacaatgctggtcataaactgcttcaaaatgtgggctaataaacataccaaatgtgaaaaaaaaaaaaaaaaa

SEQ ID NO: 1727 - DNA, 1184 bp, Rattus norvegicus
  Genbank Accession No. NM_019296
ctcggcctctaagctcccggagtcgctgcgtccgcgcagtccggaactcgtgtggccaccgcgggaacagagagggtccgttgtaacctgttgagtaactatggaggactatatcaaaatagagaaaatcggagaagggacttatggtgtggtatataaaggtagacacaggactactggccagatcgtggccatgaagaaaatcagacttgaaagcgaggaagaaggagtgcccagtacggcaatccgggaaatctctctgttaaaagaacttcgacatccaaatatagtcagcctgcaggatgtactcatgcaggactccaggctgtatctcatcttcgagttcctgtccatggatctcaagaagtacctggactctatccctcctggccagttcatggattcttcgctcgttaagagttacttgtaccaaatcctccaggggattgtgttttgtcactcccgacgagttcttcacagagacttgaaacctcaaaatctattgattgatgacaaaggaacaatcaaactggcagatttcggccttgccagagcgtttggaataccgataagagtgtacacacacgaggtagtgacgctgtggtaccggtcgccagaggtgttgctgggctcggctcgctactccaccccggttgacatctggagcatagggaccatatttgcagagctggcgaccaagaagccgcttttccacggcgactcagagattgaccagctcttcaggatcttcagagctctgggcacccctaacaacgaagtgtggccagaagtagagtccctgcaggactacaagaacactttccccaagtggaagccggggagcctcgcgtcccacgtcaagaacctggatgaaaacggcttggacttgctctcgaaaatgctggtctatgatccagccaaacgaatctctggaaaaatggcccttaagcacccatactttgacgacttggacaatcagatcaagaagatgtaaccctctggaagtcccgccctgctgtggcagggaagatcgtggcgtttactgttggctcttcctgtcttgtatagttttcttttctttgtctgtaaaccatcatctggacttttcctattttcctacgtataacttaattaacatgtaaatattattccatatgaatttaaatataattctgtatatgtgt

SEQ ID NO: 1728 - DNA, 1811 bp, Rattus norvegicus
  Genbank Accession No. NM_019301
gcacgaggaccgctgtgaggggaatggaggcttcttcgcctctggaccccgtggggcgccttgtagccttctgccgcggaggagtgcatctggccgtcctgctgctgttcttgtcgccatctactttgggccagtgcccagccccaccactgtttccttatgccaaacctataaatccaactgatgaatccacgtttcccgttggaacatctttgaagtatgaatgtcgtccaggatatatcaagaggcagttctctatcacctgcgaagtaaactcagtgtggacaagtcctcaagacgtgtgtatacgtaaacaatgtgaaactcctttagatcctcagaatggcatagtacatgtaaacacagacatccggtttggatcctctatcacttatacctgtaatgaaggataccgcctcattggttcctcctctgctatgtgcataatctctgatcagagcgttgcctgggatgccgaggcacctatttgtgaatcaattccttgtgagatacccccaagcattcccaatggagatttcttcagtcctaacagagaagattttcattatggaatggtagttacctaccagtgcaacactgatgcgagagggaagaagctctttaacctggtgggtgagccctccatacactgtaccagcatcgatggtcaagttggagtctggagtggccctcctcctcagtgcattgaactcaacaaatgtactcctccccatgttgaaaatgcagtcatagtgtctaaaaacaaaagcttgttttccttaagggatatggtggagtttagatgtcaggatggctttatgatgaaaggagacagcagtgtgtattgtcgatccctaaacagatgggagcctcagttaccaagctgcttcaaggtgaaatcctgtggtgctttcctgggtgagcttcctaatgggcatgtattcgttccacaaaatcttcaactcggggccaaagtgacctttgtttgtaatacagggtatcaattaaaaggcaattcttctagtcattgtgttcttgatggagtggaaagcatttggaatagcagcgttcctgtgtgtgaacaagtgatatgtaaactccctcaggatatgagtggattccagaaagggttgcaaatgaaaaaagattattactatggagataatgtagccttggaatgtgaggatgggtatactctagaaggcagttctcagagccagtgccagtccgatgccagctgggatcctcctctgcccaaatgtgtctctcaagtgatatgtaaactccctcaggatatgagtggattccagaaagggttgcaaatgaaaaaagattattactatggagataatgtagccttggaatgtgaggatgggtatactctagaaggcagttctcagagccagtgccagtccgatgccagctgggatcctcctctgcccaaatgtgtctctcgctcaaacagtggtctaatagctggaattttcattgggataatcgtccttattttattcatcattttttcctactggatgattatgaagtttaaaaaacgcaattccaccaatgaaaagtgtaaagaagtgggtatctatttaaattctaaagaagacagctgtgttcagcctcagtctctgctcacaagtcaggagaacaacagtaccagtagcccagcacggaattcactcactcaagaagtctaatagccgccatgtacagtgatgtctctgaaacgcaaaacatttcctgtctgtatcacttttaaaataaactattttcttttaaaatctagatgtgttgttcctcgtgcc

SEQ ID NO: 1729 - DNA, 4361 bp, Rattus norvegicus
  Genbank Accession No. NM_019345
cccggagccataatggcagagctacccgtgacagagatgccaggcgatgctctgtgcagtgggcgcttcaccatcagcacgctgctggggggtgacgagcccccaccagctgcctgtgacaatagccagcccagccatttgacccatggcagcaccttgtacctacgcacctttggttacaacactatagatgtggtacctgcctacgaacactacgctaacaggcctctgcccggcgagccccggaaggtgcggcccaccctggctgacctgcactcgttcctcaagcaggaaggtagccacctgcatgccctggcctttgatggacggccaggccatgagctgactgatggacttgtggaagacgagacaggcgccaacagcgagaagagccctggagaacctgtgcgtttcggctgggtcaagggagtgatgatccgatgcatgctcaacatatggggtgtgatcctctatctgcggctgccctggattacggcgcaggcgggcattgtcctgacctggctcatcatcctgctgtcagtcatggtgacatctatcaccggcctctctatctcggccatctccaccaatggcaaggtcaagtcgggtggtacctatttcctaatttctcggagtctgggacctgagctggggggctccattggcctcatcttcgcctttgccaatgccgtgggtgtggccatgcacactgtgggctttgcagagaccgtacgagacctacttcaggagaacggcacacccattgtagaccccatcaatgacatccgcatcatcggtgtggtcacggtcactgtgctgctggccatctcgctggctgggatggagtgggagtccaaggcccaggtgctgttctttcttgtcatcatggtctcttttgccaactacctggtgggcacgctgatcccagcatctaaggacaaagcctccaaaggtttctacagctaccatggggacatttttgttcagaacctggtacccgactggagaggcatcgatggtagcttcttcgggatgttctccatcttcttcccttcagccacaggcattctggcaggggccaacatctctggggacctcaaggaccctgctgtcgctattcccaagggaacactcatggccattttctggaccaccatttcctaccttgccatctcggccaccatcgggtcctgtgtggtgagggatgcctctggggacgtgaacgacaccataactcctggcccaggcctctgtgaagggctagcctgcgttatggctggaacttcacggaatgctccccagcagcacagctgccgctatggcctcatcaactactaccagaccatgagcatggtgtctgccttcgcacccctgatcacagccggcatctttggggccaccctgtcctcggccttggcctgtcttgtctcagctgccaaggtcttccagtgcctgtgcgaagaccagctgtaccctctgattggcttctttggcaagggctatgggaagaacaaggaacctgtgcgtggctacttgctggcctacgccatcgcggtggccttcatcatcattgctgagctcaacaccatcgctcccatcatttctaacttcttcctctgctcctacgccctcatcaacttcagctgcttccatgcctccatcaccaactcacctggatggagaccctccttccgatactacagcaagtgggcggcgctgtttggggcagtgatctccgtggtcatcatgttcctgcttacctggtgggcagctctcattgccattggagtcgttctcttcctcctgctctatgtgatctacaagaagccagaggtaaactggggctcctcagtgcaggctggctcctacaacctggccctgagctactccgtgggcctcaatgaggtggaagaccacatcaagaactatcgcccccagtgcctggtgcttacaggaccccccaacttccgcccagctcttgtggactttgtgagcacgtttacccagaacctaagcctgatgatctgtggccacgtgctcattgcacccggcaaacagagagtgccggagctccggctcatcgccagcggacacaccaagtggctgaacaagaggaagatcaaggccttctactctgacgtcatagctgaggacttgcgcagtggcgtccagatcctcatgcaggcctcgggtctgggaagaatgaaacctaacattctggtggttggcttcaagaagaactggcagtctgcccacccagccacactggaggactacattggcatcctgcacgatgcctttgacttcaactacggggtgtgcatcatgaggatgcgtgaggggctcaatgtctctgaggcgctgcagacgcacacagccccagaggcactggtacaggaggagcagaccagcaccatcttccagtcggagcaaggcaagaagaccattgacatctactggctgtttgacgatggaggcctcaccctcctcatcccttatctcctgcaccgcaagaagagatggggcaaatgcaagatccgcgtgttcgttgggggccagatcaacaggatggatgaagagagaaaggcgatcatttctctgttgagcaagttcagactgggattccatgaagtccacgtccttcctgacatcaaccagaagccccaggtggagcacaccaagcggtttgaggacatgattgcccccttccgtctcaatgacggcttcaaggacgaggccactgttgccgagatgaggagggactatccctggaagatctcagacgaggagattaataagaacagaattaagtcccttcggcaggtgaggctgaatgagattctcctggattactcccgggatgctgctctgatcatccttaccttgcccattggaaggaaggggaagtgccccagttcactgtacatggcctggctggagaccctgtcccaggacctcagtcctcccgttctcctcatccgaggtaaccaggagaacgtgctcaccttttactgccagtgatgtccagtgtggcagttcctgccgagagctgagcgcgtgggatagagtcggaactcacgctctccagctggagaagaggcttcaattcctgctgtgtcatcacatctaccggctgtgtttccaagctggctgcaccccatcagacacaccttctagaccttgaagttgcacggaaaagcttctggaagagtcttatctctttttaaaaagcttttcttttttttttttttttgtcttgatgaccgaaatattagtcattgattcagtctttgatttgtatacaaatcgagtcccagtattgggtgtgcaacttgacaatctctctcgggaccttccctgtgaccacccccaaagctgtctcatcccccccagacaggagagcaggagcccatcctgaggacccatgtggagttctgatgaccacaggaccctttgagctacacagcaacacacatttctcctcctgttccctttcagtgatggatcctgggtgctcctactagttatttagaccagggtcctctgggttctttgattacaaattctatggtttcctcagagactcagaacacacagaacaatggtagggaagcatcacaaactggtcctcactctcgagggtgcttctctcccctctctcccctctccccccccctccctctctctctcctttttccttctgacagagtcttatgtggtccaggctggccttgaacttgttctgtagtcaagaatagcttcaaacatctgatcccctgcctccattacagagcacagggattccaggcacattcacataggcatgtttcacgaggtgatagggaccacacctacggttgatgggtgccggcaatcacctgctgactatgctacccccgcccagtctctagtgtgctcctttgaagttgattgcaaccttctaaatgatcttcaaacccactcgtgtgcagtgacccgtgctttgaaaaacaggtttaatttctggaggttgtgtgtagggtctgttgctggttggtttctttgttgctcgggaattttgttttgtcaacttgacaggagctagggccatctaagcagaaggaacctcaattgacaaatgcctcctgctgattggcggcctgtaatgattgacggggtggggccagcccactgtgttgccgtaccaccatgagcaggtggtcctggggtgtataagaaagcaggctgagcaagctatgggagcaagccagtgaggagtgtctcttcatggcttctgcttcagttcctgcctggagttccttccctgacttctcttcattataaaccgtaagccatgagatgaaataaacccttttctcccc

SEQ ID NO: 1730 - DNA, 4194 bp, Rattus norvegicus
  Genbank Accession No. NM_019349
tcggcgccccgccttctccggggagcgcccggcgggagcggccggaccccgggctcgcgcgggagacgacgcgccacaaactttgccttttattgttcctagccctttaagtgcaaggggctctgttgggctggaaaaatgtccttcttcaatttccgtaagatcttcaagttggggagcgagaagaagaagaaacagtacgaacacgtgaagagagacctgaaccccgaggagttttgggagattatcggagagctgggcgacggagcctttgggaaagtgtataaggcccagaataaggagaccaatgttttagctgctgcaaaggtgattgacaccaaatctgaagaagaacttgaagattatatggttgagattgacatattagcatcttgtgatcacccaaacatagtcaagcttctagatgccttctattatgagaacaatctttggatcctcattgaattttgtgcagggggagcagtagatgccgtgatgcttgaacttgagagaccattaactgagtcccaaattcaagtagtttgcaagcagacattagaggcgttgaattacctacatgacaataaaatcatccacagagatctaaaagctggcaatattctctttaccttagatggagacattaaattagcggattttggagtgtcagctaagaataccaggacaattcaaaggagggattcatttattggcacaccgtattggatggctcctgaagtcgtcatgtgtgagacatcgaaggacagaccctatgactacaaagcggacgtttggtccctgggaatcactttaatagaaatggctgagatagagccgcctcatcatgagctaaacccaatgcgagtgctgctgaaaatagcaaagtcggagccccccacactagcacagccatccagatggtcttcaaattttaaggactttctaaagaaatgcttggaaaagaatgtggatgcgcggtggaccacatcccagctgttacagcatccctttgttaccgttgattccaacaaaccagtccgagaattgattgctgaggcgaaggctgaagtaacagaagaagttgaagatggcaaagaggaagatgacgatgatgagacagagagtgctctgccaatacctgcgaataaacgcgcctcctctgacctcagcattgccagctctgaggaagataagctttcacaaaatgcttgtattttggaatctgtgtcagaaagaacagaacacaatacttctggggataaatttagcaacaaagttcttagtgagaagcctactcctgagggacctgagaagactgtggatgtggatgggcctgcaaatgatgttaacttagaaactgtggctgaaccaaatgaccaagcggtaggattccatgagaatgggagagagaagaaaagaccccaactggaaagtcaaccagatacagaagaccaacaaactgtggatgttaatttagtcggtgaaggaaatgacagcaatatagtaattttagaaacaaacactgattgtctgaaaccagaggaagacagaaatgaagaaaaccaagagataattgagaataaacttacacaatctgaagaaattaaagatatacatattcaaacaatggacttagtttctcaagaaactggagaaaaagaggcagattttcaggcaattgacaatgaagttgggtttacaaaggaagaaacccaagagaaattgggaaaagatgataaaactcacaaagttgtgatcagtgatataaccagtgaggtgggaacagacgagcctccaggtgatacccagaagtctgctgagcagagccaggatgcagagggtggggctggggaagaagccccggagcctgcccagacactaacagagaaggccactgagggccctgaggctcatggtgctgaggaagagcctcgtagtggagagagagtagaggataagcagctagagcagcagtctgcagtgtgtgaaggtgagggacaggtaaccagcacttcagagagcacacgggcaaccacggaggaaccagagactgacgaagttgaccaagtcagcgagtcaaatagcattgaggaactagagagacttggagttactggtgctgaggaacaggctctagggagcaaaggggaggctgctacggagctagatttggagagagaagaaaatgcacaggaactgccagttaaagcagagccccaagctcctgcagcatcgcaggccagcgaacctccccctgtcttaatacccagtattaatattcattcggaaaacacagaaaataaaggagaaatgggtgctttgccaaaacctgaaaccatactgccaccagagcctgaaaatggaaagggaaatgacacggactcagggactgggtccactgtggagaacagcagcagtgacctgaacttgtccatctctagcttcctgagcaaaaccaaggacagtggctcggtgtctctgcaggagacaagaagacagaagaaaacattgaagaaaacacgtaaatttattgttgatggagtagaagtgagtgtgacaacatcaaagatagttacagacagcgactctaaaaccgaggaattgaggtttctcaggcgtcaggaacttcgagagctaaggcttctccagaaggaagagcagaaagcccagcagcagctcaacgggaaattgcagcagcagcgcgagcagatcttcaggcgctttgagcaggagatgctgagtaagaagcgacaatatgaccaagaaattgagaatctagagaagcagcagaaacagacaattgaacgactagaacaagaacacacaaaccgcctgagagacgaagctaagcgcatcaaaggagagcaggagaaggagctgtccaaattccagaatatgctaagaaaccgaaagaaggaggaacaagaatttgttcagaagcaacagcaagagttagacggcgctctgaaaaagatcatccagcagcagaaggcagagttggccaatattgagagagagtgcttgaataacaagcagcagctcctgagagcccgagaagctgcaatttgggagcttgaagaacgacatttacaagaaaagcaccagctgcttaaacagcaacttaaagatcagtatttcatacagagacatcagctgcttaaacgccatgagaaggaaacagaacaaatgcagcgttacaatcaacgacttattgaagaattgaagaacagacagactcaggaacgagctagactgcccaagattcagagaagtgaagccaagacacgaatggccatgtttaaaaaaagtttgaggattaactcaacagctacaccagaccaggaccgtgaaaaaattaaacagtttgctgcacaggaagaaaagagacagaaaaatgagagaatggctcagcatcaaaaacatgagagtcagatgcgggaccttcagttgcagtgtgaagccaacgtccgagagctgcaccagctgcagaatgaaaaatgccacctgttggttgaacatgagactcagaaactgaaggagttagatgaggagcacagccaagagctcaaggagtggagagagaagctgaggcccaggaagaagacactggaggaagagtttgccaggaaacttcaggaacaggaagtgttctttaaaatgaccggggagtccgaatgcctcaacccctcagcgcagagccggggctgtttacaaacgtctcaccccagcagtaccagggcaccagcgtgggcaggatgaagcacatgagcaggaggccgggcttgtaatacctcctctggaacatcaccagcttctcagctttcaggtcagacatgtccagctttccgcccttctctttgacagccgggtgtttgcgcacaagcagccaacccacgtgagagaagaaaaagccacggcgggagttgtgagggtcggcgtgtgtctctgagaacttgtggtgggcgcggtgatcccggggcccattcgtacacatcgttctggaatgccatggtgttggcgatgatgagaaagagcctcaggggcagccgagccttgtaagtcctgtggctccacaggcgatgagccccggctgtgatgcccagggcgctgattacgtagtacaaatatgcaaagaggcaggtgtagaccttgcaggaggggaccagtgtgatcccgtacagggctccaatgtgc

SEQ ID NO: 1731 - DNA, 1575 bp, Rattus norvegicus
  Genbank Accession No. NM_019354
atcgcttgcttcttgggcagccaccgccgccgtcggacctagccgtctgcactcctgtgttctcctgtgtattctcctgcggtccggacacaatagtatgatctttaagtgtttcgtctcccagacattttctatgggaaatcaaggggatcaggccatgatagccactggcagctttgaagaacgggacacctttagagaagcttgatcttggaggcctcagcgtgagacctcaaagcaccctcccgactccggcagagttcctctgtctcgtcttgacgattgaaggtccccactgcttcagtttttctccatcttctgggaggtagcaggaagtcagaatcatggttggtttcaaggccaccgatgtgccccccacagccaccgtgaagttcctgggggctgggacagcagcctgtattgcagatctcatcactttccctctagacaccgccaaagtccggctgcagatccaaggagagagtcaagggctagcgcgcaccgccgccagcgcccagtaccgcggcgtgctgggcaccatcctaaccatggtgcgcactgagggtccgcgcagcctctacaatgggctggtcgccggcctacagcgccagatgagctttgcctccgtccgcattggcctctacgactctgtaaagcagttctacaccaagggctcagagcatgcaggcattgggagccgcctcctggcaggtagcaccacaggtgccctggctgtggctgtggcccaacctacagatgtggtaaaggtccgcttccaggcccaggcccgggctggcggtggtcggagataccagagcactgtcgaagcctacaagaccattgcacgagaggaagggatccggggcctctggaaagggacctctcccaatgttgcccgaaatgccattgtcaactgtactgagctggtgacctatgacctcatcaaagatactctcctgaaagccaacctcatgacagacgacctcccttgccacttcacttctgccttcggggcgggcttctgcaccaccgtcattgcctcccccgttgatgtggtcaagacgagatatatgaactctgccttgggccagtaccacagcgccggccactgtgccctgaccatgctccggaaggaggggccccgaaccttctacaaggggttcatgccttccttcctccgcttgggatcctggaacgtagtaatgtttgtcacctatgagcagctcaaaagggccctgatggctgcctatgaatcccgggaggcacccttttgagcctctccagctgatgacctggaccctgctccccattcctgccctgtcttttccttcatcctctgcccagccccaacctcttcccatttcccacactccaactcccttcccagctcatctccctatacctcctcagcaaggaggccttaccctagcacatctcactatgcctcctcagcgaggaggcctgaccccggaccctgcaccctcagtcctgctaacagttaagcccaaatcttttgtcctcattcccagcccagcttagccagccttcgcccataaagcaagctccaatgtaaaa

SEQ ID NO: 1732 - DNA, 1377 bp, Rattus norvegicus
  Genbank Accession No. NM_019356
gttcgggattcacacatacacttcagaatgccgggtctaagttgtagattttatcaacacaaatttcctgaggtcgaagatgtagtgatggtgaatgtaagatccattgctgaaatgggggcctatgtcagcttgttggaatataataacattgaaggcatgattcttcttagtgaattatccagacgacgtatccgttctataaacaaactgatccgaattggcagaaatgaatgtgtagttgtcattagagtggataaagaaaaaggatatatagatttgtcaaaaagaagagtttctccagaggaagcaatcaaatgtgaagacaaattcacaaaatccaaaactgtttatagcattcttcgccatgttgctgaggtattagagtataccaaggatgagcagctggaaagcctattccagaggactgcctgggtctttgatgacaagtacaagagacctggatatggtgcctatgatgcctttaagcatgcagtctcagacccatctatcttggatagtttagatttgaatgaagatgaaagagaagtactcattaacaatatcaataggcgtttgaccccacaagctgtcaagattcgagcagatattgaggtagcttgctatggttacgaaggcattgatgctgtaaaagaagccctgagagcaggtttgaattgttctacagaaaccatgcccatcaagattaatctaatagctccacccaggtatgtgatgacaacaacgaccctagagaggacagaaggactctctgttctcaatcaggctatggcagtcatcaaagaaaagattgaggagaagaggggagtgttcaatgttcagatggagcccaaagtggttacagatacagatgagactgaacttgcaaggcagctggaacggcttgagagagaaaatgcagaagtggatggagatgatgatgcagaagaaatggaagccaaagctgaagattaaccttttggaaaacagtccaatttaaggagtacgaagcagccctttctggctgtaaaccctagacttgaaagttttccagtattgaaaacttcaaagctgaatatttttatttccaagtatttaagtattcgacaagccagaatctaaatgccctccttcatgtcagctgttttcacatagtggctctaacacctcaagcgtttttaagggagtggcttgatttgaccagagacaaatgttaaaccgcagtcctaaaattgggcttgcggttttcatttctgatgtctctggattggcacccttatggtttagagaattaccaggggctccagacaccaacaatcccaacctttctatataaaatgtactcaagcaaacatcaaataaatttctgggatattt

SEQ ID NO: 1733 - DNA, 2825 bp, Rattus norvegicus
  Genbank Accession No. NM_019371
ggatccaggttttcaagtttgttaggggatttaatgcaaatcaatatgcaaacagagagcattgtaaaaaaaaaaatccagtcctttctccggtcacacacaggttagctaatgtggagctcgcccagatgctctgcagcaccagctcaaggggaagggccaggaggagggcagtcccgggggcgggaccatgacgttgaggtcaaggcggggcttcctctcgttcctccccgggctgcggccgccgcggcggtggctccgcatctccaaaaggggccctccgacttctcactgggccagtccggcgctgggtggcagaactctacactactcctgccggtctcagagcgggactcccttctcttcagagtttcaagcaactttccccgcctttgcagctaaagtggctcggggaccgtggctgccgcaggtggtagagcccccggcccggctctctgcatctccgctgtgcgttcgctctgggcaagccctcggtgcgtgcaccctgggggtcccccgcctcggctctgtgagcgagatgcctctgggacacatcatgaggctggatctggagaagatcgccctggagtacatcgtgccctgtctgcacgaggtcggtttctgctacctggacaacttcctaggcgaggtggtgggcgactgcgtactggagcgagtcaagcagctgcattacaacggggccctgcgtgacggccagctggcggggccccgcgccggcgtctccaagcggcacctgcgaggcgaccagatcacgtggatcgggggcaacgaggagggctgcgaggccatcaacttcctcctgtccctcatcgacaggctggtcctgtactgcgggagccgcctgggcaaatactatgtcaaggagcggtccaaggcgatggtggcttgctatccaggaaatggaacaggttatgttcgtcatgtggacaaccccaatggtgatggccgctgtatcacctgtatctactacctgaataagaattgggacgccaagttacatggaggggtcctgcggatatttccagaaggaaaatcatttgtagcagacgtggagcccatttttgatagactcctgttctcctggtcagaccgcaggaatccacatgaagttcagccctcctatgccaccaggtacgccatgactgtctggtacttcgatgctgaagaaagggcagaagccaaaaagaaattcaggaatctaactagaaaaactgaatctgctcttgctaaagactgacggtggtgtgaagtccgctgggcgcattcgtttagtgacagttcctgaaatgttaagtgtcaagatccaaagactctgtccaatcccctgcctaccgcctgcatcgtttggctccctaccttgtttgtggtacttcgtgttttcttgctgggaatgcgttgccctccagacactctctttgccggatgaactcatttgctaactccagaaacacctgcagacatcctagctggccagcggtttaacggatagatctgggaatggatagatatgggaatgcagctgttcagcccaggattgcctcgtgttcgcactttatgcatacttcctggtctgataggaggaggtttgcgaagaaataaactggtgacagatgccacaaagaggcacccttgaaaccctaacagcaagaaagagaaagatctgaactatttccagatgttgttaacccgagactggacgattacggacaacctgatgacattatcgcctctagaaagggctgctgtcatagcgatcgatttataagtgtcccacggtggatgctcctttttcctggtcctacaacctgttctttttgaaggtcattgctaaattgatgctctcttgtcgaagacgaccccagcctgtatgctccatttttacttcttacttggggatcctaattatccagagaataaaactcaccaggtagtttgggttgttttttctggtactgaaaatttgaagttaaatgagagggacaggaagcgtcctggtaatttagcttctgctaactctgtgggaagagcaaagcctagcggtatgcgataaccatgcatacggtgagcagttcgagagggagatgtggttggaagtgcagacagccccctttcatcatgttccctttagctgttcttcgttcatggctaagaacagcatgttgtactcttaaaagatatggaaataaaaagacctcaaagctatcgagttctcccacattgtctgctctgccagcctcgctttagccgtcttgatccttgagagcaactggttggaagtgcatccagtggtgtggaatttcctagaactgtgggaggtttctcctgcaggatgcaggtgccgcttcccccagaactctgtacgaaacacccattttacggaagttagccatcctagttttcgctgctacttccccatctttcgaacctctttaatttccttgttagaatcccacaagcagcacagacccgagagtgttttatttcatcgtgttcagccatgcagactttccaagcaaagaagttgatacttctttcttctttcgggaaagtgtccaggaagaactgtcattcctccccccatggctctgttttgttttatttcccaccttctaacttacaacgtcatttccttatttattatgtttattgtcttgtagcctatgatgtctagagtgttaaacacaacgaaggcagggatttgtacgtttttgatccatgcagcatgttcccagcacctaagctaacatacagtaagcaacggcttaccaaacacatgttcaataaactcagtctcctctgtaaaa

SEQ ID NO: 1734 - DNA, 2756 bp, Rattus norvegicus
  Genbank Accession No. NM_019377
cgggccgggtagccactgccgctggccgccgccactgcatctactgtcgccgccaccgccgctgccgccagcatcgcctgaggagtgagtccgggaaggacgtagtcgctgcccttcgatcttcccggaagcgcctttgctccctacagtcctccgcgaaaatgaccatggacaaaagtgagctggtacagaaagccaaacttgctgagcaagctgagcgttatgatgatatggccgcagctatgaaggctgtaacagagcagggacatgaactctccaatgaagagaggaatctactctctgttgcctacaagaatgtggtaggtgcccgccgttcttcctggcgagtcatctccagcatcgaacagaaaacagagaggaatgagaagaagcagcagatgggcaaggagtaccgtgagaagatagaggccgagctgcaggacatctgcagtgacgttctggagctgttggacaaatatctcattctcaatgctacccatgcagaaagcaaagtgttctacttaaaaatgaaaggagactattttaggtatctttctgaagttgcatctggagataataaacaaaccactgtgtcaaactcccagcaggcgtaccaagaagcatttgaaatcagcaagaaagaaatgcagcctacacacccgattcgccttggcctggctctgaatttctcagtcttttactatgagattctaaactctcctgaaaaggcctgtagcctggccaaaacggcgtttgatgaagccattgctgagttggacaccctgaatgaagagtcttacaaagacagcaccctgatcatgcagctgctaagggacaatctcaccctgtggacgtcagaaaaccagggggatgaaggagatgctggagagggagagaactaatgtctattgagctctgtgatctgtttggtgtcactgtatcctccacattatgtccctttgtgcgataaacaaaaacaaaaaaaatccaatgtggactttcgatctttcacagcctaagccttgcagaaacggtccctgggatgaacagctggtatttgtatctaaaactcagactggtcccttaaatgccatggtattttgaagtcttgatttgatcaacattgacaaggattactgtgtgtttaatttttacaaactgaacactgtgattacagggctttataacttagcagagctcttcctggtaggaaaaattgacctgaattatgtgtaactttttggaaagtttaatctgatatcaaaatggtcactgaaatacaattctgttgtaaagttgtacagaaagttctagagattctcttgtgatgctgggacttgggcgagatgcttacccttggcatcctgagtgtggtaactcacagtaattctgcctgtggttgagggcctgttaacccttgatcactttgggctgttaccactcaaaagttcatgaccgcaaatatctgcagtgtcttctgaggaaattcaaaacctgaaactgaacttctttggctgataattgggctgtaacaccacaaaaaggtcccgtgttcataccacatgtgtgactaaacctttttattatagcaacgtgttcctgattagctccatgtgaaaacggggctgttaccccctatctgaaggagaggggaaagagagagaaagtagtgtatcatataaacggccataccagttttttggatgattcttcaatgttctgtggatgcggcctcttgcctgaggagcattcctagccttggggtgggagctgtgacacgtaacattcttctcaccctgtccttttgacttttgactttttcctctttaaatgtacagctttctgcttccttgggtggttttcttgggaagcctttattagtcagtactgtgtggacagggcggggcattgagcacatggtgagagctgtgctttaaaggttgagaaagaccttccagcaccacaccctgtctccctccaggtctcagcacagttgttcttcatagtatgacccaaatcgggaaaaaataaaggacttttaagtatttgtgatttcccccattgcacccagccctgacagtgctttgtctgtgcctgtgacagaccctcccctccagtggactcatccagcttcgtcctcagacacgcctcaagaagacttagaacacagggaagttgcatggacactacagtagagagaaccaagaacagccaggccttcagtctcacagtatcacccctctaccttgacattccgtgtacccatagctgtagagttcatccgtttgtccatctgctgaaatatgaaaagaattcatgcactgatttaaacaaaaacaaaaaacccacaaaaaaatttcttctttctagctgaacagaaaacgtgcagttaatactcggcgcttgacaagcagcagcgagtgtggaccaagcctgtctgtatctggtagctcttcgctctgttttctttccttaccagtattctgcctaatgtttgcttccgtggtggttctttgcctagcaagcacacctgtggttgtgaaaatagtatagcaaaaagaaaaagaccccctccccacccccagttactgatgtgctagatccgtgtatgtcttttaaacattctagtttctccttacacagagtaatcaggacgatgtaaaaactcaaaactgaaataaaacatcttatcagttaaaaaaaaaaaaaaaaaaaaaaaaaaaaaaaaaaaaaaaaaaaaaaaaaaaaaaaaaaaa

SEQ ID NO: 1735 - DNA, 940 bp, Rattus norvegicus
  Genbank Accession No. NM_019381
ccgaggtgagaagccccgagcttggcctggctcccccgccccacggagcagccccactctgatctgattggttacctgtggacagcggaggctgcgctgaacagacttggagccatgaatatatttgatcggaagatcaactttgatgccctcttaaaattttcccacataactccctccacacagcagcacctaaagaaggtctatgccagttttgcactgtgcatgtttgtggcagcagcaggggcctatgtccatgtggtcacacgtttcatccaggctggcctgctctctgccctgggcgccctggccttgatgatttgcctgatggccacacctcacagccatgagacggagcagaagaggctgggactgctcgccgtcgccttccttacaggagttggcctgggacctgccctggagctgtgcattgccatcaaccccagcatcctccccacggccttcatgggcacggccatgatcttcacctgcttcagcctgagtgccctctacgccaggcgccggagttacctctttttgggaggtatcttgatgtcagccatgagcctcatgttcgtgtcctctctggggaaccttttctttggatccatttggctgttccaggcaaacctgtacatggggctgctggtcatgtgcggctttgtcctcttcgacactcagctcattattgaaaaggctgaacacggagacaaggattacatctggcactgcattgacctcttcttggacttcgttacactcttcaggaagctcatgctgatcttggccttcaatgagaaggacaaaaagaaagagaagaagtgacgtggtgatcgatcggcctctcccagctcgccttctctccctcagccccgtttctttgcacacatcacaggtgtcgtgtcccatgaaatgaaaagcatcagaaaaaaaaaaaaaa

SEQ ID NO: 1736 - DNA, 2786 bp, Rattus norvegicus
  Genbank Accession No. NM_019622
tgccgagggtgacaccatggccctggaacaggcgatgcaggcggcacggcggggcgacctggacgtgctgaggtccctgcacgccgccggcctgctggggccttctctgcgcgacccgctagacgccctgccggtgcaccatgcggcccgctcaggcaagctgcactgtttgcgctacttggtggaggaggttgccctcccagctgtgtcccgcgcgcgcaacggcgccacaccagcccatgatgccgctgccacgggctacctctcttgcctgcagtggctgctcacacagggtggctgcagggtgcaggaaaaagataactctggtgccacggtcctgcacctggctgcccgctttggccacccggacgtggtgaactggctgctgtaccagggcggtgcgaactctgccatcaccacagacacgggcgccctgcctatccactatgctgccgccaaaggagatctcccctccatgaagcttcttgtcgggcactaccctgagggagtgaatgcccaaaccaacaacggtgccacgcccctgtacctggcgtgccaggagggccacctggaagtgacgaagtaccttgtgcaggagtgcagtgcagatccgcacctgcgcgcccaagacggcatgacccccctgcatgccgcggcgcagatgggccacaacccagtcctggtgtggctggtgagctttgcggacgtgagcttcgagcaggaccacgacggcgccacagccatgcactttgcagccagccgcggccacaccaaagtgctcagctggctcctgctgcacggcgcagagatctcccaggacctgtggggcgggaccccgctgcatgatgctgctgagaacggggaactggagtgctgccagatcctcgcggtgaatggtgcggggctggacgtccgcgaccacgatgggtatacggctgcggacctggctgatttcaatggccacacccactgctcccgctacctacgtacggtgcaaaccctgagcttggaacaccgagtcctgtcccgggatccatccatggacctggaggcaaagcagccggactcaggcatgtcttcacccaacaccaccatgtcggtccagccgccgaactttgaccttggctcacccaccagcaccctctccaactatgactcctgctcctccagccattccagcagcaagggtcagcgctctactcgaggtgccagatcctcagacttacagagctacatggacatgctgaacccagagcctcggagcaagcaagggaagccttcatctctaccaccaccgccaccaccaagcttccctccaccaccacccccaggcacacagctgcccccacctccaccaggctacccagctcccaatccccctgtggggctgcatttggataacatttacatgcagaccaagaacaaactccgccacgtggaggtggactccctcaagaaggagccgagctccggcgacggctactcggggctacgcaggcaggattccgggctgctcaggcaggattcggagctgctgctcaggcacaacaccggactgcgcaggcaggactccgaccgcaaacagcgttcattcagtaaacagcccagcacgggggactactaccgccagctgggccgcagcccgggggagccgctggccgcacgcccgggcatggcccacagcgaggaggcggcgctgctccccgggaaccacgtgcacaacggctgctccgcggactccaaagcgtccagggagctgccgccgccaccgccgccgccgcccctgcccgaggccctgagttcgccgccacccgccccacctctgcccatcgagggcgcgggcgcagcctgcggacagcggcgttcctcatcttctactggcagcaccaaatctttcaacatgatgtccccaacgggtgacaactcggagttgctggctgaaataaaagcaggcaagagtctgaaaccaacaccgcagagcaaggggctgacaacagtgttctcaggcagcgggcagccagcctcccagcctgagtcaccacagcctgcggtgtcacctgggccatctcgggcccggagccccaccccaccagcctctgggcctcagccactgctcaatggcagcatagtaccggcaccacctgccaccctagcaccaggagtgcatctggatgtggaggccctcatccccacacttgatgagcagggccggcccatcccggagtggaagcgccaggtgatggtccggaagctgcagcagaaaatgcaggaggaagaggagcagcggaggaaggaagaagaggaggaggcccggctggccagcctgcccgcctggagacgagacattcttaggaagaagctggaggaggagagggagcagaagcgaaaagaggaggagcggcagaagctggaggaaatccagagggcgaaagaacagtcggagaagctgcggacactaggatacgacgaggccaagctcgcgccctggcagcgacaggtcatcttgaagaagggggagatccctaagtaataggagtctcggcctcttgcgtgtagcctcacgagctctgagaaatggggagcggcccccagcccccgccccatcctgtcaggttggtgcggaagggtgggagccttgagcccttcccttcggtgcctgccggaatcttccctattcccctccctggccccacatccccaaccctgctgctggagtgctctcgcgaacccctgctgtcgcctggaaaaaaaaagtgcccaggctgctgacgcaaaaaaaaaaaaaa

SEQ ID NO: 1737 - DNA, 1977 bp, Rattus norvegicus
  Genbank Accession No. NM_019623
gtcctcctctgggacagggaaggatgtcacagctgagcctctcctggctgggactggggcctgaggtggccttcccatggcagaccctgctactgtttggagcctcctggatcctggcccaaattctgacccagatctacgctgcctataggaactttcgtcgcctccgtggcttccctcagccccccaaacggaactggcttatgggtcatgtgggcatggtcactcctacagagcagggcttgaaggaattgactcggttggtgggtacctacccccaaggctttttgatgtggattgggccaatggtccccgttattactctgtgccactctgacatcgtccgatctatcctcaatgcctcagctgccgttgcgctcaaggatgtgatattctacaccatcctcaagccttggctgggggatgggctcctggtgagtgctggtgacaagtggagccgccaccgccgcatgctgacacctgccttccacttcaacatcctgaaaccctatgtgaagattttcaacgacagcaccaacatcatgcacgccaagtggaaacggttgatttcagaaggcagttcccgtctggacatgtttgagcacgtcagcctcatgactctggacagtctgcagaaatgtgtcttcagctttgacagcaactgccaggagaagtccagtgaatatattgctgccatcctggagctcagtgccctagtggccaaaaggcaccagcagcctttgctgttcatggacctgctgtacaatctcacccctgatgggatgcgcttccataaggcctgcaacctggtgcatgaattcactgatgccgtcatccgggagcggcgccgcaccctcccagatcagggtttggatgagtttctcaagtctaaggccaagtccaagactttggatttcattgatgtgctgctcctgaccaaggatgaagatggaaaggagctgtcggatgaggacatcagagcagaggccgacaccttcatgtttgagggccatgacaccacagccagtgggctctcctggattctatacaacctggcgaacgacccagagtaccaggagcgctgccggcaggaagttcaggagcttctgagggaccgagatcctgaggagattgaatgggacgacctggcccagctgcccttcctgaccatgtgcatcaaggagagtctgcggctgcaccccccagtcacggtcatctcccgatgctgcacccaggacattctgctcccagatggcaggaccattcccaaaggtatcatctgccttatcagtatctttggaattcatcacaacccgtctgtgtggccggaccctgaggtctacaaccccttccgctttgaccctgaaaacatcaaagacagctcacctctggcatttattcccttctcggcggggcccaggaactgcataggtcagactttcgccatgagcgagatgaaggtggcgctggcactaacactgctgcgcttccgactcctaccggacgacaaggaaccgcgcaggcagccagagctgatcctgcgtgccgagggcggactgtggctgcgggtggagccgctgacggcgggcgcgcagtgacctcacagttggtctggagcacccccaccatcctacctctgaggatcccagaatgaacagaactgtcacccataccagaatcttacggagggccagcagggggcgctgtgaatccagtgagtgggtgagagaggccagttagtgtctgagccaaagacctttgacttcgtctaactgatcgccagcctttatcataaggtgcattcttctccaaccaacctggactattctctggacaataggaagccaaagaaacgtctgagcaagagaccagaatgaaacgcaaatttgagctcttattctcgcagcaaatcccttattcagctccatttccattattttgacctacattcaaatcatctaataaatacattctctc

SEQ ID NO: 1738 - DNA, 519 bp, Rattus norvegicus
  Genbank Accession No. NM_019904
ggtggagcaggtcgcaggaatctcttcgcttcaatcatggcctgtggtctggtcgccagcaacctgaatctcaaacctggggaatgtctcaaagttcggggagagctggccccggacgccaagagctttgtgttgaacctggggaaagacagcaacaacctgtgcctacacttcaacccccgcttcaacgcccacggagatgccaacaccattgtgtgtaacagcaaggacgatgggacctggggaacagaacaacgggagactgccttccctttccagcctgggagcatcacggaggtgtgcatcacctttgaccaggctgacctgaccatcaagctgccagacgggcatgaattcaaattccccaaccgcctcaacatggaggccatcaactacatggcggcggatggtgacttcaagattaagtgtgtggcctttgagtgaagccagccagccccagcccgtagcccccaataaaggcagctgcctctgctccctgtaacccaaaaaaaaaaaaaa

SEQ ID NO: 1739 - DNA, 1395 bp, Rattus norvegicus
  Genbank Accession No. NM_019905
aggctctctgcaataggtgcccggcccagcttttttttcaaaatgtctactgtccacgaaatcctgtgcaagctcagcttggagggtgatcattctacacccccaagtgcctatgggtcggtcaaaccctacaccaacttcgacgctgagagggatgctttgaacattgaaacagcaatcaagaccaaaggcgtggacgaggtcaccattgtcaacattctgactaaccgcagcaatgcacagaggcaggacattgccttcgcctaccagaggaggaccaaaaaggaactgccatcggcgatgaagtcggccttgtctggtcacctggagaccgtgatgttaggcctgttgaagacacctgctcagtacgatgcctctgagctcaaagcctccatgaagggcctggggactgatgaggactccctcatcgagatcatctgctcaagaaccaaccaggagctgcaggagattaaccgagtgtataaggaaatgtacaagaccgatctggagaaggacatcatctctgacacatctggagaattccgaaagctgttggtcgcccttgcaaagggtaaacgggcagaggatggttctgttattgactacgagctgattgaccaggatgcccgggagctctatgatgctggggtgaagaggaaaggaaccgatgtccccaagtggatcagcatcatgactgagcgcagtgtgtgccacctccagaaagtgttcgaaaggtacaagagctacagtccttatgacatgctggagagcatcaggaaagaggtcaaaggagacctggagaacgccttcctgaacctggttcagtgcattcagaacaagcccctgtactttgctgaccggctgtatgactccatgaagggcaaggggactcgagacaaggtcctgattagaatcatggtctctcgcagtgaagtggacatgttgaaaatcagatctgaattcaagaggaaatatggcaaatccctgtactacttcatccagcaagacactaagggtgactaccagaaggcgctgctgtacctgtgtggtggggacgactgaagggcttggcatggtggattgcccagaagtggccctacctgtgccccaacctaatgttctagagaatcagcctgccactaatggacccctgaactcctccctgtgaagatgacgacagagctgccgacccatcccccatcttagctgcctttgcctggctttcccctcattctctcctttatgccaaagaaatgaacattccagggagttggacgtaccgtctgtgacatgagacacttcctcatatgtgtcgtgaataaaccatttttactttaaaaaaaaaaaaaaaaaaaaaaaaaaaaaaaaaaaaaaaaaaaaaaaaaaaaaaaaaaa

SEQ ID NO: 1740 - DNA, 858 bp, Rattus norvegicus
  Genbank Accession No. NM_019908
atgaaggtcgacttgggcccggacccttccctggtctatcgacctgatgtggacccagagatggccaaaagcaagggcagcttccgaaactacacttcaggcccgctgctggatcgcgtctttaccacctataagctgatgcacactcaccagaccgtggacttcgtcatgcggaagcgcatccagtttggaagcttctcttacaagaagatgacggtcatggaggctgtagatatgctggatgatctggtggacgaatctgacccagacgtagacttccccaactcctttcacgcgttccagaccgcggagggcatccgaaaagcccacccagacaaggactggttccatctggttggacttttgcatgatctggggaaaatcctggccctgtggggggaacctcagtgggctgttgttggagacactttccccgtgggctgccgtccccaggcctccgtggtgttctgcgactctactttccaggacaatcctgacctccaggaccctcgatacagcacagaacttggcatgtaccagccccactgtggacttgagaatgtccttatgtcctggggccatgatgagtacctataccagatgatgaagttcaacaagttctccctaccttcagaggccttctacatggtccgattccattccttctatccgtggcacaccggcggtgactaccggcagctgtgcagtcagcaagacctggatatgctgccttgggtgcaagagttcaacaagtttgacctctataccaagtgccctgacctaccggaagtgaagagcctgcggccctactatcaggggctgattgacaagtactgcccgggcaccctgagctggtga

SEQ ID NO: 1741 - DNA, 2065 bp, Rattus norvegicus
  Genbank Accession No. NM_020073
ggcgggggccgcggcggcgagctcggaggccggcggcggctgccccgagggacgcggccctaggcggtggcgatgggggccgcccggatcgcacccagcctggcgctcctactctgctgcccagtgctcagctccgcatatgcgctggtggatgcggacgatgtctttaccaaagaggaacagattttcctgctgcaccgtgcccaggcgcaatgtgacaagctgctcaaggaagttctgcacacagcagccaacataatggagtcagacaagggctggacaccagcatctacgtcagggaagcccaggaaagagaaggcatcgggaaagttctaccctgagtctaaagagaacaaggacgtgcccaccggcagcaggcgcagagggcgtccctgtctgcccgagtgggacaacatcgtttgctggccattaggggcaccaggtgaagtggtggcagtaccttgtcccgattacatttatgacttcaatcacaaaggccatgcctacagacgctgtgaccgcaatggcagctgggaggtggttccagggcacaaccggacgtgggccaactacagcgagtgcctcaagttcatgaccaatgagacgcgggaacgggaggtatttgaccgcctaggcatgatctacaccgtgggatactccatgtctctcgcctccctcacggtggctgtgctcatcctggcctattttaggcggctgcactgcacgcgcaactacatccacatgcacatgttcctgtcgtttatgctgcgcgccgcgagcatcttcgtgaaggacgctgtgctctactctggcttcacgctggatgaggccgagcgcctcacagaggaagagttgcacatcatcgcgcaggtgccacctccgccggccgctgccgccgtaggctacgctggctgccgcgtggcggtgaccttcttcctctacttcctggctaccaactactactggattctggtggaggggctgtacttgcacagcctcatcttcatggcctttttctcagagaagaagtacctgtggggcttcaccatctttggctggggtctaccggctgtcttcgtggctgtgtgggtcggtgtcagagcaaccttggccaacactgggtgctgggatctgagctccgggcacaagaagtggatcatccaggtgcccatcctggcatctgttgtgctcaacttcatcctttttatcaacatcatccgggtgcttgccactaagcttcgggagaccaatgcgggccggtgtgacaccaggcagcagtaccggaagctgctcaggtccacgttggtgctcgtgccgctctttggtgtccactacaccgtcttcatggccttgccgtacaccgaggtctcagggacattgtggcagatccagatgcattatgagatgctcttcaactccttccagggattttttgttgccatcatatactgtttctgcaatggtgaggtgcaggcagagattaggaagtcatggagccgctggacactggcgttggacttcaagcgcaaagcacgaagtgggagtagcagctacagctatggcccaatggtgtctcacacgagtgtgaccaatgtgggcccccgtgcaggactcagcctccccctcagcccccgcctgcctcctgccactaccaatggccactcccagctgcctggccatgccaagccaggggctccagccactgagactgaaaccctaccagtcactatggcggttcccaaggacgatggattccttaacggctcctgctcaggcctggatgaggaggcctccgggtctgcgcggccgcctccattgttgcaggaagaatgggaaacagtcatgtgactgggcactagggggctagactgctggcctgggcacatggacagatggaccaagaagccagtgtttggctggttgtctatcgggactggaccaggaagataaccaaaggaaaatggaagtggacgaagcagagaagaaggaagaggttttgcaggaattaaatatgtttcctcagttggatgatgaggacacaaggaaggcctattataaggaattc

SEQ ID NO: 1742 - DNA, 3504 bp, Rattus norvegicus
  Genbank Accession No. NM_020075
ctctgcttttctctttcagagctgttgcgcagccattggtacctgtattggggaaacatagcatacaagcaagaagcttacagcctcagtggcgaaaaatttttcatgtcagagaccgagaactcttgcagtcgtttatgtcatcccttcttctccagacagaagataccaaaaagttgcaatcaaagatctgttcatcttattgataaagtcactaataagccaaaatgtctgtcaacgtcaaccgcagcgtgtcagaccagttctatcgctacaagatgccccgtttgattgctaaggttgagggcaaaggaaatggaatcaagacagttatagtcaacatggttgacgttgcaaaggcgcttaatcggcctccaacgtatcccaccaaatattttggttgtgagctgggagcacagacccagtttgatgttaagaatgaccgttacattgtcaatggatctcatgaggcgaataagctgcaagacatgttggatggattcattaaaaaatttgttctctgtcctgagtgtgagaatcctgaaacagatctgcatgtcaatccaaagaagcaaacaataggtaattcttgtaaagcctgtgggtaccgaggcatgcttgacacacatcataaactctgtacattcattctcaaaaacccacctgagaatagtgacattggtacaggaaagaaagagaaagaaaagaaaaatagaaagggcaaggacaaggaaaatggctctgtatccaccagtgagacaccaccacctccaccaccaaatgaaattagtcctccacatgctgtggaagaagaggaagatgatgattggggggaggatacaactgaggaagctcaaaggcgcagaatggatgaaatcagtgaccatgcaaaaggtctgacacttagcgatgatttggaaagaactgtagaagagcgtgttaacatcctgtttgattttgttaagaaaaagaaagaagagggcattattgattcatctgataaagacattgtggctgaggcagaaagactggatgtaaaagccatgggccctctcgttttgacagaagttctctttgatgagaagataagagagcaaatcaagaaatacaggcgccattttttaagattttgtcataacaacaaaaaggcccagcggtaccttcttcatggtttggaatgtgtggtagcaatgcatcaagctcagttgatctccaagattccacatatcttgaaggagatgtatgatgcagaccttttagaggaagaggtcattatcagctggtcagaaaaggcctctaagaaatatgtctcaaaagaacttgccaaagagattcgtgtcaaagcagagccatttattaaatggttgaaggaagcggaggaggaatcttctggtggtgaggaagaagacgaagatgaaaatattgaggtggtatattcgaagactgccagtgtaccaaaagttgaaactgtgaagtctgacaacaaggatgacgacattgatattgatgccatttaaaaggatggatgcaacttagcttaacagtgtaatgctgcaaatttttctccattatcagccagaagtgcaacatgtatgtgcaagagctaaagtggcttaacatcatgctacacttgatactaaaaagctattactgtgagtggtctataattaagcccaatgagacatctagggagtccatacatatcagtgagcagttgtagtttgcttatttatagcatgtttctttcggaaaaactagtggtggacacatttggatcacatttatacagttataaaaaataaagatttgattttggtcattcttcagactttgggctatgaatggcttatgctgaagtaattggctacttttaggatgttacaccatttaataacttagacttcttaagtttggtagattgttaggtactgaagacttgaagaatgcaaacaattataatgaccttactcagccattaagaaatgaagtattttgaaagttgtgtctccagtccattgagattggcaactgacaattcttgtcattctaaggaaatttgatgatttaatgacagtgtgacatcctcatgagaagtaaaaatgacctgtgtgtcctatggtttaagagcaaattttgaaacttggagttgtggtttttcagtttgtgtacactcaccccaaattgtagtctattgagtcatgtgcattgcacgttggataagccagggaaatgacaaataagtattttgtgtgtatttagtggttgctttgtactgagagaaaagctttgaggtgtgattaaatcgtaaactctgattctatttgggagaaacaggaaaaaggtgcacttaatctaaaacagcataagttttcaacttttacccttaaattataatttcaagatgtttagacatactgtatcttgtgtttgatgtgttccccctccctaatattatggtttattctttaatgccttttaatttggatataatagcttgtactttagattttggttgctatcttgccaaaataagtgttactgtttttcaagcttgatccccttccctgattgtcttatttaaagagaaagttaaactcatacttctgagtcagagcctgtattttggttaagacttgggatattttttacttcacattgaatatagctggatacctgagaagtctggtgatggcactgggtgggtgcagctagctaaggcctgaccagcccattcagagccttggacttcagacacaaaagtgagtttcttacccacttgctggtgtaaactctatctggggtcctgactatatttgaatacttgtcttcaatattaaaaaacatagcacatttttctttctacaaaagtacattctggagttaagaacccatgtggttgatttgtgtgtggcgtgctagctcatacattatttggatcttattctttgtgtcatccatctcacagattataagactttgattaatgtaaaaagtatgcgttaaaatcataccaaacatttggtaaaattaaaaccttgatgggaggctgggcgtggaacaggagccatatacctggaatggtaacaggggaatgtgctatgtcacaccaaagaagtgggacttggaaagtcacttgtctcctgggtttcagactctttgttgcatgggcagcccatccatatgtcattactttttgagattctcaagtagatcagcacatttcggcctcaggttggcaagattttgtcttagagctgttgctttaaagggaaatggtcaggtcttagacacttaggaaggtcttgggcttctgttcattctggtgccaaaccagtgggattcaaatttcacacaatctgggtttttattcatggaggttaacctggtaagagtaatccttcatggctctattgaggtgtcttaaaaagtttcctgtttcaaacagctacattacttgattaaaacaatgttataaaattaaatttccccctcctttcatattaa

SEQ ID NO: 1743 - DNA, 1254 bp, Rattus norvegicus
  Genbank Accession No. NM_020076
cccgacaggagacagagcacattgtagctctccaactgccggattacctggcgaccacgttgtggtcagaagagtcctgcctgccggccatggagcgctgtgtgagagtgaagtcttgggtagaagagaatcgggcctcctttcagcctccggtttgcaacaagcttatgcaccgggagcagctcaaaatcatgttcgtcggaggccccaacaccaggaaggattatcacattgaagagggagaggaggtgttttaccagctggagggagacatggtgctccgagtcctcgagcaaggagaacaccgggatgtggttatacgacagggagagatattcctcctgcctgccagggtgccccactccccgcagaggtttgccaacaccatgggcctggtgattgagagaaggcgaatggagaccgagctggatgggctgaggtactatgtgggcgacactgaggatgtcctcttcgagaaatggttccactgtaaggaccttgggacgcagttagcccccatcatccaagagttcttccactctgagcagtaccgaacaggaaagcccaaccctgaccaactgctcaaggagccgccattcccgctgagtacacggtccgtaatggagcccatgtcactgaaggcctggctggagagccactccagggagcttcaggcaggcacatccctaagcctgtttggggacagctatgagactcaggtcatcgcccacggacaaggcagcagcaaaggcccgagacaggatgtagatgtgtggctgtggcaactggagggctcctctaaggtgacaatgggaggacagtgtgtggccctggccccagatgacagcctgctggtgcccgctgggttctcgtacatgtgggagcgagcgcaaggctctgtggccttgtctgtgacacaagaccctgcctgtaagaagccactggggtgacccttctgtgtgggcccaaagcagccacagggtgcctgagtgctgtcctgacagctgccctttccagacagctctttcagcctcatgacatctccgtggacattgacagggcccctccgtgatcgtgggctgtcactggcatccaccctgctgtcatgcttagctcaggatgcagaggggattcctaggacaccagtagttcccctctctcctaacagccctacactgtcagcgaggtgcataccgtcctcatgcgcctgtcagcctaacactaagaaatctctcaataaaggcctcctgctgg

SEQ ID NO: 1744 - DNA, 1181 bp, Rattus norvegicus
  Genbank Accession No. NM_020976
aaagaatgctgtgggcactctttttcctggtgactactattcacgctgaactctgccgtccagatgcagaaaatgcctttaaagtaagacttagcatcaaagcagctcttggagataaagcgtatgtctgggacacagatgaagaatatctcttcagagcaatggtggcattctccatgagaaaagttcccaacagagaaggaacagaaatttcccacgtcctgctttgcaatgtaacccagagagtgtcattttggtttgtggtcacagaccctttgaaaaaccatacttttcctgcagttgaagtacagtcagccataagaatgaacaggaaacggatcaacagtgcattctttttggatgatcatactctggaatttttaaaaattccttccactcttgctcccccgatggatccatctgtgcccgtctggattattgtatttggtgtgatattttgcattgttacagttgcaattgcactactggttttatccggaatccggcaacgaagaaggaacaagaaaggaccacctggagtggaggatgcagaagacaagtgtgaaaacatcatcacaattgaaaatggcatcccttgtgatcccttggacatgaagagagggcacattaatgatggcttcttgacagaggatgagcgtctcacccctctctgagagttacagtcttgtaagaaaatttcaagatgcttgaatgtgatagacaacaatagaccactgaaatcataaggagttagttggcttctcaaaatattcgagaattttctttttgataaccaaatatgtaaatgtagttacacatgtttgtagttactgatttgagcatctttagaaattaagtcagggctataactatatttcatattttgaagacctaaggaaaaattcttaccactggagaatgactatagcatggcacagaaataattaaaaatggatctttttgaatactgtttatattagtctgtacatgatgaagcaaggaaaagtaaacatgagatggatgaaaatggtaatggaattttattctgttctcacacaaacagctgcttgtatattttatacatattagcctttagtagggcaagaggatctttttgttgtttgctattgcaatttgttcaagtcctatctacgctgatataataaaattaggatcatctc

SEQ ID NO: 1745 - DNA, 539 bp, Rattus norvegicus
  Genbank Accession No. NM_021261
cctcggcctccgggctgcgggaacgcccggactgggaacgccacgtcgagaggcgttcgcggaaggcgcgggatccaggacgtgctggtcacccccaaaccccaggccacccattatcgccttggttcgcccatcagagttgtaagaaaatggcagacaagccggacatgggggaaatcgccagcttcgataaggccaagctgaagaaaaccgagacgcaggagaagaacaccctgccgaccaaagagaccattgaacaggaaaagaggagtgaaatctcctaaaagcctaggaagatttccccaccccaccccttcatctccaagaaccccctcgtgatgtggaggaagagccacctgcaagatggacgcgagccacaagctgcactgtgaacccggcactccgcgccgatgccaccggcccgtgggtctctgaaggggacccccccactaatcggactgccaaatttcaccggtttgcccagggatattatagaaaattatttgtatgattgatgaaaataaaacacacctcgtggc

SEQ ID NO: 1746 - DNA, 348 bp, Rattus norvegicus
  Genbank Accession No. NM_021264
tatgtctggaaggctgtggtgcaaggccatttttgctggctacaagcgaggcctccggaaccaaagagagcacacggctcttcttaaaattgaaggtgtttatgcccgagatgaaactgagttctacttaggcaagaggtgtgcttatgtgtacaaagcaaaaaacaatacagtgactcctggaggcaaaccaaacaaaaccagagtgatctggggaaaagtaactcgggcccatggaaacagtggcatggttcgtgccaaattccgaagcaaccttcctgcaaaggccattggacacagaatccgtgtgatgctgtacccatcccggatttaaactaatggagagta

SEQ ID NO: 1747 - DNA, 1585 bp, Rattus norvegicus
  Genbank Accession No. NM_021578
accgcctcccgcaaagacttcaccccaaagctggggcgcaccccttgcacgccaccctccccccagcctgcttcttgagtcccccgcatcccaggaccctctctcctctgggaggccgatctccctcggacctgctggcaatagcttcctatttaagaacaccccacttttgggtcccagagagcgctcatctcgatttttatcccggtggcatactgagacactctggtgtcagagcgtcaccgcgactcctgctgctttctccctcaacctcaaattattcaggactatcacctacctttccttgggagaccccaccccaccccacaagccctgcaggggcggggcctccgcatcccacctttgcccggggttcgcgctctccgaagttccgtggggcgccgcctcccccatgccgccctcggggctgcggctgctgccgcttctgctcccactcccgtggcttctagtgctgacgcccgggaggccagccgcgggactctccacctgcaagaccatcgacatggagctggtgaaacggaagcgcatcgaagccatccgtggccagatcctgtccaaactaaggctcgccagtcccccgagccagggggaggtaccgccgggcccgctgcccgaggcggtgctcgctttgtacaacagcacccgcgaccgggtggcaggcgagagcgctgacccggagcccgagcccgaggcggactactacgccaaagaagtcacccgcgtgctaatggtggaccgcaacaacgcaatctatgacaaaaccaaagacatcacacacagtatatatatgttcttcaatacgtcagacattcgggaagcagtgccagaacccccattgctgtcccgtgcagagctgcgcctgcagagattcaagtcaactgtggagcaacacgtagaactctaccagaaatatagcaacaattcctggcgttaccttggtaaccggctgctgacccccactgatacgcctgagtggctgtcttttgacgtcactggagttgtccggcagtggctgaaccaaggagacggaatacagggctttcgcttcagtgctcactgctcttgtgacagcaaagataatgtactccacgtggaaatcaatgggatcagtcccaaacgtcgaggtgacctgggcaccatccatgacatgaaccgacccttcctgctcctcatggccacccccctggaaagggctcaacacctgcacagctccaggcaccggagagccctggataccaactactgcttcagctccacagagaagaactgctgtgtacggcagctgtacattgactttaggaaggacctgggttggaagtggatccacgagcccaagggctaccatgccaacttctgtctggggccctgcccctacatttggagcctggacacacagtacagcaaggtccttgccctctacaaccaacacaacccgggtgcttccgcatcaccgtgctgcgtgccgcaggctttggagccactgcccatcgtctactacgtgggtcgcaagcccaaggtggagcagttgtccaacatgatcgtgcgctcctgcaagtgcagctga

SEQ ID NO: 1748 - DNA, 6244 bp, Rattus norvegicus
  Genbank Accession No. NM_021587
gaggtccatgggcgctcacggtcgtcctcgcccaccctcgcggggtcggcgcccatagcacctcagcagcacccggcgacaccccggctgagccaggggaccctcaccttgagcagcccgcgcccctcccctcctctccaccccagctcccgccccctgctcgcctccgctcccggctggggtccgctgccgctcagccgcccgcaaagctccctccctgcggccacccagttggcctccaccccgcggcgcacaggctctccgcggagtcctcggggataccgagggagtgcgccggggcagggcgagtcgcacggccggagactgcccgcgatggcgggagcctggctcaggtggggactcctgctctgggcagggctgctagcgtggtctgcgcacggccgggtgcggaggatcacgtacgtggtgcgcccgggcccgggactgccggccggaaccctgcctctggctgggcccccgcggaccttcaacgtcgcactggacgccaggtacagccggagctcaacagccacctccagccgctccttggccgggcccccagccgagcggacccggcgcaccagccagcctggcggcgcggccctgcccgggctccgatctccgctgccacccgagcccgcgcgtccgggggcgcccagccggcagctccactcaaaggccggtgctcagaccgcggtcactcgcttcgccaaacatggcaggcaagtcgtgcgctccaaagtgcagcaggacacgcagagctccgggggctccagactgcaggttcagcagaagcagcagctgcaggggatcaatgtctgtggagggcagtgctgccatgggtggagtaaggccccgggctcccagaggtgcaccaaaccaagctgtgttccaccatgccagaatggagggatgtgtctccggcctcagttctgtgtgtgtaagccagggacaaagggcaaagcctgcgagatcacagctgcccaggacaccatgtcaccagtgtttggagggcagaaccctggctcctcgtgggtccctcctgagccagcagcaaagcgtacttcaaccaagaaggcagacaccttaccaagggtcagtccagtggcccagatgaccttgaccctcaagccgaagccgtccatgggactctcccagcagatacattctcaagtggcacccttgtcttcccagaatgtgatgattcggcatggccagacccaggagtatgtgctcaagcccaagtacttcccagccccaaaggtggtctctggagagcagtccacagaaggctctttctctttaagatatgggcaggagcaaggcacagcaccctttcaggtgagtaaccacactggtcgcatcaaggtggtctttactccgagcatctgtaaagtgacctgcaccaagggcaactgtcacaacagctgccagaaggggaataccaccactctcattagtgagaacggccatgcagccgacaccctgacagccacgaacttccgagtggtaatttgccatcttccatgtatgaatggtggccagtgcagttcaagggacaaatgtcagtgccctccaaatttcacaggaaagctttgccagatccctgtccttggtgccagtatgcctaaactctaccagcacgcccagcagccaggcaaggcactggggagtcacgtcatccattccacacataccttgcctctaaccatgaccaaccagcaaggggtcaaagtgaaatttccccccaacatagtcaatatccatgtgaagcatcctcctgaggcttctgtgcagatacaccaggtttccagaattgatggcccagtgggccagagggtgaaagaagtgcaaccgggccagtcccaagtctcttaccaagggctgcccgtccagaagacccagacagtccattccacatactcccaccagcaggtcattccgcatgtgtatcccgtggctgctaagacacaacttggacgatgcttccaggaaaccattgggtcacagtgtggcaaagcgctccctggcctttcaaagcaagaggactgctgtgggacagtggggacctcctggggctttaacaaatgccagaaatgccccaagaagcaatcctatcatggatatactcaaatgatggaatgcctacaaggatataaacgggttaacaacaccttttgtcaagatattaatgaatgtcagctccaaggcgtatgccctaatggggagtgtttgaataccatgggcagctacagatgctcctgcaaaatgggatttgggcctgaccctaccttttcaagttgtgtgccggatccccctatgatctcagaagagaaagggccctgctaccgcctcgtcagtcctgggaggcagtgtatgcaccctctctctgttcacctcaccaagcagatctgctgttgtagtgtgggcaaggcctggggcccacagtgtgagaaatgtcccctcccgggcacagctgcttttaaggaaatctgtcctggtggaatgggttatacggtttctggcattcatagacgcaggccaatccatcagcatataggtaaagaagctgtatttgtcaagccaaagaacactcaacctgttgctaaaagtactcatcctccacctctcccagccaaggaagagcctgtggaggccctgacctcctcgcgggaacatgggccgggagtggcagagcctgaagtggtaacagcacctcctgagaaggaaataccctcactggatcaagagaaaacaagacttgaacctgggcaaccccagctctccccaggggtttcaactattcatctgcacccacagttcccagtagtggttgaaaagacatcccctcctgtgcctgtggaggtggctcctgaaggttctacatcaagtgccagccaagtgattgctcctacgcaagtaacagaaatcaacgaatgtactgtgaacccggatatttgcggagcaggacactgcatcaacctgccggtgaggtatacctgcatatgctacgagggctacaagttcagtgagcagcagaggaagtgcattgacattgatgaatgtgctcaggcccagcatctctgctcccagggtcgctgtgagaacacagagggaagtttcctgtgtatttgcccagcagggtttatagccagtgaggagggttctaactgtatagatgtggatgaatgtctgaggcccgatgtgtgtagggacggccgctgcatcaacactgctggggccttccgatgcgaatactgtgacagtgggtaccggatgtcacgacggggccactgtgaggatatcgatgagtgtctgaccccaagtacctgtcccgaggaacaatgcgtgaattccccaggttcttaccagtgtgtgccctgcacagaagggttccgtggctggaatggacaatgcctcgatgtggacgagtgcctgcagccaaaggtctgtaccaatggttcctgcaccaacctggaaggctcctacatgtgttcctgccacaagggctacagccccacaccagaccatagacactgtcaagatattgatgaatgtcagcaagggaacctgtgcatgaacgggcagtgcaaaaacactgacggctccttccggtgtacctgtgggcagggctatcagctgtcagcggctaaagaccaatgtgaagatattgacgaatgcgagcaccgtcacctctgctctcacgggcagtgcaggaacacagagggctccttccagtgtttgtgcaaccagggttacagagcatctgtgcttggagaccactgcgaggatatcaatgaatgcttggaggacagtagtgtctgccagggaggtgactgcatcaatacagcagggtcctatgactgcacgtgcccggatggactccagctgaatgacaataagggctgtcaagacattaatgaatgtgcacagccaggactctgtgcacctcatggggagtgtctaaacacacaaggctcattccactgtgtctgtgaacaagggttctccatctctgcagatggtcgtacttgtgaagatattgatgagtgtgttaacaacactgtgtgtgacagtcacggcttctgtgacaacacagccggctctttccgctgcctctgttatcagggctttcaagccccacaggatgggcaagggtgtgtggatgtgaacgaatgtgaactgctcagtggtgtatgtggggaggctttctgtgaaaatgtggaagggtccttcctgtgcgtgtgtgccgatgagaaccaggagtacagccccatgactgggcagtgtcgctcccgggctactgaagattcaggtgtggatcgtcagcccaaagaagaaaagaaggagtgttattataatctcaatgatgccagtctctgtgataacgtgctggcccccaacgtcaccaaacaagagtgctgctgtacatcgggcgccggctggggagacaattgtgagatcttcccttgcccagtccaggggactgctgagttctcggaaatgtgccctagaggaaaaggttttgtccctgctggagaatcctcttacgaaaccggtggtgagaactacaaagatgctgacgaatgcctgctgtttggagaggaaatctgcaaaaacggttactgtttgaacactcagcctgggtatgaatgctactgcaaggaagggacatactacgatcctgtcaaattacagtgttttgatatggatgaatgccaagaccctaacagttgtatcgatggccagtgtgttaatacagagggctcttacaactgcttttgcacccacccaatggtcctggatgcctctgagaagagatgtgtgcagccaactgaatcaaatgaacaaatagaagaaaccgatgtctatcaagatctgtgctgggagcatctgagtgaggagtacgtgtgtagccgtcctcttgtaggcaagcagacgacatacacagagtgctgctgtttgtacggggaggcatggggcatgcagtgtgctctctgccccatgaaggactcagatgactatgcccagctgtgcaacatccctgtgacaggacggcggcgaccatatggacgggatgcgttggtggacttcagtgaacagtatggcccagaaacagacccttacttcattcaggatcgctttctaaacagctttgaggagctacaggctgaggaatgtggcatcctcaacggctgtgaaaatggccgctgtgtaagggttcaggaaggttatacttgcgattgctttgatggatatcatctggatatggccaagatgacctgtgttgatgtaaatgaatgcagcgagctgaataatcggatgtctctctgcaagaacgccaagtgcattaacacagaaggctcctacaaatgcgtgtgtctaccaggctacgtaccatctgacaagcccaactactgtacaccactgaacaccgctttgaatttagacaaagacagtgacctggagtgaaggagaagctacgtaacctatgcccatatactctgcactgtgtaaaggaaaagggagagaggtatacttgagacactgcacctaatccagaccatggcaaagaaggaaacaacgtggagttgcgtgaacccccaaagaaagtgagcggatggagtagcagcctgagaggtgcgacagaccaaatggacatttcctcaaaaacccagtatatatagtctgttcatatgtaaaattcaatggaaaagaggcaggatgcggctgtcattttaaacagaggttgtattattatcttgttttgatttttttttttactattgcttaaatttggcttttaaatagtggtgacgatgttttatatgagtcttctctgtgctgtgcagatccccagccaccattttttcttcagcgataatctcaagtgcaaacatctttgataacgtattgttaaactgtattataagtatgacacagggttgtgctgtcccttggtccggagactttgaaaaacaaattgtctgtcctgtggagcaggcagtgactgttaaacttttatctacatttagagtgggtgggaaaacacctttattttcaatgtattatcggattgcctgtcaattggatcccttacttgggtggaaatggaggagtttcttagcatttattagcactgtgttgtgtaaagtcaacccagaaaaatttaaaaacctgaaatccccccctcaaaatatttaccattgtatgttataagaaaataaaatcgccatttttgtag

SEQ ID NO: 1749 - DNA, 1733 bp, Rattus norvegicus
  Genbank Accession No. NM_021593
ccacgcgtccgagctcctacctgagcagaggtattctggcagcaatggcatcgtcggacactgaaggaaaaagagtggttgttatcggtggtggtttggttggagcattgaacgcgtgctttctcgcaaagaggaatttccaagttgatgtgtacgaagctagggaagatattcgagtggctaactttatgcgtggaagaagcattaatttggccctttcttatagaggacggcaggccttgaaggccgttggtctggaagatcagatcgtgtccaaaggtgtgcccatgaaagccagaatgatccactctctctcgggaaagaagtctgcaattccctatgggaacaagtcacagtatatcctttcaataagcagagaaaagttaaacaaggatctgctgactgccgtggagtcctaccccaatgcaaaggtgcactttggccacaagctgtcaaaatgctgtccggaggaagggatactcacgatgcttggacccaacaaagttcccagagacatcacgtgtgacctcattgtaggatgtgatggggcctactcaactgtcagagctcacctcatgaagaagccccgttttgattacagtcagcaatatatccctcatggctatatggagctgacaattccacctaagaacggggagtatgccatggaacctaactgtcttcacatttggcctagaaatgcctttatgatgatcgccctaccgaacatggacaaatctttcacatgcaccttgttcatgtcctttgaggagtttgaaaagcttccaacgcatagtgatgtgctggacttcttccagaagaactttccagatgccatccctctgatgggcgagcaagccctcatgagagatttctttctgttgcctgcccagcccatgatatcagtaaagtgctctcccttccacctgaagtcacgctgtgtgctgatgggagatgcagctcatgccatcgtcccattttttgggcaaggaatgaatgcgggctttgaagactgcttggtatttgatgagttaatggacaaattcaataatgatcttagtgtgtgccttcctgaattctcaagatttaggattcctgatgaccatgcaatttcagacctgtctatgtacaattacatagagatgcgagcgcatgtcaactctaggtggttcctgtttcaaaggctcctggataaatttcttcatgcactaatgccatccactttcatccctctctataccatggtcgccttcaccagaataagataccacgaggcagtgctgcgctggcattggcaaaaaaaggtgataaacagaggactctttgtccttgggtccctggtagccattggaagtgcctacatactcgtgcaccacctgtccccgagacctctggaactcctgagatctgcctggacgggaacctctggccactggaataggagtgcagacatttctccacgagttccatggagtcactaggacaaatgccccagttcactatccatagtgtcaacgttccgggtagcaaatgcttgattcctcttcaatatcaagggagaaactcatgttcccattgccgtcttcagttcactatgggaaaatcattgtcagcatataattaagttcggagtggagggctgtttttacagtgtctcattattttgcatgcttggactgggttcaatttttaaatttaaaaacacaataaccaaaaaaaaaaaaaaaaaaaaa

SEQ ID NO: 1750 - DNA, 2106 bp, Rattus norvegicus
  Genbank Accession No. NM_021653
gctgagatggggctgtcccagctatggctgtggctgaagcggcttgtgatattcctgcaggtagccttggaggtggctacgggcaaggtgctaatgacactgttcccagagagagtcaagcagaacatcctggccatgggccaaaagaccggaatgaccaggaatccccgattcgcccctgacaactgggtccccaccttcttcagcatccagtacttctggttcgtcctgaaggtccgctggcagagactggaagacagggctgagtatggggggctggcccccaactgcaccgtggtccgcctctcaggacagaagtgcaacgtctgggatttcattcaaggcagcagacccctggtgttgaacttcggcagctgcacctgaccttcatttcttctcaaatttgaccagttcaagagactcgtagacgactttgcctccacagctgacttcctcatcatttacattgaagaagctcacgccacagatggatgggcttttaagaacaacgtggacatcaggcagcaccgaagcctccaggaccgcctgcgggcagcacatctgctgctggccaggagcccccagtgtcctgtggtggtggacacaatgcagaaccagagcagccagctctatgcagctctgcctgagaggctctatgtgatacaggaaggcaggatctgctacaagggtaaacctggcccttggaactacaatcctgaggaagtccgagctgttctggaaaagctttgcatcccacctggacacatgcctcagttctagggggccagcaggaaggtcccccaagcttggtactcctccccaccagtacagatgtcctttagctttgaccttcgttcccagatcaattactagctcagatttttctgatctgaacaaataactacccgggaggcaattcagttcacagcacccaaccagcacaaattgttacaaccagagataaagcaataccgagctgttagcaaaagtaagtgtgcagctttgcaccactcccacaggcggagaccaatccagtgtgtgccccttctggtggaagggtactcatgcttggttggctgacttctgaagtgtagtgactcatgatgatgacgtcaaaagctcaatccatttgcccaagtttgccactcatagaatcagttgtttagtaccaagcgacaggcaggcgtatttctacttgtaggaaccaaagacattggaaacacttttctggccctaagattgaaatccgttaatattgttggtgataggtgtttccatggcaacctataatctaattctgctccctctaccatctttgaatagattgcagagaaatctggctctctggtactgacacaaaagctttataactttaactaaaccaaatcacaggcgccagcaaaagctgccattcccctgctgtaactctgttccactggcgcccagtctcttactggtctttcatgttagatggctttggactgacgggtagccatgggttcatctgtcatgtctgcttctttttatatttgtttatgatggtcacagtgtaaagttcacacagctgtgacttgatttttaaaaatgtcgggaagatgcagcaagctaacgattaaaatccgtcaggctatttttgaatggctccggtgtgatccttacaatttcctttctgacttgtgtatgtgggcctgctctgccgtcttttccgatagcccacgtgtaatgtaatcagctaaggcatcgtttgcctggagggaccccgtcctggaggaagaagctcgtatgtggcacgcatccaacatgttgtcctgtgaagtgttgtggaagggacgtggctgttcacgtcacagcaaagcacctttaggggtgatgcgtgaatggacctggggagcattctccaggcatccaaacagttcctccttgctctgccttagggctacacccaatactgtaacattgcatttatgtatggatttaggtgagtcaggatctagctataaagtcgagagtggctgtgaacttacaatcttcagactcagagtagctgggattccaggtctgtccccctatataaaaaatgcttttgacctcttgaaaaaaaaaaaa

SEQ ID NO: 1751 - DNA, 1582 bp, Rattus norvegicus
  Genbank Accession No. NM_021688
gaaagggagcggcggcgggaggcgcggagcgcgggcgccgggaagatgctgcagtccctggccggcagctcgtgcgtgcgcctggtggagcggcaccgctcggcctggtgcttcggcttcctggtgctgggctacctgctctacctggtgttcggcgccgtggtcttctcgtccgtggagctgccttatgaggacctgctgcgccaggagctgcgcaagctgaagcggcgcttcctggaggagcacgagtgcctgtcggagccccagctggagcagttcctgggccgcgtgctggaggccagcaattatggagtgtcggtgctcagcaacgcctcggggaattggaattgggacttcacctcggcgctcttcttcgccagcacggtgctctccaccacaggctatggccacacggtgcccttgtcagatgggggcaaggccttctgcatcatctactctgtcattggcatcccgttcaccctcctcttcctgacggccgtggtccagcgtgtcaccgtgcatgtcacccgcagaccggtcctctacttccacatacgctggggcttctccaagcaggtggtggccatcgtccatgccgttctgctgggattcgtcaccgtgtcctgcttcttcttcatcccggccgccgtgttctccgtgctggaggatgactggaacttcctcgaatctttttacttctgtttcatctccctgagcaccatcggcctgggggactacgttccaggggaaggctacaaccagaagttccgggagctgtacaagatcgggatcacgtgttacctgctcctgggactcatagccatgctggttgtcctggaaaccttctgtgagctccacgagctgaagaaattcaggaaaatgttctatgtgaagaaagacaaggatgaagaccaagttcacatcatggagcatgaccaactgtccttttcctccatcactgagcaggcggccggcctgaaggaggagcagaagcaaaacgagccttttgtggcctcccagtcaccaccctatgaggatggctctgcaaaccattgagcatgggtcaccagaccccggacatgaggcagagcctagactgtgttcatttttacgagaaagtcaaagctaagatgatgttattttaagaaatatctactgttaacaatattttaaaaacacggaactttggatcctgggggagtgggttttaatctctgggcaaatgaggtgtgcacccataactcacaggcaatgtgatcacctgacatcatgcagctgtaactcacaggcgatgtcatcacctggcatcctgcacctgtaactcacaggtgatgtcatcgcctggcatcctgcacctgtaactcacaggtgatattatcacctggcatcctgcacctgtaactcacaggtgatgtcatcacctggcatcctgcacttgtaactcacaggttgatgtcatcgcctggcatcctgcacctgtaactccacagttgatgtcatcacctgggcattacacactggggaagaaatacttgaaacatgttactgcaccggaaatcccattctaaaaccaaacttacta

SEQ ID NO: 1752 - DNA, 3373 bp, Rattus norvegicus
  Genbank Accession No. NM_021690
cgctaagcctggggtggtggtaggaaggtccagctcctccggccgatggctgtccactttcctccccccatcacaggtcagctggccaggtgagaaccactggcaggtgggcccagctgtggtggagagtccagctgtgggggcaccgcaggtgcgaggtctcccggacgtggttccggagggcacgctgctcaatatggtgctgaagagaatgcaccgtccccggtgctgctcttaccagctagtgttcgagcaccggcgcccaagctgcatccagggacttcgctggacgccacttaccaacagtgagggctccctggacttcagagtgagcctggagcaggccaccacagagcatgtgcacaaggccgggaagctcctgtaccgtcatctcttggcaacgtaccctaccctcatccgagacagaaaataccatctgcgactacatcggcagtgctgctctggccgggagctagtggatgggatcttggctctgggtcttggggtccactcacggagccaagctgtgggcatctgccaggtgttgctggatgagggtgccctttgccatgtaaaacatgactggaccttccaggaccgagacgcccaattctacagattccctggaccggagccccagcctgcaggaactcatgacgtggaagaggagcttgttgaggcaatggccctactctcccagcgagggcctgatgccctactcactgttgcactccggaagtccccgggtcagcgtacagatgaagagctggacctcatcttcgaggagctcgtacatatcaaggcggtggctcacctttctaactcggtgaaacgggaactagctgctgttctgctctttgaaccacacagcaaggcaggaactgtgttgttcagccagggggacaagggtacctcatggtacattatctggaagggatctgtcaatgtggtgacccgtggcaaggggctggtgaccacgttgcacgagggagatgactttggacagctggctctggtgaacgacgcacctcgagcagccaccatcatccttcgagaaaataactgtcactttctgcgtgtggacaagcaggacttcaaccgcatcatcaaggatgtggaagcaaaaaccatgagactggaagaacacggcaaagtggtgttagttttggagagaacctctcagggtgctggcccttcccgccctccgaccccaggcaggaaccgatatacggtaatgtctggcaccccagagaaaatcctagaactcctgttggaggctatgagaccggattccagtgctcatgacccaacagagacattcctcagtgacttcctgctgacgcacagtgtcttcatgccctgcacacagctctttgccgccctcctgcaccacttccacgtggagccatcagagcctgccgggggcagcgagcaggaacgcagcacctacatctgcaacaagaggcagcagattctgcgtctggtcagccggtgggtggccctctacagccccatgctccgctcagatcccgtggccaccagcttcctccagaaactctcagacctggtgagcagagatacccgacttagcaacttgctgagggaacagtatccggagagacggcgacaccacaggttggagaatggctgtgggaatgtatctcctcagaccaaggcccggaatgcacctgtttggtttcctaaccatgaggaacccctcccaagcagcgctggggccatccgagtcggggacaaagtcccctatgatatctgcagacccgaccactcggtgctgaccctgcacctgccggtgacagcctccgtgagggaagtgatggcagctttggcccatgaggaccactggaccaaggggcaggtgctggtaaaggtcaattctgccggtgatgtcgttggcttgcagccagatgcccgcggtgtggccacatccctggggctcaatgagcggatctttgttgtcgacccacaggaagtgcacgagctgaccccacaccctgagcagctggggcccactctgggttcttctgagatgctggacctagtgagtgccaaggacctggcaggccagctcacagagcatgactggaacctcttcaacaggatccaccaggtggagctgatccactatgtactgggcccccagcacctgcgggacgtcaccactgcaaacctggagcgcttcatgcgacgcttcaacgagctgcagtactgggtggccaccgaactctgtctctgcccggttcctggcccccgggctcagctactccggaagttcatcaagctggcagcccacctcaaggagcagaagaatctcaactctttctttgcggtcatgtttggcctcagcaactcggccatcagccgcctggcccacacctgggagcgtctgccccataaagtacggaagctgtactcggccctggaaaggttgctggacccttcctggaaccaccgagtgtaccgattggctctcaccaagctctctcctcctgtcatccctttcatgcccctgctactcaaagacatgaccttcattcatgaagggaaccacacactggtagaaaacctcatcaactttgagaagatgcgaatgatggccagagccgtgcggatgctccaccactgccgaagccacagcaccgcgcctctatcaccactcagaagccgggtttcccacatccacgaggacagccaggcatcaagaatctccacatgttccgagcagtccctgagcacccggagtccagccagcacctgggcttatgtccagcagctgaaggtcattgacaaccagcgggaactgtcccgcctctcccgggaactggaaccatgaggaaggactggctggagcaggcacttctctcagagaaagccagagcctgtgcaaccaagaggtccagaggccagccacagctgggcagggctctccacagagcggactcaaggccctggagtgggcagtgtcgaggcagctgtcctctgtgatgactgtcagctgtgaagatctttgatgttcacggccaaggaaaaggggccattgaggccccagaggggtaggagagctgggaggtgcaggactctggttcagtagagagccctcccaccgggctttctgcatgtctgtatgtctgtacatgcagctgtgtgtcctggatgccaggccctgtgcttgtattcacaggagccagcgagctcacatctgcatggtgtgtgtgtgtgtgtgtgtgtgtgtgtgtgtgtgtgtgtgtgagcactgggtggtgccttgcctgggagagggtggggagttctgctattctcaccacacatctgagataaacagctgggtgtgggcaaaaaaaaaaaaaaaaaaaaa

SEQ ID NO: 1753 - DNA, 1491 bp, Rattus norvegicus
  Genbank Accession No. NM_021700
gcaggtagcgagaggagcagtccctgggcccccgttgctgattggcccgtggcacaggcagcagcccggcaggcacgctcctggtccgggcagagcagataaagcgtgccaggggacacacgattagcagctcagaagtccctctgggtctcaccactgcacagaggccgaggaccccctccgagcttctttgctgcctccagacgcaatttactccaggcgagggcgcctgcagctcagcaaaacttcgaagcgagcagaggggttcagctatccaccgctgcttgactctgaccacccgcagctctctgttcttttgagcccggagtaactaggtaacatttaggaacctccaaagggtagaagaggggagtgggtgggcgtactctagtcccgcgtggagtgacctctaagtcagagactgtcacaccccccttccattttttcccaacctcaggatggcgcctcatcccttggatgcgcccaccatccaagtgtcccaagagacccagcaaccctttcccggagcctcggaccacgaagtgctcagttccaattccaccccacctagccccactctcgtaccgagggactgctccgaagcagaagcaggtgactgccgagggacatcgaggaagctccgtgcgcggcgcggagggcgcaacaggcccaagagcgagttggcactgagcaagcagcgacgaagccggcgcaagaaggccaacgaccgggagcgcaaccgcatgcacaaccttaactccgcgctggatgcgctgcgcggtgtcctgcccaccttcccggatgacgccaaacttacaaagatcgagaccctgcgcttcgcccacaactacatttgggcactgactcagacgctgcgcatagcggaccacagcttctacggccccgagccccctgtgccctgtggggagctgggaagcccgggagggggctccagcggcgactggggctctatctactccccagtttcccaagctggtagcctgagccccacagcctcattggaggagttccctggcctgcaggtgcccagctccccatcctgtctgctcccgggcaccctggtgttctcagacttcttgtgaagggcccaaacaggccctgggcggtgggcgctggcagaaagggagggagtcagagctgtctgaaatggaaggtagtggaggcactcgagcatctcgccccttctggctttcattagtcaggtccctgatttaaccaggattcgcacagttccttgctgctgtgcgtgcacaaaggacattgcaggctgatctcctcttaaccctcctcagtgtggccacctcaaactcccgctccaagcagaggagagccgtagcactaaatagttgggagactcccatacttcctggtgactccgccctctttcaaatctgcgggcctccaaccaccgctttctccagagtgacctaatccagtgttgcgtcttacctcactggctcttgttccata

SEQ ID NO: 1754 - DNA, 1182 bp, Rattus norvegicus
  Genbank Accession No. NM_021740
gttcccgggtcgtgctccgcgctcactgcagccaccttcgccgcccaccgtctcctccaacgcggactccggcagctttctcgccagagtcctcgaaactcgactaattccttacgcgtacgaccagaccaccggcgtgccccaccatgtcagacgcggcagtggacaccagctccgagatcaccaccaaggacttgaaggagaagaaggaagttgtggaggaggcagagaatggaagagacgcacctgccaatgggaacgctcaaaatgaggaaaatggggagcaggaggctgacaatgaggtagatgaagaagaggaagaaggtggggaggaagaggaggaggaggaagaaggtgatggtgaggaagaagatggagatgaagatgaggaagctgaggctcctacgggcaagcgggtagctgaggatgatgaggatgatgatgttgagaccaagaagcagaagaagactgatgaggatgactagacagcaaaaggaaaagctaaccttacgcaccgtgacctattcaccctccacttcccgtctcagaatttaaacgtggtcaccttcgagtagagaagcaggcccccgcccgcccactgcgcgagtgccacccaccaatgacatgcgctcttcaccaccccaccaaaaccacaacatgaattggcaacatgggaggagaaaagaaccagaacttcccaggccctgctttttttcttaaaaatactttaaaaggaaaatttgtttgtattttttatttacattttatatttttgtacatattgttaggggtcagccatttttaatgataacgggtgaccaaaccagccttcagagcgttttctgtcctacttcagactttacttgtggtgtgaccatgttcattatactctcaaaggagaaaaaaaaccttgtaaaaaaaacaaaaacaacaacaaaaaaacaatcttattctgagcattccagtaactttttttgtgtatgtacctagctgtactataagtagttggtttgtatgagatggttaaaaaggccaaagataaaaagattttttttcctttttttttgtctatgaagttgctgtttatttttttggcctgtttgatgtatgtgtgaaacaatgtccaacaataaaccggaattttattttgctgagttgttccaaaaaaaaaaaaaggaatcc

SEQ ID NO: 1755 - DNA, 1591 bp, Rattus norvegicus
  Genbank Accession No. NM_021744
ggaaagaaactgaagcctttctcggagcctgtctgggctgctcccactctcagaatctaccgaccatgaagcttatgctcggcttgttgctgttgcctttgacactggtgcatgcctctcccgccacaccagaaccctgtgagctggaccaggacgaggaaagtgtccgctgctactgcaacttctcagatccgcagcccaattggtccagcgcttttctatgcgcgggggcggaagacgtggagttctacggcggcggtcgcagcctggagtaccttctaaagcgtgtggacacggaagcaaatctggggcagtacactgatattatcaggtctctgcccttgaagaggcttactgtgcggtccgcgcgggttcctactcagattctattcggaaccctgcgtgtgctcggatattctggcctccgggaactgactcttgaaaacctcgaggtaaccggcaccgcgctttcgccgcttctggatgccaccggacccgatctcaacaccttgagcctccgcaacgtgtcgtgggcaacaacggatacctggctcgcagaactgcagcagtggctaaagcctggactcaaggtactaagtattgcccaagcacactcactcaacttttcttgcaaacaggtcggcgtcttccctgcccttgccaccttagatctgtctgacaaccctgagttgggcgagaaaggactgatctcggccctctgtccgcacaaattcccgaccctccaagttttagcgctgcgcaacgcggggatggagacgaccagcggcgtgtgctctgcgctggccgcagcaagagtgccactgcaggcactggatctcagtcacaattcactgcgggatactgctggcactccgagctgtgactggcccagtcagctaaactcgctcaatctatctttcactgggctggagcacgtacctaaagggctgccagccaagcttagcgtgcttgatctcagttacaacaggctggataggaaacctaggccagaggagctgcctgaagtggggagcctgtcacttacaggaaatccctttttgcactctgaatcccagtcggaggcgtataactctggcgtagtcatagccacagctctttcacccggatcagcgggcttgtcaggaactttggctttgctcctaggacatcgcctctttgtttaaggaacgtttgcatcttcctggtttctgagggtcctggtcaacaaatcctctgctttaaatttattaaaatcttaatccacaatgtaaggaaggacaatcaagatggctcaatgggtaaaagccaccaagcttgactcctgattttgatcctcgggatccacaccaaaggaaagaactctctcctgaaagttgtccatcggtgctcacaaataaatatatttttttttccggagctgaggaccgaacccagggccttgcgctcactaggcaagcgctctaccactgagctaaatccccaaccccacaaataaatatttttaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1756 - DNA, 2070 bp, Rattus norvegicus
  Genbank Accession No. NM_021745
ctgagttctgagcgtctacagcgaaagtgctgggctttggaaaggagacctgggctccgaatcctctcagggccttggacgtctctgacccaaaacaatccaaggttcttatttgaagaccaccatcccagaagcacattctcgagttgaaaagttggagtggtgttcgaaatgaatctgattgggccctcccatttacaagccacggacgagtttgctctttctgaaaacttatttggagtgctaacagagcacgcggcaggtcctctggggcagaatctggacttggaatcgtactccccatacaacaatgtgcagtttcctcaagttcagccacagatctcctcctcgtcctattattccaacctgggtttctacccgcaacaaccggaagactggtactctcctggactctatgaactcaggcgaatgcccactgagagtgtgtaccagggagagactgaggtatccgagatgcctgtgacaaagaagccgcgaatggccgcctcatcggcgggaagaataaaaggggatgagctgtgtgtggtctgcggagacagggcctctgggtaccattacaacgcgctcacctgcgagggctgcaaaggtttcttccgaagaagcatcaccaaaaacgccgtgtacaagtgtaagaacgggggcaactgcgtgatggatatgtacatgcgtcggaagtgccaggattgccggctaaggaagtgcagagagatgggaatgttggctgaatgtttgttaactgaaattcagtgtaaatctaaacggctaaggaaaaatgtgaagcagcatgcggatcagacagtgaatgaggacagcgaagggcgtgacttgcggcaagtgacctccacgaccaagctatgcagggagaaaactgaactcactgtagaccagcagaccctcctggattatattatggactcatacagcaaacagagaatgccacaggagatcacaaataaaatcttaaaagaagaatttagtgcagaagaaaattttctcatattaacagaaatggctaccagtcacgtacagattctcgtagaattcacaaaaagacttccagggtttcagacactggaccacgaagaccagattgctttgctcaaagggtccgcagtcgaggccatgttccttcgttcagcggagattttcaataagaaacttcctgccggacacgcagacctgttggaagaaagaattcgaaagagcggcatctccgatgagtacataaccccgatgtttagtttctataaaagtgtcggggagctgaaaatgacccaggaagagtacgctctgctcacagcaattgtcatcctctctccagacagacaatacataaaggatagagaggcagtggagaagcttcaggagcctctgctcgatgtcctacaaaaactctgcaagatctaccagcccgagaaccctcagcatttcgcctgcctcctgggtcgcctgacagaactccggacattcaaccatcaccacgctgagatgctgatgtcttggagggtgaatgaccacaagttcaccccgctcctctgtgagatctgggatgtgcagtgaaggacacggggagaggctagctccttgtcctcctcagagcagcaacctggtattggacttcccttcttttcatttgtaccaggtctcactcaagaatctcaatgaatatttatgtggcaattatacaattcccacaactgtaaatacaggctccatagaattgcttcccctacactgtattttacaaggcttcgggaaaccccactgacacgccctttttgcctcattaaatcaattgttacttcaattttgtcaactgagctagggaccgcctcgttttatcctccatgcggcaacattatatatatatatattttatcaaatagctgttttctcttccttttttttttttttttttttcggagctggggactgaacccagggccttgcgcttgctaggcaagcgctctaccactgagctaaatccccaacccctattaaatagctgttttcaactgagacaataaactgaacgtaatgccaagagaa

SEQ ID NO: 1757 - DNA, 2413 bp, Rattus norvegicus
  Genbank Accession No. NM_021750
cttccgggctcgggagccgcgacaggagggggcctctgaaaagggtcctgttctgagaagtccattgtgtaccttgtcaccagcgcgtctgaaccctctctgaaccttcctgaagctggaagatttcaccctgatggctgactcaaaaccactcagaaccctggatggggaccctgtggctgtggaggctttgctccgggacgtgtttgggattgtcgtagatgaggccattcggaaggggaccaatgcctctgagaaggtctgcgaatggaaggagcctgaagagctcaagcagctgctggacttggagctgcagagccagggcgagtctagggagcggatcctggagcgctgccgggctgtgattcattacagtgtcaagactggtcacccccggttcttcaaccagctcttctcaggattagatccccatgctctggccgggcgcatcattacggagagcctcaataccagccagtacacatatgagattgcccccgtgtttgtgctcatggaagaggaggtgctgaagaaactccgtgcccttgtgggctggaacactggggatggggtcttctgtcctggtggttccatctctaacatgtacgccataaacctggcccgctttcagcgctacccagactgcaagcagaggggcctccgggccctgccacccttggccctcttcacttcaaaggagtgccactactccatcaccaagggagctgcttttctgggacttggcaccgacagtgtccgagtggtcaaggctgatgagagagggaagatgatccctgaggatctggagaggcagatcagtctggcagaggctgagggctcggtgccatttctggtcagtgccacctctggtaccaccgtgctaggggcctttgaccccctggatgcaattgccgatgtttgccagcgtcacgggctgtggttacacgtggatgccgcctggggtgggagcgtcctgctgtcccggacacacaggcatctcctggatgggatccagagggctgactccgtggcctggaaccctcacaagcttctcgccgcggggctgcagtgctctgctcttcttctccgggacacctcgaacctgctcaagcgctgccacgggtcccaggccagctacctcttccagcaagacaagttctacaacgtggctctggacaccggagacaaggtggtgcagtgtggccgccgcgtggactgtctgaagctgtggctcatgtggaaggcgcagggtgggcaagggctggagtggcgcatcgaccaggcctttgctctcactcggtacttggtggaggagataaaaaagcgggaaggatttgagttggtcatggagcccgagttcgtcaacgtgtgcttctggtttgtgcctcccagcctgcgggggaagaaggagagcccagattacagccagaggctgtctcaggtggcccctgtgctcaaggagcgcatggtgaagaagggaaccatgatgatcggctaccagccccatgggacccgggccaacttcttccgaatggtggtggccaaccccatactggtccaggccgatatagacttccttctgggcgagctggagcgtctgggccaggacctgtgagctgcttcctctctctgccccacccaagctctgcataagctcctgggttcccaaaagcgacctttctaggaaacagtggccttgactgtgtgagcccccacacactaactctcctagctaagtattggctgccaggacggtgtctaagcacactacagtctgttcttacgaaatgtgcttcttttaagtcggtcatagtggtacacaccgttaataccagcactggggaggcagaggcagacacaagcagatctcttgagtttgacgccagcccggtctacagagctggcctacacagaaaaaaaacctgtcccaaaaaaaaagaaaggaaggaagtaagaaaggaaaagaaagaaatatttttcattaagattatgtctataaaaaattgttattaatatgagagatatggtacgatgtattaagaaagctagatatgggggttggggatttagctcagtggtagagcccttgcctaggaagcgcaaggccctgggttcagtccccagctccgaaaaaaagaaccacaaaaaaaaaaaaaaaaaaaaaaaaaagaaagctagatatgagtttatatatcatggtatctgagttagactaaaaaaaaaaaatacataggaaaaggcggtgagtggaactgtgccaaaggtcagcagttttccctggaggaggataacaggctgttcctaagtcagcctctcagaccttccctgcttccccactttattatgtaaccacatcacctacttctgagatataacaataaagctttgtcactataaaaaaaaaaaaaaaaaa

SEQ ID NO: 1758 - DNA, 1980 bp, Rattus norvegicus
  Genbank Accession No. NM_021754
ggcacgagggaacgtctaggcaacgtggtctccccgcccgcgggtaggcaaaggcgtttgcgcttcccagcgtctgaggcctagggagccttcagtagccgaaagttagtcttttgcagtggagtaagggctcgcggttagccgcgtagcgcccggatctggcctcaccatgttggtcctatttgaaacgtccgttggctacgccatctttaaggttctgaatgagaagaaacttcaagaggttgatagtttgtggaaagaatttgaaactccagagaaagcaaataaaatagtaaagctaaaacattttgagaaatttcaggatacagcagaagcattagcagcgttcacagctctgatggaaggcaagatcaataagcagctgaaaaaagttttgaagaaaatagtcaaagaagcccatgaacctctggctgtagctgatgctaagctaggaggggtcataaaggaaaaattgaatctcagctgtatccatagtcctgttgttaatgaacttatgagaggaatacgatcacaaatggatggcttgattcctggggtagaaccacgggagatggcagccatgtgtcttggactagcccacagcctatctcgatacagattgaaattcagtgctgataaagtagacacaatgatcgttcaggcaatttccttgttagatgacttggataaagaactaaacaactacattatgcggtgtagggaatggtatggctggcattttcctgagttagggaaaattatttcagataatttgacatactgcaagtgtttacagaaagttggagacaggaagaactatgcatctgccactctttctgaattcctgtcagaggaagtagaagctgaagtgaaagcagctgcagagatctctatgggaacagaggtttctgaagaagatatttgcaacattctacatctgtgtactcaggtcattgaaatttctgaatatagaactcagctgtatgaatatctgcaaaaccgaatgatggccattgcacccaatgttacagtcatggttggggagttggttggagcgcggcttattgctcatgcaggttctcttttgaatttggccaagcatgcagcttctacagttcagattctgggagcagaaaaggcacttttcagggccctcaaatctagacgagacacacctaaatatgggcttatttatcatgcttctcttgtaggccagacgagtcccaaacacaaaggaaagatttcacgaatgctggcggccaaaactgtgttggctatcagatacgacgcctttggtgaagattccagctctgcaatgggagctgagaacagagccaaattagaggccagattgaggattttggaggacagagggataagaaaaataagtggaacgggaaaggcattagcaaaagcagaaaagtatgaacacaaaagtgaagtgaagacttacgatccctctggtgactccacacttccaacttgttctaaaaaacgcaaaatagaagaggttgataaagaggatgaaattactgaaaagaaagcaaaaaaagccaagattaaaattaaagctgaagtagaggaggagatggaggaggcggaggaagaacaggtagtagaagaggagccgactgtaaagaagaaaaagaagaaggataaaaagaaacacataaaggaagagccactttccgaggaggagccatgcaccagcacagcagttcctagtccagagaaaaagaagaaaaagaaaaaaaagaaagatgctgaagactaatgtaaaggaaccgtaatcctgtcacctgaacacatcatgcttaagattcagttgggagcatatcagacgctctaacataatcaagggaggttgattagctttagcttttcaaacctttttgtgtcttgacatcaactgttaaccttagagtctttgatacacaaataaaaatattttctttgtattataaaaaaaaaaaaaaaaaa

SEQ ID NO: 1759 - DNA, 1545 bp, Rattus norvegicus
  Genbank Accession No. NM_021757
atggtggaggaggtacagaagcattctgtgcacacactagtgttcaggtcattgaagaggacccatgacatgtttgtggctgataatggaaaacctgtgcctttggatgaagagagtcacaagcggaaaatggcaatcaagcttcgtaatgagtatggccctgtgctgcatatgcctacttcaaaagagaatcttaaggagaagggacctcaaaacgcaccagattcatatcctcataagcagtatcctgccaatcaaggacaagatgttgaatatttggtgacaggtacacatccatatccaccaggacctggtgttgccttgactgctgatactaagatccaaagaatgccaagcgagtcagccgcacagtccttagctgtggcgttaccgtctcagaccagagttgatgcaaatcggactgcgcctgctggaagtgaataccgacacccaggggcttctgaccgttcccagcccacagcaatgaattctatgattatggagaccagcaataccaagaactctgcattaatggctaaaaaagcccctacaatgcccaaaccccagtggcacccaccgtggaaactctacagggttatcagtgggcatcttggctgggttcggtgtattgctgtggaacctggaaatcagtggttcgttactggatctgctgacagaactataaagatttgggacttggccagtggcaaattaaagctgtcattgactggccacatcagcacagtacgcggtgtgattgtgagcacgaggagcccttacttgttctcttgtggagaagacaaacaagtgaagtgttgggatcttgaatataacaaggttatacggcactatcatggccatctaagtgcagtgtatggtctggatttgcatccaacaatcgatgtcctggtcacttgtagtcgagattctactgctcggatctgggatgtgagaactaaagccagtgtgcacactttgtctggacacacaaatgcagttgctaccgtgagatgccaagctgcagagccacaaattattactggaagtcacgataccacaatacgattatgggatctggtggctggaaagacacgagtcacattgacgaatcataagaagtcagtcagggctgtggtcttacatccgctacattacacatttgcatctggttctccagataacataaagcagtggaaattccctgacggaggcttcattcagaatctctctgggcacaatgcaattattaacacgctggcagtcaatacggatggagtacttgtatctggagctgacaatggcactatgcacctttgggactggagaactggctataattttcagcgcgttcatgctgctgtacagcctgggtctttggacagtgaatcaggaatattcgcttgtgcttttgatcggtcagaaagtcggttactaacagctgaagctgataaaaccattaaagtttacagagaggatgagactgcgacagaagaaactcacccagtcagctggaaaccagaaattatcaagagaaagagattttag

SEQ ID NO: 1760 - DNA, 3025 bp, Rattus norvegicus
  Genbank Accession No. NM_021765
aggttccactgctccgtgggtctgtgtgttcttgagtaccagtgtcgctcggagcctgtgagaggctggggctcggacaatcggagccatgcctcttcgacttgacatcaagagaaagctaactgctatgtctgatcgggttaagagtgtggatttgcatccgactgagccatggatgctggctagtctttacaatggcagtgtgtgtgtttggaatcatgaaactcagacgctggtgaagacctttgaagtgtgtgatctccctgttcgagctgcgaagtttgtcgcaaggaagaactgggtggtgacaggagcagatgatatgcagattagagtgttcaattataacaccctggagagggtgcacatgtttgaagcacactcggattacatccgttgcattgctgttcatcccacccagccgttcattctcacaagcagtgatgacatgcttattaagctctgggactgggacaaaaaatggtcttgttcacaagtgtttgaaggacacacgcattatgttatgcagattgtgataaaccccaaagataacaatcagtttgccagtgcatctctcgacaggaccatcaaggtgtggcagctgggctcttcatcaccaaactttacgctggagggacatgaaaaaggcgtgaattgcattgattactacagtggtggtgataagccatacctcatttcaggtgcagatgaccggctcgttaaaatatgggattatcagaataaaacttgtgtgcagaccccggagggacatgcccagaatgtgtcatgcgcaacgttccatcctgagctgcccatcatcatcacagggtcggaagacggaacggtgcgaatttggcactccagcacctaccggctggagagcacactgaattacggaatggagcgagtgtggtgtgtggccagtctgagaggctccaacaatgtcgctctgggctacgatgaagggagcatcattgttaagcttggtcgggaggaacctgccatgtccatggatgccaatggaaagataatctgggccaagcattcagaggtccagcaggccaacctgaaagcaatgggtgacaccgaaattaaagatggagaaagactgccactagcagtaaaggatatgggcagctgtgaaatatatccacagaccattcagcacaatcctaatgggaggtttgtcgtggtgtgtggtgatggagaatatatcatctacacagcaatggccttgagaaacaagagctttggatctgcccaggagtttgcatgggcccacgattcttcagagtatgcaataagagaaagcaacagtgttgtaaagatatttaagaactttaaggaaaagaaatcatttaaacctgattttggagctgaaagtatctatgggggcttcttgctgggagtcaggtctgtaaatggcttagcattctatgactgggagaataccgaactcatccgcagaattgaaattcagcccaagcacatcttctggtctgactctggagagctggtctgtattgccaccgaggagtcattttttattcttaaatatctgtcagaaaaagtcttggctgcacaggaaacccacgagggagttactgaggatggcattgaggacgcctttgaggttcttggtgaaattcaggaaattgtgaaaactgggctgtgggtaggtgactgcttcatctacacaagttctgtgaacagattaaactattatgtgggaggcgagattgtcaccattgcccacttggacaggacaatgtaccttctgggctatattccaaaagacaataggctttatctgggagataaagaattgaacatagttagctactccctgttagtttcagtcctggaataccagactgctgtcatgcggagggatttcagcatggctgataaggtgctccctactatcccaaaagaacagaggaccagagttgcacactttttggaaaagcagggcttcaagcagcaagcactcacagtatccacagatcctgaacatcgttttgagcttgctcttcaacttggggagctgaaaattgcttaccagttagcagtggaggcagagtcggagcagaagtggaaacaacttgccgaacttgccattagtaaatgtcagttcagcctagcccaggagtgtttgcaccatgcccaggactacggtggtctgctgctcttggccactgcctctggaaacgctagtatggtgaacaagctggcagaaggtgcggagagagatggcaaaaataacgtggcattcatgagctattttttacagggcaagcttgatgcttgcctagagctcttgatcagaacaggaagactcccagaagccgccttcctggcccgaacttacttacccagccaggtctcaagggtagtgaagttgtggagggagaatctctcaaaagtcaaccagaaagcagcagaatccctcgctgaccccacagagtatgaaaaccttttccctggattaaaagaagcctttgttgttgaagaatgggtgaaggagacacatgcggatctgtggccagccaagcagtaccctcttgtcacgccaaatgaagagagaaatgttatggaagaggcaaaacggtttcagccctcaagagccacagctcagcaggaacctgatgggaaaccagcttctagcccagttatcatggcctcccaaaccactcacaaagaagaaaagagtttccaggaactagaagatgatttagataccatggaattagaggatattgatacaacagacatcaatctggatgaagatattctggatgactaaagtttgccatttactccagtaagagattatgatggcacatacaaatcagtcaccaccctgaccagaactgtggcaatccttgctctgcacacgtaaacaaggaggaacatagccccttcatcttcagggcagagttttaactgaaacagacacttgtgcttttttcatattgtcattaaaccacccctcataaaaaaaaaaaaaaaaaaaaaaaaaaaa

SEQ ID NO: 1761 - DNA, 1005 bp, Rattus norvegicus
  Genbank Accession No. NM_021835
atgactgcaaagatggaaacgaccttctacgacgatgccctcaacgcctcgttcctccagtccgagagtggcgcctacggctacagtaaccctaagattctgaagcagagcatgaccttgaacctggccgacccggtgggcaatctgaagccgcacctccgagccaagaactcggaccttctcacgtcgcccgacgtcgggctgctcaagctggcgtcgccggagctggagcgcctgatcatccagtccagcaatgggcacatcaccactacaccgacccccactcagttcttgtgccccaagaacgtgaccgacgagcaggagggcttcgccgaaggcttcgtgcgcgccctagctgaactgcatagccagaatacgctgcccagtgtcacctccgcggcacaacctgtcagtggggcgggcatggtcgctcccgctgtggcctcagtagctggcgctggcggcggcggcggctacagcgccagcctgcacagtgagcctccggtctacgccaacctcagcaacttcaacccgggtgcgctgagcagcggcggtggggcgccctcctatggcgcgaccgggctggcctttccatcgcagccccagcagcagcagcagccgcctcagccgccgcaccacttgccccaacagatcccggtgcagcacccgcggctgcaggcgctgaaggaagagccgcagacggtaccggagatgccgggagagacgccgcccttgtcccccatcgacatggagtctcaggagcggatcaaggcggagaggaagcgcatgaggaaccgcatcgctgcctccaagtgccggaaaaggaagctggagcggatcgcccggctagaggaaaaagtgaaaaccttgaaagcgcaaaactccgagctggcgtccaccgccaacatgctcagggaacaggtggcacagcttaaacagaaagtcatgaaccacgttaacagtgggtgccaactcatgctaacgcagcagttgcaaacgttttga

SEQ ID NO: 1762 - DNA, 1035 bp, Rattus norvegicus
  Genbank Accession No. NM_021836
atgtgcacgaaaatggaacaggctttctatcacgacgactcttacgcagcggcaggatacggtcggagccctggcagtctttctcttcacgactacaaactcctgaaacccaccttagcgctcaacctggcagatccttatcggggtctcaagggtcctggggcgcggggtccaggcccagagggcagtggggcaggcagctacttttcgggtcagggatcagacacaggcgcatctctgaagctagcctccacggaactggagcgcttgatcgtccccaacagcaacggcgtgatcacgacgacgcccacgcctccgggacagtacttttacccccgtgggggcggcagcggcggaggtacagggggcggcgtcaccgaggagcaggagggctttgcggacggttttgtcaaagccctggacgacctgcagaagatgaaccacgtgacgccccccaacgtgtctctgggcgccagcgggggtccccaggccgggccagggggcgtctatgctggtccggagccgcctccggtctacaccaacctcagcagttactccccagcctctgcaccctctggaggttccgggaccgccgtcgggactgggagctcatacccgacggccaccatcagctacctcccacatgcaccaccctttgcgggcggccacccggcacagctgggcttgagccgtggcgcttccgcctttaaagaggaaccgcagaccgtaccggaggcacgcagccgcgacgccacgccgcctgtgtcccccatcaacatggaagaccaggagcgcatcaaagtggagcgaaagcggctgcggaacaggctggcggccaccaaatgccggaagcggaagctggagcgcatcgcgcgcctggaggacaaggtgaagacactcaaggctgagaacgcggggctgtcaagtgctgccggcctcctacgggagcaagtggcgcagctcaagcagaaggtcatgacccacgtcagcaacggctgccagttgctgctaggggtcaagggacacgccttctga

SEQ ID NO: 1763 - DNA, 594 bp, Rattus norvegicus
  Genbank Accession No. NM_021851
atggcggcgctgggagaacctgtccggctggagagggatatctgcagagcaattgaattgttggagaaattacagaggagtggagaggtgccgccacagaaacttcaggctttgcaaagagtcctccagagtgagttctgcaatgctgtcagagaggtatacgaacatgtttatgagactgtggacatcagtagcagccctgaagtgagagctaatgcaactgcaaaggctaccgttgctgcgtttgctgccagtgaagggcactctcatccccgagttgttgagctacccaaaacagaagagggccttggattcaatatcatgggaggcaaagaacaaaactcaccaatctatatatcccggataattccaggtggaattgctgacagacatggaggcctcaaacgaggagatcagctcctttctgttaatggagtgagtgttgaaggagagcaccatgagaaagcggtggagctactgaaagcagcccaaggcaaggtgaagttagtcgtccggtacacaccaaaagtcctggaagaaatggagtcccgctttgagaaaatgagatcagcaaaacgcagacaacagacctaa

SEQ ID NO: 1764 - DNA, 4847 bp, Rattus norvegicus
  Genbank Accession No. NM_021997
cgccctcggggccgcaacgagcggccgagcttacagaatcggcccctccctctatcccttctggccgtagagcctgtccgaggcccggactcagaacgcggagaacgggttagggtagcggccgggcgtgaggggaccgcacagcatccttgttcccaggacgcgcggaccaagaggaagcgaggggtgtcgggtcctgttcgctgctggagctccaaggtgaccaaggatggcagagaggatatgaccggcggctgccgtcgtctgccctcctagtggcatcaccatgcagaagcccagtggcctgaagccccctggccgaggggggaagcactccagtcccgtgggtaggccctccatcgggtctgcctcatcttctgtggtggcatcggcgagcggctccaaagaagggtctcccctgcacaagcaggcgtcgggcccctcctcggctggagccaccactactgtctccgagaagccaggtccaaaggcagccgaagtgggtgatgacttcttgggagacttcgtggtgggcgagagggtgtgggtgaatggcgtgaagcccggcgtggtgcagtacctgggtgagacacagtttgcgccaggccagtgggccggcgtggtcttggatgatcctgtgggcaagaacgatggagctgtgggtgggctgcgctacttcgagtgcccagctctacagggcatcttcacacggccctccaagctgacccgccagcccgcagctgagggctccggcagtgacggccactcagtggaatccctcaccgcccagaacctgtccctgcattctggcacggccacgcccccactcaccggccgagtcatccccctgcgggagagtgttctcaacagctccgtgaagacgggcaatgagtctggctccaacctctcggacagtggttctgtgaagcgtggtgacaaggacctccacctgggagaccgtgtgctggttggtgggacgaagaccggtgtggtacgatatgttggggagacggactttgccaaaggcgagtggtgtggtgtggagctggacgagccccttgggaagaacgatggggcagtggcaggcaccaggtacttccagtgcccacccaagttcggtctctttgcaccaatccacaaggtcatccgaattggcttcccatctaccagtccagccaaggccaagaagaccaagcgcatggctatgggtgtctcagccttgacccacagccccagcagttcttccatcagctctgtcagctctgtggcctcctctgttggtggccggccgagccgtagtggcctgctcacagagacctcttcacgctatgcccggaagatctcaggcaccacagccctgcaggaggcactgaaggagaaacagcagcacatcgaacagctgctggctgagcgtgacttggagagggcagaagtagccaaggctaccagtcatatctgtgaggtggagaaggaaattgccctgctgaaggcacagcatgagcagtatgttgcagaagctgaggagaagctgcagcgggcacggttgctggtggaaaacgtgaggaaggagaaggtggatctgtccaatcagctggaggaggagaggaggaaggtggaggacctgcagttccgggtggaagaagagtccatcaccaaaggagacttggagacccagacccagctggagcacgcgcgcattggggagctggagcagagtctgctattggagaaggcgcaggccgagcggctgctcagagaattagcggataacaggctgaccacagtggctgagaagtctcgggtgctgcagttagaagaagagctgagcctgcggcgtggtgagatcgaagagctacaacactgcctcctccagtcaggtccaccacctgcggaccacccagaggccgctgagaccctgcggctgcgagagcggctgctgtcggctagcaaggagcaccagcgggacagcaccctgctccaggacaagtatgagcacatgctaaagacgtaccagacagaagtggacaagcttcgggcagccaacgagaagtacgctcaggaagtggcagacctcaaggccaaggtccagcaggccaccaccgagaacatggggctcatggacaactggaaatccaagctggactctctggcctccgatcaccagaaatctttagaagacctgaaggccacgctgaactctggcccaggcgcccagcagaaggagattggcgagctgaaggccctggtggagggcatcaaaatggagcaccaactggagttagggaacctgcaggccaagcatgacttagagacggccatgcatgggaaggagaaagagggcctgcggcagaagctgcaagaggcccaggaggagctggccgggctgcagcagcactggagggcacagctggaggagcaggcagcagcaccggctgagctacaagaagcccaggaccaatgtcgtgacgcccagctacgtgtgcaggagctggagggactggatgtggaataccgcggccaggctcaggccatcgagttcctcaaagaacagatctcgctggctgaaaagaagatgctggattacgagatgttgcagagggcggaagcccagagcaggcaggaggccgagcggctgcgggaaaagcttctggtggctgagaatagactgcaggctgtcgagtccctgtgctcagcccagcacagccatgtgatcgagtccaatgacctttctgaggagaagattcggatgaaggagactgtggagggcctgcaggacaagctgaacaagagggacaaagaggtggcagccttgacatcccagatggacatgctcagggcccaagtaagtgctctcgagaacaagtgcaaatcaggagagaagaagatagactctctcctgaaggagaagaggcggctggaggcagagctggaggccgtgtctcggaagacccatgatgcctctggccagctggtccacatcagccaagagttgctacggaaggagaggagtctgaatgagctgagggtgttgctgttagaagccaatcggcactccccagggcccgagagagacctgagccgtgaggtacacaaagctgaatggcggataaaggaacaaaaactgaaagatgacatccggggcctgcgtgaaaagctgaccgggctggacaaggagaagtccctgtcggagcagaaacgctactccctcattgacccagcttcagcgcccgagttgctgagactgcaacatcagttagtgagcacggagggatgcctgcgggacgcactggaccaggcccagcaggtggagaggctggtggaggccctgaggggctgctcagataggactcagaccatcagcaattccggttctgccaatggtatccaccagccagacaaggcccacaaacaggaggacaaacactgacccccaagggacaccatggaccggccctactcacaccagaagccctgccaggcttcccagcagcgccaccttcaggcaggagccagaactttccctttggagatgagactgtgtttgtaacgataattgtcctcactgccgtggacacatcccacctgaaccccctgccggaccaggaggctcccacagacacggccttccacagagcgcggtacagctgggcccagccctggaggacctctcttgtcccaaggagcttcttgaatttgcggaggctgaagcgatccagttgggcctctcttggctatagcaggctgccccgaggcttgtctgggcacccgggtacttccccatctccctttccttctggtgtcccccaggtcccctgcaggcccctgagaggtggagcagggctcctgcttggacgcgtaacacaccaagaagggcttcagtcttcagaaactagggaggggatgcttgacttcatatgctgatcctctaacacaatggtacaaggtcgcttgggcctctagccagggaagatttgggggtgacaggttccttattcctcgacaccacgctagtatgcgttacccacttcccctctgctgcccagaaagcattgagcagacagcttcagtattaggtgagctcgcaaacccactcttcttaccttgaccttgagctgggactggctcaggggcttacagccaagagcgggaagaaaactctttaaacaaagcattcacgcggtgttttgctgggtgagaggaatcacgctggttccctttatttccgggaacccctgccatgttactccaaagaccccagcaacccacagagggtcctgcttctatcttcccagggcgggaaccacagtgggtgacaggtatggtaagtccttaggattggcccaggtggcctctgtgagcaccattagacaccagcaggtgcggtcacgctcttgtccttagggagaagctgaattagcagccccacagcccaaccccctgcttcctgttggcttttgggtagcacttgccgttaacaacagcagcctagagcctagaattgacgctttagtggcccaactgcagagccagtatatcgctctttccagcacaatcgggcagctcacagattaggaattaacagccaaaggctcccacagtagggaccagacggggctgagccccaccctggagtgggcttgcacctggtaggtgtgcaagaagccatttccccataagcactggcctttgacggccccctcagcctacccggtgtggccacccagtggtggctcagccattccctcccctccccctcccctcagtggaattgtggaagtgtggcaagtccatgttcggacaataaagcttgtgattaaggtaaaaaaaaaaaaaaaaaaaaaaaaaaa

SEQ ID NO: 1765 - DNA, 1711 bp, Rattus norvegicus
  Genbank Accession No. NM_022005
agctcacctagaggagggcgcaggcgacagcacagcggtctgcgaggggacccagaagccagtggacgcgggccacccgggagcccagccagtcagccccctctgggaggcgggaaaactgcaagccgcgcccaccgccctgcccccagcgcgccactcccggctgctgggactctgctcagactcctgggatccgcttggagggaacccaacgcctagacaccatggagacggtgctgatcctctgcagcttgctggcccctgtggtcctggctagtgcagctgagaaggagaaagaaaaggatcctttctattatgactaccagaccctgaggattgggggattggtgtttgctgtggtcctcttctctgttgggatacttctcatcctaagtcgcaggtgcaagtgcagtttcaatcagaaacccagggctccaggtgatgaagaggcccaggtggagaaccttatcaccacaaatgctgcggagccccagaaggcagagaactgaagggcagcctccagcatgaagcctccagaagccaaggccagctacccgacactttagaggctgatgtcgaggcttgagaaagccggctacttcataccagacctttccccaggagatgccgaggactcgtgttccctgtgcctctccccaccccctactaaccctagtcttgtattaatgatgtgacactcacagcccttcttctcactgcagccgggctctggaccctttctgtgccgcgtctgtgccgtgtctgtgtgtgtctgctgactgtggtcgttcgtggtcgtttcattgttcctgtgaactgtgtgcttctctcccatgccaccgtcagcaccttgtgccctcctgtgacctccatctactcttgctctctggagtctccccgtccctgaggagcccttagtcccctctttctggatttaggcttgagggagaagttgtaccgagggcaggaagtccccagtgatcccggggctgagaaagttcgtaccctcttcactgatgttccttgtggactctgagaagaaacttgctccagattccaccagtttagaaggtccgtttgcagttggagattcagattgcctcccttgaggcgtctgccctccaggcctcctttttcttttagggtgcccacttaggagtcccaatccgccccaccctttacagaacacccaggaattcttgcctctgaggaatgagctccttacttaacttctgagcaatatccccataggctttggagcccttctgccttcatccaccttccctgcttctgagacttccatctctagcccaattcatctgacagaggactccttccttctctgaagctggtctgtggcaggagatagcccaggggacaggcagcaggcagggtgccggtggctctgtctctctgccacatggtgtggaatctggcagactacagtttctttcccctgcctgtcaggggtcggagtggagagggctggaagggttcaggggcagcgggagagagcaacagggtatgcacacccgtggatgcaaacgcctacgggagtcaaaggtcaccagagtggaaactcacaccagagcctgccccacctgcccattgtgttcccttggaaacgaaccaagccacactgtgtactgggactgctgatctctgtcttgtgatctattatcctctgacaacagaaaagtaaataaatata

SEQ ID NO: 1766 - DNA, 636 bp, Rattus norvegicus
  Genbank Accession No. NM_022175
atggaggctcaaggctctagccatgatatcagccgcttactctgcctgggagtcaaggaagactcggaagaacagcatggtcagtacctgggtgatgtgaaagcagaggctttctttcaggctggagaggggagagacgagaaaggtgcacagggtcagcctggagagggagcagtgggaacagaaggcgaaggagaagaattaaatggaggagaaggccactttggtcctggtgttccaggtcctgtgggtgagggggacaaggatggtggcaccagagctagtggcatggaggaggagcaacatgagcccgttgccgagggcactgagagtgtcaagtctgaggataagcagatgccactccgccgccctgggtccacccagcggcggctggcggaattggagcgcattttgctaagcagtggttcctccagtggcgggaggagcttgatagatggatggatatcagtgtgtccagagtgcaggaattggtttaagattaggagggctgcatacagaagaaataggaggcggagaacaccaatccctgaacattttagagcaacatctgggtgccctgcttgtcttggagcaagatggggagtaagatgtccttttgcaacaccgagattttga

SEQ ID NO: 1767 - DNA, 3692 bp, Rattus norvegicus
  Genbank Accession No. NM_022179
gtcgtcttatttgggagctgagacttgaggaaggtgataacttctgaatccccccaggtagtcaataccattgtggaaacatggccgccattgagccttctggtctgcacccgggagaaagagactcaagctgcccccaggagggcattccaaggccctcaggtagcttagaactggcacaggaatacttgcaacaattcaaggtgaccatgacacagctgcagcagatccaagccagtcttctgtgttccatggagcaggcgctgaagggacaggacagtcccgctccttctgtccggatgttgcccacatacgtgaggtccacaccacatggcaccgagcaaggagacttcctggtgctggagctgggggccacaggagcctcactacgtgtgttgtgggtaacactgacgggcaccaaggaacacagcgtggagaccaggagccaggagtttgtgatccctcaagaggtgatcctaggtgctggccagcagctctttgactttgctgcccgctgcctctctgaattcctggatgcataccccgtggagaatcagggtctgaagcttgggtttaatttctcttttccttgtcaccagacaggcttggacaagagcaccctcatttcctggacaaaaggttttaggtgcagtggtgtggaaggccaggatgtggtccagttgctaagggatgccattcagaggcaggggacctacaatattgatgtggtagccatggtgaatgacacagtgggtaccatgatgggctgtgagctgggcaccaggccatgtgaagtcgggcttattgtagacactggtaccaatgcctgttatatggaggaagcgaggcacgtggcagctctggatgaggaccgcggccgtacctgtgtcagcatcgagtggggctccttctatgacgaagaggccctagggccagtactgaccaccttcgacgatgccctggaccacgagtccctggttcctggtgctcagaggtttgagaagatgattggtggcctttacttgggtgagctggtaaggctggtgctggtccacttgtcccagcatggggtcctctttggtggctgcgcctctcctgcgttgctgagtcaaaacagcatcctcctggaacatgtggccaaaatggaggaccctgccactgggatagcccacgtccacacagtcctgcagggcttgggtctgagccctcaggcctcagatgctgagctcgtgcagcgcgtgtgcatggctgtgtgcacgcgagctgcccagctctgtgcctctgccctggctgcagtcctatcccgcctccagcacagcagggagcagcagacactgcacgtggccgtggccactggagggcgagtgttcgaatggcaccccaggttcctctgcatcctaaaggagacggtaatgctcttggccccagagtgtgatgtctccttcatcccctctgtggatggtggtggccggggtgtggcaatggtgactgctgtggcagcccgcctggctacccacaggcgcatcctggaagagaccctggcaccatttcagctgagcttggagcagctgacagcggtgcaggcacaaatgcgggaagccatgatcagggggcttcaaggagagagctcctccctccgcatgctgcccacttacgtccgagcaacgcccgatggcagcgaacgaggtgacttcctggctttggacctagggggcaccaacttccgtgtcctgttggtacgcgtggccgagggcagtgttcagatcaccaaccaggtctactctattcctgagtatgtagcccagggctctggacagaagctctttgatcatattgtggactgcatcgtggacttccagaagaggcaaggccttagcggacagagcctacccctgggtttcaccttctcttttccttgcaagcagcttggcctggaccagggcatcctcctcaactggactaaggggttcaatgcatcaggctgcgagggccaagatgttgtgtatttattacgggaagccattaggcgcagacaggcagtggagctgaatgtggttgccattgtcaatgacacggtggggaccatgatgtcctgtggctatgatgatccctgttgtgagatgggcctcattgtcggaaccggtaccaacgcctgctatatggaagaactccggaatgtggcgagtgtgcccggggactcaggccacatgtgtatcaacatggagtggggtgcctttggggatgacggctcactgagcatgctcggcacctgctttgatgctagcgtggaccaggcatccatcaacccaggcaaacagaggtttgagaaaatgatcagcggaatgtacctgggggagatcgtccgccatatcctcctgcacttaaccagtcttggagttctcttccggggccagaagacgcaatgccttcagaccagggacatctttaagaccaagtttctctccgagattgagagcgacagcctggccctgcgtcaggtccgagccatcctggaggacctggggctgactctgacgtctgatgatgccttgatggtcctagaggtgtgccaggctgtgtcccgcagggccgcccaactctgcggggcaggtgtggctgcagtggtggaaaagatacgggagaaccggggcctgcaggagctgacagtgtctgtgggagtggatgggacgctctacaagctacatccccacttctccaggctggtgtcagtgacagttcggaagctagcccctcagtgcacagtcacctttttgcaatcggaggatgggtctgggaaaggggcagcgttggtcactcgtgtcgcttgccgcctgacccagatggcctgcgtttgaggaaaatctccaaagagcaattgggatctccctggactaaggattcagcccacacggaccctctggcgggcccagccacccacaactcccaaagaaacccacgggtggtgccctcataactgtccgcccacacccaatggctttctgagagaagcaccactctggttagcaaggaattccccgaagatggcggaggggcaggttctagtattggatggccggggccatcttctgggccgcctggccgattgtggccaactgctgggcaggtagccgaaaggtggtggttgtacgctgtgagggcatcaacatttctggaaatttctacagaaacaagttaaagtatctggccttctccgaaagcggatgaacaccaacccgtctcgaggcccctaccacttccgagccccaagccgcattttttggcgcactgtgcgaggcatgctgccgcacaagaccaaaagaggccaggctgccctggaacgcctcaaggtgttggatgggatccctccaccctatgacaagaaaaagcggatggtggtccctgctgccctcaaggttgtgcggctgaagctaccagaaagtttgcttacctggggcgtctggctcatgaggtcgggtggaagtaccaggcagtgacagctactctggaggagaaacggaaggaaaaggcaaagatccattaccggaagaagaagcagctcttgaggctaaggaaacaggcagaaaagaatgtggagaagaaaatctgcaagttcacagaggtcctcaagaccaatggactcttggtgtgaaccaataaagactgtttgtgcctcaaaaaaaaaaaaaaaaaaa

SEQ ID NO: 1768 - DNA, 1446 bp, Rattus norvegicus
  Genbank Accession No. NM_022180
ggatccgtagaggagaatgcgactctctaaaaccctcgccgacatggacatggctgactacagtgctgccttggacccagcctacaccaccctggagtttgaaaatgtgcaggtgttgaccatgggcaatgacacatccccatctgaaggtgccaacctcaactcatccaacagcctgggtgtcagtgccctgtgtgccatctgtggcgatcgggccactggcaaacactacggagcctcaagctgtgacggctgcaagggattcttcaggaggagcgtgaggaagaaccacatgtactcctgcaggtttagcaggcagtgcgtggtagacaaagataagaggaaccagtgtcgttactgcaggctcaagaagtgcttccgggctggcatgaagaaagaagccgtccaaaatgagcgggatcggatcagcacgcggaggtcaagctacgaggacagcagcctaccctccattaatgcgctcctgcaggcagaggtcctgtctcagcagatcacctcccccatctctgggatcaatggcgacattcgggccaagaagattgccaacatcacggatgtgtgtgagtctatgaaggagcagctgctggttctggtcgaatgggccaagtacatcccggccttctgtgaacttcttctggatgaccaggtggcgctgctcagagcccacgctggtgagcacctgctgcttggagccaccaagaggtccatggtgttcaaggatgtgctgctcctaggcaatgactacatcgtccctcggcactgtccagagctagcagagatgagccgtgtgtccattcgcatcctcgatgagctggtcttgcccttccaagagctgcagatcgatgataatgaatacgcctgcctcaaagccatcatcttctttgacccagatgccaaggggctgagtgacccaggcaagatcaagcggctgcggtcacaggtgcaggtgagcctggaggattacatcaacgaccggcagtatgactctcggggtcgttttggagagctgctgctgctcctgcccactctgcagagcattacctggcagatgatcgagcagatccagttcatcaagctctttggcatggccaagattgacaacctgctgcaggagatgctgcttggagggtctgccagtgacgcgccccacgcccaccaccccctgcaccctcacctgatgcaagaacacatgggcaccaatgtcatagttgccaacacgatgccctctcacctcagcaatggacagatgtgtgagtggccccggcccagggggcaggcagccacccctgagactccacagccatcaccaccaagtggctctggatctgaatcctacaagctcctgccaggagccatcaccaccatcgtcaagcctccctctgccatcccccagccaacgatcaccaagcaggaagccatctagaattc

SEQ ID NO: 1769 - DNA, 6052 bp, Rattus norvegicus
  Genbank Accession No. NM_022183
aaatgaaactagggaagctctcctaaccgacgcacgtctgtggagaagcgtccaagtcgccggtcgcctagcgtttctcactgattttgtcgcttttaggattctcgagccccttcaggacggtcaccatggagttgtcaccgctgcagcctgtaaatgaaaatatgctactcaacaaaaagaagaatgaagatggcaagaaaagactgtccgttgaaagaatctatcagaaaaaaacccaactggaacatatactgctccgcccagatacctacatcggctctgtggagttagtgacccagcaaatgtgggtttacgatgaagatgttggtattaactacagggaagtcacttttgttcctggtttgtataaaatctttgatgaaattctagttaatgctgctgataacaaacaaagggacccaaaaatgtcttgcattagagtcacaatgatgcgaaataatttaattagtatatggaataatggaaagggaattcctgttgttgaacacaaagtggagaaaatgtatgtcccagctctcatatttggacagctcctgacctccagtaactacgatgatgatgagaagaaagtgacaggtggtcgaaatggctatggagctaaactgtgtaacatattcagcaccaaatttactgtggaaacagccagtagggaatacaagaaaatgttcaaacagacatggatggataacatggggagagctggtgacatggagctcaagccctttagcggagaggattacacgtgtattaccttccagcctgacttatctaagtttaaaatgcaaagcctggacaaagatattgtcgcactgatggtcagaagagcatacgatattgctggttccaccaaagatgtaaaagtctttcttaatggaaacaggctgccagtcaaagggttccgtagttacgtggatatgtatttgaaggataaggttgatgaaactgggaacgctctgaaggtggtgcatgaacaagtaaatccccggtgggaagtgtgcttaacaatgagcgagaaaggctttcagcagattagcttcgtcaacagcatcgctacttctaagggtggcagacatgtcgattatgtagccgatcagattgtgagtaaactcgttgatgtggtgaaaaagaagaacaagggaggtgttgcagtgaaggccgatcaggtgaagaatcacatgtggatttttggaaatgcggtaattgaaaacccaacctttgattctcaaacaaaagaaaacatgactttacaagccaagagctttggatcaacttgtcaattaagtgaaaaattcatcaaagctgcaattggttgtggtattgtcgaaagcatactaaactgggtgaagtttaaggcccaaatccaattaaacaagaagtgttcagctgtaaaacataacaggatcaagggaatccccaaacttgacgacgccaatgacgcagggagccgaaactctgctgaatgcacacttatcctgactgaaggggactcagccaaaactctggcagtctcaggacttggagtggttggaagagacaaatatggggtgttccctctcagaggaaaaatactcaatgtgcgagaagcttctcataaacagatcatggaaaatgctgaaattaacaatatcatcaagattgtggggcttcagtacaagaaaaactatgaggatgaagattcattgaaaactcttcgttatgggaagatcatgattatgacagatcaggaccaagatggttcccacatcaaaggcttgctgatcaattttatccatcacaattggccatctcttctgcgacatcgttttctagaagaatttatcactcctattgtaaaggtatctaaaaacaagcaagaaatagcattctacagtcttcccgagtttgaagaatggaagagtacaaatccaaatcacaaaaaatggaaagtcaagtactacaaaggtttgggcacgagcacatcaaaggaagctaaggagtattttgcaaatatgaaacgacatcgtattcagttcaaatactctggccctgaagacgatgctgcgatcagcctggcctttagtaaaaaacaggtcgatgatcgaaaggaatggttaactaatttcatggaagatagaagacagcggaagttacttggccttcctgaggattatttgtatggacaaaccactatgtacctgacctataatgatttcattaacaaggaacttatcctcttttcaaactctgataatgaaagatctatcccatctatggtagatggtttgaaaccaggtcagagaaaggttttgtttacttgtttcaaacggaatgacaagcgagaggtgaaagttgcccagttagctgggtcagtggcagaaatgtcctcttatcaccatggtgagatgtcgctgatgatgaccattatcaatttggctcagaattttgtgggtagcaataatttgaaccttctacagcctattggtcagtttggtaccaggctgcatggtggcaaggactcagccagccctaggtacatctttacaatgctcagccctttggctcggttgttatttccatcaaaagatgatcacacgttacggtttctgtatgacgacaaccagcgtgttgagcctgaatggtacatccctattatacccatggtgctgataaatggtgctgagggaattggtactgggtggtcctgcaaaatccccaactttgatgttcgtgaagtcgtaaataatatcaggcggctgttggatggagaagagcctctgcccatgctcccaagttataagaattacaaaggtactattgaagaactggcttcaaatcagtatgtgattaatggagaagtagctattctgaattccacaaccattgagatcactgagcttcccatcagaacatggacccagacatataaggaacaggttctagaacctatgttgaatggcaccgagaagacaccccctctaataacagactatagggaataccacacagataccactgtgaagtttgtcataaagatgactgaagaaaaattggcagaggcagagagagtgggactacacaaagtcttcaaactccagactagtctcacttgcaactctatggtactttttgaccatgttggttgtttaaagaaatatgacactgtgttggatattctaagagacttctttgagctcaggcttaaatattatggattaagaaaagaatggcttctaggaatgcttggtgcagaatcttctaaactgaataatcaagctcgctttatattagagaaaatagatggcaaaatagtcattgaaaataaacctaagaaagaattaattaaagttctgattcagagaggctatgactccgaccctgtgaaagcctggaaagaagctcagcagaaggtcccagaagaagaggaaaatgaagagaatgaagagagcgagagtgaaagcacgagccctgcagcggagtctggaccgaccttcaactaccttcttgatatgcccctgtggtatctaaccaaggagaagaaggacgagctgtgcaagcaaagggacgagaaggaacaagagctcaacacgttaaagaaaaagactccatcggatttgtggaaggaagacctggctgcttttgtggaagaactggaggttgttgaagccaaggaaaaacaggatgaacaagtaggacttcctggaaagggggtgaaagcgaaggggaagaaagcgcagatatctgaagtcctgccttctcctgtggggaaaagggtcatcccgcaggtgactatggagatgagagctgaggcagagaagaaaatcaggaggaaaattaagagcgagaatgttgagggcacccctgctgaggatggtgctgagccaggactccggcagagactagagaagaggcagaagagagagccaggtaccagggcaaagaagcaaactacattgccatttaagcctatcaaaaaagcccaaaagcaaaacccttggtctgattctgaatcagatatgagcagcaacgaaagcaattttgatgtccctccacgagagaaagagccaagaattgctgcaacaaaagccaaattcacggcggatttagactctgatgacgatttctcaggcttggatgagaaggatgaggatgaagatttcttcccattagatgatactccacctaagaccaaaatgcccccaaaaaatactaaaaaagcactgaagccacagaagagctccacatcagttgatcttgaaagtgatgggaaagacagtgtaccagcttctccaggcgcttctgctgctgacgtcccagctgagactgaaccctccaagccgtcctccaaacagacagtgggagtgaagaggacaataaccaaaggtcagtctttaacctccactgctggcaccaaaaagagagctgtaccaaaggagaccaagtcagattcagccttgaatgctcatgtctccaaaaagcctgctcctgccaaagccaagaacagtcgcaagaggatgccatcttcttctgacagctcggactctgagtttgagaaggcgatttctaaaggtgccacaagcaagaaactcaagggagaggagcgggatttccatgtggacttagatgacactgtggctcctcgagcaaaatccggacgagcaaggaagccgattaagtacctggaggagtcggatgacgacctcttctaaggggtgaggggatttcaggaatggttttactgagccacgttagttttaaagttcttccttaaccactctgaatttaattggcaggaagacttttttttaaataagaatatgcaagtgagcaggcccctgtggccttcacctttgttctcaacatactgtcagtagtggccgtctcgtgggcattgtcgtcttctctgattgtctgttttatgtctgttttctttggtctctgaaacctggcttgaatattttttggattccacataattatatgcttactcagcacagtagcatttatcaatttaaactaaagtggaaatggtttcaaaagcattcctgcctcctttcctatcccactaaatatgaggtaagacagcccttgttttcaattttataggtagaattccggccgggatcccccggcctgcctctgacggcggggactcagcttcggagagtcgggaggcatcaggtggcccgcagctctcgtcctctgcgtccttctcgcggtggctgaccgcgactccgaagaggtggctggccgctgcgcttggcggggtggggcgggatggcggcgtctgatggctggaggcggcctggccgggtactcttctacccgactctgctctacacagtgttcctggggagggtaggcagcccgaccaccgcgattggtaccaccgcatcgaccacacagtgctgctgggcgcagtgccgctgaggagcatgacgcgccggctggtactggacgagacgtgcgacggagtgatcactatgaacgaggagtacgagaccagattcctgtgcaacacctcgaaggaatggaagaatgtgggagttgagcagctacggctcagcacagtcgacatgactggagtccccaccttggccaacctccacagaggagtccagtttgctctcaagtaccagtccctgggccagtgtgtctacgtgcattgtaaggctggtcgatccagaagtgccacaatggtcgaggcctatctgattcaggtacacaactggagcccagaggaggctatagaagctatcgccaaaatccggtcacacatctccatcaggcccagccagttggaaattctcaaagagttccagaaggagattcgtgcaagggcagcaaataactaactactggtctcttgtgctgacatgagtatgaagtctgtggatgacaaagaacttggctctccgagatacagtaacatgttaaaggacaaagcgcttaagctaccaccactgcaaatgtgctgagtataatgtccctcctttgccttccttcctgaaataacacttggatggccacagagaaaaaaaaaaaaaaaaaa

SEQ ID NO: 1770 - DNA, 1050 bp, Rattus norvegicus
  Genbank Accession No. NM_022224
atgtcttctttaagtggaaaagtacaaacagttctgggccccgtagaacccagccaactgggacgcaccctgacccatgagcatctgacgatggcctttgacagtttttattgcccacctcctccatgccaggaagctgcctccagggaacctatcatgatgaaaaatttattttggattcagaaaaatccttactcccatcaagagaatcttcagttgaatcaggaggtagaagccgtaagagaagaactgttgtatttcaaggctaagggcggaggagccgtggtggagaacacgaccactggactcagcagggatgtgcgtacgctgaagtggctggcagagcagactggagtccacatcatagctggtgctgggttttacgtagacgcaactcactttgcagcaaccagagccatgtcggtggagcagcttacagatgtcctcattagtgaaattctccatggagctgacggcaccagtatcaagtgtggagttattggagaaattggctgttcctggcctttgactgacagcgagagaaaggtacttcaggctacggctcacgcccaagctcagcttggttgtccggtgatcatccaccctggacggaacccaggtgcaccattccagatcatccgagtactgcaagaagcaggggcggacatctctaaaacggtcatgtcccaccttgacaggtctatatttgataagaaagaactgctggaatttgcccaacttggctgctacttggaatatgatctctttggtacggagctccttaattaccagctaagcccagatattgatttgcctgatgataacaaaggattaggaggggtccgttttctggtgaacgaaggctatgaagatcggattctcatggcacacgacatacacacaaagcatcgactgatgaagtacggagttcacgggtactcacacatcctcaccaacgtcgttcctaagatgctcctcagaggtctgactgagagggtgctggataagatactcagagaaaaccctaaacaatggctgacttttaaatag

SEQ ID NO: 1771 - DNA, 2345 bp, Rattus norvegicus
  Genbank Accession No. NM_022266
cacagctcttctctccaagaagactcagccagacccactccagctccgaccctaggagaccgacctcctccagacggcagcagccccagcccagtggacaaccccaggagccaccacctggagcgtccggacaccaacctccgccccgagaccgagtccaggctccggccgcgcccctcgtcgcctctgcaccccgctgtgcgtcctcctgccgcgccccgaccatgctcgcctccgtcgcgggtcccgttagcctcgccttggtgctcctcctctgcacccggcctgccaccggccaggactgcagcgcgcagtgtcagtgcgcagctgaagcggcgccgcgctgccccgccggcgtgagcctggtgctggacggctgcggctgctgccgcgtctgcgccaagcagctgggagaactgtgcacggagcgtgatccctgcgacccacacaagggtctcttctgcgacttcggctcccccgccaaccgcaagattggcgtgtgcactgccaaagatggtgcaccctgtgtcttcggtgggtccgtgtaccgcagcggcgagtccttccaaagcagttgcaaataccagtgcacttgcctggatggggccgtgggctgtgtgcccctgtgcagcatggacgtgcgcctgcccagccctgactgccccttcccgagaagggtcaagctgcccgggaaatgctgtgaggagtgggtgtgtgatgagcccaaggaccgcacagtggttggccctgccctagctgcctaccgactggaagacacatttggccctgacccaactatgatgcgagccaactgcctggtccagaccacagagtggagcgcctgttctaagacctgtgggatgggcatctccacccgggttaccaatgacaataccttctgcaggctggagaagcagagtcgtctctgcatggtcaggccctgtgaagctgacctagaggaaaacattaagaagggcaaaaagtgcatccggacgcctaaaattgccaagcctgtcaagtttgagctttctggctgcaccagtgtgaagacctaccgggctaagttctgtggggtgtgcacggacggccgctgctgcacaccgcacagaaccaccacactgccggtggagttcaagtgccccgatggcgagatcatgaaaaagaacatgatgttcatcaagacctgtgcctgccattacaactgtcccggggacaatgacatctttgagtccttgtactacaggaagatgtatggagacatggcgtaaagccagggagtaagggacacgaactcatttagactataacttgaactgagttacatctcattttcttctgtaaaaaaacaaaaaggattacagtagcacattaatttaaatctgggttcctaactgctgtgggagaaaacaccccaccgaagtgagaaccgtgtgtcattgtcatgcaaatagcctgtcaatctcagacactggtttcgagacagtttagacttgacagttgttcactagcgcacagtgacagaacgcacactaaggtgagcctcctggaagagtggagatgccaggagaaagacaggtactagctgaggtcattttaaaagcagcgatatgcctactttttggagtgtgacaggggagggacattatagcttgcttgcagacagacctgctctagcaagagctgggtgtgtgtcctccactcggtgaggctgaagccagctattctttcagtaagaacagcagtttcagcgctgacattctgattccagtgacactggtcgggagtcagaaccttgtctattagactggacagcttgtggcaagtgaatttgccggtaacaagccagatttttatggatcttgtaaatattgtggataaatatatatatttgtacagttatctaagttaatttaaagacgtttgtgcctattgttcttgttttaagtgcttttggaatttttaaactgatagcctcaaactccaaacaccatcgataggacataaagcttgtctgtgattcaaaacaaaggagatactgcagtggaaactgtaacctgagtgactgtctgtcagaacatatggtacgtagacggtaaagcaatggatcagaagtcagatttctagtaggaaatgtaaaatcactgttggcgaacaaatggcctttattaagaaatggcttgctcagggtaactggtcagatttccacgaggaagtgtttgctgcttctttgactatgactggtttgggaggcagtttatttgttgagagtgtgaccaaaagttacatgtttgcacctttctagttgaaaataaagtatatatatttttataaaaaaaaaaaaaaaa

SEQ ID NO: 1772 - DNA, 1617 bp, Rattus norvegicus
  Genbank Accession No. NM_022298
gcgctgtaagaagcaacacctcctcctcgcctccgccatccacccggcagccgcgaagcagcaaccatgcgtgagtgtatctccatccacgtcggccaggctggtgtccagatcggcaatgcctgctgggagctctactgcctggaacatggcatccagcctgatggccagatgccaagcgacaagaccattgggggaggagatgactccttcaacaccttcttcagtgagacaggagctggcaagcacgtgccccgggcggtgttcgtagacctggaacccacagttattgatgaagttcgcactggcacctaccgccagctcttccacccagagcagctcatcacaggcaaggaagatgctgccaataactatgcccgtggccactacaccattggcaaggagatcattgaccttgtcttggacagaattcgcaagctggctgaccagtgcacgggtctccagggcttcttggttttccacagctttggtgggggaactggctctgggttcacctccctgctgatggagaggctctctgtcgactacggaaagaagtccaagctggagttctccatttacccagccccccaggtttccactgctgtggttgagccctacaattccatcctcaccacccacaccaccctggagcactctgattgtgccttcatggtagacaatgaggccatctatgacatctgtcgtagaaacctcgacattgagcgcccaacctacactaacttaaacaggttgataggtcaaattgtgtcttccatcactgcttccctcagatttgatggggccctgaatgttgatctgacagaattccagaccaacctggtgccctaccctcgcatccacttccctctggccacttatgcccctgtcatctctgctgagaaagcctaccatgaacagctttctgtagcagagatcaccaatgcctgctttgagccagccaaccagatggtgaaatgtgaccctcgccatggtaaatacatggcttgctgcctgctgtaccgtggtgatgtggtccccaaagatgtcaatgctgccattgccaccatcaagaccaagcgtaccatccagtttgtggactggtgccccactggcttcaaggttggcattaattaccagcctcccactgtggtccctggtggcgacctggccaaggtccagagagctgtgtgtatgctgagcaacaccacagccattgctgaggcctgggctcgcctggatcacaagtttgatctgatgtatgccaagcgtgcctttgtgcactggtacgtgggtgagggcatggaggagggagagttctctgaggcccgtgaggacatggctgccctagagaaggattatgaggaggttggtgtggattctgtggagggtgagggtgaggaagaaggagaggaatactaaattaaatgtcacaaggtgctgctttcacagggatgtttattctggtccaacatagaaagttgtgggctgatcagttaatttgtatgtggcaatgtgtgctttcatacagttactgactttaagtgtgaatgatttgtcagagacccgagccgtccacttcactgatgggttttaaataaaatactccctgtctta

SEQ ID NO: 1773 - DNA, 1160 bp, Rattus norvegicus
  Genbank Accession No. NM_022381
ttgtcagcaagacctcgctccccttacagtaactctcatctagacgtcgcaactccgccaccatgtttgaggcacgcctgatccagggctccatcctgaagaaggtgctggaggccctcaaagacctcatcaatgaggcctgctgggacatcagttcgggcggcgtgaacctacagagcatggattcgtctcacgtctccttagtgcagcttactctgcgctccgaaggcttcgacacataccgctgcgatcgcaacctggccatgggcgtgaacctcaccagcatgtccaaaattctaaaatgtgctggtaatgaagacatcattacattaagggctgaagataatgctgataccttagcactagtatttgaagcaccaaatcaagagaaagtttcagactatgagatgaagttaatggacttagacgttgagcaacttggaatcccagaacaggagtacagctgcgtagtaaagatgccatctggtgaatttgcacgtatatgccgggaccttagccatattggagatgctgtggtgatctcctgtgcaaaggacggggtgaagttttctgcgagtggggagcttggcaatgggaacattaagttgtcccagacaagcaatgttgataaagaagaggaagctgtgtccatagagatgaatgagccagttcagctaacttttgctctgaggtacctgaactttttcacaaaagccactccactgtctcctacagtaacactcagtatgtctgcagatgtaccccttgttgtagagtataaaattgctgacatgggacacttaaagtattatttggctcccaagatcgaagatgaagaaggatcttaggcgttgctagaaattgagaaactaaacctttgacgatcgcttctgagatgccagcgtgttctgaggtcttttctgtcaccaagtttgtacctgagtattcttaaatattaaaataaaatgtagatatcttctgtaaataaccttttttttcctctccataatttgcttacagaataagctccaaagtaaaaactggttttgttaacataaatgtctctgccttacaaatactggtgattttcataaatgatcttgacgctaaatgcagttttaagaaatatttttcaatttaaataaagttaactgaatttg

SEQ ID NO: 1774 - DNA, 1307 bp, Rattus norvegicus
  Genbank Accession No. NM_022390
gtgcttttgggtttggcgatcagttccgcgggagtcttgtcaggagcaggatggcggcttcgggcgaggcgcgccgagtgctggtgtacggcggcaggggtgctctgggctcgcgctgcgtacaggccttccgggcccgcaactggtgggttgccagcattgatgtggtggagaatgaagaggccagtgccagcgtgattgttaagatgacagattcattcacggagcaggctgaccaggtcactgctgaggtcgggaagctcctaggtgaccagaaggtggatgccattctctgtgtggctggaggatgggccgggggcaatgccaaatccaagtcactctttaaaaactgtgacctgatgtggaagcagagtatttggacatccaccatctctagccacttggccacaaagcacctgaaggaaggaggcctcttgaccctggccggggccaaagctgcgttggatgggactcctgggatgattggctacggcatggccaagggagccgtccatcagctctgccagagccttgcagggaagaacagtggcatgccgtctggggctgccgccattgctgtgcttcccgtcaccctggatactccgatgaacaggaaatcaatgcccgaggcagacttcagctcctggacacccttagagttcctggtggagaccttccatgactggatcactgggaacaaacggccaaactcaggaagcctaatccaggtggtaaccacagacgggaagacagagcttactccagcctatttctaagttgcacctcagtgcccaggagaaccctcttgaaactctactaacctgtgtctgtattgccgcacctggccccatgttgtctgtattcctgtttgtggtacgagataactagtcccgtttgtctcttacgtagtgctccttttttgtcctgggctggtgaggtatgtttatggggaatgagtgggggcctgtaagtagcaccatcagtgctgaggcccagggaggtatgtgtgcaggccgtcatcccagcatcccagactgctttggagacccgtttgatagttcattttttagcatttggggcactttgaaatccaacttgtttttaaattccatgttagtgccatagatgtagtttttgctgcctgaaaattaactgccatgaaaattcattggtgatgtaagtaagcaaaacctaatggactctgttggatatcatttgtgttccagcctaggctaagtgtttatgagaactattcgtgagtgttcggagtgttcttcctaataaacacatttcatgtccccgaattc

SEQ ID NO: 1775 - DNA, 974 bp, Rattus norvegicus
  Genbank Accession No. NM_022391
aattcggcacgagccaaccttgagcatctgatcctcttggcttctccttcctatcgctgagctggtaggctggagacagttgtttgggtgccaacatcaacaaacgatttctgtagtttagcgtttatgaccctggcgtgaagatttaaggtctggattaagcctgttgacttctccagctacttctaaatttttgtgcataggtgctctggtctctgttgctgcttagttcttccagccttcctcaatgccagttttataatatgcaggtctctcccctcagtaatccaggatggctactctgatctttgttgataaggataacgaagagccaggcagccgtttggcatctaaggatggattgaagctgggctctggtgtcaaagccttagatgggaaattgcaggtttcaacgccacgagtcggcaaagtgttcggtgccccaggcttgcctaaagccagcaggaaggctctgggaactgtcaacagagttactgaaaagccagtgaagagtagtaaacccctgcaatcgaaacagccgactctgagtgtgaaaaagatcaccgagaagtctactaagacacaaggctctgctcctgctcctgatgatgcctacccagaaatagaaaagttcttccccttcgatcctctagattttgagagttttgacctgcctgaagagcaccagatctcacttctccccttgaatggagtgcctctcatgatcctgaatgaagagagggggcttgagaagctgctgcacctggaccccccttcccctctgcagaagcccttcctaccgtgggaatctgatccgttgccgtctcctcccagcgccctctccgctctggatgttgaattgccgcctgtttgttacgatgcagatatttaaacgtcttactcctttatagtttatgtaagttgtattaataaagcatttgtgtgtaaaaaaaaaaaaaaaaactcgagagtac

SEQ ID NO: 1776 - DNA, 2410 bp, Rattus norvegicus
  Genbank Accession No. NM_022392
tacgctgctttggtggcgtgcacctctcacggtgtgcctagccgccgatgcccaggctgcacgatcacgtctggagctacccaagcgcgggcgctgcgaggccgtacagcctcccgcgaggcatgattgcggcggccctctgtccgcagggccccggagcccccgagcccgagcccgcgccccggggccagcgagagggaaccgcaggcttcagcgcacgacccggcagctggcaccacgacctggtgcagcggagcctcgtgctcttctcatttggcgtggtcctggctctggtgctcaacctgctgcagatccagcggaatgtcacgctcttcccggacgaggtgatagccaccatcttctcctccgcctggtgggtgcccccgtgctgtggcacggcagccgctgttgtcggcttattgtatccctgtattgacagtcacctgggagaaccacacaagttcaagagagagtgggccagtgtcatgcgatgtatcgcggtgtttgttggcatcaaccatgccagtgccaaattagatttcgccaataatgtgcagctgtccctgactctggcagccctatccttgggcttgtggtggacgtttgatcgatcccgaagtggcctggggctcgggatcaccatcgccttcctagccacgctgatcactcagtttcttgtttataatggcgtctaccagtacacgtccccagatttcctctatatccgttcttggctcccttgtatatttttctcaggaggtgtcacagtgggaaacataggacgacagttagctatgggtgttccagaaaagcctcacagtgactgagtttgagcacatgattcagggcggaagcagaatgtggagacactggtcctgggtgtggtgaagaggatctttttctcaatgttccatttagactgggctgatgataaatgactcctaaagatgcgttcacgtagtctaaatagcaagtggaggcaaggactacttacctaaagtcttaccttgctcacccaccctcacacctgtctgcactggaacattctatcccaggctgtatgtgagagttgggtaagggggccggtttcccgagtattagatttcactcatcattcaaagcaaaatgccatatttcaaagccttgaatcaaaatgaattaccaactagcagttttatatcagtgcccaaaggagagaggttgatggtgcttaacagagatgaagtatgtgcagtaagaatatttatccagaattaaaatatagggttgtgtaaagaggggctaagggcagcagtaagttggaggaagatcatgctccccggaggacccagtgcagccacatctccaggtctcgctcaggctggcgctcacacgtgggtctcatcagtgtgggaactatgctgtttactgacaggaggcttgtagacaatcttactgacagcccaggacaacacaaagtcaggattctgcattgcgatgctggacttttcatctcaatttaagtgaagttttatccaagatctggagcatctaagagtgaatagctgtctgctgtttcagtcgtaatgagccgaaattgtgtctctgtcactccagagtggagaggacttttccacagccctatggagcttgcaatctgtgattgccttgtaaaaggttgagtgtgcacgtcactgcgttcggtgcgcagtgtcctgtgtgtgttggacagcgtagaacacatgggaccttgcaagtattgggtcttcaacttcaagtgcaatgtgtatgaaaccaatctgagccttgtattctcttaaatatttattatttttttttaaccgcgcgagctgttctggagaagggttctcgggtcatttcagagctgtgtgaggcacactcagcaatactgtgtcagccgtgacgctccccagtcacaccctccactacaccctagtcctttgacatactccaggtttgtaagtttagtgatttttacttacaaatttacccttttttgcattctaaaattgtgtttaaattatatggaagtacttggtgtaggcagtcattggtccccgggcagcagaagctctgcctgtggaatcgggtttgggttcactctgcagggctcctcatagaggctttgcttatttgttttgaggaaaatgtctggagtaaacctttgttttctgaaactactttagctaaaagaaaatgggtgttctagactttggaatggttcttaaagtttcctggaaataaaaataatgattggcacttcaaagacattctttagccaagacttcagtgtctagcagaaaccacaagtgactagaagagcaagtgatcttggtgatgcacttgattgtatacaatgagtattttttctcttaaactggaaataaatctgttagaaataatatagcca

SEQ ID NO: 1777 - DNA, 1358 bp, Rattus norvegicus
  Genbank Accession No. NM_022393
ccacctctggccactgctgcacagggaagccacgatttcacacagttccaggacttacctcagcttcacactgcttctgacactctccttggtcccagctcagtatctgtctggattctggtgtctcggtttcagttcagatagccctagaggccttgtgtttgtgcaagcatgacaatggcatatgaaaacttccagaacttggggagcgaagagaaaaaccaagaggctggtaaagctcctccccagtccttcctgtgcaatatcctctcttggacccacctcctcctgttctccctgggccttagcctcctgctgctggtggttatctccgtgattggatcccaaaattcccagttaaggagggacctagaaaccctgagaaccactttagacaacaccacctccaacaccaaggctgaactacaggccctggcctccaggggtgacagcttgcaaacaggaatcaattctctgaaagtggaggtggatgatcatgggcaggaactgcaggcaggccgaggcttgagccagaaggtggcttctctggagagcacagtggagaagaaggagcagactctcagaacagatctatctgaaataaccgatcgtgtgcaacagctggggaaggacttgaagaccctgacatgtcagctggccagcctcaagaacaacggctcagcagtggcctgctgcccccttcactggatggagcatgaaggcagctgctactggttctctcagtctgggaagccgtggcctgaagctgacaagtactgccagctggagaattctaacctagtggtggtcaactccctggcggagcagaattttctacagactcacatgggcagtgtggtcacttggattggcctaacggaccaaaatgggccctggcgatgggtggacgggaccgactatgagaaaggctttacgcactgggccccaaagcagccagataactggtatggacacgggctgggaggaggcgaggactgtgcacacttcacctcagatggtcgctggaatgatgacgtttgccagaggccctaccgctgggtctgtgagatgaagctggccaaggacagctaggagcactctccaagtaatttatttcttcagtggttttagctggggaagcctggagtttggactcctcctatcccatttcaatgttatttgggacttttctttttgtcaaaaaatttaagtcaaggagaaaggattgtgtttgagatggtagtgtggtgtccggaagaatggggttattgaaatctgtggtattttgtacagagtgccgcttattgtaggactttttaatgtaacaaaaataaaatactgttggttttaaaaaaaac

SEQ ID NO: 1778 - DNA, 1570 bp, Rattus norvegicus
  Genbank Accession No. NM_022395
ccctatccacagcagagatggcggcggcggctgtatcccggacgttgttgccggtggccggacggcgcctgtggggatttacgcgaaggcttccgctccgcgccgccgctgctcagccattgtactttggaggggaccgactcagaagtacacaggctgctccacaagttgttctgaatgttcctgagacacaagtcacttgtttggaaaatggactcagggtagcttctgaaaactctgggatctcaacatgcaccgttgggctgtggatcgatgctggcagtcggtatgagaatgaaaagaacaatggcaccgctcactttctggagcacatggctttcaagggcactaaaaagaggtcccagttagaccttgaacttgagattgagaacatgggtgcccatctcaatgcctatacctccagagagcagactgtctactacgccaaagccttctccaaagatttgccaagagctgtagaaattcttgctgacataattcagaacagtacattgggagaggcagagattgaacgtgagcgtggagtcatcctcagagaaatgcaggaagttgagaccaacttgcaagaagttgtctttgattatctgcacgccacagcctatcaaaacaccgcgctcggacggacaattctgggaccaaccgagaacatcaaatctataagccgtaaggacttagtggactacataaccacacattataagggaccaagaatcgtgctggctgctgctggaggtgtttgccataacgaactgctggagttagcgaagtttcattttggtgactctttgtgcgcacacaaaggagatgtaccagctctgcctccctgtaaattcactggaagcgagattcgggtgagggatgacaagatgccactggcgcacctcgcagtggctattgaagcagttggttggacgcacccagacacgatccgtctcatggtcgcaaacacactgataggcaactgggaccgctctttcggaggaggaatgaatttatcgagcaagctggcccagctcacgtgccatggcaatctctgccacagcttccagtccttcaacacctcctacacagacacaggattgtgggggctctatatggtttgtgaacaagccacagttgctgacatgctgcacgctgtacaaaaggaatggatgcgtctgtgcacagctgttagtgagagtgaggtcgcacgcgccaaaaaccttctcaagacaaacatgctgctgcagcttgatgggtcaactccgatctgtgaagacatcggtaggcagatgctatgctacaacaggagaatccccatccctgagcttgaggccaggatcgatgctgtggacgcggagatggttcgagaagtgtgcaccaagtacatttatggcaaaagcccggccattgctgctctcggtcctattgagcgcttaccagattttaaccagatttgtagtaacatgcgctggactcgtgactgatttttgtgatgaattatcctacacatacatatttataaaactgagacctagaagttttgaaagactgctcatcttcaagtgaa

SEQ ID NO: 1779 - DNA, 1882 bp, Rattus norvegicus
  Genbank Accession No. NM_022399
cgggggccagtgtgccgccgccccctcggcccgccatgctcctttcggtgccgctcctgcttggcctcctcggcctggctgccgcagaccctgccatctatttcaaagagcagttcttggacggagatgcctggaccaaccgctgggtcgaatccaaacataagtctgattttggcaaattcgtcctcagttctggcaaattctacggggaccaggagaaggataaagggttgcagacaagccaagatgcccgattttacgcgctgtccgccagattcgaacccttcagcaacaagggccagacactggtggtacagttcaccgtgaagcatgagcagaatatcgactgtgggggcggctacgtgaagctgtttccgggtggcttggaccagaaggacatgcatggagactcagaatataacatcatgtttggtccggacatctgcggtcctggcaccaagaaggttcatgtcatctttaactacaagggcaagaacgtgctgatcaacaaggatatccggtgtaaggatgatgaattcacacatctatacacgctgattgtgcggccagacaacacctacgaggtgaaaattgacaacagccaggtggagtcgggctccttggaggatgattgggactttctgccgcccaagaagattaaggatcctgacgctgccaagccagaagactgggatgaacgagccaagattgatgaccccacagattccaagcctgaggactgggacaagccagagcacatccctgaccctgatgctaagaagcctgaggactgggacgaagagatggatggagagtgggaaccaccagtgattcaaaatcctgaatacaagggcgaatggaagccacgtcaaattgacaacccagattacaagggtacctggatacacccagagattgacaatcctgaatactcccccgatgcgaatatctatgcctatgatagttttgctgtactgggcttagacctctggcaggtcaagtctggcacaatttttgacaacttcctcatcaccaatgatgaggcctatgcagaggagtttggcaatgagacctggggtgtcaccaaggctgcagagaagcagatgaaggacaagcaggatgaggagcagaggcttaaggaagaagaagaagacaagaagcgtaaagaggaagaggaggccgaggataaagaggatgaggatgacagagatgaagatgaagatgaagaggatgagaaggaagaagatgaggaggatgccactggccaagccaaggatgagctgtagaggccacaccacctgcctccagggctggactgaggcctgaacacccgccacagagctggctgctccaataatgtctctatgagactcaagaacttttcattttttttccaggcaggttcaggtctggggtggattctgatttttgttccccctgcctcccccaatccctcccccaaccccccctttttttttactggtgtttgtctttaattcttcagccctcaacctcctggcctctcatttttgaatcaacattttttctttctgtccctttctccatctcttggtcactatcctccaactctaggaacaggtatggaggaaaagccctaggcttgagatttcatctgctctcctttctgaatctcagaggagggtaggagaagggggtggtatcttccctccccccagcactgaggaagaatggggctcttcccctttctcccttgcccccaggactgggccatttgtggggcagccagttctagcacagctcacactgagagtgtaagaactacaaacaaaatttctattaaattaagttttgtgtcttcaaaaaaaaaaaaaaaaaaaaaaaaaaaaaaaaaaaaaaaaaa

SEQ ID NO: 1780 - DNA, 15231 bp, Rattus norvegicus
  Genbank Accession No. NM_022401
atggtggctggcatgctcatgccactggaccagcttcgggccatctatgaggtgctctttcgtgagggggtgatggttgccaagaaggaccggcgaccccgaagcctgcatccccatgtgcccggcgtcaccaatctacaggtcatgcgtgccatgacctcgctgaaagctcggggcctggtgcgggagacctttgcctggtgccacttctactggtacctgaccaacgagggcatcgaccacctacgccagtacctacacctgccaccggagatcgtacctgcctctctgcagcgtgtgcgccgccctgttgccatggtgatgcctgcacgtcgtcgctccccccatgtgcagaccatgcaaggtcccttaggctgtccaccaaagaggggccctctgccagctgaggaccctgcccgggaggagcggcaggtctatcgcaggaaggagcgtgaggaaggggcacctgaaacccctgtggtgtctgccaccatcgtggggaccctggccaggcccggcccagagcccaccccagccacagatgaacgagaccgtgtgcagaagaaaacttccaccaagtgggtcaataaacaccttatcaaggctcaaaggcacatcagtgacctgtatgaagacctccgtgatggccacaacctcatctccctgctggaagtcctctcaggagacagcctgccccgagagaaggggaggatgcgtttccacaagctgcaaaacgttcagattgccctggactatctccgacatcggcaggtgaagttggtgaacatcagaaatgatgacatcgccgatggcaaccccaagctgaccctgggcctgatctggacaatcatcctgcacttcaagatctcagacattcaggtgagcggccagtccgaggacatgacagccaaggagaagctgctgctgtggtctcagcgtatggtagagggctaccaaggcctgcgctgtgacaacttcaccaccagctggcgcgacggccggctcttcaatgctatcatccacaggcacaagcccatgctcatagacatgaataaagtgtaccgacagaccaacctggagaacctagaccaggccttctccgtggcagagcgggacctgggagttaccaggctcctggacccagaagatgtggatgtccctcagcctgatgagaagtccatcatcacctacgtttcatccctgtatgatgccatgccccgtgtgccgggcgcacaggatggagtgagggccaatgagctgcagcttcgttggcaagagtaccgggagcttgtgctgctgctgctacagtggatccggcaccacaccgctgcttttgaggagcgcaagttcccctccagctttgaggagattgagatcctatggtgccagtttctgaagttcaaggagacagaacttcctgccaaggaggcagacaagaaccggtccaaaggcatctaccagtctttggagggagcagtacaagcaggccagctcaagattccccctggctaccacccgctagacgtggaaaaggagtggggcaagctgcacgtggccatcctggagcgggagaagcaactccggagcgagtttgagaggctggagtgtcttcagcgcattgtgagcaagctacagatggaggctgggctatgtgaggagcagctgtaccaggcggattccctactgcagtcggatattcggctgctggcctcaggcaaggcggcacagcgggctggggaagtggagagagacctggacaaggctgatggtatgatccggctgttgttcaatgatgtgcagacccttaaagatgggcggcatccacagggtgaacagatgtaccggagggtgtatcgtctgcatgagcgcctggtagccatccgcactgaatacaacctccggctgaaggcaggggtgggtgcccctgtgacccaggtgaccctgcagagcacacagaggcgcccagagctagaggactccacactgcgttacctgcacgacctgctggcatgggtggaggagaaccagcgtcgaatagacggtgctgagtggggcgtggacttgcccagtgtagaggcacagctgggcagccaccgaggcatgcatcagtctattgaggaattccgggccaagatcgagcgggctcggaatgatgagagccagctctcccctgccacccgaggtgcctaccgagactgcctgggccgcctggacctgcagtatgcaaagctgctgaactcctccaaggcccgcctccggtccctggagagcttgcatgggtttgtggcggcagctaccaaggagctgatgtggctgaatgagaaggaagaggaagaagtgggctttgattggagtgaccgcaacaccaacatggctgccaagaaagaaagttactcggccctgatgcgtgagctggagatgaaggaaaagaaaattaaggagatccagaacacgggggacaggttgctgcgggaagaccatcctgcccggcccacagtggagtccttccaggctgccctgcagacacagtggagctggatgctgcagctgtgttgctgcattgaagcgcacttgaaagagaacacagcctacttccagttcttctcagatgttcgggaggctgaggaacagttgcagaaactacaggagacgttacgcaggaagtacagctgtgaccgctccatcactgtcacaaggcttgaggacctgctgcaggatgcccaggatgagaaggagcaactgaatgagtacaaagggcacctctcaggcctggccaagcgggccaaggctattgtgcagctgaagccacgcaaccctgcccaccctgtgcggggtcacgtgcccctgctagctgtgtgtgactacaagcaggtggaggtgactgtgcacaagggtgaccaatgccagctggtgggccctgcacagccgttccactggaaggtgctcagtagttccggcagtgaggctgccgtgccttctgtgtgctttcttgtgccgccacccaaccaggaggcccaggaagctgttgctaggctggaggcccagcatcaggccctggttactctgtggcaccagcttcacgtggacatgaagagtcttctggcatggcagagcctcaatcgtgacatacagctcatccggtcctggtccctagtcacgttccgcacgctgaagcccgaggagcagcggcaagctctgcgcaacctggagttgcactaccaggccttccttcgagacagccaggacgctggtggctttgggcccgaggaccggctggtggcagagcgcgaatatggatcttgtagtcgccactaccagcagctgctacaaagcctggagcagggtgagcaggaagagtctcgctgtcagcgatgcatctcggagctcaaggacattcggctgcaactggaggcctgtgagactcggactgtgcaccgtctgcggctgccactggataaagaccccgcacgggagtgtgcccagcgcatcgctgagcaacagaaagcacaggctgaggtggaggggctgggcaagggagttgcccggctgtctgctgaggctgagaaagttctggccttgccagagccgtcacctgctgcaccaactctgcgctcggagttggaattgaccctgggcaagctggaacaggtcagaagcctgtctgccatctacttggagaaactcaagaccatcagcttggtaattcgcagtacccagggggctgaggaggtgcttaaaacacacgaggagcacctgaaggaggcccaggccgtgcctgccacactccaagagctcgaagtcaccaaggcttcactaaagaagctgcgggcccaggcggaggcacagcagcctgtattcaacaccctacgagatgagctgaggggggcacaggaagttggtgaacggctacagcagcggcatggtgagcgggacgtggaagtagagcgctggcgagaacgtgtcactcagttgctggagcgctggcaggctgtgctagcccagactgatgtgcggcagcgggagcttgaacagctgggccgccaacttcgctactaccgtgaaagtgcggatccgctgagctcctggctgcaggatgccaagagccggcaagaacagatccaggctgtgccaatagccaacagtcaggctgcacgagaacagctgcgccaggagaaggccctgctggaggagattgagcgccatggtgagaaggttgaggagtgccagaagtttgctaagcagtacatcaatgcaatcaaggactatgagctccagctgatcacctacaaggctcagcttgaacctgtggcctcccccgccaagaagcccaaggttcagtctggatcggagagcgtcatccaggagtacgtggatctgcgtacacgctacagtgagctgaccacactcacgagtcagtacatcaagttcatcagtgagacactgcgccgcatggaagaggaagagcggctggctgagcaacagcgggcagaggagcgggagcgcctggccgaggtggaggccgcgctggagaagcagcggcagctggctgaggcccatgcccaggccaaggcacaggccgagctggaggcacgagaactgcagcggcgcatgcaggaggaggtgacgcggcgcgaggaggcggcggtggacgcacagcaacagaagcgcagcatccaagaggagctgcagcatctgcggcaaagctcagaggcagagatccaggccaaggcccagcaggtggaggctgcagagcgcagccgcatgcgcattgaggaagagatccgcgtagtccgtctgcagctagagacaactgagcgtcagcgtggaggggcggaggatgagctgcaggctctgcgtgcacgggctgaggaggcagaagcacagaagcggcaggctcaggaggaagccgagcgcttgcggaggcaggtgcaggatgagagccaacgcaaacggcaggcggaggccgagctggccctgcgtgtgaaggcagaagcggaggcagcgcgagagaagcagcgggccctgcaggctctggatgaactgaaactgcaggccgaggaggccgaacggtggctgtgccaagccgaggcagagagggctcgccaagtgcaggtagccctggagacagcgcagcgtagtgcagaagtggagctgcagagcaagcgtccgtcctttgcagagaagaccgcacagttggagcgcacgctgcaggaagagcacgtgacagtgacacagctgcgggaggaggcggaacggcgggcacagcagcaggctgaagccgagcgagcccgtgaggaagccgagcgggagctggagcgctggcagctgaaggccaatgaggcgctgcggctgcggctgcaggcagaggaggtggcacagcagaagagcctggcccaggccgatgcggagaagcagaaggaagaggcagaacgggaagcccggcggcggggcaaggcagaggagcaggccgtgcggcagcgagagctggctgagcaggagctggagaagcagcggcagctgacagagggcaccgcccagcagcgcctggctgccgagcaggagctgattcgcctgcgggcagagacggagcaaggtgagcatcagcggcagctgctggaggaagagctggcccggctacagcacgaagcgacagcagccacacagaagcgccaggagctggaggctgagctggcgaaggttcgggcagagatggaggtactgctggccagcaaggcacgagccgaagaggagtctcgctccaccagtgaaaagtccaagcagaggctggaagctgaggcagggcggtttcgagagctggctgaggaggctgcccgcctgcgtgctctggccgaggaggcaaggcggcaccgggagttggccgaggaggacgcggcacgccagcgggccgaggcggacggagtgcttacggagaagctggctgccatcagtgaggccacaaggctcaagacggaggcagagattgcactcaaagagaaggaggccgagaacgagcgcctgaggcgcctggctgaagatgaggccttccagcggcgccggctggaggagcaggcagcacagcacaaggcagacatagaggagcgcctggcccagctgcgcaaggcatccgagagcgagctggagcgacagaaggggttggtggaggataccctgcggcagcggcggcaggtggaggaggagatcatggctctgaaggcgagcttcgagaaggccgcggctggcaaggcagaactggagctggagcttggccgcatccgcagcaatgccgaggacaccatgcgcagcaaggagctggccgagcaggaggcagcgcggcagcggcagttggcagctgaggaggagcagaggcgccgggaagccgaggagcgggtgcagaggagcctggcagcggaggaggaagccgcacggcagcgcaaggtcgcactggaggaagtcgagcggctcaaggccaaggttgaggaagcgcggcgcctgcgagagcgagctgagcaggagtctgcgaggcagctgcagctggcccaggaggctgcccagaaacggctgcaggcggaggagaaggcgcacgcctttgtggtgcagcagcgagaagaggagctgcagcagactcttcagcaagagcagaacatgctggagcggctgcggagcgaggcagaggcagcgcggcgagctgctgaggaggcggaggaggcccgggagcaggcagaacgtgaggcagcgcagtctaggaagcaagtggaagaggccgagcggctgaagcagtcggcagaggagcaggctcaggcccaggcccaggcgcaggcggctgcagagaaactgcgcaaggaagcggagcaggaggcggcgcgtcgggcccaggcggagcaggctgcgttgaaacagaagcaggcagccgacgcggagatggagaagcacaagaagtttgcagagcagacgctacggcagaaggctcaggtagagcaggagctgaccacgctgaggctgcagctcgaggagaccgaccaccagaagagcatcctggatgaggagctgcagcggctaaaggctgaggtaacagaggcagcccggcagcgtagccaggtagaggaggagctcttctctgtccgcgtgcagatggaggagctgggcaaactcaaggctcgcattgaagctgaaaaccgggcactcatccttcgtgacaaggacaacacacagcgcttcctggaggaggaggccgagaagatgaaacaggtggcagaggaagctgcacggttgagcgtagctgcccaggaggcagcaaggctgcggcagctagccgaggaggacctggcccagcagcgggccctggcggagaagatgctgaaggagaagatgcaggcggtgcaggaagccacaaggctcaaggctgaggctgagctgctgcagcagcagaaggagctggcacaggagcaggcccggcggctgcaggcggacaaggagcaaatggctcagcagttggtagaggagacacagggtttccagcggaccctggaggctgagcggcagcggcagctagaaatgagcgcagaggctgaacgcctcaagttgcgcatggctgagatgagccgggctcaggcccgtgcagaggaggatgcccagcgcttccggaagcaggctgaagagatcggcgaaaagctgcaccgcactgaactcgctacacaggagaaggtgacattggtgcagactctcgagatccagcgacagcagagtgaccaagatgccgagcgtctgagggaggccattgctgagctggagcgtgagaaggagaagctcaagcaggaggcgaagttactgcagctcaagtctgaggagatgcagactgtgcagcaggagcagatactgcaggagacacaggccctgcagaagagctttctctctgagaaggacagcttgctgcaacgcgaacgcttcatcgagcaggagaaggccaagctggagcagcttttccaggacgaggtggcaaaagcaaaacagctgcaggaggagcagcagcggcagcagcagcagatggagcaggaaaagcaggagctggtggccagcatggaggaggcccggaggcggcagcgtgaggcagaggagggtgtgaggcgcaagcaagaggaactgcagcgtctggagcagcagcggcagcagcaggagaaactactggcagaggagaaccagaggctgcgggagcggctgcagcgcctggaggaagagcaccgagctgcgttggcgcactctgaggagatcgccacctcccaggctgctgccacaaaagcactgcccaatggccgcgacgcacttgatggcccctccatggaggccgagcccgagtacacctttgagggattacgtcagaaggtgccagctcagcagctacaggaagcaggcattctgagcatggaggaactgcagcgtttgacacagggtcacaccacggtggctgagctcacgcagcgggaagatgtgcgccactacctgaagggcggcagcagcatcgcaggattgctcctgaagcccaccaatgagaaactgagtgtctacacagccctacagcggcagctgctcagccctggaacagcccttatcttacttgaggcccaggcagcctcgggcttcctgctggaccctgtccggaaccggcggctgacggtcaatgaggctgtgaaggagggtgtggtgggtcccgagctgcaccacaagctgctgtcagctgagcgtgccgtcactggctacaaggacccttacacaggagaacagatctctctcttccaggccatgaagaaggacctcattgtcagggaccatggcatccgcctgctggaagcccagatcgccacaggtggcatcattgaccctgtacacagccaccgtgttcccgtggacgtggcctaccagcgtggctacttcgatgaggagatgaaccgtgtgctggctgacccaagcgatgacaccaagggcttctttgaccccaacactcacgagaacctcacgtacctgcagctgctggagcgctgtgtggaggaccccgagacaggcctgcgcctcctgccactcacagacaaggctgccaagggtggtgagctggtgtacactgacacggaggcccgtgacgtcttcgaaaaggccacagtgtctgcaccattcggcaagttccagggcaagaccgtgaccatctgggagatcatcaactcagagtacttcacagcggagcagcgacgggacctgctccggcagttccgcacgggccgcatcacggtggagaagatcatcaagattgtcatcacggtggtagaggaacacgagcggaagggccagctctgctttgagggcctccgtgcccttgtgcctgctgcagagctgctggacagtggagtcatcagtcatgaagtctaccagcagctgcagcggggtgagcgctctgtgcgggaagtggccgaggcagacgaggtgaggcaggccctgcggggtaccagtgtcattgccggtgtgtggctggaagaagcagggcagaagctgagcatctatgaggccctgaggagagatttgctgcagccagaggtggctgtggccttgctggaggcccaggctggcactgggcacatcattgaccctgccacgagtgccaggctgactgtggatgaggcagtgcgtgctggcctggtgggtcctgagatgcacgagaagctcttgtcagctgagaaggctgtaacaggctatagggatccctactcgggacagagcgtctcgctcttccaggctctgaagaagggtctcatcccccgagaacagggcctgcgcctgctggatgcccagttatccactggtggcattgtagaccccagcaaaagccaccgtgtgcccctggatgttgcctatgcccggggctacctggacaaagagactaacagggccctgacgtcacccagagacgatgccagagtctaccttgaccccagcacccgggagccagtcacctacagccagctccaacagcggtgccggtctgaccagctgactgggttgagcctactgcccctctcagagaaggccgtccgggcccggcaggaagaggtctactctgagctccaggcccgtgagacattggagaaggccaaggtggaggttcctgtgggcggctttaagggcagggcgctgacagtgtgggagctcataagctcggaatacttcactgaggagcagcggcaggagctgctacggcagttccgcacaggcaaggtcactgtagagaaggtcatcaagattcttatcaccattgtggaggaggtggagactcaacggcaggagagactgtccttcagtggcctccgtgcccctgtgccggccagtgagctcctggcctccaagatcctcagcagaactcagtttgagcagctcaaggatggcaagacatcagtcaaagatctgtcagaggtgggctctgtgcggacactgctgcaaggcagcggctgcctggctggcatctatctggaggactcgaaggagaaagtaaccatctatgaggccatgcgccggggcctcctcagagccagcacagccacactcctgctggaggcccaggcggccactggttttctagtggaccctgtgcggaaccaacgtctgtacgtccatgaagctgtcaaggctggagtggtgggcccggagctccatgagaagctgctgtcggctgagaaggcggtcactggttacaaagatccctactctggcagcaccatctcgctgttccaggccatgaagaagggcttggtcctcagggaccatgccatccgcctgctggaggcccagattgccacaggtggcatcattgaccctgtgcacagtcaccgccttcccgtagatgttgcctaccagcgtggctacttcgatgaggagatgaaccgtgtgctggctgacccaagtgatgacaccaagggcttcttcgaccccaacacccacgagaacctcacgtacctgcagctgctggagcgctgcgtggaggaccccgagacaggcctgcgcctcctgccactcagaggggcagagaagacagaggtggtagaaaccacacaggtgtatactgaggaggagactcggagggcgttcgaggagacgcagattgacatcccaggtggtggcagccacggtggctcctccatgtctctatgggaggtgatgcagtcagacatgatcccagaggaccagcgtgcccggctcatggccgactttcaggctggcagagtgaccaaggagcgcatgatcattatcatcatcgaaatcattgagaagacggagatcatccgccagcagaacctcgcctcctatgactacgtacgccgccgcctcaccgccgaagacctgtatgaggcccggatcatctcccttgagacctacaacctcttccgggaaggcaccaagagcctccgtgaggttctggagatggaatctgcctggcgctacctttacggcacaggatcggtggccggtgtctacctgcctggctctaggcagacgctaaccatctaccaggcccttaagaaggggctgctgagtgccgaggtggcccgcttgctgctggaagcacaggcagccacaggctttctgctggacccagtgaaaggcgagaggctgactgtggacgaggccgtgcggaagggtctggtaggccccgagctgcacgatcggctcctctctgccgagcgagctgtaactggctaccgagacccctacaccgaacagcccatctcactcttccaggccatgaagaaggagctgatccctgccgaggaggcactgaggctgctggatgctcagctagccacaggaggcattgtggacccccgcctgggtttccacctccccctggaggtggcttaccaacgaggctacctcaataaggacacgcatgaccagttgtcagagcccagtgaggtgcgcagctatgtggacccctccacggatgagcgtctcagctacacacagctgctcaagcgttgccgccgtgacgacaacagcggccagatgctgctgccgctctctgatgcccgcaagctgaccttccgcggcctgcgcaagcagatcaccgtggaggagctggtacgctctcaggtcatggatgaggccacagcactgcagctgcaagaaggcctgacctccattgaggaggtcactaagaacctgcagaagttccttgagggtaccagctgcattgctggagtctttgttgatgctaccaaggaacggctgtcggtgtaccaggccatgaagaagggcatcatccgtcccgggacagccttcgagctcctggaagcgcaggcagccaccggctacgtcattgaccctatcaaggggctcaagctgactgtggaagaggccgtgcgcatgggtatcgtgggccccgagttcaaggacaagctgctgtctgctgagcgtgccgtcactggctacaaggacccttactctgggaaactcatctctctcttccaggccatgaagaagggcctgatcctgaaggaccatggcatccgcctgctagaggctcagatcgccaccggtggcatcattgaccctgaggagagccaccgcctgcctgtggaagtggcctataagcgtggtctctttgatgaggagatgaacgagatcctgactgacccctcagatgacaccaagggcttcttcgacccaaacaccgaggagaacctcacatacctgcagctgatggagcgctgtatcactgacccccagactggcctgtgtctcctgccgctgaaggaaaagaagcgggagcggaagacgtcctccaagtcctcagtgcgcaagcgccgcgtggtgattgtggaccctgagacgggcaaggagatgtcagtgtatgaggcctaccgcaagggcctcatagaccaccagacatacctggagttgtcagagcaggagtgcgagtgggaagaaatcaccatctcttcctcggacggcgtcgtcaaatctatgatcatcgaccgccgctctggccgccagtatgacattggtgacgccatcaccaagaacctcattgaccgctcagcactggaccagtaccgcgctggcacactttctatcaccgagtttgccgacatgctctcaggcaacgctggtggcttccgctcccgctcctcctctgtgggctcatcttcctcctaccccatcagttctgctgtccctaggacccagctagcctcctggtctgatcctactgaggagactggcccagtggccggcatcctagacacagagactctggagaaggtgtccatcacagaggccatgcaccgcaacctggtagacaacatcactggccagcggttgctggaggcacaggcctgcaccgggggcatcattgaccccagcactggtgagcgcttcccggtcactgaggctgtcaacaagggcctggtggacaagatcatggtagaccgtatcaatctggcccagaaggccttctgtgggtttgaggacccacgcaccaagaccaagatgtcagctgcccaggccctgaagaagggctggctttactacgaggcaggccagcgtttcctcgaggtgcagtacctgacgggtggtctgattgagcctgacacacctggccgtgtgtctcttgatgaagccttgcaacgtggcactgtggatgcccgcacagcccagaagctgcgtgatgtcagtgcctactccaagtacctcacgtgccccaagaccaagctcaagatctcttacaaggacgctctggatcggagcatggtggaggagggcacagggctgaggctgctggaagccgcggcacagtccagcaagggctactacagcccgtacagtgtcagtggctctggctctactgctggttcacgcactggttcacgcaccggctccagggccggctcccgtcgtggcagctttgatgccactggctctggcttctccatgaccttttcttcttcctcctactcttcctcaggctatggccgccgctatgcctcagggccttcagcctctcttgggggccctgagtctgcagtggcctgatcccccagcctgtatcctgccttcccgctctgcatgtcgccaggctccccgtggaggcgctggggtcttttctttcttcttctttttttttttttttttaacatttaaaggtgtcttcctcccaagcggtgcctaaaatctaaccaaaaagaccagaataacacattaatatatatatatatatgcgatgtccagacagcctgtgtcttgggaaacagggctggcccaggcccagtgaccactccactctccttgggcctccctaatcctttctacctgccactcaccacagctaggtgccttggagaatccagagctgggcactcagcccactactcctgtctctcctgggaggattgccatctgggaaaggcccccagacctctaagccaaccccactggatgtctacctgctggtcctagctgctgaggggaactggggacggtcctgtgagcagacagctgttgagtctcttgaggcctctgccctgagccagctgcttctccccagtgtatacctgaatattcagtgggttttgctggcaaaggaaagatcccaggccaaccatctcttccagcctgcccagagaagccccttccccatgggaagataaggcctggtcctggccccagcctcccgcctggctcctgcagctgccattggagctgtgctttgtagctcactaccccatacttattcccttgagacctgagcctctgcttcagccttccagcctcaactccccttgtaagtgccttctgtgtccttgtacccaggccctaaagacccagacccagggcaagagatggacattctggctgggcggggctggagggttctgcagatctgagaattccttctccagaggcccagggtcttcaagcctgtggaacccctctgggtgctgctgcccaccccactcccagggagccctggccagcccagctgtgctaacataagtacttggccagtgacactctcccttccctggccttggtggctcctacccctgcctccaccctctgagtgagctttgcatgttccactaaccttgagctggtgacaggtggagatgccaggcagaacactaacctgaccatgggcgggggccctgcggtgtccgcccctcaataaaagcaattccaaccttaaaaaaaaaaaaaaaa

SEQ ID NO: 1781 - DNA, 1046 bp, Rattus norvegicus
  Genbank Accession No. NM_022402
acgagggcaatccctgacgcaccgccgtgatgcccagggaagacagggcgacctggaagtccaactacttccttaagatcatccaacttttggatgactacccaaaatgcttcattgtgggagcagacaatgtgggctccaagcagatgcagcagatccgcatgtccctccgcgggaaggctgtggtgctgatgggcaagaacaccatgatgcgcaaggccatccggggccacctggagaacaaccccgctctggagaagctgctgcctcacatccgggggaacgtgggctttgtgttcaccaaggaggacctcaccgagattagggacatgctgctggccaataaggtgccagctgctgcccgagccggtgccatcgccccgtgtgaggtcacagtacctgctcagaacaccggtctggggcccgagaagacctctttcttccaagctttgggcatcaccactaaaatctccagaggtaccattgaaatcctgagcgatgtgcagctgataaagactggagacaaggtgggagccagcgaagccacactgctgaacatgttgaacatctcccccttctccttcgggctgatcatccagcaggtgtttgacaatggcagcatctacagcccagaggtgctggacatcacagagcaggccctgcacactcgcttcctagagggtgtccgcaatgtggccagcgtctgtctgcagattggctacccgactgttgcctcagtgcctcactccatcatcaatggatacaaaagggtcctggctttgtctgtggagactgactacaccttcccactggctgaaaaggtcaaggccttcctggccgatccatctgcatttgcggctgcggcccctgtggctgctgccaccactgctgctcctgcagctgctgctgccccagccaaggtcgaagcaaaggaagagtcggaggaatccgatgaggacatgggattcggtctcttcgactaagcccctcacaccaagtcagcctgcttaatttgagaaagatggaaataaaggcttacttctctt

SEQ ID NO: 1782 - DNA, 552 bp, Rattus norvegicus
  Genbank Accession No. NM_022500
atgacctctcagattcgtcagaattattccaccgaagtggaagctgccgtgaaccgcctggtcaacttgcacctgcgggcctcttacacctacctctctctgggcttcttttttgatcgggatgacgtggctttggaaggcgtaggccacttcttccgcgaattggccgaggagaagcgcgagggcgccgagcgtctcctcaagttgcagaacgaacgcgggggccgtgcactcttccaggatgtgcagaagccatctcaagatgagtggggtaaaaccctggaggccatggaagctgccttggccctggagaagaacctgaaccaggccctcttggatctgcacgccctgggctctgcccgcacagaccctcacctctgtgacttcttggaaagccacttcctggataaggaggtgaagctcatcaagaagatgggcaaccacctgaccaacctccgtagggtgcagggcccacaaccagcgcagactggcgtggcccaggcatctctgggcgagtatctctttgagcgcctcactctgaagcacgactag

SEQ ID NO: 1783 - DNA, 460 bp, Rattus norvegicus
  Genbank Accession No. NM_022503
ggccgccgatttttggcgttcagtagtcgcggttggtgggtaacaactgagctaagatgctgcggaatgtgctggcccttcgtcagattgcccagaggaccatcagcaccacttcacgaaggcattttgaaaacaaagttccagagaagcaaaagctgtttcaggaggataatgggatgccagttcatctgaaaggcgggacatctgatgccctcctttacagagccacaatgcttctgacagttggtggaacagcgtatgccatctatatgttagctatggctgcattccccaagaagcagaactgacgtcgtcatcccagtctccacatggttcagtttcattcactgcgcgatggaccaggaacctgatgaataactgaactcttctatggggatcaatatttattgatgtgtattaactgccaccaataaagcagtccttaaccattaaaaaaaaa

SEQ ID NO: 1784 - DNA, 364 bp, Rattus norvegicus
  Genbank Accession No. NM_022504
cggaaagctgcagccatggccctgcgctaccccatggccgtgggcctcaacaaaggccacaaagtgacgaaaaacgtcagcaagccgagacacagccgccgccgcgggcgcctcaccaagcacaccaagttcgtgcgagatatgatccgggaggtgtgcgcgttcgcgccctacgagcggcgtgccatggagctgctcaaggtgtccaaggacaagcgagcactcaagtttatcaagaagagggtgggcacgcacatccgcgccaagagaaagagggaggagctgagcaacgtgctggcagccatgcggaaggcggcggccaagaaggattgatgacccctcccccaataaaagatggttctta

SEQ ID NO: 1785 - DNA, 1243 bp, Rattus norvegicus
  Genbank Accession No. NM_022509
attttgggcgagcccagccccgtccgtggtagcaggccatggcgatgggcagcggcggcggcgcgggctctgagcaggaagacaccgtgctgttccggcgtggcaccggccagagtgatgattctgacatttgggatgatacagcattgataaaagcttacgataaagccgtggcctcctttaagcatgctctaaagaacggtgacatgtgtgaaacttcagataagccaaaaggcacagctagaagaaaacctgctaagaagaataaaaaccaaaagaagaatgccacagctccattgaaacagtggaaagctggtgacaaatgctctgccgtttggtcggaagatggctgcgtttacccagctaccatcacgtcagttgaccttaagagagaaacctgtgtcgtggtttatactggatatggaaacaaagaggagcaaaacctatctgatctgctttccccgacctgtgaagtagctaacaatacagaacagaacactcaggagaatgaaagccaagtttccacagacgacagtgaacactcctccagatcgctcagaagtaaagcacacagcaagtccaaagctgctccatggacctcgtttctccctccacctcccccggtgcccggggcgggattaggaccaggaaagccaggtctaaggttcagtgggccaccgccgccgccacctccccctcccccgttcttgccgtgttggatgcctccgttcccttcaggaccaccaataattcctccaccccctcccatatctcccgactgtctggatgacacggatgctctgggcagtatgctaatctcttggtacatgagtggttaccacactggttactatatgggtttcagacaaaataaaaaggagggaaagaagtgctcacatacaaattaagaagttcagctctctcccaaggagatggtttgttggtgtccctggtcgataagaacagaagtctcctcgtcacctttgtggactcttggctaagtggtgtcatcatcagggtctccctgtcccgggagtccatcctgagtcagcagcagggcatgcatagagcagcagttggaggaaccgatcaatcgatcgatcagtggcagtgtgagtgcatggaagtcagccaaactgtgactgagcacaaacggacaattgcaattttcttagaatgtcaagatttgtattaatgcctttaaaattaaataaaacccttttttgaaaaaaaaaaaaaaaaa

SEQ ID NO: 1786 - DNA, 1749 bp, Rattus norvegicus
  Genbank Accession No. NM_022512
gtcaggaggtcccggaggtctgtgcccatggccatggccgctgcgttgctcgcccgggccggtggctctctcggcagagctctccgcgctcgagattggcgaagattacatactgtttaccagtctgtggaactacctgagacacatcagatgttgcgccagacatgccgggactttgctgagaaggagctggtccccatcgctgcccagctggacaaggaacatctcttccccacatcgcaggtgaagaagatgggggagctcgggctgctggccatggatgtgccagaggagctgagtggtgctggcctggattacctggcctactcgatcgccctggaggagatcagccgtggctgcgcctccaccggagtgatcatgagtgtcaacaactctctctacttgggacccatcctgaagttcggatcctcacagcagaagcagcagtggatcacccctttcaccaacggtgacaaaatcggctgttttgccctcagtgagccaggcaatggcagtgacgcgggggccgcttccaccactgcccgggaagagggtgactcctgggtcctcaacggcaccaaagcctggatcaccaactcctgggaggcttctgccacggtggtgtttgctagcaccgacaggtcccggcagaacaagggtatcagcgctttcctggttcccatgccaactcctgggcttacgctgggcaaaaaggaagacaagctgggcatccgggcctcatctacagctaacctcatctttgaggactgtcgcatccccaaggagaacctgctcggcgagcctgggatgggcttcaagatagccatgcaaaccctggacatgggccgcattggcatcgcctcccaggccctgggtattgcccaggcctccctggattgtgccgtgaagtacgccgagaaccgccatgcctttggggcacccctcacaaagctccaaaacatccagttcaagctggcagacatggccctggccctggagagtgcccgcctgctgacctggcgcgccgccatgttgaaggacaataagaagcctttcaccaaggagtcggccatggccaagctggctgcatcagaggctgctactgccattagccaccaggccatccagatcctgggcggcatggggtacgtgacagagatgccagccgagcgctactaccgagatgcccgcatcactgagatctatgaaggtaccagcgaaatccagagactggtgattgccgggcatctgctccggagctaccggagctgagcccccgcccttcttgggaacttgccagcctgctcagaccatgaagggacctgcctcggtcagcctttctgcccctcactgtagcccccagtcagactaggggaaagtctgtctcagggagagggaaggtcaaccgctgtgacctgtcagctcagaatggggcggcgtggctacctctttaccccccaccaacagtgcctctctctttgagcgacctgctggaggcagggccacagagacctgaatgaccctggccctcccaatgcggatgccgttcccaagagtcctcagaggcaagaacaggaggggcagggcggggtgaggaggggaaggggatggcccagtgcttgagtccccagggttgtcgtgggaaggctggggaaccggatcatagggccctggctagaggtcaagtggccgcaggtggttctgtggctgtagagctgcctgtggtcaataaagctcacctgtgtcctg

SEQ ID NO: 1787 - DNA, 463 bp, Rattus norvegicus
  Genbank Accession No. NM_022514
ctgctcgctgtcgaaatgggcaagtttatgaaacccgggaaagtggtgctggtcctggctggacgctactccggacgcaaagccgtcatcgtaaagaacattgatgatggcacctccgaccgcccttacagccatgccctggtggctggaattgaccgctatcccagaaaagtgacagctgccatgggcaagaagaagatcgccaagcgatccaagatcaagtcctttgtgaaagtttataactacaaccacctcatgcccacaaggtactctgtggatatccccttggacaaaactgttgtcaacaaggatgtgttcagagacccagcactgaaacgcaaggccaggcgggaggccaaggtcaagtttgaggagcgatacaagacagggaagaacaaatggtttttccagaagcttcgcttttagatgtatttttgttttcgtcattaaaaaaataaaaaat

SEQ ID NO: 1788 - DNA, 541 bp, Rattus norvegicus
  Genbank Accession No. NM_022515
ccggccagacatctgtcaccatgaaggtcgagctgtgcagttttagtgggtacaagatctacccgggacacgggcggcgctacgccaggaccgatgggaaggttttccagtttcttaatgccaaatgtgagtccgcattcctttccaaaaggaaccctcggcaaattaactggactgtcctctacagaagaaaacacaagaaaggacagtcggaagaaattcaaaagaaaagaacccgccgtgcagtcaagttccagcgggccatcacaggcgcttctctggctgatataatggccaagaggaatcagaaaccagaagttaggaaagctcagcgagaacaggctatcagggctgccaaggaagcaaaaaaggctaagcaggcatcaaagaagacagcaatggctgctgccaaggctcccacaaaggcagcccctaaacaaaagattgtgaagcctgtgaaggtctctgctcccagagttggtgggaaacgctaatttagtagatgagagtttaaaaataaagatttgtctctaaaaaaaaa

SEQ ID NO: 1789 - DNA, 2697 bp, Rattus norvegicus
  Genbank Accession No. NM_022516
cgtcccctgcggtctcctctgtgtgccatggacggcatcgtcccagacatagcagtcggtacaaagcggggatccgacgagctcttctccacgtgtgtcagcaacggccccttcatcatgagcagctcggcctcagcagccaacggaaatgatagcaagaagttcaaaggtgataacaggagcacaggagttccttccagagtcatccatgtccgaaagctacctagtgatgtcactgagggcgaggtcatctccctggggctgccctttgggaaagttaccaacctccttatgctgaaggggaagaaccaggccttcattgaaatgagcacagaggaggctgccaacactatggttaactactacacatcggtggcgccagtgcttcgtggacagcccatctacatccagttctccaaccacaaggagctcaaaaccgacagctcgcccaaccaggcacgtgcccaggcagccctgcaggctgtgaactccgtacagtcaggaaacctggccttggcagcctctgctgctgccgtggatgcaggaatggcaatggcaggccagagcccagtgctcaggatcattgtggagaaccttttctacccagtgacactggacgtgctgcaccagatcttctcgaagtttggcacagtcctgaagatcatcacgttcaccaagaacaaccagttccaggcgctgctgcagtatgctgaccctgtgagcgcccagcatgccaagctgtccctggatggccagaacatctacaatgcctgctgcacgctgcgcatcgacttctccaagctcaccagtctcaacgtcaaatacaacaacgacaagagccgagactacacacgccctgacctgccctctggagacagccagccatcactggatcagaccatggcagcagcctttggcctctctgttcctaatgtccatggagccctggcacccctggccataccctctgctgctgctgctgctgctgcagccggccgcattgccatcccagggctggcaggcgccgggaattccgtccttttggtcagcaacttgaaccctgagagagtcacaccccaaagcctctttattctcttcggcgtctacggtgatgtgcagcgggtgaagatcctgttcaacaagaaggagaacgcacttgtcgagatggcagacggcagccaggcccagctggccatgagccacctgaacgggcacaagctgcatgggaagtcagtgcgcatcaccctgtcaaagcaccagagtgtgcagctgcctcgtgagggacaggaggaccagggcctgaccaaggactatggcagctcaccgctgcaccgcttcaagaaacctggctccaagaactttcagaacatctttcctccctcagctaccctgcacctctccaacatcccgccctctgtgtcagaggatgacctcaagagcctcttctccagcaatggcggtgtggtcaaaggcttcaagttcttccagaaggaccgcaagatggcactgatccagatgggctctgtggaggaggcagtgcaggcactaattgagctgcacaaccatgacctgggcgagaaccaccacctgcgagtgtccttttccaagtccaccatctaggtgcctgtgggcctgcgaagcttccgccattccagaaaagccactttaaaaagcagctgaagtgaccttacagaccagagatttatttttttaaagagagatcagtttacctgtttttaaaaaaattaaatctagcccactttgccgtggcaggaaatggcttgggccacagaggcccaggcccagcaaccatgccttgaggggcttaggcgtgaggccacagcggtgccccaacacagccgcttctgtgccttacaaaaccagcgtgcctcacggccgcacacccaccctctaaggccaccagttgtctctagacctgcagtgagccaggcggcctatacttaggctccccaatgccgtgtaagagctggggccactcccctacacccattataatcaagtgacatgattctcccatgtccctggccagcccagagggcccaggccgtcctcagcgccgagccttgtgtgaccttgtattctattccgtggggtcacagacacctgtgcctagcaatctttccacttgaccaaatacccgagtcttttccatttatatgcaagagatagagtttttaagtaactttttatagcagtggtacaattgtatgtgtgtactctaagcttctctgtcccctgcactccttccttccagtgaccaacttgcaggtgggcccaggccagggctggagaagaagctctgaggcttgtgggtgtcctaccttcaaattttggaccaaagttttgttctctgcccgcctctgactatgcccagttgaggggctgacctctaggccttaatgtccttcctggacgcccacctccatcctagcctgtttctatgggaggggttccctgcacctcagtttctgtgaaagtcatggaagagtgtaaatatttatgattttatacctgtggggctgaggcggtgcagcattttttatggtgacagatgtatattttggtaacgactacaggctcagtattgtcctgggccagccctagccacatctaccccagcccagatggtgtattggggggagggggactttccattaaagcagtttataacctttg

SEQ ID NO: 1790 - DNA, 900 bp, Rattus norvegicus
  Genbank Accession No. NM_022518
gcggctgctaaggaccgagtctggtcgggcggcctgaggtctctggccagtatcgcttccacctgtccacaaacatggggaatatctttgcaaacctcttcaagggcctttttggcaaaaaagaaatgcgcattctcatggtgggcctggatgctgcagggaagacaacaattctatacaaactgaagctgggcgaaattgtgaccaccattcccaccattggtttcaacgtggagactgttgaatacaagaatatcagcttcaccgtgtgggatgtgggtggccaggacaagattcggccgctgtggcgccactacttccagaacacccaaggcttgatcttcgtagtggacagcaatgacagagagcgtgtgaacgaggcccgtgaagagcttatgaggatgctagctgaagatgagctccgagatgccgttctcttggtgtttgccaacaagcaggacctccccaatgccatgaatgcggccgaaatcacagacaagctggggctgcactctctacgccacaggaactggtacattcaggctacctgtgccaccagcggagacgggctctatgaaggactagattggctgtctaatcagctccggaaccagaagtgaaccagacccctccttccccctcacttcctcttctccgccctcagctttcctctcatgtggcaaacgtgcgactctgtggtcctgagtgccagaagctgtctccatgggttggtcacagtgtgcatcgcaccgtgctgtacatgtgcagacgcagcctgcagccaggtttttatttaatgtaaatagtttctgtttccactgaggcagtttctggtactcctatgcaatattacttagctttttttattgtaaaaagagaatcaactcactgtcagtacct

SEQ ID NO: 1791 - DNA, 1938 bp, Rattus norvegicus
  Genbank Accession No. NM_022521
gcggacgtgtcaggtctctctgcacttccattcctgaaggacccacacaatgctttccaaactagcaagtctgcagactgttgccgctctgcgtcgaggactccgcacctcagtcgcctctgccacatctgttgcaacgaagaagacagagcaaggcccaccatcctctgagtacatttttgaacgggaatctaaatatggtgcacacaattaccatcctttacctgtagccctggagagaggaaaaggcatttatatgtgggatgtggaaggcaggcagtacttcgacttcctgagtgcttatggtgctgtcagccaaggacactgccacccaaagatcatagaagccatgaagagtcaggtggacaagctgacattaacatctcgggctttctataacaatgtccttggtgaatatgaggagtacatcaccaagcttttcaactacaacaaagttcttcctatgaatacaggagtggaggccggagagactgcgtgtaagcttgctcgccgttggggctacaccgtgaaaggcatccagaaatacaaagcaaagatcgtttttgctgttggaaacttttggggtcggacgctgtctgcagtctccagttccacagatccgaccagttatgatggctttggacccttcatgccaggctttgaaaccatcccatataacgatctgcctgcgctagagcgtgctcttcaggatcccaatgttgctgctttcatggtggagcccatccagggtgaagcgggtgttatcgttccagatccaggatacctgacgggagttcgagaactttgcacccggcaccaggtcctgtttattgctgatgaaatacagacaggattggctagaactggtcgatggctagctgtggatcatgagaatgtcagacctgacatagttcttcttgggaaggccctttctggtggcttatatcccgtgtctgcagtgctgtgtgatgatgacataatgctgaccattaaaccaggcgagcacggctccacgtatggcggcaacccactaggctgccgaattgctattgcggctcttgaggttttagaagaagagcatcttgctgaaaacgcagacaagatgggtgccatcttgagaaaggagctcatgaagctgccatctgatgttgtgactgctgtgagagggaaagggttgctaaatgccatcgtcatccgagaaaccaaagattgtgacgcttggaaggtgtgcctgcgactccgagataatgggcttctggccaagccaacccatggtgatatcatccggcttgcccctccacttgtgatcaaagaggatgagatccgggagtcagtggagatcatcaacaagaccatcttgtccttctgagagtaggaactctggggagccatcttcagatggggctcttgtgaaactctgcttgggatgggcagattcggcttgtctgtctcctaaaagacaattttttgaatatgtattatatatttcagttgatgcatagtggagtgacacctaggaacctgcaggtggctgcgtgacacaagagtgagagcgagaggcatctctttgttaaagtttgactgtgtgggagctttctaaggagaaacagatctatctgcatacagcctgcagagtcctgccgtaatttacatgtgtctttacatcttccttgctggcatgaatgttttgtatttggaagtttttttctgagatactacataagaaactgttgaatcattataatcaatgaatggtaagatgattgagggttgagcatatgtaaaatactagtttaaagtacactttgcattggccaacagcagaatgtattatatagtttctgagaattcattaccaaattatactttaagtgcttgattgcaatttgtaaaacatttattttcagtatttctttgaataaagcttcgtttttcttt

SEQ ID NO: 1792 - DNA, 1668 bp, Rattus norvegicus
  Genbank Accession No. NM_022523
gcgctcctacagtggctgccggggctggtatttcaaagcgtggttgatctggtggctctgagaatcattctgattactgcttcagacaccataggagtggcaagatcccacctgccaggtgaagggcgggcagatcagtgactttgacctgtacctgctggtcctgacttccagaggcccaggatgggggaattcaacgagaagaaggcaacatgtggcacagtctgcctcaagtatctgctgttcacctacaactgctgcttctggctggctggcctggccgtcatggcagtgggcatttggacactggccctcaagagtgactacattagtctgctggcttcaagcacctacctagcaacagcctacatcttagtggtggctggtgttgttgtcatggtgactggagtcctgggctgctgtgccactttcaaggagcgacggaacctgttacgcttgtacttcatcctgctcctcatcatcttccttctggagatcattgctggcatcctggcctatgtctactatcagcagctcaacaccgagctcaaggagaatctgaaggacaccatgatcaagagataccaccagtcaggccatgagggtgtgaccaacgctgtagacaagctgcagcaagagttccactgctgtggcagcaacaactctcgagactggagagacagcgagtggatccgctctggtgaggcagacagccgtgtggtccctgacagctgctgtaagactgtggtaactggctgtggtaagcgggagcacgcctccaacatctataaagtggaaggtggctgcatcactaagctggagtccttcattcaggagcacctgcgggtcatcggggccgtgggcattggcatcgcctgtgtgcaggtcttcggcatgatcttcacctgctgcttgtacagaagcctcaagctggagcactactgaccatggtgccaggccagaaggccagcctcgcgctgtgtcccagccccccactactgaacactactgagttagactgctgactgccagagaggtagctgccctcatgccattaccatgtcccctggtggctccacctccgtggtagcttcaagtgcctttccctgcacaccaaagtcccaaagcttgaggcagcgtacttgccccagcattaacaagagggggcatgtatgccagtgttgggctaggcctggctagtagagtagggtttagattacttgacagaagtgcctcttatgtagactgcttccctttgggtagctgtgatctgcagtaagtctggggagaatccgagcataccactacacggtgggtaagagcaggtgggaaggggcctttctggttgggctaggcacctttcatgcctgctgccaggaaccctcagatagggcaagcttaggggaactggaatcccacactgtatgctgtcctttccacacaggcctcttgctcctaacggcctcagccctgggcttttcctactactgataacactatgtaaatgttccatgttcctgtacactgtctcttttgggaacatctctgaatggagcatggctgttttcattcactgctgtatcccagatgcccacagatgctcctgctgtgtgacaggtgctcaataaatgtataagcagtcaaaaaaaaaaaaaaaaaaaaaaaaaa

SEQ ID NO: 1793 - DNA, 1475 bp, Rattus norvegicus
  Genbank Accession No. NM_022533
tgcccaaacaccagcacactaggggttcttcacgatctctatccagagcaaacaggcgaaccgagggttaaggggcggggcctcttcgaggggcggggcctcgggcggagcggggtcgggcttcgcgcacctgtaggttctgtctagggatccgctgtcgcagccccggagcagcgccgggagcgcgtcccgagcgtcgtaggctcgcgatcgctatggcggagttcccgtcgaaagtgagcaccaggaccagcagccccgcgcagggcgtgggagcatctgtgtctgcgatgcgaccggacctgggctttgtgcgctccgcccttggggtgctcgcgcttctgcagctggtgctggggctgctggtgtgggccttgattgctgacaccccataccacctgtatcctgcctacggctgggttatgtttgtagctgtcttcctctggctggtaacaattgtcttcttcatcatctacctgtttcaactgcacatgaagttgtatatggtgccctggccgttggtgttactggtcttctttgttgctgccaccgtcctctatatcaccgcctttgtcgcctgtgcggcggcggtcgatctgacatccctgaggggctcccgaccgtacaaccagcgctcggctgcctctttctttgcttgtctggtgatgattgcctacggactgagtgctttcttcagcttccaggcctggcgaggagtgggcagcaacgcggccacgagtcagatggctgggggctactcttaagccagctatgctgtgacctaagccacggctgggtcttagcacagggccacccccaaccttaccaggcttaagctctccaagcactcctgaggaacaggcccaagctggcacagatggacagccaagagccaggagcggggacatcctcctcacctcccttattcagcagaagatgatggggttggggggctcttgtggctttgccttgtcatcagagaacttcagtgtcccaggctgggccaccctgctcaccagcactaaatgcactaacagaccttcagcctctgatctgcctagtgtaaacctaacaagacaacacatgatctacgttccagaagctaagcccacccccaggctcttctggacccacctccccctcccctaccgcacgccaacccattgtcacctgtagagagacttttatagaagagttgggatttcgaggactggactatttcagttggtttcaatagtttccaagacagcaagcctcaccatgtcccctccctcacgtggaactctttctctcctttgggagagagcatccgtgcagggtgctccccccaggctgctgattagacacaggggacttccaaggagggagagagggaagcagggccttgcctggtgagttgtcaggaggttaatggcgactcttatttggaattattattttttacaatttaaataaaaatggatgtgtctgtttgg

SEQ ID NO: 1794 - DNA, 840 bp, Rattus norvegicus
  Genbank Accession No. NM_022536
gctgcgcctctcggagcgcaatatgaaggtgctcttcgccgccgccctcatcgtgggctccgttgtcttccttttgctgcctggaccctccgtggccaacgataagaagaagggacctaaagtcacagtcaaggtatactttgatttccaaattggagacgaacctgtaggacgagtgacctttggactctttggaaagactgttccaaaaacagtggataattttgtagccttagctacaggagagaaaggatttggctataagaacagcaagttccatcgtgtcatcaaggacttcatgatccagggtggagacttcaccaggggagatggcacaggaggaaagagcatctatggtgagcgcttcccagatgagaacttcaagctgaagcactatgggcccggatgggtgagcatggccaatgcaggcaaagacaccaatggctcccagttcttcataactacagtcaagacctcctggctagacggcaagcacgtggttttcggcaaagttctggaaggcatggatgtggtacggaaggtggagaacaccaagacggacagccgggacaagcccctgaaggatgtgatcattgtagactgtggcaagatcgaagtggagaaaccctttgccattgccaaggagtagagagagcctcggggacctcatccctctaaacagctgtctgtgcgggtcctgtcgattccctcacaggtgaaagcagccagtcacaaggctctgtgcggctctggctccagtgcttccatccgacggggtggccacacccctcacattccacaggcctgatttttatataaaactcctaccaatgctgatat

SEQ ID NO: 1795 - DNA, 871 bp, Rattus norvegicus
  Genbank Accession No. NM_022538
agatctgtgaccatgttcgacaagccgcggctgccgtacgtggtcctcgatgtgatttgcgtgttgctggctggattgccttttataattcttacttcaaggcatacccccttccaacgaggagtgttctgtactgatgagtccatcaagtacccttacagagaagacaccatcccttatgcgttattaggtggaatagtcattccattctgtattatcgttatgattactggagaaactctgtctgtttactttaatgtcttgcattcaaattcctttgtcagcaatcactatatagccaccatttacaaagccgttggagcctttttgtttggagcctcagccagtcagtccctgactgacattgctaagtactctataggcagactgcggcctcacttcctggctgtctgtaacccagactggtcaaaaatcaactgcagcgatggctacattgagaacttcgtatgtcaagggaatgaacagaaggtcagggaaggcaggttgtccttctactcggggcactcctcattctctatgtactgcatgctgtttgtcgcactttatcttcaagccaggatgaagggagattgggcaagactcttacgacccatgctacagtttgggcttgttgctttatccatatatgtgggcctgtctcgagtttctgattacaaacaccactggagcgacgtgttaattggcctcattcaaggagctgttgtggcaatattagtggttttgtatgtaactgatttcttcaagaccacagagtctaacaaagaaagaaaagaggactcacatacgactctacacgaaaccaccaacagacagagctacgcaaggaatcacgagccctgaaggggtcgac

SEQ ID NO: 1796 - DNA, 494 bp, Rattus norvegicus
  Genbank Accession No. NM_022541
aagaattcggcacgatggccgagcttggtgaagcggacgaagcggagttacaacgcctggtggccgccgaacagcagaaggcacagttcactgcgcaggtgcatcacttcatggaactatgttgggataagtgtgtggagaagccaggaagtcggctagactcccgaactgaaaactgcctctctagctgtgtggatcgattcattgacactactcttgccatcaccggtcgttttgcccagatcgtacagaaaggagggcagtaggccataccttggaatgacggaagaccaaaagacttgttactaagcagactgaatggccagtggtgaaagacttgtcaacatgtcaggttagcgtcaggcagttaccaagtctgttggtgttaagaagtaacaaagcaaatgttcaagtgaaattttatttattggaattcagtaattccaagttgtatcacaccagttaataaatgtgaagtctccgatcaaaaaaaa

SEQ ID NO: 1797 - DNA, 4269 bp, Rattus norvegicus
  Genbank Accession No. NM_022585
tctcggccgcggtgtttccgtttctctccctggttgtcgcctgctctgctcttctcatccttctcgctctgctgctctgcggagtgacgaggctgaatcttctccccacccagttcgcgcttttcttctttttctcgcgccgctccatttctccagtccggctgccgccgccactgctgctcagctggtgtcggtgccgcgcgtttcccccacgtcgtccccgcagcctatggcccaggccgccttgggtatttctgctcaaggtaaccacatccctctttaaaaattccgccgaaaaagagaagacgctttacccgactctttgggccgttatctcacggcgaactttctgaccgagtatacaactacccagaaggcctaggagaagtgctgtatagagagcagttcgattttaacgctgagccaccttgggaacctagctgatgataggggggttccatctcctaacttgtccatggaggtcttcacttcagaaacccaagactcacattcatccagcttggtgtcaagtgggctgttgctgccaggattatcttgtgattatatgaaagatgtatcagtttcttctgaagtgcagtcaactgtagaagcctttgtagcaggtgtgtaacaagtttgttgcatattctaaggacccagacataggcttggtggcccgtctcttgtttttcctggtttatgactttcggctttgtggaatacggctgagatgaaaggatttattgacgatgcaaactactccgttggcctgttggatgaaggaacaaaccttggaaatgttattgataactatgtttatgaacataccctgacaggaaaaaatgcattttttgtgggggatcttgggaagatcgtgaagaagcacagtcagtggcagaacgtggtggctcagataaagccattttacatggtgaagtgcaactccactccagccgtactggagatcttggcagctcttggaactggatttgcttgttccaccaaaaatgaaatggctttagtgcaagaattaggcgtatctccagaaaacatcatttatacaagtccttgtaagcaagcatctcagataaagtacgcagcaaaagttggagtaaatattatgacatgtgacaatgaagttgaattaaagaaaattgcgaggaatcacccaaatgccaaggtcttactacatattgcaacagaagataatattggaggtgaagatggtaatatgaagtttggcactacactgaagaactgtaggcatcttttggaatgtgccaaggaacttgatgtccaaataattggggttaaatttcatatttcaagtgcttgcaaagaatatcaagtctatgtccatgccctgtctgatgctcgatgtgtgtttgacatggctggggagtttggctttacaatgaacatgttagacatcggtggaggcttcacaggaactgaaattcagttggaagaggttaatcatgttatcagtcctctgttggatatttacttccctgaaggatctggcattcagatcatttccgaacctggaagctactatgtatcttctgcatttacgcttgcagtcaatattattgctaagaaagttgttgaaaatgataaattatcctctggagtagaaaaaaatgggagtgacgagccagccttcgtgtactacatgaatgacggtgtttatggttcttttgcaagtaagctttctgaggacttaaatactgttccagaggttcacaagaaatacaaggaagatgagcctctgtttacaagcagcctttggggtccatcctgtgacgagcttgatcaaattgtggaaagttgtcttcttcctgagctgagcgtgggagattggcttatctttgataacatgggagcagattctttgcacggaccgtctgcttttagtgacactcagaggccagctatttatttcatgatgtcactcagtgattggtatgagatgcaagatgctggaattacttcagatgcaatgatgaaaaacttcttctttgcaccctcttgcattcagctgagccaagaagacaacttctccactgaagcttaaacaggcattaacgcttctttagatctgaagtcgcaggttaagcttgtctggtctacattccagtgtggggaaaaattcaatcaatctttattctgttaattttcttggaaacaaattcatagtaatagctgtttgggaccagacaaaatcagctttcatctataattcattgggggtaataggggatttatttagataatgtatccagatttaaacataccagtttgacccaccccttaagcgtttaaaataaaatatgcaacaaaatggatgacttagtggagatggaagcccattaattgggttccccatcaaatcgtttacatacaagtacacagtttttataataaggattcctgttaaaagtcttgtaaagttgatgtctttcacccagatctatcacatgtgagtggaagaccagtgtgacttcattagatacgtttagtgtatttagagtgtgtaaatttgtgctttggactgtagtttaataaatgtaaaattgcatcatagtatttgttgtatttgacctaatgtaaccttgtatgattgcaataaaactttgtgtagattttaccattttttcaggctaaaaatttgggaatggggctagctagcaaaggtagttttgaactagttgtgtgtatggtctgttttgagagttttctttatagtccatttgtttggtttggctcaatatactttttagttatttaattagtaatttaagtaaaaagtgtttggtaatcattgtgaagttcagattcattatggagagtcgatgtgcagtaagcatgatgtttaacaattttaacaccagaaaatgttaatcttgcataaaccaattgtaataataataggtgtttctgtatagataggatgcatagagtaccttagtaaatctttgaatcacaaatcttttggctgatagaaaagattttattaaacactgaaaacttggtcggggatggggagagagactgcagaagactgcagaaccctaaccttaaagaagggctatgtctatttccagcatcctgatgccccttcgcacagacatttaaatcgagagggctttggggtggtgaagcacactcttcaatttctcacttgtaatggtatcaaattgcaatttttttgttgttgctgatcttggtttgaacctagtcccttagtttcttgttaattcccatttgttcaagcttagtaattcttccttccgtactaaagcttggtggggggtggggggaggagttagcttcactaacctgacactgttgccaggaattttggctttgttcactgctagtgtgttagtcctaagtctcagaatcacagaagtaatgagacaacttacaggggtcacttttcctaccttactctatgttcacaagtggaattcctgacctccaagaggaaatgtgacttcactttggtgccaatggacaggaaattctacctgtgctacataggagaagtgtgggatacacttgaatagctggattttacaccttgatttcaaggtggaaagaaattgatcatgaatctctaatttcaaatcaaaccagtaggtgcttaatatttttgatttgaatattgcccacttgaatatcatgggttctattaattataagaacaactaaggaccccagtccactgtcatctagttgcccttggacttttttccaaggtatactatggggtttatgcaaaatttgaagctaccatatgcattgttgtggtccaggaatgccaaaacttaaagcgtggtacaacctgagtccttggcctgactgtacaggcgtggtctctgtggcatcagttttgccttctgcataggagaaaggttgtatgtaacacagcccggaattgctatctcacatgtgaatgataggtaaacataagaatgtctgtattgtttttgaagactgtttgccataaatctaaagtcaaacctatgtatttcaatttggtatgcttaagaataattaatgtaaaatctttttatatgatattgtaatctcagttcaaatttaattgcaaatataaaacccaaatgatttctatatatagtaaattgaactgtcaaggtaacttgtgtgtgattctgaatacacagatacaatgtttttattcctcatgctttactttgatggcttctatcatgaaatagatgtgaaattttatgaaaaaaa

SEQ ID NO: 1798 - DNA, 2741 bp, Rattus norvegicus
  Genbank Accession No. NM_022588
ccgccggcgcccccgcgcccgcccccgccccggcccgcgcccggcccgccgcccgcgcccgcgccccgcgcccgcggccccgccgccggcccggacatggccgccaacatgtacagggtcggagactatgtctactttgagaactcctccagcaacccgtacctgatccgcaggattgaagagctgaataagacagccaacgggaatgtggaggccaaagtggtgtgtttctacagaaggcgggacatttccagcagcctcatcgcgctggctgacaagcatgcaaccctgtcagtctgctatagagccggaccgggggcggacaccggcgaggaaggggaagtggaggaggaggtagaaaacccagagatggtagacctgcctgagaaacttaagcaccagctgcggcatcgggaactgttcctctctcggcagttggagtctctgcctgccacccacatcaggggcaagtgcagtgttaccctgctcaatgagaccgagtcactcaagtcctacctggagcgtgaggatttcttcttctactctctagtctacgacccacagcagaagaccctcctggctgataaaggcgaaattcgtgtagggaaccggtaccaggctgacatcactgatttgctgaaagacggtgaggaggacggccgcgatcagtcgaagctggagaccaaggtgtgggaagcccacaatccacttgtagataagcagattgaccagtttctggtggtggcccgctctgtgggtacctttgcacgggccctggattgcagcagctccgtgcggcagcctagcctgcacatgagtgccgccgcagcctcccgagacatcaccctgtttcatgccatggacacgctgcacaagaacatctacgacatctccaaggccatctctgcccttgtgcctcagggtgggccagtgctctgcagggatgagatggaggagtggtcagcatcagaagccaacctttttgaggaagctctggaaaaatatgggaaagatttcacagacattcagcaagactttctcccatggaagtcgctcaccagcatcattgagtattactacatgtggaagaccaccgacagatacgtccagcagaaacgtttgaaagcagctgaagcagagagcaagttaaagcaggtttatattcccaactataacaagccaaacccaaaccagatcagcgtcaacagtgtcaaggccagtgtagtgaatggcacagggacaccaggccagagccccggggccggtcgggcctgcgagagctgttacaccacacagtcttaccagtggtattcttggggtccccctaacatgcagtgtcgcctctgcgcatcttgttggacatattggaagaaatatggtggcttgaaaatgccaacccggttagatggagagaggccgggaccaaaccgcaataacatgagtccccatggcatcccagctcggagcagtgggagccccaagtttgccatgaagacaaggcaggccttctacctgcatactaccaagttgacacgcattgcccggcgcttgtgccgtgagatcctacgcccatggcatgccgcacgccacccctacatgcccatcaacagtgcagcaatcaaggctgaatgcacagcacggctgcccgaagcttcccagagcccactggtgctgaagcaggtagtacggaagcccctggaggctgtgctccggtatcttgagactcatccccgcccgcctaagcccgaccctgtgaagagctcatccagtgtgctcagcagtctgacccctgccaagtcagcccctgtcatcaacaatggctcccctaccatcttgggcaagaggagctatgagcagcacaatggggtagatggtctggcaaaccatggacagaccaggcacatgggaccaagtcggaatctcctgctcaatgggaagtcctaccccaccaaagtgcgcctaatccgaggcggctccctgcctccagtcaagcggcggcggatgaactggattgacgccccagatgatgtattttacatggccaccgaggagaccaggaaaatccgaaagctgctctcatcttcagaaaccaagcgtgctgcccgccggccctacaagcctattgccctgcgccagagccaggccctgccgctgcggccacccccacctgcaccagtcaatgatgagcccattgttattgaggactaggcggtcacccacagtggcctgcctgggcccctccatcagccccagagtatccagtgaggcctgcagaggccaagcggcctccctcccccaccagactgctgcccaccccaccctctgtttccgtagtgccccaactcccgccctcacatgcagagaaactgctcctctggtggacatgcgggggaagaagtgtggtctaacttattccaagacaccgaggagtcttttttagctttgtgtttactttctggctggagcagagatgaggagtgccctgggccgtgggctgcagggcttctcagctggggtgggctctaaggttttgttgtgttctgttgaaggtgccattttaaattttatttttattacttttttgtagatgaacttgagctctgtaacttacacctggaatgttaggattggtgcagccagcagcggccaagctgcctggcagggttggtcccttgtcttttcaagtaattttcatattaaacaaaaacaaagaaaaaaatctcataaaaaggaaaacccca

SEQ ID NO: 1799 - DNA, 8216 bp, Rattus norvegicus
  Genbank Accession No. NM_022591
gagctccgcccctccccttgcccagcctcgccccttcgcctctctagggtgttggtttcctttcagttctctttcttcaacctatccactggctgacctaggccggtttctgctccttgttgcggagaaccaacgcgcccctcactgtgcacagcttttccagtcccgagcgcaggcacatagagattgtgctgccgctatggagaaactctgtggttatgtgcctgtccacccagacatcctctccttgaagaatcggtgcctgaccatgctctctgacatccaacccctggagaaaatacatggacagagatctgtcaacccagacatcctgtccttggagaaccggtgcctgaccttgctccctgatctccagcccatggagaaaatacatggacagagatctgtccacccagacatcctctcctcagagaaccggtgtctgaccttgctccctgacctccagtccctggagaagctatgtggacatatgtctagtcacccagacgtcctctctttggagaaccgatgtcttgctaccctcccgactgtaaagagaactgtttcgagtggccccttgctccagtgtcttcacagatctcatacggcacaagctgatctgcgtgacccgaactttcgcaactgcctgttccctgagcctcctaccatagaggctccatgtttcttgaaggaactagaccttccaactggacccagggccctgaaatccatgtctgctacagctcgagttcaggaagtagctttgggtcagcggtgcgtctcagaaggaaaggaattgcaggaagaaaaagaaagcgcagaagtcccgatgcctttgtacagtctaagcttggggggagaagaagaagaagtggtgggggcaccggtcctaaaactcacatctggagactctgactctcaccctgaaaccactgaccagatcctgcaggagaagaagatggctctcttgaccttgctgtgctcagctatggcctcaagtgtgaatgtgaaagatgcctccgatcctacccgggcatctatccatgaagtctgcagtgcgctggcccccttggaacctgagttcatccttaaggcatctttgtatgctaggcagcagcttaacctccgggacatagccaatatagtgttggccgtggctgccctcttgccagcctgccgcccccatgtacgacggtattactctgccattgttcacctgccttcagactggatccaggtagccgagttctaccagagcctggcagaaggggatgagaagaagttggtgcccctgcctgcctgcctccgtgctgccatgactgacaaatttgcccagtttgatgagtaccagctagcgaagtacaacccacggaaacaccgatccaagacacgttcccgccagccaccccgccctcaaaggacaaaacctccattttcagagagtgggaaatgttttccaaagagcgtttggccccttaaaaacgaacagatttcgttcgaagcagcttataatgcagtgtcagagaagaaaaggctaccaaggttcactctgaagaagttggtagagcaactgcatatccatgagcctgcgcagcatgtccaggccctgctgggctacaggtacccatccaccctagagctcttttctcggagtcatctccctgggccatgggactctagcagggctgggcaacggatgaagctccaaaggccagagacctgggagcgggagctgagcttacgtggaaacagagcttctgtgtgggaggaactcatagacaatgggaaactccccttcatggccatgctccggaacctgtgtaacctgctgcggactgggatcagtgcccaccaccatgaactcgttctccagagactccagcatgagaaatctgtgattcacagtcggcagtttccattcagattccttaatgctcacgactctctcgatagactcgaggctcagctcagaagtaaagcatcgcccttcccttccaatacaacattgatgaagcggataatgattagaaactcaaaaaaaatcaagagacctgccaacccgaggtacctgtgcaccctgacgcagcggcagcttcgggcggcaatggctatcccggtgatgtatgagcatctcaagcgggagaaactgaggctgcacaaggccagacagtggacctgtgaccttgagttgctggagcggtatcgccaggccctggaaacggccgtgaacatctctgtaaagcacaacctacccccgctgccaggccgaaccctcttggtctatctcacagatgcaaatgccaacagactttgtcccaagagtcacttgcaagggcctcccctgaactatgtgctgctgttgatcgggatgatgatggctcgggcggagcagacgacagtttggctgtgtgggacaggaactgtgaagacaccagtacttacagccgacgaaggtatcctgaagactgccatcaaacttcaggctcaagtccaggagttagaagaaaatgatgagtggcccctggaaacttttgagaagtacctgctatctctggctgtgcgaaggacccctattgacagggtcatcctgttcggccaaaggatggatacggagctgctgaatgtagccaaacagattatctggcagcatgtgaattccaagtgcctcttcgtcagtgtcctcctacggaaaatgcagtacatgtcaccaaatttgaatcccaatgatgtgacgctctcgggctgcactgacgggatcctgaagttcattgcggagcatggagcctctcgtcttctggaacatgtgggccaactagataagatattcaagatccctccacccccaggaaagacaaaggtctcacctctccggccgctggaggagaacaaccctggtcccttcgttcctatttcccagcatggatggcgcaacatccggcttttcatttcgtccactttccgagacatgcatggggaacgagacttgctgatgcgatctgttctgccagcgctgcaggcccgagcgttcccccaccgcatcagccttcacgccattgacctgcgctggggaatcacggaggaagagacccgcaggaacagacaactggaagtgtgccttggggaggtggagaactctcagctgttcgtggggatcctgggctcccgctatggctatactccccccagctatgatctgcctgaccacccccactttcactggacccagcgatacccttcggggcgctctgtaacagagatggaggtgatgcagttcctgaaccgtggccaacgctcggaaccctctgaccaagctctcatctacttccgagatcctggtttccttagctctgtgccagatgtctggaaacctgactttatttccgagtcagaagaggctgcacatcgggtctcagaactgaagagattcctacaggaacagaaagaggttacctgccgcaggtactcctgtgaatggggaggcgtagcagccggccggccctatactgggggcctggaggagtttggacagttggttctccaagatgtgtggagcgtgatccagaagcgttacctgcagcctggggcccagttggagcagccaggatccatctcagaagaggatttgatccaggccagctttcagcagctgaagagcccaccgagtcccgcacggccacgccttcttcaggataccgtgcaacagctgatgctgccccacgggaggctgagcctagtgattgggcaggcaggacagggaaagactgccttcctggcatcccttgtgtcggccctgaaggttcccgaccagcccaatgtggccccgttcgttttcttccacttttcagcagcccgccctgaccagtgtcttgctttcaacctcctcagacgcctctgtacccatctgcatcaaaaactgggagagccgagcgctctccccagcacttacagaggcctggtgtgggaactgcagcagaagctgctcctcaaatctgcccagtggctgcaaccaggccagactttggtccttattatcgacggggcagataagttggtggaccataatggacagctgatttcagactggatccccaagtctcttccgcggcgagtacacctggtgctgagtgtgtctagtgactcaggcctgggagagacccttcagcaaagtcagagtgcttatgtggtggccttggggtctttggtcccgtcttcaagggctcagcttgtgagagaagagctagcactgtatgggaaacggctggaggagtcaccttttaacaaccagatgcggctgctgctggcaaagcaggggtcaagcctgccactgtacctgcacctcgtcactgactacctgaggcttttcacactgtacgaacaggtgtctgagagacttcgaaccctgcccgccactctcccactgctgctgcagcacatcctgagcaccttggagcaagagcatggccataacgtccttcctcaagctttgactgcccttgaggtcacgcacagtggtctgactgtggaccagctgcatgcagtcctgagcacgtggttgactttgcccaaggagactaagagctgggaagaggcagtggctgccagtcacagtggaaacctctaccccttggctccatttgcctaccttgtccagagtctacgcagtttactaggcgagggccccgtggagcgccctggcgcccgtctctgcctctctgatgggcctctgaggacagcagttaaacgtcgctatgggaaaaggctggggctagagaagactgcgcatgtcctcattgcagctcacctctggaagatgtgtgaccctgatgcctcaggcaccttccgaagttgccctcccgaggctctgaaagatttaccttaccacctgctccagagcgggaaccatggtctccttgcaaagttccttaccaacctccatgtggtggctgcatatctggaagtgggtctagtcccggacctcttggaggcttacgagctctatgcttcttcaaagcctgaagtgaaccagaagctcccggaggcagatgttgctgtattccacaacttcctgaaacaacaggcttcactccttacccagtatcctttgctcctgctccagcaggcagctagccagcctgaagagtcacctgtttgctgccaggcccccctgctcacccagcggtggcacaaccagtgcatactgaaatggattaataaaccccagaccttgaagggtcagcaaagcttgtctctgccaatttcctcatccccaactgctgtggccttctctcctaatgggcaaagagcagctgtggggactgctggtgggacaatttacctgttgaacttgagaacctggcaggaggagaaggctctggtgagtggctgtgatgggatttcctctttcgcgttcctgtcagacactgctcttttccttaccaccttcgatgggctcctggagctttgggacctgcaacatggttgttgggtgttccagaccaaggcccaccagtaccaaatcactggctgctgcctgagcccagaccgccgcctgctggccaccgtgtgtttgggaggatacgtaaagctgtgggacacagtccagggccagctggctttccagtacacccatcccaagtctctaaactgcatcaccttccacccagaggggcaggtggtagccacaggcaactggtctggcatcgtgaccttcttccaggcagatggactcaaagtcaccaaggaactagggggcccaggaccctctgttcgtacgctggcattcagtgcacccgggaaggttgtggctctaggccggatagatgggacagtggagctgtgggcctggcaagagggcacacggctggcagccttccctgcacagtgtggcggtgtctccaccgttcttttcttgcatgctggaggccggttcctgacggctggggaagatggcaaggctcagttatggtcaggatttcttggccggcccaggggttgcctgggctctctttatctttctcctgcgctctctgtggctctcaacccagacggtgaccaggtggctgttgggtaccgaggagatggcattaaaatctacagaatttcttcaggtccccaggaggctcaatgccaagagctaaatgtggcggtgtctgcactggtctggctgagtcccagcgtcttggtgagtggtgcagaagatggctccctgcatggctggatgctcaggagaaactcccttcagtccctgtggctgtcatccgtgtgccagaagcctgtgctggggctggctgcctcccaggagttcttggcttctgcctcagaggacttcacggtgcgactgtggccaagacagctgctgacacagccacatgcagtagaagagttgccctgtgcggctgaactccggggacacgaggggccggtgtgctgctgtagcttcagcccggatggacgcatcttggccacagcgggcagggatcggaatctcctctgctgggacgtcaaggtagcccaagcccctctcctgattcacacgttctcgtcctgtcatcgagactggatcactggctgtacgtggaccaaagacaacatcctgatctcctgctctagtgatggctctgtgggactctggaacccagaggcaggacagcaacttggccagttcccaggtcaccagagtgccgtgagcgctgtggttgctgtggaggaacacattgtatctgtgagtcgggatgggaccttgaaagtgtgggaccgtcagggtgtggagctgaccagcatccctgcccattccggacccattagccagtgtgcggctgctctggaaccccgtccagctggacagcctggatcagagcttatggtggtgactgttggactggatggggccacaaagctgtggcatcccctgttggtgtgccaaatacataccctgcagggacacagtggtccagtcacagctgctgctgcttcagaggcctcaggcctcctgctgacctcagacaatagctctgtacgactctggcagatccctaaggaagcagatgatacctgcaaacctaggagttctgcggtcatcaccgctgtggcgtgggcaccagatggttctctggtggtgtctggaaatgaagctggggaactaacgctgtggcagaaagcgcaggctgtggctacggcacgggctccaggccgcgtcagtgacctgatctggtgctccgcaaatgcattctttgttctcagtgctaatgaaaatgtcagtgagtggcaagtggaactgaggaaaggttcaacatgcaccaatttcagactttatctgaagagagttctgcaggaggacttgggagtcttgacaggtatggccctggcgcctgacggccagtctctcattttgatgaaagaggatgtagaattgctacagatgaagcccgggtctactccatcttcgatctgcaggaggtatgcagtgcattcttctatactgtgcaccagcaaagactatggcctgttttacctgcagcagggaaactctggatctctttctatcttggagcaggaggagtcagggaagtttgaaaagaccctggacttcaatctgaacttaaataatcctaatgggtccccagtatcaatcactcaggctgaacctgagtctgggtcctcgcttttgtgtgctacctctgatgggatgctgtggaacttatctgagtgtaccccagaaggagagtgggtcgtagataacatctggcagaaaaaatcaagaaaccctaaaagtcgaactccggggacagattcgtccccaggcttattctgcatggatagctgggtagaacccacacatttaaaggcacggcagtgtaaaaagattcacttgggctctgtcacggccctccatgtgctgcccggattgctggtgactgcttcagaggacagagatgttaagctgtgggagagacccagtatgcagctgctcggcttgttccgatgtgaagggccggtgagctgtctggaaccttggatggagcccagctctcccctgcagcttgctgtgggagatgcacaaggaaacttgtattttctatcttgggaatgaagatgaagaatcaggacaaagatggtgtcaccggatgatggtcacctgaagacaccagtgtctatattcttaataaggttataaaataaagtgttggaagatctaaaaaaaaaaaaaaaaaaaaaaa

SEQ ID NO: 1800 - DNA, 2098 bp, Rattus norvegicus
  Genbank Accession No. NM_022592
gaattcgggaatgtcatggatccagtgagacagatccagtgcgaccgtgaaggcaaacgctttccgttcctctcagctccaccagcttccacgtcctcgcccgaccgcgccatggagggttaccataagccagatcagcagaagctccaggccctgaaggacacagccaatcgcctgcgcatcagctccatccaggccaccaccgcggcaggctcgggacaccccacatcatgctgcagcgctgccgagatcatggctgtcctgtttttccataccatgcgctacaaggccctggatccccgaaaccctcacaatgatcgctttgtgctctccaagggccatgcagctcccatcttatatgcagtctgggctgaagctggcttcctgcctgaggcagagctgctgaacctgaggaaaatcagctctgacttggatgggcatcctgtcccgaaacaagccttcaccgatgtggccactggctccctgggccaggggctgggagctgcgtgcgggatggcatacacaggcaaatacttcgacaaagccagctaccgagtctattgcatgctgggagacggggaggtgtccgagggctccgtttgggaggccatggccttcgctggaatttacaagctggacaacctcgttgccatttttgacatcaaccgtctgggccagagcgacccagccccgctgcagcaccaagtggacgtctaccagaagcgctgtgaggcctttggctggcacgccatcatcgtggatgggcacagtgtggaggagctgtgcaaggcctttggtcaggccaagcaccaaccaacagccatcattgccaagaccttcaagggccgcgggatcacagggattgaagacaaggaggcgtggcatgggaagcccctccccaaaaacatggctgagcagattatccaggagatttacagccaggttcagagcaaaaagaagatcctcgccacgccccctcaggaggatgccccttccgtggacattgccaacatccgaatgcctaccccacccaactacaaagtgggggacaagatagccacacggaaagcctatggattggcccttgccaagctgggccacgccagtgaccgcatcatcgccctggatggagacaccaaaaattccaccttctcagagctcttcaaaaaggagcacccagaccgtttcatcgagtgctacattgctgagcagaacatggtgagcattgctgtgggctgtgccacacgtgacaggacagtgcccttctgcagcacttttgcggccttcttcacacgcgccttcgaccagatccgcatggccgccatctccgagagcaacatcaacctttgtggctcccactgcggcgtgtccattggggaagacgggccctcgcagatggccctggaagacctggccatgtttcggtcggtccctatgtccaccgtcttttacccaagtgatggagttgccacagagaaggcagtggaattagcagccaatacaaagggcatctgcttcattcggaccagccgcccagaaaatgccattatctatagcaacaacgaggatttccaggttggccaagccaaggtggtcctgaagagcaaggacgaccaagtgacagtgatcggggctggcgtaactctgcacgaggctctggctgctgcagagatgttgaagaaagagaagatcggtgtccgtgtactggaccccttcaccatcaagcccctggacaaaaagctcattctcgactgtgccagagcaaccaaaggcaggatcctcaccgtggaggaccactactatgaaggtggcataggcgaggcagtatctgctgtggtagtgggcgaacctggagtcacagtcactcgcctggcggtcagccaagtaccacgaagtgggaagccagctgagctgctgaagatgtttggtattgacaaagacgccattgtgcaagctgtgaagggccttgtcaccaagggctaggaaggacatgggatgccgggtgggtgaactacacattccagggatgttctggcaaaggtgctcaagggtgtaccgagtggaaaggtaaatatatgttttgagaaaaaccgaattc

SEQ ID NO: 1801 - DNA, 1097 bp, Rattus norvegicus
  Genbank Accession No. NM_022594
agctccagagatggctaccgcgatgacagtttccagcaaactcctcggcctgctgatgcagcagctgagaggtacccgccagctgtacttcaacgtcagccttcgatctctgagctcctctgcacaagaggcgtccaaaagaatccctgaggaagtctcagaccacaactacgagtctattcaagtaacatctgcccagaagcatgttctgcatgtacaactaaaccggccggagaagaggaatgccatgaacagggctttctggagggagttggtggaatgcttccaaaagatatctaaagactccgactgtcgggctgttgtggtctctggtgcaggaaagatgttcacttcaggtattgacctcatggacatggcatcagacatcctgcagcccccaggagacgatgtggcccgcatagcctggtacctccgagacctcatcagccgataccaaaagactttcactgtcattgagaagtgccccaagccggtgatcaccgcaattcacggaggctgcattggtggaggcgtggatcttatttctgcctgtgacattcgctactgcactcaggatgctttcttccaagtcaaggaggtggatgtgggcctggctgctgatgtaggaacgctgcagcgactgcccaaggtcattgggaaccggagcctggtcaacgagctgaccttcaccgcccgcaagatgatggctgacgaggccctggacagtgggctggtcagccgcgtgttcccagataaggacgtcatgctgaatgcagcctttgccctggcggccgatatttccagcaagagtcctgtggctgtgcaggggtcaaaaatcaatttaatctactcccgagaccattctgtggacgagagccttgactatatggccacttggaacatgagcatgctgcagacccaggacatcatcaagtcagtccaggcagccatggagaagaaggactcaaaaagcatcaccttctccaagctctgagtgccttcctgaccctggtcccctcagtgcctcctcccggtgtataactttatgacttagttcttcagttcccggggccttatctccactgtgaacaataaag

SEQ ID NO: 1802 - DNA, 1904 bp, Rattus norvegicus
  Genbank Accession No. NM_022597
gagcgactgcgggcccaggttgtcgcgctgcgctcggtgagtacaggatccagcttccaggatgtggtggtccttgatccctctctcttgtctgctggcactgaccagtgcccatgacaagccttcctcacacccactgtcggacgacatgattaactatatcaacaaacagaatacaacatggcaggctggacgcaacttctacaatgttgacataagctatctgaagaagctgtgtggaactgtcctgggtggacccaacctgccggaaagggttgggttcagcgaggacataaatctacctgaatcctttgatgcacgggaacagtggtccaattgcccgaccatcgcacagatcagagaccaggggtcctgtggctcttgttgggcatttggggcagtggaagccatgtctgaccgaatctgcattcacaccaatggccgagtcaatgtggaggtgtctgctgaggacctgcttacctgctgtggtatccagtgtggggatggctgtaatggtggctatccctctggagcatggaacttctggactagaaaaggcctggtttctggtggagtatacaattctcatataggctgcttaccctacaccatccctccctgtgaacaccatgtcaatggctcccgtcccccatgcactggagagggagatactcccaagtgcaacaagatgtgtgaggctggctactccacatcctacaaggaagataagcactatgggtacacttcctacagtgtgtctgacagcgagaaggagatcatggcggaaatctacaaaaatggcccagtggagggtgcttttactgtgttttctgacttcttgacttacaaatcaggcgtatacaagcatgaagccggtgatgtgatgggaggccatgccatccgcattctgggctggggaatagagaatggagtaccctactggctggtagcaaactcctggaacgttgactggggtgataatggtttctttaaaatcctcagaggagagaaccactgtggaattgaatcagaaatcgtggctggaatcccacgcactcagcagtactggggaagattctaatctgctgggacttgattgtatagtccttaggagactttttccaaaatttagcaatgcaggcagggagtgaggcagataggagtctttgattctttgagttcacctaacatgcatgaagctttcagcaaggtttgggtgactggaccagagctgccccccatcagagccaccctacctggctcccttctagcctatcccatgacagtgatcacagcctacatcctagcctctccctagactagtgctgtgtgtagcgcctgctgctgtggctctgtctgccatccctcccacccccacctcagcatccccagaccaagggctttggctgcaggatttccaaaggaatgaacaccaactacatgatgagaggacagatgccacccgccagctgcaccttgaagctagtcacttctaggactgtggcaggctttgatggcccaatgcagttctctggagaaaactacctttccccaaggcatctgcacccattgacaatggtaatgtgcccatctctccttggtcctgccctcaaccgatgcttttccagtcagggttttgttttttgttttgttttgtgtacctcaactgagttatgaagatttgtactggttttacagatcatctcatcgtatggaaaagaacaagcttcgtggtcagtttactgggtgaccggcagacaccacaatcaaactagtctggggaaaacctgcttttttgttgtaggtgccacgtaaccctgtcagtttgacaaggaatgaccgtgccaataaaccaattctccctctgcttggaaaaaaaaaaaaaaaaaaaaaaaaaaaaaaaa

SEQ ID NO: 1803 - DNA, 5215 bp, Rattus norvegicus
  Genbank Accession No. NM_022599
gagagcccagccttctccctggctcctatttaagcatcaggcaaagaccgtgggtcccagcaacagcagtgaggaggcacttggcacttcgggcaggtggtagccgctgtgcctggcaccttggcatcctgcctgggctgcacgtggcctggcacccatacagctcctgattgctgcggctggaaggagcctgtgattctgcgtgagtgtggggtccttgggtatacagtcagccgaggtagaggtgggctggcctaggactgtacacttctctaggagctgggcttaactaaaacagaagagattgcggttagacatcaagaggaactcagacccgtgggaaagaaccaggacctgaggcaaaggcgagatttgggtggtggacgggggacagggagactcttcacagtcctcacaggacctacacaggggcctatggtctcagacctgggatcatgttcctgagggggtataagagagaggggcaggtcaggaagcataggaagtcagttgcacatgggggagggttgtggggaaactgtaaaagctatgctggggaggcggcacggagcttgattcaccttcacctgcgccgggcacccgctgaccccgggtttccgcccggagagcagtcagatatgaacggacgggtggattatttagtctccgaggaagagatcaacctgaccagaggaccctcggggctgggcttcaacatcgtcggtgggacagatcaacagtatgtctccaatgacagtggcatctacgtcagccgcatcaaagaggatggggctgcggcccgggatgggcggctccaggagggtgataagatcctctcggtaaatggccaagacctgaagaacctgttgcaccaagatgccgtagacctcttccgtaatgcaggatatgccgtgtccctgagagtgcagcacaggttaccagtgcagaatggacctatagttcatcgaggcgacggagagccgagtggagttcctgtagctgtggtgctgctgccagtgtttgcccttaccctggtagcagtttgggccttcgtgagataccgaaagcagctctgagatgcctgttgtcttccagtgtgtccgatgagctaactatctctctcactcaccatctcgacatcctcccctagtcttccttcccacatagccaacacatgatttaaagtgactgcttatcacccgaaaccttgctgttcaaaatctccaagacttcacattctaatggaagagtaaagagattatttgaagaaagctgggggtggggagagccttgcttagaataaatgagaagttacatattttactagaactgccaataaaaattcagctatcagccaaagaggagaagcttgctcttcctgtctccatggacgacaccttttgcttagctggtgtgctttgaaggctagctgtgctatgtgaaaggaggagctgattttttaaatactttttcttgggaagtatttgtggcctttaatttgtaactatatacttagatgcctatattggacataggcgaatgaatttttttcttttcttagaaaagaaaatacatatatacattaacacacacacacacacacacacacacacagcataaaactgatgccttatggagagttaaagaggtgagaaaactactggttcttggatttctagtggacaagttttgggaactagggggtcatattcctttatatataatcaaaactcatattaaagaatgagttctggattgtaaagagaacttactttttccacttgtctgtaagtctttgtccacaagttaaaaacatacacagtcctaagggctgatcataactgaaacacttcaaaaattattggcagagaaggtataacggggatggaaaagttagctttaaaagagaatgctcagtcagtggcattaggaaaataatgactgaagcaattagttgaaaactgtagaacaactagtgttccagggtagctacagtgatgtgggaaattgtggcaaagcagttcttctcaagtcaatttgtttaaaagactttggggtgtaaagatgagtcctgacagtctctgaatgaccttagtgactgttgtactatgtgaaaggatccattggcatggagatgagaagtaggagggccaaataaaccatcaagacaactgaaaaaagatcatacctcagggtggcacttgaaccctcaaagtgctcaccaactttcagtttctagtatcaggcaaagcctaagggaagggactgctttcctggcagggtggaccccaaatcagcctgcttctgatagagttacgatgagaaggcccaaattgatgtaggctttctttttgtgtatttttcccaaagctataagcactagttttggttttaataaggtaatggaccattttttcagaaaaaggggaaggaataaggtttgtttgtttatagagggtgcaaggaagtttagtgagcatttctgaggaaagcctgagcacacagagtagattaactatgccagagaatagccagggatattggggggtggggggtagtggagctgtcctgtttatgtagcatcaaagttggttttagagtactgaggatagttgaaccaagcctaattttttttttcactttaacaaaataatttccgtcttttcaataaattggccagactattttgacctaagattataaagagttttcctgacaacctagcagtcacttaacagatgtcgattgcacattagttttgtcaagacacctttataacaaagggaaatgcacacacttcatccaaaaggacattgtggttacagttaggaagaaaacacttaagatggaattatccatgtaagtgtaagttgtttatattacagacaacaaaagaaaatagctcccaagctttgagcactgaagatctcagaggaaggactccttaggtgccaatcgtctagcaagcatgcatacataggggacaagttaagagtcttaccgggttgagtaagaaaaggaaattattgccatgcgagacagagcacgatgcagcaatgtggaggatgagcagacagctagcatgttgtaaggagctcagaacgggagagccttcctgcagtggcatcgggggagaatgcaaaggaaagtcttgaacagtccagtgagcctttgcctctggataaactgttgatacagggagacatttgctttaaacagtcttcacataaccaagccattcagtacttcttgaaactgacttcataacaggagtcattgtaagttccacagaaagcaagacgtatgtatttcagttcttgtcttgaccagcagcactccggaggcccagtgtccggtgccctccttgtatctgaagcaggggtaacagctctgctgtgggcctgtttccctctagtatttacctcaaggcttggaaatgtattttgaaagaccttcagtcaaacgaagtaaagcaaatgtcaagaaggataaaccactgttgtgtgttgatgtgtggtgtattgtgatgtaaataaaaaatatcgttgaagttttactttgtaaagattctggtaacacttgggtctccttgggaaagaaacaacacttgaccaaagcatttaagttttaggcaaattccataatatttcactcttagttataaaattatcatacatgagatgttgaggatctatatagattattcagattttatattccttatagattgactcaaatattccttaaaagattatatatgatgctcctatggcataaattgtaatgtttaatgttttgaaaattggttataggtattttttaagttcccataaagtgtttcttgtatttgtcattgtgaattatatgtaattctaatagatattgtttgctttagtcatttttgtctccttttcctatagtttcctgtgtgagtgattccatgtaattaattggacagtctatccacaggcaacaaatagaagtagtatttgtaattgcagcctgtgccagggactgtgttagactgattagtaacactatgaatcacccgagatcttaagtattgctataaagagaagactgaagatgagagagtaaagtattttcctgggattatatagttggtaaaaaagaatcatgatttaaactctggactttggataaaagtatcagtaattttcctcattgctagcagtcctcatgcaaggtctctggactaaagcgatgtattacctgcaaatgcttgagtttcatcccatacttatggcgtgaggtgagtgtggcagccagcatctctgtcctcctaggtaactggttagtgctgaacctcgagattcaccactgtcaggagctgtctctgcttagaatcacctggacagctggctgtcaacccacgttaagtaagaacatgtgggactagaattcagtcaacaataaaagctttcatcaggtggctaaaatgtgcagactctgtttgtactggcatgttggccatcactcacagatgcaactctagccagaatcaagaatggggcagatccagagcccagctcgctgagcttctgccccagatttcagaggcagagtaagaagtggaacagtgttttcctcccaggtgctcaggacaggctggtcaacttccagtcacatatgccatttagtaagtgcttcggcctgtgcagccattagtaaccaaatcatgggatagtgaatctaaaatactcttggataaaatttgtattagaattaaaaaaaaatgagggtcagaaaggtgaactaactccaacttagatgcccctcccctttattttggtctcaaatctgttttaatgtgtccacaacattaatcaaaaactgtattttttttttttcggagctggggactgaacccagggccttgcgcttgctaggcaagcgctctaccactgagctaaatccccaacccccaaaactgtattttaaaaatcagttcactttcatctttttttccttgggttttcagtaaagaccagaaggactgacagacagctagagaggttgtgtagacatccagatggggagagtgcattggacaatctgagaaatctattcaggtgctgcctaattccattagctttaagttagatacaagctgtttgtagtattttgggttttattgtgcaaataaacaatagaggcctttagtcccagcgttaggatgcagagatccatttct

SEQ ID NO: 1804 - DNA, 470 bp, Rattus norvegicus
  Genbank Accession No. NM_022643
ctgttttgagacgttggagtggacaaacttatttttccacgatgccggaggtgtcggcaaaggggactactatttccaagaaagggttcaagaaagcagtcaccaagacccagaagaaggagggccggaaacgtaagagatgccgcgaagagagttactccatctacatttataaggtgctgaagcaagtgcacccggacaccggcatctcttccaaggccatgagcatcatgaactccttcgtgacagacatcttcgagcgcatcgcgggcgaggcatcgcgcctggcgcattacaacaagcgctcgaccatcacgtcccgggagatccagacggctgtccgcctgctgctgcccggggagctggccaagcacgctgtgtccgagggcaccaaggcggtcaccaagtacaccagctccaagtgagcccacagagctcacaacagacccaaaggctcttttcagagccac

SEQ ID NO: 1805 - DNA, 492 bp, Rattus norvegicus
  Genbank Accession No. NM_022672
ctttccggtggaggagtctggagacgacgttcagaaatggcacctcgcaaggggaaggacaagaaggaagaacaggtcatcagccttggacctcaggtggctgaaggagagaatgtatttggtgtctgccacatctttgcatccttcaatgatacctttgtccatgttactgatctttctggcaaggaaaccatttgccgagtaactggtggaatgaaggtgaaggctgaccgagatgagtcctctccgtatgcagccatgttggctgcccaggatgtggcccagaggtgcaaggaactgggcatcactgccctgcatatcaaactccgggccacaggaggaaacaggaccaagacccctggacctggagcccagtcagccctcagagctcttgctcgctctgggatgaagattgggcggattgaggatgtcacccccatcccctctgacagcactcgaaggaagggtggtcgtcggggtcgccgtctgtga

SEQ ID NO: 1806 - DNA, 811 bp, Rattus norvegicus
  Genbank Accession No. NM_022674
gccttttctctgccttgcttgcttgagctccagcacagtccgagatggctggcggtaaggctggaaaggactccggaaaggccaagacaaaggcggtttcccgctcccagcgagcgggcttgcagttccctgtgggccgtattcatcgacacctgaaatctaggacaacaagccacggacgtgtgggcgcgaccgcagctgtgtacagcgcagccatcctggagtacctcaccgcagaggtacttgagttggcaggaaatgcatcaaaagacttgaaggtaaagcgtattacccctcgtcacttgcaacttgctatccgcggagatgaagagttggactctctgatcaaggctacgattgctggtggtggtgtcatcccacacatccacaaatcactgattgggaagaaaggacaacagaagactgtctaaggatgcctggattccttgttatctcaggactctaaatactcttaacagctgtccagtgttggtgattccagtggactgtatctctgtgaaaaacacaattttgcctttttgtaattctatttgagcaagttggaagtttaattagctttccaaccaaccaaatttctgcattcgagtcttaaccatatttaagtgttactgtggcttcaaagaagctattgaatctgaagtggtgggttttgattgagttgactgtttttaaaaaactgtttggattttaattgtgatgcagaagttatagtaacaaacatttggttttgtacagacattatttccactctggtggataagctcaataaaggtcagatcccaaactaaaa

SEQ ID NO: 1807 - DNA, 619 bp, Rattus norvegicus
  Genbank Accession No. NM_022676
gcggccatggagcccgacaacagtccacggaagatccagtttacggttccgctgctggagcctcacctggacccggaggcagccgagcagattcggaggcgccgccccacccctgccacacttgtgctgaccagcgaccagtcatccccagaagtagatgaagaccggatccccaacccacttctcaagtccacactgtcaatgtctccacggcaacggaagaagatgacaaggactacacccaccatgaaagagctccagacaatggttgaacatcacctagggcaacagaaacaaggggaagaacctgagggagccactgagagcacagggaaccaggagtcctgcccacctgggatcccagacacaggctcagcgtcaaggccagatacctcggggacagcacaaaagcctgcagaatccaaacccaagactcaggagcagcgtggtgtggagcccagcacagaggacctttcagcccacatgctaccactggattcccaaggagccagcttggtctgacagaagttgacatccggggatcgccagtgagtgtggaagttcatggacactggatgtttcttaatctcttgtttttaaacgtgataaatttggtgtt

SEQ ID NO: 1808 - DNA, 377 bp, Rattus norvegicus
  Genbank Accession No. NM_022686
acttttactcacaaccatgtctggacgtggtaaaggtggtaaagggcttgggaaaggtggcgctaagcgtcatcgcaaagtcctgcgcgacaacatccagggcatcacaaagcccgccatccgccgcctggcccggcgcggaggagtgaagcgcatctccggcctcatctacgaggagacccgcggtgtgctgaaggtgttcctggagaacgtgatccgcgacgccgtcacctacacggagcacgccaagcgcaagacggtcactgccatggacgtggtctacgcgcttaaacgccagggccgcacactctacggcttcggtggttaaactgctaatgcgctttccttagctgttgcaaaaggcccttttcagggcc

SEQ ID NO: 1809 - DNA, 689 bp, Rattus norvegicus
  Genbank Accession No. NM_022688
tcaggtgggtacaagctgcccttggcatgccctatagcctccaaccacagccagagggatttgctgatgtaccaggcttcccactgtgtatgtacatggtaagaggatcaacctggacattagttccacctgacctctgactgatggtttggaaaacaagtttaattagaatcccttggccactgcagaggggaaaattaggctgatttctgtcccactggaggataaaggaagacttaggccagcgcttcagcttgtcaggacacgcccaatgtcgtttttcttagtggaaattgattgtgagtctttttaattccaggagcgtcctttatgacacagcttcaaaacagaacccaagtattttgagttatactccaacttctgccattgccttaaatgtagaagccaaaccttctctttatggactttcagagtggacacaaaggatcacttgctgctagatgacagtagtgtcttgggactgtccagtccctttaggaaaggaagggtctgcagctgcatgaactgggaagctgctaacggggaggaattagcgcccccaccctaaactcatccacccgaattcggcgccccagcaaccctgactccctgccagcacgtccacggctgcttaccccggcaacctcccatcccctgagccctccctcaataaatgcaatctgtagcaa

SEQ ID NO: 1810 - DNA, 3166 bp, Rattus norvegicus
  Genbank Accession No. NM_022694
ccgtgcaacggggcatcgtcaagatggtcctctctgggtgtgccatgattgtccgagggctgccccgtggtaccgctccagagaggcagatcaacctcagcaacattcgagctggaaatctcgacacacgtcgtcgagctgctacacaaccagatgggaaagataccccagatgagccctgggcatttcctgctagagagttccttcgcaagaagctgattgggaaggaagtctgtttcacgatagaaaacaagactccccaaggacgagagtatggaatgatctaccttggaaaagatactaatggggaaaacattgcagagtcgctagtcgcagaaggcttggctcccggagagagcatgagagccaataatccagagcagaaccggctttcagaatgcgaggaacaagcaaaggcatcgaagaaagggatgtggagtgaggggacgggtcacacacatccggacctcaagtacaccattgagaacccaaggcactttgtggactcacaccaccagaagcctgtcaatgctatcattgagcatgttcgagacggcagtgtggtccgggccctgctccttccggatcactaccttgttaccgtcatgctgtcagggattaagtgcccaacctttcgtcgagaaacagatggtagtgaaacaccagagcccttcgctgcagaagccaagtttttcacggagtctcgactgcttcagagagatgttcagatcattctggagagctgccataatcagaacattctgggcaccatccttcatccaaatggtaacatcactgaactcctcctgaaggaaggttttgcccgctgtgtggactggtcaattgcagtttacacccggggtgcagaaaagctgagggcagctgagaggtttgccaaggagcgtaggctgagaatatggagagactatgtgcctcctactgctaatttggaccaaaaggacaagcagtttgttgccaaggtaatgcaggttttgaatgctgatgccattgttgtgaagctgagttctggagactacaagaccatccacctgtcaagcatccgaccaccaaggttggagggagacaacatacaggataagaataagaagctgcgtcccctgtatgacatcccctacatgtttgaggcccgggaattccttcgcaaaaagctgattgggaagaaggtcagtgtgactgtggactacattagaccagccagcccagccacagaaacagtgcctgccttttctgagcgtacctgtgccacagtcaccattggaggaataaacattactgaggcccttgtcagcaaaggcctagccacagtgatcagataccggcaggatgatgaccagagatcttcacactatgatgagctgctggctgcagaggccagagcgattaagaatggcaaaggattgcacagcaagaaggaagtgcccatccaccgagttgcagacatttctggggacacccagaaagcaaagcagttcctgccctttcttcagcgcgcaggccgttctgaggctgtggtggagtatgtcttcagtggctctcgcctcaagctctacttacctaaggagacctgtctcatcaccttcctgctggcaggcattgaatgtcccagaggagcacgaaatctcccaggcttggtgcaggaaggagagccattcagtgaggaagccacacttttcaccaaggaactagtgctgcagcgagaggtggaggtggaggtagagagcatggataaggctggcaacttcattggctggctacacatggatggggctaacctgtctgtcttgctggtggagcacgcgctctccaaggtccacttcactgctgagcgcagcggctactataagcctctcctgtctgctgaggaagctgccaagcagaggaaagagaaggtctgggcccactatgaggagcagcctgtggaggaggtaatgcctgtactggaagagaaggagcgctcggccagctacaagccagtgtttgtgaccgagatcacagatgacctgcatttctatgtgcaagatgtggagactggcacccagctggaaaaactgatggagaacatgcgcagtgacatctccagccaccctcctgttgagggtctacgcccacgccggggagagttctgcattgccaaatttgtagatggagaatggtaccgcgcccgggtagaaaaagaggagtcccctgccaaagtgcatgtcttctacatcgactatggcaatagagagatcctgccatccacccgcctggccctaccacctgccttcagcactcgcgtgttgccagctcaagccacagagtatgccttcgccttcatccagtggccccaagatgaggacgctcgcacagatgctgtgacagtgtgtgcggacatccaaaacactcagtgcctgctcaacgtggagcacctgagtgccagctgcccccatgtcactctgcagtttgcggattccaaaggtgatgtggggctgggcctggtgaaggaaggactcgtcatggtagaagttcggaaggagaagcagttccagaaagtgatcacagagtacctgaatgcccaggaatcagccaagagtgccaggctgaacctgtggcgctatggcgacttccgagctgacgatgctgatgagtttggctacagtcgctaaggagaacttgcctggctcccagcaccgatgatgccagaccttctccctctgccaggaagccgttttcaactccagacctggtcgggggagtatagattgggtccagcttgcttcagacagaaacctcctctgtcgcgggtagcattggagctggggtggagagcccaaggcttgctggggcagacccctcagtggtactgccgtccagtctctcccagatgattttgtatttttatttaattgtcttcaaatcaggaaagaaccatgaaagactgtgtgttagtgaagggtataatcgtgacacagaggcagctgtcagctggcacccacctctcccccagaccacccttcttcccaagctctgtccaagtgttgattatgtgacttctgatacatccgttctcaaattccagtgtgcccatatctgcccccacaccagcctgttctgtatttaaagcttttgagacccaataaaatagtacctgctgtctgcaaaaaaa

SEQ ID NO: 1811 - DNA, 466 bp, Rattus norvegicus
  Genbank Accession No. NM_022697
ctttccgtctccggccgccgcaggagaggagtcgccgccatgtccgcgcatctgcaatggatggtcgttcggaactgctccagtttcttgatcaagaggaataagcagacgtacagcacggagcccaataatctgaaggcccgaaactccttccgctacaacgggctaattcaccgcaagacggtcggagtggaggcctggcctgatggcaaaggggtcgtggtggttatgaaacgcagatccggtcagcgaaaacctgccacttcctacgtgaggaccaccatcaacaagaatgctcgggctaccctcagcagcatcaggcacatgatccgaaagaacaagtaccgccctgatctgcgtatggcggccatccgcagagccagtgccatccttcgaagccagaagcctgtggtggtgaagaggaaacggacccgccccaccaagagctcctgagccccacaccccg

SEQ ID NO: 1812 - DNA, 4344 bp, Rattus norvegicus
  Genbank Accession No. NM_022849
ggaacagattctggtttggctgtgaggctggtgaatggaggagacaggtgtcggggtcgcgtggagatcctttaccagggttcctggggcaccatgtgtgatgacagctgggacatcaatgatgccaacgtggtgtgcaggcagctgggctgtggctgggccttgtctgccccaggaagtgcccagtttggacagggtctgggtcccattgttctggatgacgtggcctgtagaggacatgaggcctatctgtggagctgctcccaccgaggctggctctctcataactgtggacatcaggaggatgctggagtgatctgctcagattctcaaacaagcagtcccacacccggttggtggaaccccgggggcacaaataacgatgtgatctacgacactcaagaaaccacagaaacttctcaaacaagcagtcccacacctgattggtggaaccatgggggcacaattaatgatgtgatctatgacactcaagaaaccacagaaggaacagattctggtttggctgtgaggctggtgaatggaggagacaggtgtcggggtcgtgtggagatcctttaccagggttcctggggcaccgtgtgtgacgacagctgggacatcaatgatgccaacgtggtgtgcaggcagctgggctgtggctgggccttgtctgccccaggaagtgcccagtttggacagggctctgggtccattgttctggatgacgtggcctgtagaggacatgaggcctatctgtggagctgctcccaccgaggctggctctctcataactgtggacatcaggaggatgctggagtcatctgttcatattctcaaacaagcagtcccacacccgattctcaaacaagcagtcccacacccggttggtggaaccccgggggcacaaataacgatgtgtcctatggacccgaacagaccacagacgcaacagattctggtttggctgtgaggctggtgaatggaggagacaggtgtcagggtcgtgtggagatcctttaccagggttcctggggtaccgtgtgtgacgacagctgggacaccaaggatgccaacgtggtgtgcaggcagctggtctgtggctgggccttgtctgccccaggaagtgcccactttggacaaggctctggatccattgttctggatgacgtggcctgtacaggacatgaggcctatctgtggagctgctcccaccgaggctggctctctcataactgtggccaccatgaggatgctggagtcatctgttcagatgcccaaacccagagcacaacctggccagatatgtggcctactaccactccagaaactacaacagattggtggactacaaaatattcttcctctgttcctacaacacaattccccaccatagccgattggtggacaactccttctccggaatacacctgtggaggtttactgaccctaccctatgggcagttttccagcccatactaccctggaagctatcctaacaatgccagatgtttgtggaaaattttcgtctccagcatgaaccgtgtgacagtggtcttcacagatgtgcagcttgaaggaggttgcaactatgactacatcctggtttttgatggccctgaaaacaattcttctctcattgctcgggtttgtgatgggttcaatggatctttcacctcaacccagaacttcatgtctgtagtctttatcacggatggcagtgtcacgaggagagggttccaagctgactactactccactcctatcagcaccagcacaacctctccaacgacgttcccgatcgttactgattggtggacaactccttctccggaatacacctgtggaggtttactgaccctaccctatgggcagttttccagcccatactaccctggaagctatcctaacaatgccagatgtttgtggaaaattttcgtccccagcatgaaccgtgtgacagtggtcttcacagatgtgcagcttgaaggaggttgcaactatgactacatcctgggttttgatggtcctgaatacaattcttctctcattgctcgggtttgtgatgggtccaatggatctttcacctcaacccagaacttcatgtctgtagtctttatcacggatggcagtgtcacgaggagagggttccaagctgactactactccactcctatcaggaccagcacaactcctccaacgacgttcccgatcattactggaaatgattcttcattggtgctgaggctggtaaatggaacaaaccggtgtgagggccgagtggagatcttgtacagaggctcttgggtaccgtgtgccgacgacagctgggacatcaatgatgccaatgtggtctgcagacagctcggttgtggctctgctctgtctgctccaggaaatgcttggtttggtcagggttcagggctcattgtcctggatgatgtgtcttgctctgggtatgagtcccacctgtggaattgtcgtcaccctggctggcttgttcataattgtcgtcatgttgaggatgcaggagtcatttgctcactccctgatccgactccctctcctggtccagtttggacaagtcctccttttgtaaactatacttgtggaggtttcctgactggactctctgggcaattttctagcccatactaccctgggagctatcctaataatgccagatgtttgtggaacattgaagtcccaaacaactaccgcgtgactgtggtcttcagagatgtgcagctggaagggggctgcaactatgactatatagagatttttgatggcccccaccacagttcacctctcattgcccgggtttgtgatggggccatgggctctttcacttcaacatccaacttcatgtcagttcgcttcaccactgatcacagtgttactcgaagagggttccgggctgactactactcagactttgacaataataccaccaatctcctttgtctgtcaaatcacatgagagccagtgtgagcaggagctaccttcagtccatgggctactcctccagggatcttgtcattcctggttggaacgtgagttaccagtgtcagcctcagataacacaaagggaggtcatattcacaattccctacacaggctgcggtactaccaaacaggctgacaacgagaccatcaactactccaacttcctcaaagcggctgtttcaaatggcatcatcaaaaggagaaaggatctccacatccatgtcagctgcaagatgcttcagaacacctgggtcaacaccatgtacatcaccaacaacacagtcgagatccaggaagtccagtatggcaattttgacgtgaatatttccttttatacatcctcctccttcttgtatccagtgaccagcagcccatattatgtggatctggaccagaatttgtaccttcaggccgaagtcctccattcggatacctctttggctctgtttgtggacacctgtgtggcttcgccacatcccaatgacttctcgtctttgacatatgatctcatcaggagtggatgcatacgagatgaaacttaccaatcttactcctcgccctcaccacgcatcacccgctttaaattcagttctttccacttcctgaaccgcttcccctcagtatacctacagtgtaaactggtggtttgtcgagcaaacgatgtctcctcacggtgctacagaggatgtgtagtaaggtccaagagggatgtaggctcctaccaagaaaaggtggatgttgttctgggacccatccagttgcaatctcccagcaaagaaaagaggagtctcgacttggcagtggcagatgtggagaagccagccagctcccaggaggtctatcccactgcagccatctttggtggagtcttcctggccctggttgtagctgtggcagccttcacactgggaaggaagacacgcactgcccgtggtcaacctccaagtactaagatgtgaagcaaaacaacccagacattggtcccaaatgcatagattcccagaaaagatggaagtcaggagtgtctaatgcctggcacccagatacacgatgactaggcttcccttagcacaaatgtgtggccgagtatgatcagatggtaaagaagaaaggtgggggccaagttttcccagggtctagaggctgaaggctgggaagaatgtcataggagaatgagatcagtgtctacaataacaggcaactgtgagccaaacattggcatcaccatcctttctctagctagaatttccctttcccccttttatactgacttttttgaactgtagtgttaaatggacctttccgtacaacaaactaaaataaagaatctttttcca

SEQ ID NO: 1813 - DNA, 2547 bp, Rattus norvegicus
  Genbank Accession No. NM_022855
cggtcttgccttaagaataaatagataaggggttggggatttagctcagtggtagagcgcttgcctcgtaagcgcaaggccctgggttcagtcctcagctccgcgccggccggagagactagacgctttcctttctttttcaccccctcttttctttcgttcttttttttttttttccccctcctctcatgtattcacttccgggtccggtgccgcttccggatgctcgaggccgaaggatgtttgacctccggataagcgaggcgccgccgtgcattcattcccggttgcatcggtggccacagccgcggcccggacggcgactccgctctcagcggcggcagtaaggaggagccggcggcggcgcgctgagccagtagacgcgggcccgtccttccctcgctcgcgccttccttcctcggcctcgttcatcttcagcggccggcggcggggatgtgccggcgctgacgggcggacgcgcgccgggccgagccgctgcccgcggccgcgcctctgagctctctatcggcaccagcttatatcaccgagaagataattgtaaaggcataccttgttgagaacataactgagaggttgtacggatgggatgaacacgcgtcagttgcctgcctgtctgctggagtttggatgctagcgttgctcatagggaactgctgcctagggatgcacctgctctacagtaccccatttcatcgtgcttgtctcgattaaagaattcaaagtggagtaccgcaaacttgatatggataataaaaagaaagacaaggacaaatcagatgacagaatggcacggcccagtggtcggtcagggcacagcactcgaggaactgggtcttcttcatctggagttttaatggttggacctaactttagagttgggaaaaaaattggatgtggcaattttggagaattacgattagggaaaaatttatatacaaatgaatatgtggcgattaaactggagcccatgaaatccagagcaccacagctgcatttggaatacagattctataagcagttaggatctggagatggtatacctcaagtttactattttggcccttgtggtaaatacaacgctatggtgctggaactgctgggacctagtttggaagatttgtttgacctctgtgatagaacattttctcttaaaaccgttctcatgatagctatacagctgatttctcgcatggagtatgtccactcaaagaacttgatatacagagatgtgaagcccgagaatttcttaataggacggccaggaaacaaagcccagcaagtcattcacatcatagattttggtttggcaaaggaatatattgatccagagacaaagaaacatataccatacagagaacacaaaagccttactggaacagccagatacatgagcataaacacacatctaggaaaagaacagagcagaagagacgatttagaagctttaggacatatgttcatgtatttcctgagaggcagtcttccttggcaaggcctaaaggcagatacattaaaagagagatatcagaaaattggagacacaaaacgagccacaccgatagaagtgctgtgtgaaaacttcccagaagaaatggcaacatatcttcgttacgtacgaaggctagatttttttgaaaagccagactatgattacttaagaaagctttttactgacttgtttgatcgcaaagggtatatgtttgattatgaatatgactggattggtaaacagttgcctactcctgtaggtgcagttcagcaagacccggctctgtcatcgaacagagaagcacaccaacacagagacaagatacagcagtctaaaaaccagtcggcagaccacagggcagcttgggactcccagcaggcaaatccccaccatttgagagctcaccttgcagcagacagacatggtggctcggtacaggttgtaagttctacaaatggagagctaaacacggatgaccccacggcgggacggtcaaatgcacccattacagcccctacggaagtagaagtgatggatgaaaccaagtgctgctgctttttcaaacgaaggaaaaggaaaaccatacaacgtcacaagtgactggacacagacagagcctggggagttacttacatgtttatatgctgtctcgtgattaaaatcatctctagagtgaccacatatattttcaaggactcactcttgaaacaaaaaagtcatactttcatatttcattttgtggttgtcttatattcattcccccaccccggaattccttagacccttctgcccctgctagcgcttccaccagctctcctccgctccccgctcctgcagcccagcctccttgtgtgcaagaactgtcagggagatctgctggcagttccagtccggaagccggagaagactctgatcatgaggatggaaactattgccctcctgtcaagcgcgagcggacatcatctctaacgcattcagaggagaagagcagcggcttccggctgaagcccccaacgcttatccacgctgctgttccg

SEQ ID NO: 1814 - DNA, 1760 bp, Rattus norvegicus
  Genbank Accession No. NM_022858
ggcaacaatcaaaacccctcccaaaaaaaatcccagcggaggagaacctttcggaaaagcgtctctctcggaaagacgcaggagcggtccctcccaggagaagacagactcagcgggccacgggatcgccactccgggcgccactcgcttcctacgacctcgcaggaaaggggtaactgtgccggactggaagcaccagcgccggcatgaaattggagtgttcgtcccacgcgcagccacggggacaaaatgggcagcgatctggagggggccggcagcagcgacgtgccatctccactgtccgcggctggtgacgactccttaggctcagacggggactgtgcagccaacagcccggcggcgggcagcggcgccggggatctggaaggtggcggcggcgagaggaattcgagtggcggggcgagcacccaagacgatcccgaggtgaccgatggcagcagaacgcaggcctccccggtggggccgtgcgcgggcagcgtgggcggcggtgagggcgcgcgcagcaagccgtacacgcggcggcccaagcccccctactcctacatcgcactcatcgccatggccatccgcgactccgcgggcggacgcctgacgctggccgagatcaacgagtacctcatgggcaagttcccctttttccggggcagctacacgggctggcgcaactccgtgcgccacaacctctcgctcaacgactgtttcgtcaaggtgctgcgcgacccctcgcggccctggggcaaggacaattactggatgctcaaccccaacagcgaatacaccttcgccgacggggtcttccgccgccgccgcaagcgcctcagccaccggaccacagtctccgcatcgggctacggcggaggaagcccacccggacctgcggggaccccgcagcccgcgcccaccgccggctcctccccaatcgcgcgctcgcccgctcgccaggaggagggctccagcccggcgagcaagttctccagctccttcgccatcgacagcatcctcagcaagccgtttcgcagccgccgcgacggcacccggctctgggggtgcagctaccctggagcgctgctccctgcccgccgctgcgcgcctatcccgcgctccttcccgcgtcgtccggcggtgccctgctgccgctctgtgcttacggcgcggcgagcccacgctgctggcgtcgcgcggggccgaggtgcagcccgcggcgcccctgttcgtggcgcccctctccaccgcggccccagccaagccatttcgaggtccggagaccgccggcgcggcgcacctgtactgccccctacggctgcccacggccctgcaggcggccgcggcctgcggtccgggtccgcacctgtcctaccgggtggagacgctgctagcttgacaggagcttggagctctgctggtgggtctagggtggagttgggagcaccttttgtcatggagggcaccttttgtcatggaggttggaatgcgggctccagggctgtgcactttccaccttccccgaggaatagagattttttttcaactctccatcaaatgtgctaagtaagcatttgtcccaagtgttttaacttagtccagaatagttcctttgtcttttctaactttacagaggatcaaagctgttcttttctatttcatggccaggcctgtactctcccgcaaagaggctttcctctccctcctattgtgttgcaccttctgctgatttttcttccccacccacgcccgaattc

SEQ ID NO: 1815 - DNA, 2352 bp, Rattus norvegicus
  Genbank Accession No. NM_022946
accgaggaagccagagctctcggagatgaagctgtaggcaacaaaatgatcgacctttttaaggctgagtgggtttcttcagtttgcgtgcaagtttcacggaatggaaggactgaccaggtttgggttccccaggatgaatggacagggtacacgcctcgcgggaaagacgacgagatcccgtgccggaggatgcgcagtggcagctacatcaaagccatgggggatgaggacagcggggactcggacacgagccccaagccatctcctaaggtggctgcaagaagagaaagctatctcaaggccacacagccatcccttacagagctcaccaccctcaagatctccaacgaacactcccccaaactccagatccggagtcacagctacctgagggcagtaagtgaagtctccattaacagaagcctggacagcctggatcctgcaggcttgctcacgtcaccaaagttccgctccagaaacgagagctacatgcgagctatgagcaccataagccaggtgagcgagatggaggtgaacggacagttcgaatccgtatgcgagtctgtgttcagcgaactggagtcgcaggcggtggaagcgctggacctgcccatgcctggctgcttccgcatgcggagccatagctacgtgcgggctatcgagaagggctgctcccaggatgatgagtgcgtgtcgctgaggtcgtcctcccctccacgcacaaccaccaccgtgaggaccatccagagtagcaccggtgtcataaaactgagttctgccgttgaagcccagagtagcacagagtccgcgcaggatgcctacatggacgggcaaggccagcgcggggacatgatcagccagtctggcctcagcaactccaccgaaagtctggacagtatgaaggctctcacggctgccatcgaggctgcaaacgcgcagatccacggcccggcaagtcaacacatgggcaccaacgctgctgccgtcaccaccaccaccaccatagccactgtcaccaccgaggacaggaagaaagactttaagaaaaacagatgcctatctattgggatacaggtggacgacgccgaagagtcagagaaaatggcagagagtaagacgtccagtaagttccagtccgtgggagtgcaagtagaagaggagaagtgcttccgcaggttcactcggtccaacagtgtaacgactgcagtacaggctgacctggacttccatgataatctggaaaattctctggagtctatagaggacaattcgtgtcccggcccaatggccagacagttctcgcgagatgccagcacctctaccgtcagtatccagggttcaggaaaccactaccatgcctgtgcagccgacgatgactttgacacggattttgacccctctatcctgcctcctccggacccctggattgactctatcacagaagaccctctggaggccgttcaaaggtccgtgtgccaccgggacggccactggttcctgaagcttctccaggcagagcgagaccgcatggaagggtggtgcaagcaaatggagagagaagagagggaaaacaacctcccagaagacattctagggaaaatcagaaccgcggtgggcagtgcccagcttctcatggcgcagaaattctaccagttcagagaactgtgtgaagagaacctgaatcccaatgctcacccgagacccacttcccaggatttggcggggttttgggacatgctgcagttgtccatagaaaacattagtatgaaatttgatgaacttcatcagttaaaggccaataattggaaacagatggatcctcttgacaagaaggagcgaagggcccctcctccagtgccaaagaagccggcgaagggccccgcgccgttgatccgggagcgctcgctggagagctcgcagcgccaggaggcccgcaagcgcctgatggccgccaagcgcgcagcatcagtccgccagaactcggccaccgagagcgccgagagcatcgagatctacatccccgaggcgcagacccgcctctgagcgcggccgacgaggaccgtcccgcatccctgccctcggccgtctccccgccccctccgtctctgagctcagtgaccgccaccgtcgtggcgtagttgtccacctcgcaggagccgtccccaggccgccccgcttcctgggccactttgcccatcttctccaccgagcttcgctccccagtcctgaagcctcatgcagacatccaaaccctttattttctgggccaagcaaacttgtgtagaaacgacacctgtaggtcactcaccctcctcagttctctcaagctagtgtgcccctagaactcag

SEQ ID NO: 1816 - DNA, 2699 bp, Rattus norvegicus
  Genbank Accession No. NM_022948
tcgggtctggtctcaacagcctggtctgggggagtcactccagatgacatccactgtcccggaactctgccaagaggggggtgggtcaggcgaaccagtttagggagcccccgcccttccctgctgctcagcgtcacgcgtgacgtccgggtgatggctgggaggaaagcggagagctgtgaggaaggcgggtctgagagctgctagaggctgtaaatccccggaaagcaagatgggcgacttgcccttaaatatcaacatccaggaacctcgatgggaccaaagcacattcctaggcagagcccggcacttcttcacagttactgatccccgaaatctcctgctgtccgggaaacagttggaagcttctcggaacatcgtgcagaattacagggctggtgtggtaactcctgggctcactgaggaccagctatggagagccaaatacgtgtatgactcagcattccacccggacacaggggagaaggtggtcttgattggtcgcatgtcggcccaggtgcccatgaacatgaccattactggctgcatgctcaccttctacaggaagactccaactgtggtgttctggcagtgggtgaatcagtccttcaatgctattgtgaattactctaatcgcagtggagacgctcctatcactgtgcagcagctgggaacggcctatgtgagtgccaccactggggctgtggctactgctctgggactcaagtctctcaccaagcacctacccccactagtgggtcgattcgtaccctttgcagctgtggctgccgccaactgcatcaacatccccctgatgaggcagagggagctgcaggtgggcatcccagtgactgatgaagctggtcagagacttggccactcggtgactgctgccaaacagggcatcttccaggtggtggtatcgagaatcggcatggcgatccccgccatggccattcccccggtgatcatgaacactctggagaagaaagacttcctcaagcgccgcccctggctgggggcccccctgcaggtgggactggtaggcttctgcttggtatttgccacacctctgtgctgcgctctttttccccagagaagctctatacatgtgaccaggctggagccggagctgagagctcagatccaagcacaaaaacccagcatcgatgtggtttactacaacaaggggctttgaggggaatcggcctctgtccctgtccttacctccttaggctgcttctttggtgccacttctcaatgctaccacctgtttaatcttccgggtactgggcaggggggcttgatgtggggagcagccactgagaccagcaaccttagactgggggaggcacccctataagcctcttctctcctctctggtttcaaagagcaagtcacaaagcccatccctcctgtgtctgtgtgcgtgcgtgcagacatacctaggcagtgcatggaactgttcgttcatttgctcctgaatgctaaggcagaagtgctgttctaggatgtcctgatgtttgtcttctctctcggtctcctgcccacctcacagcaagccaggtgataggcgagaatcctttccctaagctattcctctggccaagtcatttctgatagcatcttagccttctgaccccaagataagcgccaggatcccagaacacagactgaaggacatctgcagatcttaacccttccagttttgaatagctggctctgaaagctggttcaggagctgggctggcagaggaagcagggtgggatcagggaagcagggggctcatacttgctggactccacatcctgggatggctccactcctctcttctcttcctatggaacatgaggatgtctctgtagcctgcagtgcccctaccctgcttttagagatagtcttgggcattcttggtctgttctgatgactcatgtcatgactcagaaagaaatcccacaatcccaattccttccccaattagaaagccacacaggcagagcaagcattctcttcaggaactgccaccccctgtacccacttatagggggaccggtgtgggaacggtgcttaaacacaggcctcaagcgtacaatatcaagacaggtaattctgtgtttcattgactcctcttagacacacccacctcagctccttcctttccatctaccccgtctctgaaagaacccagggcttcacaatgctaggcaagtgctctaccactgagctacatccccagtgccccctcttccttccttcctgtctctttctttcttttttgtttttgtttttcaaatatggtttctctatgtagccctggctgtcctggaactcagagatctgattgcctaagacagtgagttctgggattaaaggcatataccaccattgccagcagcccttcttgttcctaagacatggatggccctgtgctccctctgcccttcaaaaagaggagggacccaggccttcatagctggaccaaatggaagatgggtttaggaatggcatgagtggtaatgactccagtgtgtagaattatatctgcactctaaatccatgacctctagctaaaaggcgaatggggtccccagtgatatccacggagaccactttcactcaccccctcctccagtgacaacaggtgtcatgtcatggtgtcaataaactgcagtcctgtctaaaaaaaaaaaaaaaaaaa

SEQ ID NO: 1817 - DNA, 4131 bp, Rattus norvegicus
  Genbank Accession No. NM_022951
ctcggagaaagacaggccggccatcaggaaaacaaacaagcctcagcaacatctaaacccttgaaaggatcctgagagaggggggaaagggaaaacagcagccaccagcccaaccacttgtgtcttctgcccctccccacctatcttgcccaccccaccagcccacgctgcttgggacttgaaatctgtggccgaaggaccgtcaccacataacttcaaaaataatcaaccaccctccctacccaaacccacccaatctcactcatccagcatttcctttttggagtccactcagaatttttttcaacgaccccctctccctaatggagttgggtggggggaaaatgaaaactgagttggtctttacttttttaagagactttttgatccaatgaggccccacaagtaactgagtttgggtcctggttggttgttttattttttttcctccaaaattttacccctcccccctgagcccgaggtgctgacgtcgcaaaaaaattggataaagccaccatcatgggttcaggacccatagaccccaaagaacttctcaagggcctagatagcttccttactcgggatggagaagtgaagagtgtggatggaattgccaagatcttcagtctaatgaaggaggcacgaaagatggtgagtcgatgcacgtacttgaatattatcctgcagacccgggcgccggaggtgctagtcaagtttattgacgtcggcggctacaagcttctgaacagttggttaacgtattcaaagacgaccaacaacattcctctcctacagcagattctgctgactctgcagcacctcccactgactgtggaccacctcaagcagaacaacacagcgaagctagtgaagcagctcagcaagtcaagcgaggacgaagagctccggaaattggcatcagtccttgtcagtgactggatggctgtcatccgctcccagagtagcacccagcctgcagagaaagataagaagaaaaggaaggaagaggggaaaagtcgaaccacgcttcctgagcggcctttgactgaagtgaaggctgaaacccgggctgaggaagccccagagaagaagaaggagaagcccaagtcacttagaactacggcacccagtcatgccaagttccgttctactggactggagctggacaccccatctttggtgcctgtgaagaagaactccagcactgtggttgtgtcagacaagtacaacctgaagcccatccccctcaagcggcagagtgccacagctgctccaggcgatgctgccccgcctgcagagaagaagtacaagcccctcaacacaacccccaataccaccaaagaaattaaagtgaagatcatccccccacagcccatggagggcctcggttttctggatgctctcaattccgcccctgtcccaggcatcaaaattaagaagaagaagaaggttctatcacctactgctgccaagcccagcccttttgaagggaaaacaagcactgagccaagcacagccaaaccttcctccccagagcctgcagcccccgctgagcccatggacacagaccgtcctggcacccctgtccccgctgtggaagtcccggagctcatggatgcagcctcttcggagccaggagctctggatgcaaagcctgtggaaagccctggagatcccaaccagctgactcgaaagggcagaaagagaaaaactgtgacgtggcctgaggagggcaagctgagggagtatttctacttcgaactggatgaaactgagcgagtgaatgtgaacaagatcaaggactttggggaggctgctaagcgtgagatactgtcggaccgacatgcttttgagacagcccggcgactaagccatgacaatatggaggagaaagtgccctgggtatgtcccaggcctctggttctgccctcacctcttgtcatccctggaagcaacagccaggagcgatacatccaggctgagcgggagaagggcatccttcaggagctcttcctgaacaaggagagtcctcacgagcctgatcctgagccgtatgaacccattcctcccaaactcatccccttggatgaggagtgcgccatggatgagactccgtatgttgagaccctggagcctggagggtctggtggctcacctgatggagcaggaggctccaagctgcctccagttctggccaatcttatggggagcatgggagcagggaagagcccccagggccctggaggcggtggcatcaatgttcaggagatcctcacttccataatgggcagtccaaacaaccacccttcagaggagctgctgaaacagccagactactcagacaagctgaagcagatgctggtgccacatgggctcctaggtcctggtcctgtagccaatggcttcccaccaggaggccctgggggccccaagggtatgcagcatttcccccctggtcctggagggcccatgccaggtccccatggaggccctggtggaccagtgggtccacgtctcctgggtcccccaccaccttctcggggaggtgatccattctgggatggcccaggtgaccccatgcgaggtggcccaatgcgtgggggtccaggacctggtcctggaccataccacagaggccgagggggtcgtggaggaaatgaaccgccaccaccccctccattccgaggagccagaggaggtcgttctggaggaggccccccaaatggccgagggggtcctggtggaggtggcatggttggaggtggtgggcaccgcccccatgaaggccctggagggagcatgggcagtggacatcggtctcatgagggccctggagggagcatgggcagtggacatcggtctcatgaaggccctggacacgggggaccccatggccaccggccacatgacgtccctagccatcgaggccacgaccatcgagggccaccacctcatgaacaccgcggtcatgatggccatgggggaggcggccaccgagggcatgatggaggccacagtcacggaggagacatgtcaaaccgccctgtctgccgacacttcatgatgaagggcaactgccgctatgagaacaactgtgccttctaccacccaggggtcaacgggcccccactgccctaggcctgcctgccctacccgcacccctgtggactgcagctttgctccttccacttggttatggcttctgtgaggcccactttccttttccccagctgatgaggagccggccccctcagttcccacctggttgggtttctgggggtttctgattcctggtgtgcattgatgtacatattccctccagtctggagcggagaggagagagactggactgctgagacggctggcttcactttgtgaggagatttgccctgtgccccaaaccccttccagtattagccccgatgcctgagaacctgaagccggccaccctggagacctctgctctccacatgcacacggaactgagttggtcagctgcacttaggaaaccgtccaagctaagctcattatcttcacagggtgagggggtggtgaggggtaccatatatcccactgcactgagggctcaagctggctgaagctgagttctggaactaccccccacttgtgccccacatgggccagtcactgttgagtcctttctcaagaaggactgcaactgttacttcccaggtcatcgtgggtctgctaggttcagtgatggcacattcatatctgtgtccagtggaagttgtatctggcagaggggtggcctgtagtgttgggccactcttgcctacagccattttcgagactccgtgaggccagctttcattaactttagccgggtataccgggcctgacgcactacatgcactgcctttgggagtgggctggctccttaccccgtaaggagccctgtcagtgaggcttcctgggtagactcagcaggaggggcccttcccagtcctctcctccccctgtcttggcatcagttgttttctatgaaaacagtgggttggttttgtgcagggtcttgggttagaaccaatggatttgaggagttttttcttttggttttgtatattttgtacattaataataaacagtggaaagagaagcagctcattt

SEQ ID NO: 1818 - DNA, 2752 bp, Rattus norvegicus
  Genbank Accession No. NM_022958
cttgtcatgggggaggcggagaagttccactacatctacagctgtgacctggacatcaacgtgcagctgaagatagggagcttggaagggaagagagaacaaaagagctacaaagctgtcctagaagatcccatgctaaagttttccggactataccaagagacatgctctgatctgtatgtgacttgtcaagtttttgctgaagggaagcccttggccttgccagtcagaacatcctacaaaccatttagtacacgatggaattggaacgagtggctgaaactcccggtgaaataccctgacctgcccaggaacgcccaagtggccttgactatatgggatgtgtatggacccggaagggctgtgccggtgggaggaacaaccgtgtcactctttggaaaatatggcatgtttcgccaaggaatgcacgacttgaaagtctggcctaacgtggaggcagatggctccgaacccacacgaaccccgggcagaacaagcagcacactctcagaagaccagatgagccgccttgccaagcttaccaaggctcatcggcagggacacatggtgaaggtggattggttggacagactaacgtttagagagatagaaatgataaatgagagtgagaaacgaagctctaatttcatgtacttgatggttgagtttcgctgtgtcaaatgcgatgacaaggaatatggtattgtctactatgaaaaggatggtgacgaatcatctccaattttaacaagctttgagttagtgaaagttcctgatcctcaaatgtctatggagaacttagtggagagcaaacaccacaagcttgctcggagtttaagaagtggaccatctgaccacgatctcaaacccaacgctaccacaagagatcagctaaatattattgtgagctacccaccaaccaagcagctcacatatgaagaacaagatcttgtttggaaatttagatattatcttactaatcaagaaaaggctctgacaaagttcttgaagtgtgttaactgggacctaccccaggaggccaagcaggcgctggaacttctgggaaagtggaagccaatggatgtggaggattccctagagctgctctcctctcattacaccaaccccaccgtgcggcggtacgctgtggcccgcttgaggcaggccgatgacgaggatttgctgatgtacttgctgcagctggtccaggctctgaaatatgaaaactttgatgacataaagaacggtttggagcctaccaagaaggatagtcaagcttccgtgtcagagagcctgtcaagttctggagtcagttctgcagatatagatagctctcaaattataaccaaccctcttcctccggtggcctcccctcctcctgcatctaaatcaaaggaagtttctgatggggaaaacctagagcaggatctttgtaccttcttgatatcaagagcctgtaagaactcaacactggctaactatttatactggtatgtgatagtggagtgcgaagatcaggacacacagcagagggacccaaagactcacgagatgtacctgaacgtcatgaggcgcttcagccaagccctgctcaagggtgacaagtccgtgcgggtcatgcgctccctgctggcggcacagcagacctttgtagatcgcctggtgcatctgatgaaggcagtgcagagagaaagtgggaaccgcaagaagaagaatgagagacttcaagccttgcttggagataatgaaaaaatgaacttatcagatgtggagctgatcccattgccgttagagccacaggtgaaaatacggggaatcatcccggaaacagccacactgttcaagagtgctcttatgcctgcccagctgttcttcaagacagaagacggtggcaaataccctgtgatcttcaagcatggggacgacttgcgtcaagatcagcttatccttcagatcatctccctcatggacaagctgttgcggaaagaaaatctggatttgaaattgaccccttacaaggtgttagccacgagtacaaaacatggcttcatgcagttcatccagtcagttcccgtcgccgaagttcttgacacggagggaagcattcagaactttttcaggaaatatgccccaagcgagactggacccaatggcatcagtgcagaggtcatggacacttacgttaagagctgtgctggctactgtgtgatcacctacatccttggggttggagaccggcacctggataaccttctgttaacaaagacaggcaaactcttccatatagatttcgggtatattctgggccgagatcccaagcctcttcctcctccaatgaagctgaataaggagatggtcgaagggatgggtggtacccagagtgagcagtaccaagagttcagaaagcagtgttacacggccttcctccacctgcgaaggtattcaaatctgattctgaacttgttctccttgatggttgatgcaaacattccagatattgctcttgaaccagataaaactgtaaaaaaggttcaggataagttccgtctggacctgtcagatgaggaggccgtgcattacatgcagagtctgatcgacgaaagtgttcacgccctgttcgctgcggtggtggagcagatccataagtttgcccagtactggagaaaatgaaagtggatttgacccatcgtgatgcctgacttagtaagaaaacacatgagaaaccactgctgtgtactgaggacattagaga

SEQ ID NO: 1819 - DNA, 864 bp, Rattus norvegicus
  Genbank Accession No. NM_023027
atggcggccagcctctggatgggagacctggaaccctacatggatgagaacttcatctctagagcctttgccaccatgggggagaccgtgatgagtgtcaaaattatccgaaaccgcctcactggaatcccagctggctactgctttgtggaattcgcagacttggccacagccgagaagtgtttgcataaaattaatgggaaaccccttccgggagccacacctgcaaaacgttttaaactgaattatgccacttacgggaaacagccagacaacagccctgagtactccctgtttgtgggggacctgaccccagacgtggacgatggcatgctgtatgagttctttgtcaaagtctacccctcctgccggggaggcaaggtggttttggaccagacaggcgtgtctaagggctatggctttgtgaaattcacagatgagttggagcagaagcgagccttgacggagtgccagggagcagtgggactggggtgcaagcctgtgcggctgagtgtggccatccccaaagcgagccgtgtaaagccagttgagtacagccagatgtacagttacagctacaaccagtattaccagcagtaccagaactactatgcccagtggggctatgaccagaacactggcagctacagctacagctaccctcagtatggctatacccagagcaccatgcagacatatgaagaggttggggatgatgcactggaagaccctgcgccacagctggatgtgactgaggccaacaaggagttcatggaacagagtgaggaactgtacgatgcactgatggactgtcactggcagcccctggataccgtgtcatcagagatccccgccatgatgtag

SEQ ID NO: 1820 - DNA, 1572 bp, Rattus norvegicus
  Genbank Accession No. NM_023102
ctctctctgcaagtgaccctgaggccaccaagatgagcacctcggccgggcctgtgagcgtacccgggtgtcaatagccgggagccaaggggccaccaggcgcaatggtgtactaggccgggcgcgagctcaggtttcgcactcggatctcacggcagagtcaccgtggagaggccagggtaccacaaacttatggattttgacaagaaaggagggaagggggagttggaggagggcaggagaatgtccaaaaccggcacgaatcggagcaaccacggcgtccgcaattcggggaccagctcaggggtcctgatggtgggccccaacttccgagtcggcaagaagataggctgtgggaatttcggggacgttcgcctaggaaagaacctgtatacaaatgagtacgtggctatcaaactggagcccatcaagtcccgggccccgcagctgcatctggagtaccgcttctacaagcagctcagcaccacaggtgtccctcaggtctactacttcggcccttgcgggaagtacaacgccatggtgctggagctgctggggcccagcctggaggacctgttcgacctgtgcgaccgcaccttcacgctaaagacggtgctgatgatcgccatccagctgatcacgcgcatggagtatgtgcataccaagagcctcatctaccgcgacgtgaagcctgagaacttcctggttgggcggccgggcagcaagcggcagcactccatccacatcatcgactttggcctggccaaggagtacatcgaccctgagaccaagaagcacatcccgtaccgcgagcacaagagcctgacgggcacggcgcgctacatgagcatcaacacgcacctgggcaaggagcagagccgccgggacgacctggaagcgctagggcacatgttcatgtacttcctacgcggcagtctgccctggcaggggctcaaggcggacacgctgaaggaacgctaccagaagattggtgataccaagcgtgccacgccaatcgaggtgctgtgtgagagcttcccggaggagatggccacctacttgcgctatgtgcggcgcctagacttctttgagaagccagactacgactacctgaggaagctcttcaccgacctcttcgaccgcagcggctacgtgtttgactacgagtatgactgggccggcaagcccctgccgacacctatcggcaccgtccatcctgatgtgccctcccagccgccacatcgtgacaaagctcagctccacaccaagaaccaggcgctgaactccaccaatggagagctgaacacagacgaccccaccgcgggccactccaacgcccccatcgcggcccctgcagaagtagaggtggcggatgaaaccaagtgctgctgcttcttcaagaggaggaagagaaaatcgctgcagcgacataagtgagggactttggcggaaatctctacacccgtgtctcgtcatccccttcgagagcattaactatttaaaaccaggagagaagccgtgcgccgtccctcgtgcgcccctgttagctctaaagtccagcttgtcccctca

SEQ ID NO: 1821 - DNA, 1408 bp, Rattus norvegicus
  Genbank Accession No. NM_024125
acgggaccgggacgcagcggagcccgcgggccccgcgttcatgcaccgcctgctggcctgggacgcagcatgcctcccgccgccgcccgccgcctttagacccatggaagtggccaacttctactacgagcccgactgcctggcctacggggccaaggcggcccgcgccgcgccgcgcgcccccgccgccgagccggccatcggcgagcacgagcgcgccatcgacttcagcccctacctggagccgctcgcgcccgccgccgcggacttcgccgcgcccgcgcccgcgcaccacgacttcctttccgacctcttcgccgacgactacggcgccaagccgagcaagaagccgtccgactacggttacgtgagcctcggccgcgcgggcgccaaggccgcaccgcccgcctgcttcccgccgccgcctcccgccgcactcaaggccgagccgggcttcgaacccgcggactgcaagcgcgcggacgacgcgcccgccatggcggccggcttcccgttcgccctgcgcgcctacctgggctaccaggcgacgccgagcggcagcagcggcagcctgtccacgtcgtcgtcgtccagcccgcccgggacgccgagccccgccgacgccaaggccgcgcccgccgcctgcttcgcggggccgccggccgcgcccgccaaggccaaggccaagaaggcggtggacaagctgagcgacgagtacaagatgcggcgcgagcgcaacaacatcgcggtgcgcaagagccgcgacaaggccaagatgcgcaacctggagacgcagcacaaggtgctggagctgacggcggagaacgagcggctgcagaagaaggtggagcagctgtcgcgagagctcagcacgctgcggaacttgttcaagcagctgcccgagccgctgctggcctcggcgggtcactgctagcccggcgggggtggcgtgggggcgccgcggccaccctgggcaccgtgcgccctgccccgcgcgctccgtccccgcgcgcgcccggggcaccgtgcgtgcaccgcgcgcacctgcacctgcaccgaggggacaccgtgggcaccgcgcgcacgcacctgcaccgcgcaccgggtttcgggacttgatgcaatccggatcaaacgtggctgagcgcgtgtggacacgggactgacgcaacacacgtgtaactgtcagccgggccctgagtaatcacttaaagatgttcctgcggggttgttgctgttgatgtttttgtttttgttttttgttttttgttttttttttggtcttattatttttttgtattatataaaaaagttctatttctatgagaaaagaggcgtatgtatattttgagaaccttttccgtttcgagcattaaagtgaagacattttaaaaaaaaacggcacgag

SEQ ID NO: 1822 - DNA, 711 bp, Rattus norvegicus
  Genbank Accession No. NM_024127
gggactcgcacttgcaatatgactttggaggaattctcggccgcagagcagaagatcgaaaggatggacacggtgggcgatgccctggaggaagtgctcagcaaggctcggagtcagcgcaccataactgtcggcgtgtacgaggcagccaagctgctcaacgtagacccggacaacgtggtcctgtgcctgctggctgcggatgaagatgacgaccgggacgtggctctgcagatccatttcaccctcattcgtgctttctgttgcgagaacgacatcaacatcctgcgggtcagcaacccgggtcggctggcagagctgttgctactggagaacgacaagagccccgctgagagcgggggcctggcgcagaccccggacttacactgtgtgctggtgacgaacccacattcatcacaatggaaggatcctgccttaagtcaacttatttgtttttgccgggaaagtcgctacatggatcagtgggtgccagtgattaatctccccgaacggtgattccccgaacggtgatggcatctgaatggaaataactgaaccaaattgcactgaagttttgaaatacctttgtagttactcaagcagtcactccccacgctgatgcaaggattacagaaactgatgtcaaggggctgagttcaactacaggagggctaggagatgactttgcagatggacagagaggtgaaaata

SEQ ID NO: 1823 - DNA, 628 bp, Rattus norvegicus
  Genbank Accession No. NM_024131
tgaattcctggaacctcaactggctcccactgctctctcggtgcagttaccgtttggcgatccctctcctgctaacatgccgttcgttgagttggaaacaaacttgccggctagccgcatacccgcagggctggagaaccggttgtgtgcggccacagccaccatcctggacaaacccgaagaccgcgtgagcgtgacgatacgaccgggcatgaccttgttgatgaacaaatccacagagccctgcgcccacctcctgatctcttccatcggtgttgtgggcaccgcggagcagaaccgcagccacagctccagcttcttcaagttcctcaccgaggagctgtccctggaccaggacaggatcattatccgattcttccccttggagccctggcagatcggaaagaaaggaactgttatgacgtttctgtgatggagacaaggaacgcagggcgtttgcttgagcctgtccagagcccttccagagaggcctcctggcagatacgataccagatccctcttttgcataagtgtctgtgatctcactgacctgttttcctctcccccagcctcgtgaacgagagagcaataaagaagagagcataatcccaaaaaaaaaaaaaaaaaa

SEQ ID NO: 1824 - DNA, 806 bp, Rattus norvegicus
  Genbank Accession No. NM_024134
gcttgaatctaatacgtcgatcataccatgttgaagatgagcgggtggcagcgacagagccaaaataacagccggaacctgaggagagagaaaccggtccaattacagtcatggcagctgagtctctgcctttcgcctttgagacagtgtccagctgggagctggaagcctggtatgaggatctgcaggaggtcctgtcctcagatgaaattgggggcacctatatctcatccccaggaaacgaagaggaagaatcaaaaaccttcactactcttgaccctgcatccctagcttggctgactgaggagccagggccagcagaggtcacaagcacctcccaaagccctcgctctccagattccagtcagagttctatggctcaggaagaagaagaggaagatcaaggaagaactaggaaacggaaacagagtggtcagtgcgcagcccgggctgggaaacagcgactgaaggagaaggagcaggagaatgagaggaaagtggcacagcttgctgaagagaacgagcggctcaacgaggaaatcgagcgcctgaccagggaggtagagaccacacggcgggctctgatcgaccgcatggtcagtctgcaccaagcatgaactgttggcatcacctcctgtctgtctctcccggagtgtacccagcaccatcacgccagtgccaagcatgtaatctccagtgcacatgctgaggaggggactgagggtagaccaaaggagaggggcttgtacactgtacattctttattcattccatacccagtaaagtgactttgtgtgaaaaaaaaa

SEQ ID NO: 1825 - DNA, 1786 bp, Rattus norvegicus
  Genbank Accession No. NM_024153
cggcgggttgctcttctcagccatggctcctcgctgctggcgctggtggagctggtccgcgtggcctggggttcggccgcttccctccaggagcactccgacccctggcttctgcaagaagttctccacacaggagacaacccctcagatctgtgtggtcggcagtggcccagctggcttctacacagcccaacacttgttgaagcaccacacccgggcccacgtagacatctatgagaagcagctcgtccccttcggcctggtgcgctttggtgtggcacctgaccatcctgaagtaaagaatgtcatcaacacatttacacagacagcccgctcagaccgctgtgccttccggggcaatgtggtggtgggcagggacgtgtccgttccagagcttcgggaagcctaccatgctgtggttctgagttatggagccgaggaccaccaacccctggaaattcctggcgaggagctgcctggagtggtctcagcccgggcctttgtgggctggtacaatgggcttcctgagaaccagaagctggctccggatctgagctgtgacacggctgtgattctggggcaagggaatgtggctctggatgtggcccggatcctgctgaccccacctgagcacctggagaaaacagacatcacagaggttgcactgggggtcctgaggcagagtcgggtgaagactgtgtggatagtgggtcggcgtggacccctgcaagtagccttcaccattaaggagcttcgggagatgattcagttgccaggaacccagcccattttggatccttcggatttcttgggcctccaggacagaattaaggatgtcccccgtccaaggaaacggctgacagagctgctgcttcggacagccacggagaagccaggagtggaagaggctgcccgccgggcactggcctctcgggcctggggcctccgctttttccgaagcccccagcaggtgctacccaccccagatggtcgacgggtagcaggcatccgcctggcagttaccagactggagggtgttggtgagtccacacgggcagtgcccacgggagatgtggaggacctcccttgtgggctgctgctgagcagtgttgggtataagagccgtcccatcgaccccagcgtgccctttgaccccaagcttggaatcatccccaacacagagggccgggttgtgaatgcaccaggcctctactgcagtggctgggtgaagaggggacccacaggtgtcatcaccacaaccatgacagacagcttcctcaccagccaggtgctgctgaaggacctgaaggccgggctgctgccctctggccccagacctggctatacagccattcaagccctgctcagtgatcgaggggtccggccagtctctttctcagattgggagaagttggatgctgaggaagtagctcgaggccagggcactgggaaaccaagggagaagctggtggatcgaagagagatgctgcagctgctggggcactgaacctgggccccagaccccaccgtacaagaagagctgtgctgggttggcagttgggttacagtgctgactgtcctggcttggaggccgacctgtggcctttccagggccctctgagctctgcctcagttaacctcccagtgtgggtttaggcccaggagggaacctgagctagggatggatggaggtacggacagaccctacccatcttgtttccttcctgtcggacgatggtaggcctctagactggaacacagtggaaataaaacagacgtgcctaag

SEQ ID NO: 1826 - DNA, 2739 bp, Rattus norvegicus
  Genbank Accession No. NM_024156
ggaattcccgtctatctgtctgccctgatccgaggcctccccagagcgtggtttctgctgcagaacctgagaccatggccaaaatagcacagggtgccatgtaccgaggctctgtccacgacttcgcagactttgatgcaaatcaggatgccgaggctttgtacacagccatgaagggcttcggcagtgacaaggagtccatattggagctgatcacctcccgcagcaacaagcagaggcaggagatctgccagagttacaagtccctctatggcaaggacctcatcgcagacttgaagtatgagttgacagggaagttcgagcgactgatagtgaacctgatgaggccgcttgcctattgtgacgccaaagagattaaagacgctatctcgggcattggcactgatgagaagtgcctcattgaaattttggcttcccggaccaatgagcagatacaccagctggtggccgcatacaaagatgcctatgagagagacctggagtctgacatcattggagacacttcaggccacttccagaagatgctggtggtactgctccagggaacccgggagaatgacgatgttgtgagtgaggacttggtccagcaggatgtccaggacctgtatgaggcaggggaattgaaatggggaacagatgaggcccagttcatctatatcttgggaaaccgtagcaaacagcacctacgattggtgtttgatgagtacctgaagaccacagggaagcccatcgaagccagtatcagaggggagctgtctggagactttgagaagctgatgttggccgtggtgaagtgcatccgaagtaccccggagtattttgctgaaaggctgttcaaagccatgaagggcctggggactcgagacaacactctgatccgtatcatggtctccaggagcgaactggatatgcttgacatccgggagatcttccggaccaagtatgagaagtcactctacagcatgatcaagaatgatacctctggtgaatacaagaaggctttgctgaagctatgtggaggggacgatgatgccgctggccagttcttcccggaggcagcacaggtggcctatcagatgtgggaacttagtgcagtgtcccgagtcgagctgaagggtaccgtgcgtgcggccaacgatttcaaccccgatgctgatgccaaaggcctgcggaaagccatgaagggaattggaaccgacgaagccaccatcatcgacatcatcacacagcgcagcaatgtccagcggcagcagatccggcagaccttcaaatctcactttggccgggatttaatggccgacctgaagtccgagatctcaggagacctggcaaggctgatcctggggctcatgatgccacctgcccattacgatgctaagcagctgaagaaagctatggagggagccggcacagatgaaaaggctcttatagaaatcctggccacccggaccaatgctgaaatccgagccatcaatgaggcctacaaggaggattatcacaagtccctggaggatgccctgagctcggacacatctggccacttcaaaaggatcctcatttctctggccacagggaatcgagaggaaggaggagaaaaccgggaccaggctcaggaagatgctcaggtggctgctgagatcttggaaatagcagacacacccagtggagacaaaacctccttggagactcgattcatgaccgtcctgtgcacccgtagctatccccacctgcgcagagtcttccaggagttcatcaagaaaaccaactatgacatagagcatgtcatcaagaaggagatgtctggggacgtcaaggacgcatttgtggccatcgttcagagtgtcaagaacaagcctctcttctttgctgacaaactgtacaagtccatgaagggtgccggcacggatgagaagaccctcaccagggtgatggtgtcccggagtgagatagacctgctcaacatccggagggaattcattgagaaatatgacaagtctccacaccaagccattgaaggtgacacctctggagacttcatgaaggctttgctggcgctctgtggtggagaagactaaaactcatggccttggagggtccccctgccatgcagtggccaaccgcaccagccaccgtgacctgaccaagccattgctccagcttcagagactaaggaagaagtgaggggtggagttggactgtgatccggctggggtgctctcttgccattgagggtcccaggcggtcccttctgttatccctcctgctcatggctaagtggctggtgaaccacagccatatatgcattcaaccctgctccccgtctgcctccttctccgcccaccctagcttccatccctccacacgaatccctgcctgatttaagctttgtcacatctctaaacacctccttggatggagccaccctgcccccagccctgaacagccgggggagggtagagagttcctcagagctggctcccagctgtgtccatcattggagtggcagcaggcaggtttcatacagtgctgtggactcgagaagccgttacactggactggaatggtggacagttgggtcacttactggaccccaatggagaaaagtgtgtcaccactcctcgccaagtctctgcttgtcttttccaataaattcggaaaagtggatcaagaataccttggcagggaataggggggcaaagtttagaacagagggaattc

SEQ ID NO: 1827 - DNA, 2021 bp, Rattus norvegicus
  Genbank Accession No. NM_024157
atgaagctcgctctgcttattctgctactcttgaatcctcacttgagttcttccaagaacacaccagcctcaggtcagcctcaggaggatctggtagagcagaaatgcttactgaaaaactacacgcatcactcctgtgacaaagtcttctgccagccatggcagaaatgtatcgagggaacctgtgcctgcaaactcccttaccagtgcccaaaggccgggaccccggtgtgcgccactaatggaagaggctacccgacatactgtcacctgaagagtttcgaatgtcttcacccggagataaagttctcgaataatggaacatgcacagctgaagaaaagtttaatgtttccttaatttatggaagcacagatacagagggaattgttcaagttaaactcgtggaccaagatgagaaaatgttcatatgtaaaaatagctggagcaccgtggaagccaacgtggcctgcttcgacctcggatttccactgggtgttcgtgacatacaaggaaggtttaatatacctgtaaatcacaaaataaactccaccgaatgcctgcatgtgcgttgccagggagtagagaccagtttggcagagtgtacctttaccaagaagagttcgaaggctccccatggcttggcaggtgtagtgtgctacacacaggatgcagatttcccaacaagtcagtccttccagtgtgtgaatgggaagcgcattcctcaggagaaagcctgtgatggtgtcaacgactgtggagatcaaagtgatgagctgtgttgcaaaggttgccgaggccaagccttcctttgcaagtcgggagtttgcatcccaaaccaacgtaagtgtaacggtgaggtggactgcatcaccggcgaggacgagagtggctgtgaagaagacaaaaagaataaaattcataaaggccttgcacggtcagaccaaggaggagaaactgaaattgagactgaagaaacagaaatgttgactcctgatatggacacagaaagaaaacggataaagtccttattacctaaactatcctgtggagtcaaaagaaatactcacattcgcaggaaaagagtggtcggagggaagccagccgagatgggagattacccatggcaggtggcgattaaggatggagatagaataacctgtgggggcatttatatcggtggctgttggattctgacagctgcacactgtgtcagacccagtagatatcgcaactaccaagtatggacgtctttattagactggctaaagcctaactctcagttggcagttcagggagtgagcagagttgtcgttcatgaaaagtataacggagccacctaccagaatgacatagctttggttgaaatgaaaaaacacccgggcaagaaagaatgtgagctcatcaattctgtccctgcctgtgtcccatggtctccatatctattccaaccgaatgacagatgcatcatttctggatggggtcgagaaaaagataaccaaaaagtctactcactcaggtggggcgaagtcgacctaataggcaactgctcgaggttttacccgggtcgctactatgaaaaagagatgcagtgtgcgggtaccagtgatgggtccattgatgcctgcaaaggagactctggaggccccttggtctgcaaggatgtcaacaatgtcacttatgtttggggcattgtgagctggggagaaaactgtgggaaaccagagttcccaggtgtttacaccagagtggccagctattttgattggattagctactacgtgggaagaccccttgtttctcaatacaatgtctgaagctacgacctccttctttctgcacttcttctttccagggttatactttaattgaaatgaaactgtataattagttctcctcgatgctggcaagaagcaagtcttactggctagttcctaaagtttcttcaaagtttatgccattttagaattctgtcatataatccccaataaatattccagttaagcacacaaaaaaaaaaaaa

SEQ ID NO: 1828 - DNA, 666 bp, Rattus norvegicus
  Genbank Accession No. NM_024162
ctcacgaccgacatcgacctcctttctcattgcaccatggcggacgcctttgtcggtacctggaagctagtggacagcaagaattttgatgactacatgaagtcactcggtgtgggctttgccaccagacaggtggctagcatgaccaagccgaccacaatcattgagaagaatggggataccatcaccataaagacacacagtaccttcaagaacacagagatcagctttcagctgggagtagagtttgacgaggtcacagcagatgacaggaaggtcaagtcggtcgtgacactggacggaggcaaactggtccatgtgcagaagtgggacgggcaggagactacgcttacacgggaactaagtgatgggaaactcatcctgactctcacccatggcaatgtggtgagcactcggacttacgagaaggaggcgtgacctggctgccccgtcactgactgctcctctgccaatggctacccctaactcagcaccacgttgcctcatgtttctcccctctgacgttttatataaatactctttggttgggcttttcctggagatatgggacaccagcctggacccaggtcccattgtgtatgtggtttattttttaaatgtatccaaagggtgctccaaggtcaataaagcagagccaaggccacc

SEQ ID NO: 1829 - DNA, 2073 bp, Rattus norvegicus
  Genbank Accession No. NM_024351
gtctctgtgtggtctcgtcatcagcacagctgggcctacacgcaagcaaccatgtctaagggacctgcggttggcattgatcttggcaccacctactcctgtgtgggtgtcttccagcatggaaaggtggaaataattgccaatgaccagggtaaccgcaccacgccgagctatgttgctttcaccgacacagaacgattaattggggatgcggccaagaatcaggttgcaatgaaccccaccaacacagtttttgatgccaaacgtctgatcggacgtaggttcgatgatgctgttgttcagtctgacatgaagcactggcccttcatggtggtgaacgatgcaggcaggcccaaggtccaagtcgaatacaaaggggagacaaaaagtttctatcctgaggaagtgtcttcaatggttctgacaaaaatgaaggaaattgcagaagcttaccttggaaagactgttaccaatgccgtggtcaccgtgccagcttacttcaatgactctcagcgacaggcaacaaaagatgctggaactattgctggcctcaacgtacttcgaattatcaatgagccaactgctgctgctattgcctatggcttagataagaaggtcggggctgaaaggaatgtgctcatttttgacttgggaggtggcacttttgatgtgtcaatcctcactatcgaggatggaatttttgaagtcaaatcaacagctggagacacccacttgggcggagaagactttgacaaccgaatggtcaaccatttcattgctgagtttaagcgaaagcacaagaaggacatcagtgagaacaagagagctgtcaggcgtctccgcactgcctgtgagcgggccaagcgcaccctctcctccagcacccaagccagtattgagattgattctctctatgagggaattgacttctacacctccattacccgtgctcgatttgaggagttgaatgctgacctgttccgtggcacactggaccctgtagagaaggcccttcgagatgccaaactagacaagtcacagatccatgatattgtcctggtgggtggttctaccagaatccccaagatccagaaacttctgcaagacttcttcaatggaaaagagctgaataagagcattaaccccgatgaagctgttgcctatggtgcagctgtccaggcagccattctatctggagacaagtctgagaatgttcaggatttgctgctcttggatgtcactcctctttcccttgggattgaaactgctggtggagtcatgactgtcctcatcaagcgcaataccaccattcccaccaagcagacccagactttcaccacctactctgacaaccagccaggtgtactcatccaggtgtatgaaggtgaaagggccatgaccaaggacaacaacctgcttgggaagtttgagctcacaggcatacctccagcaccccgtggggttcctcagattgaggttacttttgacattgatgccaatggcatcctcaatgtttctgctgtagataagagcacaggaaaggagaacaagatcaccatcaccaatgacaagggccgcttgagtaaggaggatattgagcgcatggtccaagaagctgagaagtacaaagctgaggatgagaagcagagagataaggtttcctctaagaactcgctggagtcttatgctttcaacatgaaagcaactgttgaggatgagaaacttcaaggcaagatcaatgatgaagacaaacagaagattcttgacaagtgcaacgaaatcatcagctggctggataagaaccagactgcggagaaggaagaatttgagcatcagcagaaagaactggagaaggtctgcaaccctatcatcaccaagctgtaccagagtgctggtggcatgcctggaggaatgcctggtggcttccctggtggaggagctcctccatctggtggtgcttcttcaggccccaccattgaagaggtcgattaagtcaaagtagagggtatagcattgttccacagggacccaaaacaagtaacatggaataataaaactatttaaattggcacc

SEQ ID NO: 1830 - DNA, 1453 bp, Rattus norvegicus
  Genbank Accession No. NM_024360
gacggtatcgatcgaaccccttcgataacagcggaatcccccgtctacctctctccttggtcctggaatagcgctaccgatcacaaagtagccctaagacataataaaccctcaactgctccgtagtttttcttatgaaagccaagtaaaggggacgtaagcaaaaaaatatttttttttgcgtgaaggattccaaaaataaaattctctggggattgagaagaaagaaaaaaaggaaaatgccagctgatataatggagaaaaattcctcgtccccggtggctgctaccccagccagtgtcaacacgacaccggacaaaccaaagacagcctctgagcacagaaagtcatcaaagcctatcatggagaagaggcgccgggcaagaataaatgaaagtttgagccaactgaaaacactgattttggatgcacttaagaaagatagctcccggcattccaagctggagaaggcagacattctggaaatgacagtgaagcacctccggaacctgcagcgggcgcagatgaccgccgctctcagcacagacccgagcgtgttggggaagtaccgcgccggcttcagcgagtgcatgaacgaggtgacccgcttcctgtccacgtgtgagggcgttaacaccgaggtgcgcactcggctgctgggccacctggccaactgcatgacccagatcaacgccatgacctaccccgggcaggcgcaccccgccttgcaggcgccgccgccgccgcccccgtcaggacctggcggtccccagcacgcgccattcgcgccgccgccgccgcttgtgcccatccccgggggcgcggcgccccctcccggcagcgcaccctgcaagttgggcagccaggctggagaggctgccaaggtttttggcggcttccaagtggtgccggctcctgacggccaatttgctttcctcatccccaatggggccttcgcccacagcggcccggtcatcccggtctacaccagcaacagcgggacctcggtgggtcctaacgcagtgtcgccttccagcggctcctcgctcactgcggactccatgtggaggccgtggcggaactgaggggctcaggccactgctaatcataaactccctagcccacctctctcttctgacggacactaaatacgaacttggactttaggagagacttttataagtcggtggttactttgttgcttttttaaattctaaaaagttactttttgtagagagctgtattaagtgactgaccatgcactgcatttgtatatattttatatgttcatattggattgcgcctttgtattataaaagttgagatgacatttcgttttttacacgagatttctttttttatgtgatgccaaagatgtttgaaaaatgctcttaaaatatcttcctttggggaagtttatttgagaaaatataataaaagagtgaaggctttt

SEQ ID NO: 1831 - DNA, 1201 bp, Rattus norvegicus
  Genbank Accession No. NM_024363
agatggcggcagccgaggccgcgaactgcatcatggaggtttcctgtggccaagcagaaagtagtgagaagcccaatgctgaggacatgacatccaaagactactactttgactcctatgcccactttggcatccacgaggagatgctaaaggatgaggtgcgaaccctcacgtaccgcaactccatgtttcacaatcggcatctcttcaaagacaaggtggtgctggatgtgggctcgggcactggcatcctctgcatgttcgctgccaaggcaggggcccgcaaggtcattgggatcgagtgctccagtatctctgattatgctgtgaagattgtcaaagccaataagttagaccacgtggtgaccatcatcaagggcaaggtggaggaggtggagctgcctgtggagaaggtggacatcatcatcagcgagtggatgggttattgcctcttctatgagtccatgctcaacactgtgctgcacgctcgtgacaagtggctggcacctgatggcctcatcttcccagaccgagccaccctgtatgtgacagccattgaggaccgacagtataaagactacaagatccactggtgggagaatgtatatggctttgatatgtcctgcattaaagacgtggccatcaaggagcccctggtggacgtggtggacccaaagcagctggtcaccaacgcctgcctcataaaggaggtggacatctacacagtcaaggtggaggacctgaccttcacctccccgttttgtctgcaagtgaagaggaatgactatgtgcatgcactagtggcctacttcaacatcgagttcacccgatgccacaagaggaccggcttctctaccagtcctgagtctccatacacacattggaagcagactgtgttctacatggaggactacctaacagtgaagaccggcgaggagatttttggcactattggaatgaggcccaacgccaaaaacaatcgtgacttggactttaccatcgacctggacttcaagggtcagctgtgtgagctctcttgttccaccgactaccggatgcgctgaggaggtgccaggctggccctcctgcaaaagggggctcaggggctgggcttgggggatgggagggtacatcgtggcagtgtttttcataacttatgtttttatatggttgcgtttatgccaataaatcctcagctgac

SEQ ID NO: 1832 - DNA, 1390 bp, Rattus norvegicus
  Genbank Accession No. NM_024386
gagactccgggcgaagatggcgacagtgaggaaggctttcccacagaggctggtgggcttggcgtccctccgggctgcgagcacctcctccatgggcaccttgccgaagcgggtgaagatcgtggaagtcggcccccgagatggtctgcagaatgaaaagagtatcgtgccgacgccagtgaaaatcaaactgatagacatgctatccgaagcagggctcccggtcatcgaggccaccagctttgtctctcccaagtgggtgccgcagatggctgaccactctgacgtcttgaagggcattcagaagtttcccggcatcaactacccggtcctgacaccaaacatgaaaggctttgaggaagcggtagctgcaggtgccaaggaagtgagcatctttggggctgcgtccgagctcttcacccggaagaatgtgaactgctctatagaggagagtttccagcgctttgatggggtcatgcaggccgcgagggctgccagcatctctgtgagagggtatgtctcctgtgccctcggatgtccctacgaggggaaggtctccccggctaaagttgctgaggtcgccaagaagttgtactcaatgggctgctatgagatctcccttggggacaccattggcgtaggcacgccaggactcatgaaagacatgctgactgctgtcctgcatgaagtgcctgtggccgcattggctgtccactgccatgacacctatggccaagctctggccaacacgttggtggccctgcagatgggagtgagcgttgtggactcctcggtggcaggactcggaggctgtccctatgcaaagggggcgtcaggaaacttggctaccgaggacctggtctacatgctgactggcttagggattcacacgggtgtgaacctccagaagctcctagaagccggggacttcatctgtcaagccctgaacagaaaaaccagttccaaagtggcacaggccacctgcaaactctgagccccttgttcacctaaaccggaactgtgggagttgggtgtacacaatgattcctggatggggaaatggaatgaaggcaaatgagccggcctcacagaggtccctctcctacatagaagggctagagctgccagcacgcccggaccagctccccagagctgcgtgcctaagcactgcttggctggccctgggtgagtccactagccagcagagctgacatccatgtgccacgaccgcgggtcccatgttctacctctgaggacagcagcgcctttgctgaaatggtgggctcaatctactgcggtggccgactgccaactccagcgtctctgggaaatctctgtacgtgattcttgaaaacagcttatgtaattaaaggtttaattttctaatatc

SEQ ID NO: 1833 - DNA, 1815 bp, Rattus norvegicus
  Genbank Accession No. NM_024387
ataagtctggctatttctctccaggcacggagtgttggggtgtgccatctcccctttgggaccaccttgggttgccctcttagcaaagttggccttaccaaggagcagtcatcttggattatataatttgaatgagccaaggaccgaagtgagggcagcacaaacaactcagcaacaatgtcttcagaggtggagacctcggagggcgtcgatgagtcagagaacaactctacggcaccagaaaaggaaaaccataccaaaatggcagacctttctgagctcctgaaggaagggaccaaggaagcacatgaccgggcagaaaatacccagtttgtcaaagacttcttgaaaggaaacattaagaaggagctatttaagctggccaccactgcactttacttcacatactcagcccttgaggaggaaatggatcgcaacaaggaccacccagccttcgcccccttatatttccccacggaactacaccggaaggaagcactgatcaaggacatggagtatttctttggtgaaaactgggaggagcaggtgaagtgctccgaggctgcccagaagtatgtggatcggattcactacgtaggacagaatgagccagagctgctggtggcccatgcttacactcgttacatgggggacctttcgggaggccaggtgctgaagaaggtggctcagcgggcactaaaactccccagcactggggaagggacccagttctacctgttcgagcatgtggacaatgcccagcaattcaagcagttctaccgcgccaggatgaatgccttggacctgagtatgaagaccaaagagaggattgtggaggaggccaacaaagcctttgaatataatatgcagatattcagtgaactggaccaggctggctccatgctaacaaaagaaaccctggaggatgggctcccagtacatgatgggaaaggagatgtacgtaaatgccccttttatgctgctcagccagacaaaggtaccctgggaggcagcaactgccccttccggacagccatggctgtgctgaggaagcctagcctgcagctcattctggctgccagtgtggccttggtagctggactcttggcctggtactacatgtgaaggacctgtcatgttgtttgcatcctatcccaagtgacctcttccatccccatctccacctctgcccaaaactaccacctcaggtgacttttctaatgctgggtttgagaaaacaagcaaccaataaaagccagacactagcacctctgcctgccagcatcttctctgccaaccaggtacataccagacagcggctgtcgctctgttaacagccagtgcccgactgcagttcagtcatggacttctcatctggcagtgctccaggacgtttgccatttgggaggcctgggtacactgttttcttagcagtacttggaatagtcattgccatgctgggagtgagctgcccacacccaggttttgtggaaaacggtcatgccagctgatgggtcagttttccaggccttttggagtagaagctgtgtattcctgcctcaaagcctacagagcttatcctgcataaccaggatctccccaagaagtcttgttagcctggtctgtctccactgactacacctgccacagcactctaaaaacaaactccacacactcccctccttcctgggacagtacagagtcctcagaaacagtggcatgttgcataccaatggacatcctctttgatgacactccttgcccacttcctagcaccttctatttccttgtattcatgctaaacaccataaaaga

SEQ ID NO: 1834 - DNA, 2488 bp, Rattus norvegicus
  Genbank Accession No. NM_024388
gcgaaagttggggtagtgtgcgagaaggattgcagagcgcacgcggaaccagactgcgactgggtcctgggtcgctggtcccggccacggggagcgggagccggccggagatgccctgtatccaagctcaatatggaacaccagcaaccagcccaggaccgcgtgaccacctgacaggtgaccccctggcccttgagttcagcaagcccaccatggacctggccagccccgagacggcgcccaccgcacctgccaccctgcccagtttcagcaccttcatggacggcggatacaccggagagtttgacaccttcctataccagctgccggggacagcccagccgtgctcctcggcctcctccacatcttcttcctcgtcctcggccacctctcccgcgtcggcttcctttaagtttgaggactttcaggtgtatggctgctaccctggcaccctgagcggcccattagacgagaccctgtcctccagtggctctgattactatggaagcccctgctcagccccgtcaccacctacacccaacttccagccatcccagctctccccttgggatggttcatttggccacttctcccccagccagacttatgaaggccttcgggtatggactgagcagttgcccaaggcttccgggcctccgccacctccaaccttcttctccttcagtcctcccaccggtcccagccccagcctggcccagagttccctgaagttgttcccagcaccagccacccaccagctaggggagggggagagctattccgtgccagccgctttcccgggcttggcacccacctctccgaactgtgacacttccggcattctggacgcacccgtaacctccaccaaggcccgcagtgggtcttcagggggcagtgagggccgctgtgctgtctgtggagacaacgcttcgtgccagcattatggggtccgcacctgtgagggctgcaaaggcttcttcaagcgcacagtacagaaaagtgccaagtacatctgcctggcaaacaaggactgccctgtggacaagaggcggcggaaccgctgccagttctgtcgcttccagaagtgcctggctgtgggcatggtgaaggaagttgtccggacagacagcctaaaggggcggcggggccggctaccttcaaaacccaagcagcccccagatgcctcccctaccaatctcctcacgtccctcattcgagcacatttggactccgggcctaacactgccaagttggactattccaagttccaggaactggtgctgccccgctttggaaaggaagatgccggtgacgtgcagcaattttatgacttgctctctggctccctggacgtcatccggaagtgggcggaaaagatcccgggcttcattgagctttccccaggagaccaagacctgttgctagagtccgcctttctggagctctttatcctccgcctggcctaccgatctaagcccggtgaggggaagctcatcttctgctcaggcctggtgctacaccggctgcagtgtgcccgcggctttggtgactggatagacaacattctagccttctcacggtccctgcacagcttgggtgttgatgttcctgcctttgcctgcctgtctgctctggtcctcatcactgatcgacatggcctccaggaccctcggcgggtggaggagctgcagaaccgcattgctagctgtctgaaggaacacatggccgccgtggcaggagacccacagccggccagctgcctgtcacgtctgctgggcaaactgcctgagctccggactctgtgcacccaaggcctacagcgcatcttttgcctcaagctggaggacttggtgccccctccacctatcgtggacaagatctttatggacaccttgtctttctgaccctgccccgaacacgcgtgcacactcacgtgcatgttcttcttgtcacccacgtgcctttaagcccatagcccacggacccccagaccaccccaccccccagcctgttttttgagctaagactgatgtatctcctcattccagaagatggacagagagagagagagagctcaagacctgggggggagggtgtgtattcacgggggtgaccccactatttctcttatccctcccagctcagacctggccttccgcgtgtttttgtaagataaaccatttttaacacataccactctgctgtatataagctgacgctgctgtaaatacagaaaggaagaggtcggggtgggggtttgagaggaagggtgggccccccaaccccgccagctgggcaagcctctcgagcctccaacttgagatctcttccgctctccttccatgtgtacatagctgtcactcaagaaggtgattgacagattctgatttatatttgtgtatttttttcctggatttataggatgtgactttttctgattaatatatttaatatattaaataaaaactagacatgtagctgaaaaaaa

SEQ ID NO: 1835 - DNA, 1289 bp, Rattus norvegicus
  Genbank Accession No. NM_024391
cgcggccgcttctcactggcccagagcaagtgaagaccagtggagaatgaacccgttttcctctgagtcagcatggctctgcttgactgccactgcggtgctggggggcatgcttctctgcaaagcctggagttcagggcagctaaggagccaggtggtgtgtctggctggcctctggggaggtgcctgcctgctcagcctgtccctcctctgcagcttgttcctcttatcggtgtcctgcttcttccttctgtatgtgagttcatctgaccaagacttgttacctgtggatcaaaaggctgtgctggtgacaggtgccgattccggtttcggtcatgctttggccaagcacctggacaagctgggtttcacagtgtttgctggagtgctggataaagagggcccaggagcggaggaattgaggaaaaactgctctgagcgcctttcggtgctccagatggatgtcaccaagccagagcagataaaagatgttcacagcgaagtcgcagagaagatacaagacaaaggactgtgggctgtggtcaacaatgctggggtcttgcactttccgatcgacggggaactcattcccatgaccgtgtacagaaaatgcatggcagtgaacttcttcggagccgtcgaggtcaccaaggtgtttctgcctctacttagaaagtccaaggggaggctggttaacgtcagcagcatgggagccatgattccatttcagatggtggccgcctacgcctccacgaaggcagctataagcatgttctcagccgtcatcaggcaagagcttgccaaatggggagtcaaagtcgtgaccatccatcctggaggcttccaaacaaacatcgtaggctcacaggacagttgggataaaatggagaaggagatcctggaccacttttccaaagagattcaggagaactatggacaggaatatgtccatacgcagaagctcgccctcccggtcatgagagagatgtccaacccggatatcacccctgtgctgcgggacatccagcacgccatttgtgccaagaacccctcttccttttattgctcagggagaatgacttacctgtggatctgcttcgcggcctactccccgatcagcttattggactatattttgaaaaactattttactccaaaactcatgccaagagctttaaggacagcaagttagaagaacaagggcccgggtagggtgggaaatgccacatgcttaggatgaaagggaaacctcttattaaactaactttctacctcaaaaaaaaaaaaaa

SEQ ID NO: 1836 - DNA, 2535 bp, Rattus norvegicus
  Genbank Accession No. NM_024392
gagcagtaccccggccactgccagtgtgtgcgtggtgcaggatagactcatggcttcgcctctgaggttcgacgggcgtgtggtcctggtcaccggcgccgggggagggttgggcagagcttatgccctggcttttgcagaaagaggagcattagttgttgtgaatgacttaggaggggacttcaaaggcgttgggaaaggctcttctgccgcagacaaggtcgtggaagaaataagaaggagaggcgggaaagcggtggccaattacgattcaggcgaagcaggcgagaagcttgtgaagacagcactggacacattcggcagaatagatgttgtggtgaacaatgctgggatcctgagggaccgttccttctctaggataagtgatgaagactgggatataattcaaagagttcatttgcggggctccttccaagtgacccgggcagcatgggatcatatgaagaagcagaattatggaagaatcattatgacggcctcagcttctggaatatacagcaactttggccaggcaaattatagtgctgcaaagctgggccttctgggtctcgccaatactctcgtgattgaaggcaggaagaacaacattcattgtaacaccattgccccaaacgctgggtcacggatgacagagacggtgatgccagaagacctcgttgaagccctgaagccagagtatgtggcaccgctggtcctttggctttgccatgagagctgtgaggaaaatggtggcttgtttgaggttggagcaggatggattggaaaattgcgctgggagaggaccctgggagccattgtcaggaagcggaatcagcccatgactcccgaggcagtgagggacaactgggtgaagatctgtgacttcagcaatgccagcaagccgaagagcattcaagagtccacaggtggtataatcgaagttttacataaaatagattcagaaggaatctcacaaaatcacaccggtcaagtggcatctgcagatgcatcaggatttgctggcgtcgttggccacaaacttccttcattttcttcttcatatacggaactgcagtgcattatgtatgccctcggagtaggagcttcagtcaaaaatccaaaggacttgaagtttgtttatgaagggagtgctgacttctcctgtttgcctacatttggagtcattgtcgctcagaagtccttgacgagtggaggcttagcagaggttcctgggctgtcaatcaactttgcaaaggttcttcatggggagcagtacttggagttgtataagccacttccccgatcaggggaattaaaatgtgaagcagttattgctgacatcctggataaaggctctggcatagtgattgttatggacgtctattcttattctggcaaggaacttatatgctataatcagttctctgtcttcgttgttggctctggaggctttggtggaaaacggacatcagaaaaactcaaagcagctgtagccgtaccggatcggcctccagatgctgtactgagagataccacttcactgaatcaggccgctctgtaccgcctcagtggagactcgaatcctttacacattgacccgagctttgcgagcattgccggttttgagaaacccatattacacggattatgtacttttgggttttctgcaaggcatgttttacagcagtttgcggataatgatgtgtcaagattcaaggccattaaggttcgttttgccaaaccagtgtatccaggacaaactctacaaactgagatgtggaaggaaggaaacagaattcattttcaaaccaaggtccaagagactggagacattgtcatttccaatgcatatgtggatcttgttcctacatctggagtttccgctcagacaccttctgagggtggagcactgcagagtgctcttgtatttggggaaataggtcgacgcctcaaggatgttggacgtgaggtggtaaagaaagtaaatgctgtatttgaatggcatatcacgaaaaatgggaatgttgcagccaagtggaccattgacctgaagaacggctctggagaggtttaccaaggccctgccaaaggctctgctgacacgaccatcacaatttctgatgaggatttcatggaagtggtcctgggcaagcttaacccacagaatgccttcttcagtggcagactgaaggcccgaggaaacatcatgctgagccagaagctacagatgattctgaaagactatgccaagctctgaaggacccactgcgtgctttaataaaaccagaatcattacgttctgtctacgcagtcatgctccagccttctttgaaacgatccacggtaatgtgcagcagaaatcgcttaacattttcagattcagataactttcagattttcattttctactaatttttcacatattatttttataaggaactgtaatctagctagcaaataattgttctgttcatagatctgtatcttaataaaaaaaaagtcaaccgaaaaaaaaaaaaaaaaaaaaaaaaaaaa

SEQ ID NO: 1837 - DNA, 8040 bp, Rattus norvegicus
  Genbank Accession No. NM_024396
agcggggcccggcagggcgcgcagagaagagggccgcggcgctgaggcggcggagcgcggcccggccatgggcttcctgcaccagctgcagctgctgctctggaagaacgtgacgctgaagcgccggagcccgtgggtcctggcgtttgagatcttcatcccccttgtcctcttcttcatcctgttgggactgcggcagaagaagcccaccatctctgtgaaggaagctttctacacggcagcaccgctgacatcggccggcatcctgcctgtcatgcagtcgctttgccctgatggccagcgtgatgagtttggcttcctgcagtatgccaactccacggtcacccagcttctggaacgcctcaaccgtgtagtggaagagagcaacttgtttgacccagagcgacctagcctgggctcagagcttgaggcactgcaccaacgtctggaggccctcagctcgggccctggcacctgggagagccactcagctagacctgcagtttcatccttctctctggactcggtggccagggacaaaagagagctttggcgtttcctgatgcagaacctgtcactgcccaacagcacggcccaggccctcctggctgcccgtgtagacccttctgaggtctatcgcttgctttttggtcctttacctgacctggatggaaagttggggttcctcaggaagcaggagccctggagtcacctgggtagcaatcctctgttccaaatggaggagctgctgctggctcctgcccttttggagcaactcacatgtgctccaggctctggggagctgggccggattcttaccatgcctgagggtcatcaggtagaccttcagggctaccgggatgctgtctgcagcgggcaggctacagctcgtgcccagcatttcagtgatctagccactgagctccggaaccagctggacatagccaagattgcccagcagctgggcttcaatgtccccaacggctcagatccacagccgcaggcaccgtccccacagagtctgcaggcactcttaggggacctgctggatgtccagaaggttctacaggatgtggatgtcctatcagcccttgccctgctgctgcctcaaggtgcctgtgctggccgggcccccgcacctcaagctggcagcccgagtggcccggccaacagcaccggggtaggggcaaatacaggtcccaacaccaccgttgaggagggcacccagtcacctgtcaccccagcctctccggacactctgcaaggccagtgctcagcctttgtgcagctctgggctggcttgcagcccatcttgtgtggcaacaaccgtaccattgagcctgaagcactccggaggggcaacatgagctcactgggctttacgagcaaagaacaacggaacctgggccttcttgtgcacctcatgaccagcaaccccaaaatcctgtatgcacccgcaggctctgaagctgaccatgttatcctcaaggcaaatgagacctttgcctttgtgggcaacgtgacgcactacgcccaggtctggctcaacatctccgcagagatccggagcttcctggagcagggcaggctgcagcagcatctgcactggctgcagcagtacgtggctgacctccggctacaccctgaagcaatgaacctgtcactggacgagctgccccctgctctgcgcctggactacttttctctgcccaatggcacagcccttctgcagcagctagacacaatagacaatgcagcctgtggctggatccagttcatgtccaaggtgagtgtggacatcttcaaggggtttcctgatgaggagagcatcgtgaactacactctcaatcaggcctaccaggacaatgttacagtatttgccagcgtgattttccagacacggaaggatggttccctccccccacatgtccattacaagattcgccagaactcaagcttcaccgagaaaaccaacgagatccgtcgtgcttactggcgtccagggcccaacactggtggccgcttctacttcctctacggcttcgtctggatccaggacatgatagaacgtgccatcatcaacacgtttgtggggcacgacgtggtcgaacccggcaactacgtgcagatgttcccgtacccctgctacacccgtgacgacttcctgtttgtcattgagcacatgatgccactgtgcatggtgatctcctgggtttactctgtggccatgaccatacagcacatcgtggcggagaaagagcatcggctaaaggaggtgatgaagacgatgggcctgaacaacgccgtgcactgggtggcctggttcatcacgggctttgtgcagctgtccatctccgtgacagccctgaccgccatcctcaagtatggccaggtcctcatgcacagccacgtgctcatcatatggctcttccttgctgtctatgctgtggccactatcatgttctgcttcctggtgtctgtgctgtactctaaggccaagttggcctcggcctgcggcggcatcatctacttcctgagctacgttccctacatgtatgtagcaatccgtgaggaagtagcccacgataagatcactgccttcgagaagtgcattgcgtccctgatgtccacaacagccttcggcctgggttccaagtactttgctctgtatgaagtggcaggtgtgggcatccagtggcacacgttcagccagtccccagtggaaggggatgacttcaacctgctccttgctgtcaccatgctgatggtggacacagtggtctatggcgtactcacttggtacattgaggctgtgcacccaggtatgtatgggctgccccggccctggtacttcccactacagaagtcctattggctgggcagtgggcggacagagacctgggagtggagctggccatgggcacacgcaccacgcctcagcgttatggaggaggaccaggcctgtgccatggagagccggcacttcgaggagactcgcggtatggaggaggagcccacccacctgcctttggtcgtctgcgtggacaagctcaccaaggtctataaaaatgacaagaagctggccttaaacaaactgagcctcaatctctacgagaaccaggtggtctctttcctaggccataacggggctggcaagaccactaccatgtctatcctgactggactgttcccacccacgtcgggctcagccactatctatggccacgacatccgcacagagatggatgagatccgtaagaacctgggcatgtgcccacagcacaacgtgctctttgaccagctcactgtggaggaacacctctggttctactcacgcctcaaaagcatggcacaagaggagatccgcaaagagatggacaagatgatcgaggacctggagctctccaacaagcgccactcgctggtacagacgctgtctggaggcatgaagcgcaagctttcagtagccattgccttcgtgggtggctctagagccattatcttagatgagcccacagctggcgtggacccctatgctcgacgtgccatctgggacctcattctgaagtacaagccgggtcgcactatcctcctgtccacccatcacatggatgaggccgacctgctgggggaccgcattgccatcatctcccatgggaagctcaaatgctgcggctctcccctcttcctcaagggtgcctacggcgatggctaccgcctcacactggtcaagcggcctgcggagcctggcacctcccaagagccagggatggcttccagcccctcaggtcgtcctcagctgagcaactgctcagagatgcaagtgtcccagttcatccgcaagcatgtggcttcctccctgctggtgtcagacacgagcaccgagctctcctacatcctgcccagcgaggctgtcaagaaaggggccttcgagcgcctctttcagcaattggagcacagcctggacgcactgcatctgagcagttttgggctgatggacacaaccctggaggaggtgttcctcaaggtgtctgaagaagaccagtcactggagaatagtgaggccgatgtgaaggagtcccggaaggatgcactgcctggggcagagggcctgacggctgtggagagtcaagcaggcaacctggctcggtgctcagagctggcacagtcccaggcttcactgcagtctgcatcttctgtgggctccgcccgtggggatgagggtgctggctacaccgacggctacggtgactaccgtcccctctttgacaacttgcaggacccagacagtgtcagcttacaagaggctgaaatggaggccctggctcgggtaggccagggcagccgcaagctagagggctggtggctgaagatgcggcagttccatgggctcctggtgaagcgcttccactgtgctcgccggaactccaaagcgctctgctcccagattctgctgcctgccttcttcgtctgtgtggccatgactgtggcattgtctgtccctgagatcggtgacctgcctccactggtcctgtcgccttctcagtaccacaactatacccagccccgtggcaactttatcccctatgccaatgaggaacgccgcgagtaccgattacggctgtcacctgatgccagcccccagcagttggtgagcacattccggctgccctctggtgtgggtgccacttgtgtgctcaagtctccagccaacggctccctggggcccatgctgaacttgagcagtggagagtcccgcctgctggccgcacggttcttcgacagtatgtgcctggagtccttcacacaggggctgccactgtccaacttcgtgccacccccaccctcgcccgccccttccgactcacccctgtccccggatgaggattcactgctagcctggaatacgtccctgccccctactgctggaccagagacgtggacgtgggcgccttctctgccacgcctggttcacgagccggtccgctgtacctgctctgcacagggcacgggcttctcgtgccccagcagtgtgggtgggcacccaccccagatgagagtggtcacgggggacatcctgactgacatcaccggccacaatgtttccgagtacctgctcttcacctctgaccgtttccgactgcaccgctatggagccatcacctttggtaatatccagaagtccatcccagcacccattggtacccggacccctctcatggtccggaagattgcagtgcggagggtggcccaggtgctctacaacaacaagggctaccacagcatgcccacctacctcaacagcctcaacaatgccattctgcgtgcaaacctacccaaaagcaagggcaatccagcagcctacggtatcaccgtcaccaaccaccccatgaacaagaccagtgctagcctctccctggattacctactgcagggcacagacgtggtcatcgccatcttcatcattgtggccatgtccttcgtgccggccagcttcgtggtcttccttgtggccgagaaatccaccaaggccaaacacctgcagttcgtcagcgggtgcaaccctgtcatctactggctagccaactacgtgtgggacatgctcaattacctggtcccggccacctgctgcatcatcatcctcttcgtgtttgacttgccggcctacacgtcacccaccaacttccccgcggtgctctccttgttcctgctctatggatggtccatcacacccatcatgtacccggcctccttctggtttgaggtccctagctcagcctacgtgttcctcatcgtcatcaacctcttcattggcatcacggccacagtggccaccttccttctgcagctctttgagcatgacaaggatctgaaggttgtcaacagttacctgaaaagctgcttcctcatcttccccaactacaacctgggccacggactcatggagatagcctacaacgaatacatcaacgaatactatgccaagatcggccagtttgacaagatgaagtccccgtttgagtgggacattgtcacacgtggactggtggccatgacagtcgagggcttcgtgggattctttctcaccatcatgtgtcaatataacttcctacggcagccacagcgtctgcctgtgtctactaaacctgtggaagacgatgtagacgtggccagtgagcggcaaagagtgctccgtggcgatgctgacaatgacatggtcaagatcgagaacctgactaaggtgtacaagtctcggaagatcggccgcatcctggcagtggaccgcctttgcctgggtgtgcgccccggagagtgctttgggctcctcggggtcaatggtgccgggaagaccagcaccttcaagatgttgactggagatgagagcacaacagggggcgaggcctttgtcaatggacacagtgtgctcaaggacctgctccaggttcagcagagccttggctactgcccacagttcgacgccctgttcgatgagctcacggctcgcgaacacctgcagctgtatactcggcttcgaggcatcccctggaaggatgaggcgcaggtggtgaggtgggccctggagaagctggagctgacgaagtgtgcagacaagccagccggtagctacagtgggggcaacaaacggaaactttccacagccatcgctctcattgggtaccctgccttcatctttctagacgagcccaccactggcatggaccctaaggcccggcgcttcctgtggaacctcattctggacctcatcaagacaggacgttcagtggtgctgacctcacacagcatggaggaatgcgaggctgtgtgcacacggctggccatcatggtgaatggacggctgcgctgcctggggagtatccagcacctcaagaacaggtttggggacggctacatgatcactgtaaggaccaaaagcagccagaacgtgaaggatgtggtgcggttcttcaaccggaacttcccagaggccatgctcaaggaacgccaccatacgaaggtgcagtatcagctcaagtcggagcacatctcgctggctcaggtgttcagcaagatggagcacgtggtcggtgtactgggcatcgaggactactcagtcagccagaccactctggataacgtgtttgtgaacttcgccaagaagcaaagtgacaatgtggagcagcaagaggctgagccatccaccttgccgtccccccttggactacttagcctgctgcggccccgccctgcacccacagagctccgggcactggtggccgatgagcctgaggacctggacacggaggacgagggcctcatcagcttcgaggaagagcgggcccagctctccttcaacaccgatacgctctgctgacgttcaagagtcacatcagggatgcagctgtttggggcagaagtcaggcggtggccgtagccccagtcacacatgccaggccctggaaaggcaggttcaggaccaaagggctcccgccctcctcccaactaccatcctccccgatcgtgccaaaggctgggctggccctgggctgcacacaccctcaccctgctttgccttaaagccttgggtcctggcccagccccttaccctgcccagcaccatccaccttcccagggtgacatgggctgccccaagtatcctgtgacccttctctgcagcggccaccagtctacccaggccagcatcttgcacagatgtctttcatgaaaagactgcagttggggaggtggcagcttgcctacttattttgctttaagagcctccctcactctgctgttgtgaagaagttaggctaccatgggaagccatgaatgtggctgcctcagccctggtggaatggcaggaacggagaagctgggcttgctggctaggtgaggggccactgctccctccctgccccctcaagctgcctttgctctcccgctcagcttggcccttcctgccacccatgtgggagtaggaccttgtatatagcacacagatgtttgttttcaataaataagcaaaaaggaaaaaaaaaaaaa

SEQ ID NO: 1838 - DNA, 2744 bp, Rattus norvegicus
  Genbank Accession No. NM_024398
acaaaatggcgccttacagcctactggtcacccggctgcagaaggccctgggtgtgcggcagtaccatgtggcctctgccctgtgccaacgggccaaggtggccatgagccactttgagcccagtgagtacatccgatatgacctgctagagaagaacattaacattgtccgtaaacggttgaaccggcctcttactctctcggagaagattgtgtatggacacctggatgacccagccaaccaggagatcgagcggggaaagacatacctgcgtttacggcccgaccgggtggccatgcaggatgcaacagcccagatggctatgctacagtttattagcagtgggctgcccaaggtggctgtgccatcaaccatccactgtgatcatctgattgaggcccagcttgggggtgagaaagacctacgccgggccaaggacataaaccaggaagtatataatttcctggcaactgccggtgccaagtatggtgtgggcttctggaggcctggatctggaatcattcaccagatcattctagaaaactatgcataccctggagttcttctgattggcactgactcccacacccccaatgggggtggcctgggaggtatctgcattggagtagggggtgctgatgctgtggatgtcatggctgggatcccctgggagccgaagtgtcccaaggtgattggcgtgaagctgacgggcaccctctctggttggacctcacccaaagatgtgatcctgaaagtggccggcatcctcacagtgaaaggtggcacaggtgccattgtggaataccatggacctggtgtcgactccatctcctgcactggcatggcaacaatttgcaacatgggtgcagaaattggggccactacaccagtgttcccctacaaccacaggatgaaaaagtacctgagcaagacaggccgagcagacattgccaacctagcagaagaattcaaggatcacttagtgcctgaccctggctgccagtatgaccaagtgattgaaattaacctcaatgagctaaagccacatatcaatggaccctttacccctgacttggctcacccagtggcagatgtgggcactgtggcagagaaggaagggtggcctctggacatcagagtaggtttgattggcagctgcaccaattcaagctacgaggacatgggacgatcagcagctgtggccaagcaagccctggcgcacggactcaagtgcaagtctcagttcaccatcaccccaggctctgagcagatccgagccactatcgagcgggatggctatgcacagatcctaagggatgtgggtggaatcgttttggccaatgcctgtggcccttgcatcggccagtgggacaggaaagacatcaagaagggggagaagaatacaatcgtcacctcctacaacaggaacttcacaggccgtaatgatgcaaatcctgagacccatgcctttgtcacatccccagagattgtcacagccctggccattgcgggaacccttaagttcaacccagaaactgacttcttaacaggcaaggatggcaagaagttcaagttggaggctccagatgcagatgagcttccccgatcggactttgatccagggcaggacacataccagcacccccctaaggacagcagtggccagcgggtggatgtgagccctaccagccagcgcctgcagctcctggaaccttttgacaaatgggatggcaaagacctagaggaccagcaaatccttatcaaggtcaaagggaagtgcactactgaccacatttctgctgccggcccctggctcaagttccgtgggcatctggataacatctctaataacctgcttatcggtgccatcaacatcgaaaatggcaaagccaattctgtgcgcaatgctgtcacccaggagtttggccctgtacctgacactgctcgctactacaagaaacatggcatcaggtgggtgatgattggagatgagaactacggtgaaggctcaagccgggagcacgcagcactggagcctcgccatctggggggccgagccatcatcaccaagagcttcgcaaggatccatgaaaccaatctaaagaagcagggcttgctgcccctcacctttgctgacccctctgactacaacaagattcatccagtggacaagctgaccattcaaggcctgaaggactttgcccctggcaagcctctgaactgcatcatcaagcaccccaatgggacccaggagaccatcctgctgaaccacactttcaacgagacacagatcgagtggttccgtgcaggcagcgccctcaacaggatgaaggagctgcagcagtgaggagccaggctggctcactgtcccactctggaccctgctggggcaaaggtgcaggcccatgtgcatccacagagcctcatctggtctgtccagcatgaccacctgctctaagatggtgaccagacctgcttcttgccctccctatcctcagcccactgagtgaaccaacatggagggcacttaagatgatggagggcacttaagatgatgtcccagccccgccttcctgttcagtttggtttgtctttgagcaacccatgcaactgtatttatttttgatgacagcactccctctacagaagtttttattctgcctaatcatttcactggtggctgaaggattttagagaaacttgttcttataaggaaaaaaaaaaaaaaaaaaaaaaaaaaaaa

SEQ ID NO: 1839 - DNA, 1552 bp, Rattus norvegicus
  Genbank Accession No. NM_024399
cagttcccaagagagctctgtatttttcacttctcacttagatctaaacttggaaacttttctcagaagttaagtgtcctttgacctcctctcttctgaattgcagaaaccagaccagattttggtatttggtaaaatgacttcttgtgttgctgaagaacctattaaaaagattgccatcttcggagggactcatggaaatgaactgactggagtgtttctagttactcactggctaaagaatggcgctgaagttcacagagcagggctggaagtgaagccattcattaccaacccaagagcggtggagaagtgcaccagatacattgactgtgacctgaaccgtgtttttgaccttgaaaatcttagcaaagagatgtctgaagatttgccgtatgaagttagaagggctcaagaaataaatcacttatttggtccaaaagatagtgatgatgcctacgatgtcgtttttgtccttcataacactacttctaacatgggttgcactcttattcttgaggattccaggaatgactttttaatccagatgtttcactatattaagacctgcatggctccattaccctgctctgtttacctcatcgagcatccttccctcaaatatgcaaccactcgttccattgccaagtatcctgttggtatagaagttggtcctcagcatcacggtgttctgagagctgatattttagaccaaatgagaagaatgctcaagcacgctcttgattttatacagcgtttcaatgaaggtaaagaatttcccccctgtgctattgatgtctataaaataatggagaaagttgattatccaaggaacgaaagtggagacgtggctgctgttatccatcctaatctgcagctgcaggatcaagactggaaaccattgcaccctggagatcctgtgtttgtgtctcttgatggaaaagttattccactgggtggagactgtaccgtgtacccagtgtttgtgaatgaagctgcatattatgaaaaaaaagaagcatttgcaaagacaacaaaactaacactcaacgcaaaaagcatccgctccactttgcactaaacatctctgcaagctcacagttatgggatcttacagacctctagaagtctgtaaacgctccaagaccagagtgcctcattctagttcttttcctcagcaccttggccccatgcctcaagcagtaagcatccaggccaggttctgagaggaacgaataaattcatgaatgtctttcatatatgtttggatgagctatgtacagtagacaggcaagtgtgcttggttctgtattaattctttatacattacattctggtagtttaacattgttaactttcacatttagaacataacattgaaatacatgcctacatgcaatttagcatacagtgagacagactgaatatgtgttttcaaggaatgcataagtactattcaaaactaatagtacagacttgctgtttttaagtgctgatatgtgagttaataacagtgtattattaaatgtccattccttaaaaaaaaaaaaaa

SEQ ID NO: 1840 - DNA, 4878 bp, Rattus norvegicus
  Genbank Accession No. NM_024400
ctgtcactaggcctgagcgcacagcccggcggagagagcagatccttgctcagtatccagccctatcgcggccaaggcggaggacgaagagtccaggctcttattctggacttgttccccaattccagggcgcttctcgatcctgcagcagcctcttagcagctccagcagtgcggagccattaactcggtgctggaataaaaaaaattcccgcgcgccggcgcagcctttttctaagtgacccggagcttttggctgcgagctctgcaagaactttcaaatcaaagtgcttgtgaattttaagcatccggagcaggccaacgaagctctgcgcgtctaaccgtctaaccgtctaaccagaacaagagttctctgcgctgcagtgtgcggtgtcatgcagccagaagtccctttggggtcaggcaagctgaagccctgctcagacatgggggacatccagcgggcagcgaagtttcggagctctcagtctgcacacatgctgttgctactcctcgcttccataacaatgctgctgtgtgtgcggggcgcacacgggcgccccacggaggaagacgaggagctggtgctgccctcgctggagcgcgcccggggccacgattccaccacactcctccgtctggacgcctttggtcagcagctgcatctgaagttgcagccagacagcggtttcttagcgcctggcttcaccctccagacggtggggcgcagtcctgggtccgaggcacagcatctggaccccactggggacctggcccactgcttctactctggcacggtgaacggtgaccccagctccgccgccgccctcagcctctgtgaaggtgtgcgcggtgccttctacctacaaggcgaggagttcttcattcagccagcgcctgcggtggccaccgagcgcctggtccccgccgaaccgaaggaggagtcaatcgcacctccgcggttccacatcctgaggcgaaggcggcggggcagcggcggcgcaaagtgcggtgtcatggacgaagagaccctgccaaccagcaactcgggtcgcgaaagccagaacaccccggaccagtggcctctgcggaaccccactcctcagggcgcgggaaagccaacaggaccaggaagcataaggaagaagcgatttgtgtccagcccccgttatgtggaaaccatgctcgtggctgaccagtccatggctgacttccacggcagcggtctaaagcattaccttctaaccctgttctcggtggcagccagattttacaagcaccccagcattaggaattcaattagtctggtggtggtgaagatcttggtcatatatgaggagcagaagggaccggaagttacttccaatgccgctctcacccttaggaatttctgtagctggcagaaacagcacaacagccccagtgaccgggatccagagcactatgacacagcgattctgttcaccagacaggatttatgtggctcccacacctgtgacactctcgggatggctgatgttggaactgtatgtgaccccagcaggagctgttcggtcatcgaagatgatggtttacaggctgccttcaccacagcccatgaattgggccatgtgtttaacatgccacacgatgacgccaagcactgcgccagctttaatggcgtgagtggggattcccatctgatggcctcgatgctctccagcttggaccacagccagccctggtctccttgcagtgcctacatggtcacatcattcctggacaacggccatggggaatgtttgatggacaagccgcagaacccaatcaagctcccatctgatcttcccggtaccttgtacgatgccaaccgccagtgtcagtttaccttcggggaggaatccacgcactgccctgatgcagccagcacatgcagtaccctgtggtgcactggcacctccggtggcttactggtgtgccaaacaaaacacttcccttgggcagatggcaccagctgcggagaagggaaatggtgtgtcagcggcaagtgtgtgaacaagaccgacatgaagcactttgctactcctgttcatgggagctggggaccgtggggaccatggggagactgctcaagaacctgtggtggaggagttcaatatacaatgagagaatgtgacaacccggtcccaaagaacggggggaagtactgcgaaggcaaacgagtccgctacaggtcctgtaacattgaggactgtccagacaataacggaaaaacattcagagaggagcaatgcgaggcgcacaatgagttttccaaagcttcctttgggaatgaacccacggtggaatggacacccaagtatgctggcgtctcgccaaaggacaggtgcaagcttacctgcgaagccaaaggcattggctacttctttgttttacagcccaaggtggtagatggcactccctgtagtccagactctacttctgtctgtgtgcaaggacagtgtgtgaaagctggctgtgatcgcatcatagactccaaaaagaagttcgataagtgtggcgtttgtggaggaaatggctccacgtgcaagaaaatatcaggaacggtcactagtacaagacctgggtatcatgacattgtcacaattcctgctggagccaccaacattgaagtgaaacatcgtaatccaaggggatccagaaacaatggcagctttctggctattagagctgcagatggtacctatattctgaatggaaacttcactctgtccactctagagcaagacctcacctacaaaggtactgtcttaagatacagtggttcctcagcagcattggaaagaatccgcagctttagtccactcaaagaacccctgaccatccaggttcttatggtgggccatgctctccgacccaaaatcaagtacacctattttatgaagaagaagacggagcccttcaacgctattcccacattttcggagtgggtgattgaagagtggggggagtgctccaagacatgtggttccggttggcagaggagagtggtagagtgcagagacattaatggacaccctgcttctgaatgtgccaaagaagtgaagccagccagtaccagaccttgtgcagaccttccttgcccacgttggcaggtgggggattggtcaccatgttctaaaacttgtgggaagggttataagaagagaaccttgaaatgtctgtcccatgatggcggtgtgttatcaaatgagagctgtgatcctttgaagaaaccaaagcattacattgacttttgcatactgacacagtgcagttaagaggttttgaggacaaggtagcgtgggagggctgatacactgaaagcaagagtgctggagggatcctgtgaatcaaaccagtaaacagtgaggtgtggcaatgaggtgtgtataggggatacattagcaaaagaggtagatccgtacactatcctgccagttaacttctgatagggtagttaatgaggaatagtagcatctgaaagatcatacatagcactatgaagccccaaagtactattagtattccttttgttacatccactgcacaaataattttcagagtctggcagaagcatggctaccctgttgcatggtactaattaatactttgtatcacaggggttgggaaaggaaagcagaagaatggtaagattggatttcaaacatggcttacttttttatcactggaggcagggagaagggtacaaacaagatcattattcaaagtttctggctgccgtggtttcagggaaggttgattcctatcaagagtgaaaagttctgattgctcaacatgagagagagaaagcctcgtctctgtgaaataactcttgatttcttcttagaccatctccgttttttaaccataattcctgttgaggtagtaacaattcacctacttataaaatgtacattgggtgggaaaaagtgaagtataagagttacacataaaaactcaaggaataagcaacatggctcctgctttgctttctcctaaggttagcctgcctgggatctgtggacgttaaagataatccttgactcacaaaaggcagtaaaaccatacatgtcatgcaagagtaagaatgggctatagagatcagggtcccatgagatgggggacacggaggtcactcatctcacatgggagactgctgcaggatagcaggtccactcctggcagctggtccaacagtcgtatcctggtgaatgtctgttcagctcttttactgagagagaatatgactgtttccatatgtatatagtaaaatacattactatgatttatatgtactttataagtattggtttgtttgttccttctaagaaggactatagtttataataaatgcctataacatatttatttttatacatttatttctaatgataaaaccttttaagttatatcgcttttgttaaagtgcatataaagatagagtatttatacaatatatgttaactagaaataataaaagaacacttttgaatgtgtttgcctattttctgaagtgggcttaactcctgggcaagaaatctaatgagacacaagcattggatttcaggacagctttaaaatctgggtgaatgaactgtatttcctgtttatagacatactaataaaaaagaagttgatgatgtctttagtgataagattgttactaacgtggttggcaaattactgtaaagagtcagatagtaagcgtttatggcattgtaggctatatttcctgccacaaccctgtgacagtgaatgctttgtaggaatgagagcagccataaatgacatgtacaccatagctgtgctttaataaaaccttatttgcaaaaaaaaaaaaaaaaaaaaaaaaaaaaaa

SEQ ID NO: 1841 - DNA, 1173 bp, Rattus norvegicus
  Genbank Accession No. NM_024403
tcgagttaagcacattcctcgataccagcaaatccctacaacatgaccgagatgagcttcctgaacagcgaagtgttggcgggggacttaatgtcccccttcgaccagtcgggtttgggggctgaagaaagcctaggtctcttagatgactatctggaggtggccaagcacttcaaacctcatgggttctccagcgacaaggcgggctcctcagaatggctggctatggatgggttggtcagtgcctcagacaccggcaaggaggatgccttttccgggacagattggatgttggagaaaatggacctgaaagagtttgacttcgatgctctgtttcgaatggatgacctggaaaccatgccagatgagcttttggccacgttggatgacacatgtgatctttttgcccctctagtccaagagactaataaggagccccctcagacagtgaacccaattggccatctcccagaaagtgtaataaaagtcgaccaggctgccccctttacattcttgcagcctcttccctgttccccagggtttctgtcttccactccagatcattcctttagtttagagctgggaagtgaggttgatatctctgaaggagataggaagcctgactctgctgcttatattactctaacccctcagtgtgtaaaggaggaagacactccctctgatagtgacagtggcatctgtatgagccctgagtcctacctgggctctccccaacacagcccttccacctccagggccccaccagacagtctgccttctccaggtgttcctcgtggttctcgacccaaaccttatgacccacctggagttagtgtgacagctaaagtgaagactgaaaagttggataagaagctgaaaaagatggagcaaaacaagacagcagctactaggtaccgccagaagaagagggctgagcaggaagccctcactggcgagtgtaaagagctagaaaagaagaacgaggctctgaaagagaaggcagattctctcgccaaagagattcagtatctaaaagacctgatagaagaggtccgtaaggcaagggggaagaagagagttccttaatagggtagtcaggtgctttgtgcttgtacatagtcttgtgatgctgtgtttgctgtaataaattattttgtagtgaaagtaaaaaaa

SEQ ID NO: 1842 - DNA, 1240 bp, Rattus norvegicus
  Genbank Accession No. NM_024404
tcgcggcggcggcgggtgtcgtctcggcggcggcggaggcagtagcactatgtcggaggagcagttcggaggggacggggcggcggcggcggcaacggcggcggtaggcggctcggcgggcgagcaggagggagccatggtggcggcggcgcagggggcagcggcggcggcgggaagcgggagcggcggcggctctgcggccggaggcaccgaaggaggcagcaccgaggcagagggagcgaagatcgacgccagtaagaatgaggaggatgaaggccattcaaactcctccccacgacacactgaagcagcgacggcacagcgggaagaatggaaaatgtttataggaggccttagctgggacaccacaaagaaagacctgaaggactacttttccaaatttggggacgttgtagactgcactctgaagttagatcctatcacagggcgatcaaggggttttggctttgtgctatttaaagagtcggagagtgtagataaggtcatggatcagaaagaacataaattgaatgggaaagtcattgatcctaaaagggccaaagccatgaaaacaaaagagcccgtcaaaaaaatttttgttggtggcctttctccagacacacctgaagaaaaaataagagagtactttggtggttttggtgaggttgaatccatagagctgcctatggacaacaagaccaataagaggcgtgggttctgtttcattacctttaaggaagaggaaccagtgaagaagataatggagaagaaataccacaatgttggtcttagtaaatgtgaaataaaagtagccatgtcgaaggagcagtatcagcagcagcagcagtggggatctagaggagggtttgcaggaagagctcgcggaagaggcggtggccccagtcaaaactggaaccagggatatagtaactattggaaccaaggctatggcagctatggatataacagccaagggtacggtggttatggaggatatgactacactggttacaacagctactatggatatggtgactatagcaatcagcagagtggttatgggaaagtatccagacgaggtggtcatcaaaatagctacaaaccatactaaattattccatttgcaacttatccccaacaggtggtgaagcagtattttccaatttgaagattcatttgaaggtggctcctgccacctgctaatagcagttcaaactaaattttttctatcaagttcccg

SEQ ID NO: 1843 - DNA, 2052 bp, Rattus norvegicus
  Genbank Accession No. NM_024484
cgggacactttgcagacatggagactgtcgttcgcagatgcccattcttatcccgagtccctcaggcctttctgcagaaggcagggaaatctctgctgttctatgctcaaaactgccccaagatgatggaagtcggggccaagccggctcctcggaccgtgtccacttcagcagcacagtgccagcaggtcaaagaaacccctccagccaatgagaaagagaaaactgccaaagccgcagtccagcaggctcctgacgagtcccagatggcacagactccagacggcacacagctcccgcctggacacccgtcaccctctacaagccagagctctgggagcaagtgccctttcctggcagcacagctagccagacgggcagcagcgtcttccgcaaggccagtctggagcttcaggaggacgtggcaggaaatgcatgctgtgaggacagaggttgctcaaagcccagtgctccccagcttggtcaatgcaaaaagggatggagaaggtccaagcccactgctgaagaacttccaggacatcatgagaaagcaaaggccagaaagagtgtctcatcttcttcaggataacttgcccaaagtcgtttccacttttcaatatgatcatttctttgagaagaaaattgacgagaaaaaaaatgaccacacctaccgagtttttaaaactgtgaaccggagagcacagatctttcccatggcagatgactacacggactccctcatcaccaataatcaggtgtcggtctggtcgagtaacgactatctaggcatgagtcgacacccacgggtgtgtggggccgtcatagagactgtgaaacagcatggtgccggtgcaggtggaactagaaatatttctggaacgagcaagttccatgtggaactggagcaggagctggctgacctccacggcaaggacgcggcgctcttgttctcttcctgcttcgtggccaacgactccactctcttcaccctggctaagatgatgccaggctgtgaaatttactctgattccgggaaccatgcctccatgatccaagggattcgcaacagtcgagtgccaaagtatatcttccgccacaatgatgtcaaccatctcagagaactgttgcagagatccgacccctcggtccccaagatcgtagcattcgaaactgtccattcaatggatggagcagtgtgccccctggaagagctgtgtgatgtggcccatgagtttggagcgatcacgtttgtggacgaggtccatgcagtagggctctatggggcttcaggtggagggatcggtgatcgggatggagtcatgccaaaaatggacatcatttctggaacactcggtaaagcgttcggctgtgttggaggatacattgccagcacgagtttgctgatcgacaccgtccggtcctacgctgcgggcttcatcttcaccacctccctgccaccaatgctgctggctggagccctggagtctgtgcggatcctgaagagcaatgagggacgtgcccttcgccgccagcaccagcgcaatgtcaagcttatgaggcagatgctaatggacgctggcctcccagtcatccactgccccagccacatcatccctgtgcgggttgccgatgctgctaaaaacacagaaatctgtgatgagttgatgaccaggcataatatctacgtccaggccattaattacccaacagtgcctcgtggggaggagctcctccggatcgcccccaccccgcaccacacaccgcagatgatgaactacttcctagagaagctgctgctcacgtggaagcgagtcgggctggaactgaagccacattcgtcagctgaatgcaacttctgcaggaggcccttacacttcgaagtgatgagcgagagagagaaagcctatttctcaggcatgagcaagatggtgtctgcccaggcctgactgtgactcagttattcacaaaccccagaccattaccatacccaaatagtagccagaattgtctttagatgtgaagtaaattatatattaaatcttaatctatagt

SEQ ID NO: 1844 - DNA, 1539 bp, Rattus norvegicus
  Genbank Accession No. NM_030826
gaattccgcgctacaggcatttttgagtccaatatcttctacagtatgtctgctgctcggctctccgcggtggcacagtccaccgtgtatgccttctccgcgcgcccgctggcgggcggggagcccgtgagcctgggctccctgcggggcaaggtgctgctcattgagaatgtcgcgtccctctgaggcaccacgacccgggactacaccgaaatgaatgatctgcagaagcgtctggggcctcgtggcctggtggtgctcggtttcccgtgcaatcagttcggacatcaggagaatggcaagaatgaagagattctgaattccctcaagtatgtccgacccggtggtgggttcgagcccaactttacattgtttgagaagtgcgaggtgaatggtgagaaggctcacccgctctttaccttcctgcggaatgccttgccagcacccagtgacgatcccactgcgctcatgaccgaccccaagtacatcatttggtccccggtgtgccgcaacgacatttcctggaactttgagaagttcctggtaggtccagacggtgttccagtgcgcagatacagcaggcgctttcgcaccatcgacatcgaacccgatatagaagccctgctgtccaagcagcctagcaacccctaaggcattcctggtatctgggcttggtgatggctggctgccctccggggggaggtttttccatgacggtgtttcctctaaatttacatggagaaacacctgatttccagaaaaatcccctcagatgggcgctggtctcgtccattcccgatgcctttacgcctaaagaaaggcggtttcaccactaagaataaagtgctgcggaattccgtgtcttcctgggcacgtttttgtatgaatattcaagaaggcaccccgattactccgtgtccctgctgctgagacttgctaagaaatatgaagccacactggagaagtgctgtgctgaaggcgatcctcctgcctgctacggcacagtgcttgcagaatttcacctcttgtagaagaacctaagaacttggtcaaactaactgtgagctttacgagaagcttggagagtatggattccaaaacgcattctggtccgatacacccagaaagcaccctaggtgtcgaccccaactctcgtggaggcagcaagaaacctgggaagagtgggcaccaagtgttgtacccttcctgaagctcagagactgccctgtgtggaagactatctgtctgccatcctgaaccgtctgtgtgtgctgcatgagaagaccccagtgagcgagaaggctcaccaagtgctgtagtgggtccctggtggaaagacggccatgtttctctgctctgacagttgacgagacatatgtccccaaagagtttaaagctgagaccttcaccttccactctgatatctgcacactcccagacaaggagaagcagataaagaagcaaacggctctcgctgagctggtgaaacacaagcccaaggccacagaagatcagctgaagacggtgatgggtgacttc

SEQ ID NO: 1845 - DNA, 15438 bp, Rattus norvegicus
  Genbank Accession No. NM_030827
aggagccagcgggtagtgctgaacaagactcctgttccggagcggagtaacctgcctgtgcccgctgcgacgcgcgcccacctcccggggaaggaacggcgaggcccggggccgtctccgcgatggagcgcggggccgcagcggcggcgtggatgctgttgctggcgatcgctgcctgcctggagccagtcagtagccaagaatgcggcagtgggaattttcgctgtgacaatggatactgtatccctgcgtcctggaggtgtgatgggaccagagactgtttggatgacacagatgaaattggctgtcctcccaggtcctgcgaatcaggccttttcctgtgtcctgctgaggggacctgcatccctagctcctgggtgtgtgacgaggataaggattgttcggacggtgcagacgaacagcaaaattgtgctgggaccacgtgctcggctcagcagatgacgtgctccaacggtcagtgtattccgagcgaatacaggtgcgaccatgtcagcgactgccccgacggctctgacgagagaaactgccattatccaacatgtgatcaacttacttgtgccaatggagcctgctataacacgagtcagaggtgtgaccaaaaagttgactgcagggattcctcggacgaagctaactgcactaccctgtgttcgcaaaaagaatttgaatgtggcagtggagagtgtatccttcgcgcctacgtctgtgaccatgacaatgactgcgaagataacagcgatgagcgcaattgcaactatgacacctgcggaggtcaccagttcacttgctccaatggccagtgcatcaaccagaactgggtttgtgatggagatgacgactgccaagattctggtgatgaagatggatgtgaaagtaaccagagtcatcataggtgttacccaagagaatgggcgtgtcctgggtctggacgatgcatctcaattgataaagtttgcgatggagttcctgactgtccagaaggagacgatgagaacaacgtcacaagcggaagaacctgtggtatgggtgtctgctctgtcttaaactgtgagtaccagtgccatcagacgccatttggaggagaatgcttctgccccccaggtcatattatcaacagcaatgacagccgtacttgcattgatttcgacgactgccagatatggggaatttgtgaccagaagtgtgaaaaccgacagggccgtcatcagtgcctctgtgaagaagggtatatcctggagcgagggcagcattgcaaatccagtgactccttcagtgcagcctctgttatcttctccaatggtcgggatttgctagttggagatcttcatggaagaaacttccggattctagcagagtctaagaaccgaggaatggttatgggagtggattttcactatcagaaacacagagttttttggacagaccccatgcaggaaaaggtgttttccactgacatcaatggcttaaatacccaagaaattcttaatgtttctgttgacactccagagaatctggctgtggattggattaataataaactttatctggtagagacaaaggtcaaccgcattgacgtggtcaacttggagggaaatcagcgtgttactctcataactgaaaacttagggcatcctagaggaattgcccttgatccaactgtgggctatttgtttttctcagattggggaagcctctctgggcaacccaaggtggagagagccttcatggatggtagcaatcggaaagacctggtaacaaccaaagtggggtggcctgctgggatcactctggatctggtgtccaagcgagtttactgggtggattctcgttatgactacattgaaactgtaacatatgacggaattcaaaggaagacggtagctcgtggaggctcccttgttccgcatccctttggaataagcttatttgaggaacacgtgttctttactgattggacaaagatggctgtgatgaaagccagcaagttcacagaaaccaaccctcaagtgtaccaccagtcttccctgaggcctcacggagtgacggtttaccatgccctcaggcaacccaatgccaccaatccgtgcgggagcaacaatgggggctgtgcgcaggtctgtgtcctcagtcacaggacggataatggtggcctgggctaccggtgcaagtgtgaattcggctttgaactggatgatgatgagcaccgctgtgttgccgttaagaacttcctgctcttctcatcgaaaacggctgtgcgtggaatcccattcaccctctccacccaggaagatgtcatggttcctgtcacagggagtccatccttcttcgttggaattgattttgatgcccaacacagtactgtcttctattcagatttgtcaaaagacataatttataaacaaaaaattgatggcacaggaaaagaggttatcacagcaaaccggttggaaagtgttgagtgtttgacttttgactggatctcaaggaatctttactggacagatggaggactaaagagtgtcactgtcctgaggctggctgataagtcccgacgacagataatcagcaacttaaacaaccctcgttccattgtggtgcatccgaccgctgggtatatgttcctgagtgattggttccgtcctgcaaaaattatgagagcatggagcgatggttctcacctaatgcccatagtcaatactagtctggggtggcccaatggcttggccatcgattggagtgcttcacgattgtactgggtagatgccttttttgataagattgaacacagcacccttgatggtttagatagaaaaaggctgggccatgtagaccagatgactcatccatttggactcaccgtttttaaagataatgtgttcataacagactggagactgggtgctattattcgagtgaggaaatcagatggtggtgatatgacagttattcgaagaggcatcagcagcgtaatgcacgtgaaagcctacgatgctgacctccagactgggtctaactactgcagtcagaccacccacgccaacggtgactgcagccacttctgcttcccggtcccgaacttccagcgggtgtgcggctgtccctatggaatgaagcttcagagggatcaaatgacttgtgagggagacccagcccgagagccacccacacagcagtgtggctccctctcctttccctgcaacaatggcaagtgtgtgcccagtttcttccgctgtgatggagtggacgattgccatgacaacagtgatgagcatcagtgcggggtgtttaataatacttgctcaccttcggctttcgcctgcgtccgcggtggacagtgcatccctggccagtggcactgtgacagacagaatgactgtttagacggcagtgatgagcaaaactgccccacacatgccacgtcgtccacttgcccgtccacctccttcacctgcgacaatcacgtgtgcatcccaaaagactgggtctgtgacacagacaatgattgctcggatggctcggatgaaaagaactgccaagcttcagggacctgccagcctacacagtttcggtgccctgaccaccgatgcatcagcccgctgtatgtctgtgatggggacaaggactgcgcggatgggtctgatgaggcgggctgtgtgttaaactgtacgagtgcccagttcaaatgtgccgatgggagttcttgcattaacagcaggtaccgctgcgatggggtttacgactgcagggacaactctgacgaggcaggctgccccaccaggcctcccggcatgtgccacccggatgagttccagtgccaaggagacggtacatgcatccctaacacctgggagtgtgacgggcatccagactgtatccacgggtccgacgagcacactggctgtgttcctaagacctgctcgccgactcatttcctctgtgacaatggaaactgcatctacaaagcgtggatctgtgatggggacaatgattgtagggatatgagtgatgagaaggactgtcctacccagccttttcactgtcctagcacgcagtggcagtgcccgggctacagcacctgtatcaatctgagtgccctgtgtgacggcgtctttgactgtccgaatgggactgacgagtccccactttgcaatcaagacagctgctcccattttaatggtggctgtactcatcagtgcatgcaagggcccttcggagccacatgcctatgcccattaggataccaacttgccaatgataccaagacctgtgaagatatcaatgagtgcgatattccaggcttctgcagccagcactgcgtcaacatgagaggttccttccggtgcgcttgtgatccagaatatacgctggaaagtgatgggcggacttgcaaagtcacaggatctgaaaatccgttgttagttgtagcaagtcgtgacaaaatcattgtggacaacatcactgcccacacgcacaatctctactcgttggtccaggatgtttcttttgtggttgctcttgattttgattcagtcactggtcgtgtcttctggagtgacttactgcagggtaaaacctggagtgtctttcaaaacggaacagacaagagagtggtccatgacagtggcctctctgtgacagaaatgattgcagtagattggattggtcgcaacctttactggacggactatgctcttgaaacaatcgaagtttctaaaattgatggaagtcacagaacagtactgatcagcaaaaatgtcacaaaaccgaggggactcgcgttagatcccagaatgggtgacaatgtaatgttttggtctgactggggccatcaccctcgcattgagcgagccagcatggatggcaccatgcgcacagtcattgtccaggaaaagatctactggccctgtggcttaagcatcgactaccccaaccgcctcatctacttcatggatgcctatcttgactacattgaattctgtgattacgacggacataaccgaaggcaggtcattgctagcgatttggttctccaccatccgcacgccctcactctgttcgaagactttgtgtactggactgaccgtggtactcggcaggttatgcaggccaacaagtggcatggggggaaccagtcagttgtaatgtacagcgttcaccaaccgcttggaataactgccattcatccttcaaggcaaccaccttcccggaatccatgtgcctctgcctcttgcagccatctttgcctgctttctgcacaggcgcctagacattattcttgtgcttgcccttcaggatggaacctctccgatgattctgtcaactgtgtgagaggtgaccaacctttcttgatgtccgtaagagacaatataatttttggaatctcccttgatcctgaggtgaagagcaatgatgccatggtccccatatcagggatacagcatggttatgatgttgaatttgatgactctgagcaattcatctactgggttgagaatccgggtgaaattcacagagtgaagactgatggcagcaacaggacagtgtttgctcctctgtccctgctggggtcttctttaggcctggccttggactgggtatcaaggaacatttattataccactcctgcaagtcggtccattgaggtgttgacgctcaagggagatacgaggtatggaaaaaccctgattgccaatgacggcacccccctcggagttggtttccccgttggcatagctgttgatcctgcacgtgggaaactatattggtcagaccacgggacggacagtggggttcctgccaagatcgcaagtgctaatatggatggaacatctttaaaaattctcttcactgggaacctgcagcatctggaggttgtcaccctggacattcaggagcagaagctgtactgggcagtcaccagcagaggcgtgattgagagaggaaatgtggacggtacagagaggatgatcctggtgcaccatctggcccacccatggggccttgtggtctatggctccttcctttactactctgatgaacagtatgaggtcattgagagagttgacaagtcctctgggaataacaaagtcgtcctcagagataacgttccgtacctgaggggtcttcgggtttaccaccgccgcaatgccgctgactcttccaatggctgtagcaacaaccccaacgcttgccagcagatctgcctgcccgtgccaggtggaatgttctcctgcgcctgtgccagtggctttaagctcagccctgacggtcgctcctgttctccatataactcgttcatggtcgtttccatgctgcccgcagttagaggctttagcttggagttgtctgatcactcggaggccatggtgcccgtagctggccaaggacgaaatgttctgcatgcggacgtggatgttgccaacggctttatttactggtgtgattttagcagctctgtaagatcctctaatggaattcgtagaatcaaacccgacgggtctaattttaccaacgtcgttacctatggcattggggcaaatggaatccggggtgttgcactggactgggcagcaggaaatctttattttaccaatgcctttgtgtacgaaaccctgatagaagtgttacggatcaataccacgtaccgccgtgtactcctcaaagtctcagtggatatgccccggcatattattgttgaccccaagcatagatatctcttctgggccgactatgggcagaagccaaagatcgaacgctcttttcttgactgtaccaatcgaactgtccttgtttccgaaggcattgtcacccctcggggcttggccatggaccatgacactggctatatttattgggttgatgactccttagatttaattgccaggatccatcttgatggaggagaatctcaggtggttcgctatggcagccgttacccaactccctatggcatcactgtgtttggagagtctatcatttgggtggatagaaacttgaaaaaagtcttccaagccagcaagcaaccagggaatacagatccacccgtagtgataagagataagatcaacctgctccgtgacgtgaccatctttgacgagcacgcccagcccctctcaccagcagagcttaacaataacccttgtctgcaaagcaatggtgggtgttcccacttttgctttgccttacctgagttgcctactcccagatgtggatgtgcttttgggactctgggaaatgatggcaagagctgtgctacctcccaagaagatttcctcatctattccttaaataattccctgagaagtttacactttgaccctagagaccatagcctacctttccaagtgataagtgtggcgggaactgccattgcactggattatgaccgtagaaacaatagaatcttcttcacacaaaagctaaactctctccgtggccagatttcctatgtcagcctgtattcagggagcagctctccaactgtcctgctgtcaaatataggggtgactgatggcattgcctttgattggataaatagaagaatttattacagtgacttttcaaatcagacaataaattccatggctgaagatggatccaatcgtgctgtgattgcccgtgtttccaaacccagagctattgtattagatccttgccgagggtacatgtattggactgactggggtaccaacgccaaaatcgagagagccacactgggaggaaacttccgggtccccattgtgaacaccagcttggtttggcccaatggactcgctttggaccttgagactgaccttctgtactgggcagatgctagcttgcagaaaatagaacgcagtactctcacgggcacgaaccgagaagtcgttgtcagcactgcctttcattcctttggcttgactgtctatggccagtacatttactggacagacttgtacaccagaaaaatctaccgggctaacaagtacgacgggtcagacctggtagcaatgaccacacgtttgcccacccagcctagtggtatttccacagtggtcaaaacccagcggcagcagtgtagcaatccttgtgaccagttcaacggaggatgcagccatatctgtgctccaggtccaaatggagctgagtgtcagtgtcctcacgaaggcaactggtatctggccaacgataacaagtactgcgttgtggacacggggacccgctgtaatcaactccagttcacctgcctcaatgggcattgtattaatcaggattggaaatgtgacaatgacaacgactgtggtgatggcagtgatgagcttcctacagtctgtgcctttcacacctgccgatcaacagccttcacttgtggcaacgggcgatgtgtgccataccactatcgctgtgattactacaatgactgcggggacaacagcgacgaggcaggttgcctgttcagaaactgcaacagcaccacagagttcacgtgcagcaatgggcggtgcataccgctcagttatgtctgcaatggcataaacaattgccatgacaatgacacctcggatgagaaaaactgccctccccacacttgcccgccggatttcacaaaatgccagaccacgaatatttgtgttccccgagctttcttgtgtgatggagacaatgactgtggagacgggagtgacgagaaccccatttactgcgcctcacacacatgccgcagcaacgagttccagtgcctctcccctcagcggtgtattccaagctattggttctgtgacggtgaagccgactgtgcagatggctcggatgaacctgacacttgtgggcattctgtgaacacctgcagggccagtcagttccagtgtgataatggcaggtgcatctcaggcaattgggtctgtgatggtgataacgactgtggggacatgagtgacgaggaccagcggcatcactgtgagcttcagaactgttccagcactcagtttacctgtgtcaacagcagacctcccaacaggaggtgcatcccacagtactgggtctgtgacggtgatgcggactgctcggacgccctggacgagctgcagaattgcaccatgagaacctgctctgcaggggagttcagctgtgcaaatggacgatgtgtcaggcagtcattcaggtgtgatcggcgcaatgactgtggagactacagtgatgagaggggctgctcgtacccaccctgccatgcaaatcaatttacgtgtcagaacgggcggtgtatccctaggttctttgtttgtgatgaggacaatgactgtggagatggttctgatgagcaggagcacctgtgtcacaccccagaacccacatgcccccttcatcaattccggtgtgacaacgggcactgcatcgagatggggcgagtctgtaaccatgtggacgactgctcagacaacagcgatgagaaaggctgtggcattaacgagtgcctagattcttcaatcagtcgctgtgaccacaactgtacagataccataactagtttctactgttcctgtctccctggctacaagctcatgtctgacaaacgctcttgcgtggatattgacgaatgcaaggagtcaccccagctctgtagccagaagtgtgagaatgtggtaggctcctatatttgcaagtgtgcccctggctacatccgtgagccagatgggaagagctgccggcagaatagtaacatcgagccctatctcatctttagcaaccgttactatataagaaacttaactacagatggctcatcttactccctgattttgcaaggattgggcaatgttgtggccctggactttgatagagtagaaaagaggctgtattggattgatgcagagaagcaaatcattgagaggatgtttttgaataagacaaaccgggagaccatcataaaccacaggttaagacgtgctgaaagtctggctgtagactgggtcagcagaaaactctattggttggatgccatcttggactgcctgtttgtctctgaccttgaaggtcgacaccgcaaaatgatagcccagcactgtgtggatgctaacaataccttctgctttgaacatcccaggggaattgtccttcatcctcaaagagggcatgtctactgggcagattggggtgttcacgcatacattggaaggattggcatggatggaaccaataagtctgtgatcatctctaccaagatagaatggcccaatgccatcaccattgactacaccaacgatctcttgtactgggcagatgctcacctgggttatatcgagttctctgatttggaaggtcaccaccgacacacggtgtacgatggatcactgcctcacccctttgctcttacgatttttgaagacactgttttttggacagattggaatacacggacggttgaaaagggaaacaaatatgatgggtcaggtcgagtggtgctggtgaacacaacgcacaaacccttcgacatccacgtgtaccatccataccggcagccgattatgagcaatccctgtggtaccaacaacggtggctgttctcatctgtgcctcatcaaagcgggggggagaggattcacctgcgcgtgtcccgatgacttccagaccgttcagcttcgagacagaacactctgcatgcccatgtgctccagcacgcagttcctgtgtggcaacaatgaaaagtgtatccccatatggtggaaatgtgatggccagaaagactgctctgatggttctgatgaaccagacctgtgcccacaccgcttctgccgtctggggcagttccagtgccgggatggcaactgcacgagcccccaggctctgtgcaatgctcgccaggattgtgctgatggctctgatgaagaccgtgttctctgtgagcatcaccggtgtgagtccaacgagtggcagtgcgccaacaagcgttgcatcccacagtcctggcagtgtgactcagtgaacgactgcctggataactcagatgaggacacttcgcactgcgccagcaggacctgcaggcccggccagttcaagtgtaacaatggtcgctgtatcccgcagagctggaagtgtgacgtagacaatgattgtggagactactccgatgagcccatcgacgagtgcacgaccgctgcttacaactgtgacaaccacacagaattcagctgcaagactaactaccgttgcatcccgcagtgggcggtgtgcaatggttttgatgactgcagggacaacagtgatgaacaaggctgtgaatcggtgccatgccatccttctggggatttccggtgtgcgaatcaccactgcatccctctccgctggaagtgtgacggcactgacgactgtggagataactcggatgaggaaaactgcgttcctcgggagtgctcagagagcgagtttcgatgtgctgatcagcaatgcatcccctctcgatgggtctgtgaccaagaaaatgactgtggagacaactcggatgaacgggactgtgagatgaagacctgccatcctgaacattttcagtgtacgagtggacactgtgtgcccaaggcgttggcatgcgatgggagggcagactgtctggatgcgtctgatgaatctgcttgtcctactcgctttcccaacggcacctactgcccagccgccatgttcgaatgtaaaaaccacgtgtgcatccagtcgttttggatatgtgatggggaaaatgactgtgtcgacggttccgatgaggagatccacctgtgcttcaacattccgtgtgaatcaccacagcgattccggtgtgacaacagccgctgtgtttatggccatcagctgtgcaatggtgtggatgactgcggagatggaagtgacgagaaagaagagcactgtagaaaaccaacccacaaaccgtgcacagacactgaatataagtgtagcaatgggaactgcatttcgcagcactacgtgtgtgataatgtgaatgactgcggagacctttctgatgaaactggttgcaatctaggagataacagaacgtgtgctgaaaacatatgtgaacagaactgtacccagctgagcagcggaggctttatctgctcctgcagacccgggttcaaacctagtacttcggacaaaaattcctgtcaagacatcaatgaatgtgaggagtttggcatctgcccccagagctgtcgaaacagcaaaggaagttatgaatgtttctgtgtcgatggcttcaagtctatgagtacccattatggagaacggtgtgcagctgatggaagccctcctctcttgctcctgcctgagaatgtccgaatccggaagtacaatacctcctctgagaagttctcagagtatctggaagaggaggagcatatccaaactattgactatgactgggatcccgagcacataggcctcagtgttgtctattacactgtgctggcacagggctctcaattcggtgctatcaaacgtgcctacattcccaactttgaatctggtagtaacaatcccatacgtgaagttgacctgggcttgaaatatttaatgcagccagatggattagccgtggactgggtcggaaggcatatttactggtcagatgctaagagccaacggattgaggtggctaccctcgatggaaggtaccggaagtggctgatcaccacccaactggatcagccagctgccattgctgtgaatcctaagctagggcttatgttctggactgaccagggaaaacagcccaaaatcgagtctgcctggatgaacggggaacatcgcagcgttctggtttctgagaaccttggctggccaaacggtctttccatagattacctgaatgatgaccgggtctactggagcgactccaaagaagatgtcattgaagccataaaatatgatgggactgacaggagacttatcataaatgaagcgatgaagcccttcagtctggacatcttcgaagacaagctatactgggtagctaaggaaaagggagaagtgtggagacaaaataaattcgggaaagagaacaaagagaaagtgctggtggtgaacccgtggctcactcaagttcgaatcttccatcaactgagatacaatcagtcagtgtccaacccttgcaagcaggtctgtagtcacctctgcctgctgagaccaggaggctacagctgtgcctgtccccaaggctccgacttcgtaactggcagcactgtccagtgtgatgcagccagtgaacttcccgtcaccatgcctcccccatgcaggtgcatgcacggaggaaattgctattttgatgagaatgaactccccaaatgcaagtgttccagtggctatagcggagaatactgtgaggttgggctctcgagaggcatccctccagggacgacaatggctgttctgttgaccttcgtgatagtcatcattgttggagctctggtgcttgttggactctttcactacaggaaaactggctccctcttacccactctgcccaagctgccaagcctaagcagccttgccaaaccctctgaaaatggaaatggggtgacgttcaggtcgggggctgatgtgaacatggacatcggtgtgtctcctttcggccctgagacaattattgacagatccatggcgatgaatgaacactttgtcatggaggtgggcaagcagcctgtgatatttgaaaacccaatgtatgcagccaaggacaacacttccaaagtggccctggcagttcaggggccatcaacaggcgcacaggtgactgtaccagaaaatgtggaaaaccagaattatggaaggcccatagatccttctgagatagttccagagccaaagccagcctcccctggagctgatgaaattcagggcaaaaaatggaacatcttcaaacgaaaacccaaacagacaacgaactttgagaacccaatctacgcagagatggacagtgaggtaaaggatgctgtggctgtggccccccctccgtctccttctctccctgccaaagcttcaaaaagaaatttgactccaggctacactgccacagaagacacctttaaagacactgcaaatctcgttaaagaagattccgacgtatagcctcgccagctctctagggaacatttagacactcacttttgcacatatattttttacagacaaatgaaaaagaagttaacattcaatactttataaaaaaaatatatttttctctgtttgcctataattgaaggtgtgtcgtgtgtcttttttactgatgccacttcatatttttacaattatcacgggcactgtgtatatcttggactgatgttgtctggaggtgatgctgtgaacattactggacttgtgtaaactttggaaggattatcacacctctgcccctgctaacacgaaggtgcccgttgagtgggtcgctgagctgaagaatacacgatctggtgaggaaaggaattggcctagggctttggatctgtctagagaggagataacactcatatttcctttgaaacaatacaggaattctttatgctcatttgagggcccatttttacacattggcacttaattaatagtcaacgttcaacatcacgtgtcaacctgattagtgagtgtgcagataggggccagtgttggcttcatgcgctgtagatggctcagacaacacagacggtacacagggtgactcagctggacccttctgcgctcctccgccttctgaggccagctatgttttgattgtgcttcgtccctagttgccaagtcaacatttgcacctgccgtgtcacgtcccatactgagtttctgtctcatggaacgagctcttgcttgacagaccttaaatcaacttaagcccttgcctgtcatctcaggtgtcccctaccttcgtgactggaattccgtagttgactgtatgtactaaagccagacccgtgtctccacagagcagggcgccgaacagacaccagtcgatcgaagcctcagctgggtgtctgactctgggtgcacaatgttattgtactgactatttatttcctcagttgacgacgaatagaaagggaaaacattcttcctgagcctttctcaggcctttgcctaaatccgtgcatttgtgtccgaacgtactgtacgtcccagctcttcttttgagtggttggtgtatcctctgtcacaggaagtatggcacgagcatgcgttttccacagcgagtagcattcctggttctctgtgttcaccttgcacatgtgttaatgaatgaatgggagggtgggagaatggatgaatgaaatatactactgattattttattctcgagtcctcgaaatattttgttgctcgtattttgagtacccattgtaattactttgattagaaattaaaaagctactggaaacgctgctgctggaaatttctaataaatgtgtattttatc

SEQ ID NO: 1846 - DNA, 2772 bp, Rattus norvegicus
  Genbank Accession No. NM_030837
ccacgcgtccgcggaggtcgaggccgtccggtcgctgagttgtcctgaagctcgggttaagagggcctgtaagagctgttggtagtcatcccaagtaggctggtggttagcagtggaattttaaagtagagacatcattaaggagtcagaagatcaacatgggagaccttgaaaagggggctgcaacccatggggccggatgctttgccaagatcaaggtgtttctgatggcattaacatgtgcatatgtatccaaatcgctatcaggaactttcatgagttccatgctcacacaaatagagagacaattcggtatccccacagctatagttggattcatcaatgggagctttgagataggaaatcttttgttgattatatttgtgagttattttggaatgaaactgcacagacctatcgtgattggtgttggatgtgcagttatgggcctgggttgcttcataatatcactacctcatttcctcatgggccgatatgaatatgaaacaacgattttacctacaagcaacttgtcctcaaacagcttcttgtgtatggagaaccaaacccagaccttaaatccagcgcaagacccagcagagtgtgtgaaagaagtgaaatcactaatgtggatatatgtactggtaggaaatattatacgtggaattggtgaaactcccatcatgcccttgggtgtttcctacatagaaaactttgccaaatctgaaaactctcctttatacattggaattttagaaacaggaaagatgattggcccaatatttgggcttttgttgggatccttctgtgcaagcatttatgtagacacagggtctgtgaatacagatgacctgaccataactcccacagatatacgctgggttggtgcttggtggatcggctttttggtctgtgcaggagtgaatatcctgattagcattccctttttcttttttcccaaaacactcccaaaggaaggattacaggaaaatgtggatggaactgaaaatgccaaagaggagagcacagagaaaaggccaaggaagaaaaaccgaggaatcactaaagatttctttccgttcctgaagagccctgtcctgcaacccgatttacatgctgttcacccttataaggtgctccaggtcaatgcatttaacatttactttagcttcctgcctaagtaccttgaaaaccaatatggaaaatccactgcagaggtcatcttcctcatgggtgtttataacttacctgcaatatgcattggatatttaattgctggcttcatgatgaagaaattcaagatcactgtcaagacagctgcattcctccgattctgcctatccttgtctgaatatagttttggtttctgtaacttcctaattacctgtgataatgtcccagttgctggtttgactaactcttatgaaagagatcagaaacctctatacttggaaaataatgttcttgctgactgcaacacaaggtgcagctgcttgacgaaaacatgggatccagtgtgtggagacaatggcctagcatacatgtcagcctgcctcgcaggctgcgagaagtctgttggaactggaaccaacatggtgtttcacaattgcagctgcattcagtcaccaggaaactcgtccgcagtcctggggctgtgtaataaaggccccgagtgcaccaacaagctgcagtaccttttaatactatcaggatttctcagtatcctctactcattcgcagccatacctggatacatggtttttctgaggtgtatcaagtctgaagagaagtcacttgggattggaatacatgcattttgcataagagtatttgctggcattccagcacctatttactttggagctttgatagacagaacctgtttacactggggaactcagaaatgtggtgcgccagggcgcaggatgtatgatataaatagcttcaggcgcatttaccttgggatgtctgcagctctaagaggatcaagctatctccctgcatttgttattgtaatacttacaaggaagttctctcttcctgggaaaatcaactcttcagaaatggaaattgcagagatgaagctcacagagaaggaaagccagtgcacagatgtgcacagaaatcctaagttcaagaatgatggagaactgaaaacgaagctgtaatgacttttctactgccttgtgtaaggccatgaacagaatgctagaattcaaaacacttcacttttgaatcatgagataaacaacaggaatgcttaactttaagaacctcaacaattagttttacactcatgataaaagtagcattttcatgaggctggtgtaggacttaagtttttcccaggatagatttctatagagacccccacattgaacattaaagcttccttcattgtatcaaggaaagtatgtatttctaagatatcttcaagtagctttaaagcctagtccttaaacactatttcattctgttgaacttatgtttcgatgtggggggatttagagagacaaatatgcattgtggctgtgctcagaaaaaaaaaaaaaaaacctattctttctatgcacaagctgtctgcatacgtttatatctagaagttattaacccttattttttattttagtcatgatgcttccgagattagacttctctctcatgtgccatctcctggttttagttccatttttctttacttatgtcacacatttgatcatttatcttacagtactgacaaacctgatcacattattaaaaaattcacattgc

SEQ ID NO: 1847 - DNA, 2094 bp, Rattus norvegicus
  Genbank Accession No. NM_030844
ggcacgagctccgatctccgctgagaggctcctgggggccggggctccgaggaaaatggttcgatgttattaaaaatgaatcttaagaagaaaaatgaatcacagcagttaaactatggagttctgctacttgtaagaagtggagaagcctgagattacatcactgacccttgatcctccactgagctaaaacaccagctggtaattgcctatgattttatagacttccctccatctgctgggtccaagtgtccgtctgactgctctggtaccggagcatctttatttctgcatctaaacttgtaaaaagcacatcgaatcttgttccccaggagaaaatcttcaatgtaaccattttcaatgtatccgatgatacaagcgcattgtaatctccaggtagaagcagctttatcagtggaaagggtttaatagaacatatcctatcatgctttttctctgccccttctcaaatcatcagcagtagaaaagagaagaaaacatgtcaggacacaaatgttattcctgggagttgcaggatcggtttgctcaagataagtcagttgtcaataagatgcaacagaaatattgggaaacgaatgaggcctttatcaaagccacagggaagaaggaagatgaacatgtcgttgcttctgatgcagacctggatgccaagctagagctgtttcattcgattcagagaacctgtttggacttgtctaaagcaattgtgctctatcaaaagagaatatgtttcttgtctcaagaagaaaatgaactgggaaaatttctccgatcccaaggcttccaggacaaaacccgagcaggaaaaatgatgcaagccacaggaaaggccctctgcttttcctcccagcaaaggttggccttgagaaaccctttgtgtcgatttcaccaagaagtagagacttttagacatcgggccatctccgatacctggctgacagtgaaccgcatggagcagtgccggacagaatatagaggggcgttattgtggatgaaggacgtgtctcaggaactggatccagacctctacaagcaaatggagaagttcaggaaggtacagacacaagtccgcctcgcgaagaagaactttgacaaattgaagatggatgtgtgtcaaaaggtggatcttcttggagcaagcagatgtaacctcttatctcacatgctagcaacatatcagaccactctgctccacttttgggagaaaacttctcacaccatggcagccatccatgagagcttcaaaggctatcaaccatatgaattcacaacgttaaagagcttacaagaccctatgaaaaagctagtcgagaaagaaaagaagaagagctcccggagggaaaaccgggaggctgtggcacaggagccgaggcagttaatttcattggaggaagagaaccagcacaaagaatcctctacttgccagaaggaggagggaaaaagcgttccgtcgtctgtagacaagagttctgcagatgatgcatgctcaggacccatagatgaactattagacgtgaaacctgaggaagcttgcctgggtcccatggcagggaccccagaacctgaaagtggggacaaggacgacctcctgctgttgaacgagatcttcagcacttccagcctggatgaaggggagttcagcagggagtgggctgcggtgttcggagacgaccggctgaaggaaccagcccccatgggggcccagggagagccagaccccaagccccagataggctctgcgttccttccttcacagcttttagaccaaaacatgaaagatctccaggcctctctccaagagcctgccaaggctgcctcggacctgactgcctggttcagcctctttgctgacctcgaccccctatcaaatcctgatgctattgggaaaaccgataaagaacacgaattgctcaatgcatgagtctgcaaccttcaacaggggagccctccggccactccgcaacacctcatccagggcttgcagaagtctaacgtgctcagtacgctgttttaatatttacatgccattttaataaaacgagagggtcaaggccctgtttctatcgctataaa

SEQ ID NO: 1848 - DNA, 929 bp, Rattus norvegicus
  Genbank Accession No. NM_030845
cctaaaccagctccagcactccagactccagccacactccaacagagcaccatggtctcagccacccgctcgcttctctgtgcagcgctgcctgtgctggccaccagccgccaagccacaggggcgcccgtcgccaatgagctgcgctgtcagtgcctgcagacagtggcagggattcacttcaagaacatccagagtttgaaggtgatgccgccaggaccccactgcacccaaaccgaagtcatagccacactcaagaatggtcgcgaggcttgccttgaccctgaagcccccatggttcagaagattgtccaaaagatgctaaagggtgtccccaagtaatggagaaagaagatagattgcaccgatggcgtctgtctggtgaacgctggcttctgacaacactagttttacacattttacgatttctattgagggtcctatttattttatgtatttatttattccaccaagtgtgtggtttttattttacattaatatttaacgatgtggatgcgtttcatcgatggtcgttcaattccaattgtgcagtttaaagatggtaggcgttaaatatctcgttaaattaatatttattgggagaccattaggtgtcaaccactgtgctagaaggtgttgagcgggaagaagggcggagagatgagagtctgggatcgtgttttgtgttagggtgaggaatgtgtgagaggctatgttgtatgttttgaaagaatgttatttattgaaagttgtctttcatattttatggtcaacattgatgtgttgaagcttcccttggacattttatgtctagtttgtagggcacaatgccttttatattctttaaccaatgctccttctcgtctcaggacagagaagttcaaaggactgttacaaatgaaataaaaataaaagttttattaaaaaat

SEQ ID NO: 1849 - DNA, 737 bp, Rattus norvegicus
  Genbank Accession No. NM_030847
cgaggacagactccaactctgacttcttcagcgactctcgagacttcccgaaccaagccgtctttcctcagaccttacagtcctcccagccttcctctctgacttagagagccagaccccagccctcttcccccaggattgagtgctccgacccttcgaaggcttgcctctcctgctctgagccagcatctggcagccatgtcactcctcctgttggtggtctctgcccttcacatcctcattcttgtcttgcttttcgtggccactctggacaagtcctggtggactctcccagagaaggagtccctgaacctgtggtatgactgcacgtggaacaccaccgctaaaacgtgggcctgcagtaacgtcagtgagaacggctggctgaaggcagtgcaggcgctcatggtgctgtctctcatcctctgctgtctgtccttcatcctcttcatgatccaactctacaccatgcggagaggagggctcttctacgccaccggcctctgccagctctgcaccagtgcggctgtgttctccggggcactgatctatgccatccatgctaaggagatcctggcaaagcacccgagtggaggcagcttcggctactgcttcgccctggcctgggtggcctttccactcgccctggtcagtggcatcatctacatccacctgcggaaacgagaatgagcgctgtgtccccctagaaaataaagccctgtaaccacaaaaaaaaa

SEQ ID NO: 1850 - DNA, 2207 bp, Rattus norvegicus
  Genbank Accession No. NM_030872
gtctcccggctgtgcttggccgtgcggagggccggtgccagcacctccagctccgggacagcagcgggagccaagcccgagccgcaggcgtcgtcgccatgcgctggttccgggcgctgttgaagaatgcgtccctggcaggggcgcccaagtacatcgagcacttcagcaagttctccccgtccccgctgtccatgaagcagtttctagacttcggatccagcaatgcctgcgagaaaacttcattcaccttcctccggcaggagctgcccgtgcgcctggccaacatcatgaaagagatcaacctgcttcctgaccgggtgctgagcaccccctcagtgcaactggtgcagagctggtatgtccagagtctgctggacatcatggaattcctggacaaggaccccgaggaccaccggaccctaagccagttcactgatgccctggtcaccatccggaaccggcacaatgacgtagtgcccaccatggcacagggagtgttggagtacaaggacacctatggtgatgacccagtctccaaccagaacatccagtactttttggaccgcttctacctcagccgcatctctatccgcatgctcattaaccagcacaccctcatctttgatggcagcaccaacccagcccaccccaaacacattggcagcattgatcccaactgcagcgtgtctgatgtggtgaaagatgcctatgacatggctaagctcctgtgtgacaagtattacatggcttcccctgacctggagatccaggaagtcaatgccaccaacgccacccagcccattcacatggtctacgtcccctcccacctctaccacatgctctttgaactcttcaagaatgccatgcgggccacagtggaaagccacgagtccagcctcactctccctcccatcaaaatcatggtggccctcggtgaagaagatctgtccatcaaaatgagtgaccgaggcgggggtgtccccttgaggaagatcgagaggctcttcagctacatgtactctacagctcctacaccccagcctggcactgggggtaccccgctggctggctttgggtatggactccccatttcccgcctctacgccaagtacttccagggggacttgcagctcttctctatggagggctttgggacagatgctgtcatctatctgaaggccctgtccacggactcagtggagcgcctgcctgtctacaacaagtctgcctggcgccactaccagaccatccaggaggccggtgactggtgcgtgcccagcacagagcccaagaacacatcgacgtatcgggtcagctaggggccttctcttcctggcacctgggaggatgctgccacctctgaatccagccaccacagggacttccctatctatcccctggggtacgggggtgaaactgggtctccccgatggccagatctgtctttgtagaaatcgcagtggcccatctgtggcgatccctaagtgccaatctgtctctatggagaaacctagggggtttccctggagcctggtctccatggtgatgatgcttgagggttggggacggctctacctggtggggtggccccagagacacttctcccaagaccagagctgtctgttttctaccagaaaccctgggtccccctcactgcctgcatagtcctggtctcccacgtggctgcctcgcttgccttatgcccacaccctgtacaggcacattgggctggtttcttcgtcagtagtaagaaagatggagagagactggggaaacgggggccaaccttgtctctggtcctgcagcctctctccatctccactctggacactaaagttgccactgggaacttgagaatgggtggccgttctcacccaaggcccaccgagaaggcctaagagtaacctgtccccaaggcgatcttagcaatgtttctgccgcttcctggcctggcatgtcctcacgtgtatacctcccctgcccagtgtacgctcaccctatccctgcttgagctttagaccccagacttcctatgcccactatgtgtgcacagacgactcaaacccaggatgccccatgtacatagccagttttgtaatctcagatgcctcacccttgccctccgcacacaggggttaaagccgtgtgcccctcccagtggctgggatggtgacagtgacatccacagtaaatagatgaaatga

SEQ ID NO: 1851 - DNA, 1966 bp, Rattus norvegicus
  Genbank Accession No. NM_030873
atggccggttggcagagctacgtggataacctgatgtgcgatggctgctgccaggaggccgccattgtcggctactgcgacgccaaatacgtctgggcagccacggccgggggcgtcttccagagcatcacgccagcagaaatagatgtgattataggaaaagaccgggaaggtttctttaccaatggtttgactcttggaggaaagaagtgctctgtgatcagagatagcctatacgttgactcggactgcacaatggacatccggacaaagagtcaaggtggggagccaacatacaacgttgctgttggcagagctgggagagtcttggtctttgtaatgggaaaagaaggggtccatggaggcggattgaataagaaggcatactcaatggcaaaatacttgagagactcttgggttctagctgctaggcagactgttaagtattaggggaaattgctcttaaattttcctagctgtaagcttaagtcttaattctggaaattttattagcaatgcagggtgatgggatatgaacctgtgtctcctttgtatccctctgttggtggggaaaggtgtctgtctttcttccccttccccttaaataattctgttcatttttggttgtttccttgtgtactccagcattggttatagttatgggaaaggaaggtgtccacacaggcacaattaacaagaaaacatatgaactcgctttatacctgaagaggtctgatgtataagcagcctctcccatctacctacctatcaactgtcttcatcaccaccctaattatggtcataatgctaccagattgtagatggtagctagtttttccttccttattttctactgtcatgattcccaagggtcatttgtatgttagccactgtgtgcccaacccttatctggcatcgtgatcgcagcacaataatgatttgcatgatatcttgagattgggggaagggggcatgccaagtcgggcatcacttcgtcttagcaattagtggaatactgattactaaaataagttaatattaagcaaggtgccggtgtacaatctctaatttgatcagtgttttctcagcactttgagcatttacttagctcatttagtcttccttttgtagcgcatggttgggaggaaaaagtgcatgcatctgtacttcacacctttctcatcccctcccttcgaacatgaggcgtttggtttgcttccattctctttgtgtagtgcctggtttatttaacctaatcaatacctcctcgctgagctgtgagagtcgcagtgatttactttgatacagtgattgcacttgggacacactgtttgtagtgtcaatagcacgtgatgagtgcagctgtggagagaaaggcacttcctcccatgaccttactacagtaaccataccgatcaaattcccagggacattcgatcattgcagtagctcagacttcttgtcttttctttgcacaccagctgtactcttgagtaaaattgtaaaaggctgccattatggatattaggtaacccaacataaccatctggagtgtgtccagtttatttttcataggaccaatttttatttgcagcttaggtttttatatgaagttgcattattgtggacttggctgtcttgtgatgtatttttttcatatgtatcctgtgccatactattgttaaaatgaactgttgctattgtgagatggaatttctttcgaatggcactactttagggacattctagtatttgcttctattgtttgggcattgtggataatgtacagatttaaaaacaaatcttgttgctgatttgtccatttctttccctgcactttgttacatctgggatacagtctaactcatctgatttaatatgcatttaaaaaaatgccataactattaaacaccttgtttacagacagatgaaataaatttattccaaccaaaaaaaaaaaaaaaaa

SEQ ID NO: 1852 - DNA, 1450 bp, Rattus norvegicus
  Genbank Accession No. NM_030985
cggggactggatgatgctgtcccgctggagaggattcgtggcttgagtcctgttccacccgatcaccggggtggccgaggcggtaccagcgctgcgctctctcagctcctgccacattccctgagttaacatatgagagattggtatagaaatggctggcattttgtctggataaatcacacaaccctcccagaaagtgatcaccaggtcaagtggatttcgaatagtgtctgagaccaactcaacccagaaaaacaaaatggcccttaactcttctgctgaagatggtatcaaaagaatccaagatgactgccccaaggctggcaggcacagttacatatttgtcatgatccctaccctctacagcatcatctttgtggtgggaatatttggaaacagcttggtggtgattgtcatttacttttacatgaagctgaagactgtggccagcgtctttcttctcaatctcgccttggctgacttatgctttttgctgacttgtcccctgtgggcagtctataccgctatggagtaccgctggcccttcggcaatcacctatgtaagatcgcttcggccagcgtgacgttcaacctctacgccagtgtgttccttctcacgtgtctcagcatcgaccgctacctggccatcgtccacccaatgaagtctcgccttcgccgcacgatgctggtggccaaagtcacctgcatcatcatctggctgatggctggcttggccagtttgccagctgtcatccaccgaaatgtatacttcatcgagaacaccaatatcacagtgtgcgcgtttcattatgagtctcggaattcgacgctccccatagggctgggccttaccaagaatattctgggcttcttgttccctttccttatcattctcaccagctatacccttatttggaaagctctaaagaaggcttatgaaattcaaaagaacaaaccaagaaacgatgacatctttaggataattatggcgattgtgcttttcttcttcttttcctgggtcccccaccaaatattcactttcctggatgtgctgattcagctgggcgtcatccatgactgtaaaatttctgacatcgtggacactgccatgcccatcaccatctgcatagcgtattttaacaactgcctgaaccctctgttctacggctttctggggaagaaatttaaaaagtatttcctccagctcctgaaatatattcccccaaaggccaagtcccactcaagcctgtctacgaaaatgagcacgctttcttaccggccttcggataacatgagctcatcggccaaaaagcctgcgtcttgttttgaggtggagtgacaggttcaaagcacactggcaatgtaatgccctgacagaagccagggagcctctgactaaatggcttacgaccaaaggaccattcaccctgcctcaggatctaagcagaaa

SEQ ID NO: 1853 - DNA, 2837 bp, Rattus norvegicus
  Genbank Accession No. NM_030987
gaattcggcacgaggtggaaagcactgagacgtgaagatgagtgaacttgaccagctgcggcaggaggccgagcaactgaagaaccaaattagagatgcccgtaaagcatgtgcagatgcgactctttctcagatcacaaacaacattgatccagtgggaagaatccaaatgcgaaccaggagaacactgagggggcatctggcaaagatttatgccatgcactggggcacagactcaaggctccttgtcagcgcctctcaggatgggaaactcatcatctgggacagctataccacaaacaaggttcatgccatccctctgcgctcctcttgggtcatgacctgtgcatacgctccttctgggaattatgtggcctgtggtggcctggataacatctgctccatttacaatctgaaaactcgtgaaggaaatgtgcgtgtgagtcgtgagctggcaggacatacaggttatctatcctgttgccggttcctggatgacaatcagatagttaccagttctggagacaccacatgtgccctgtgggacatcgagaccggccagcagacaaccacgtttactggacacactggagatgtcatgagcctgtctcttgctcctgacaccagactgtttgtctctggtgcttgcgatgcttcggtcaagctctgggatgtccgagaagggatgtgccggcagacctttacaggacacgagtctgacatcaatgccatatgtttctttcccaatggcaatgcctttgccactggctcagacgatgctacatgcaggctgtttgaccttcgtgcagaccaggagctcatgacctactcccatgacaacattatctgtggtatcacatctgttcccttctccaagagtggccgcctcctcctcggtggctatgacgacttcaactgtaatgtctgggatgcactcaatgctgacagagcaggtgtcctagctggacatgacaaccgagtcagctgcttgggggtgactgatgatggcatggctgtggcaacaggatcctgggacagcttcctcaagatctggaactaaggccacagcaggtggatggatgccatggcgactggaagaccattccaaccttgaagcgttactgcgatagcatatcctatccaaccatactaacgtggacacccacacctcccctcagaacttcaaaagggcaagatcttttttccttcacttattgctgaaaccaagagcacaactcccattaagagaaggatctctgtgctgtaaactaaaacaaattgtgcatttttctggggccattgtctttggtttattttgttttgttttttgtttttgttttgtttgtcttgggcaaatttttaaaggaaatactacaataaaaatgttaaccagaaggtaaccctgagtatgattgtgagagagacacaccttcttactagttcatttgcatttaaatcagtgatcctgatctgtggcaatcatgaaaaacaagttgaagactttgtttatctggaattgtttctaaatataagtcatttgtagcaagactttggaagcattcacgtttcttccttaaacatattcctttatgttcagtagttaagagaaccagagcccatgggggtgtctgactgtcactgatgcatttttgtccctggcttgcttttttttttttttttttttttttgtctcatgtcacagatgactgtttcgcacaaacacagcatagtggaagaaaaaattcagaagcaaagtagccaagcacatgttatgatggccacgaatgcttggtcagaatccttccctttgctcagcagtgaacttattcccagcacccttccctcctcactgtccagtttctgttctttccttgggtttcctgtgaagttggagggaagtttgtagtcatgtgacactagccgtcctgcccctgctgtcagattttttttctccagagaggtgcctgtcctgtgcttggatagtcagtttgtgtatgaaacaatgtacaaatcaatgttttgaaaataatgatctcagactttctaagttaaattttaaacaatttgattgtttgccatattgggtgggtttactcttagaatcgcatgctgtagaaatgctctaaagtgcatataggactcagtccttagatgttctttttattttaagaaataacctcttcaagttgtaaccgtggcggctttgtccattactgttgctattctgcacacatatcggaagcagcaagcgctttacacactcgagtagtgggataagtcactgttttctttactttacaagatgatagtcctgttgggaatgactgctgctggcttcaggaagggagggaagctgctccgctgcctctttgccacttcctggaagcagcctccatggaacagcctttgcatctgaggcaaccatttttacaccgtgcagatcttcgtggttatcatctcaaagccatgttcagcagcagcgtttggacagcagtgttctgtgggccctcccatcccccgatatcctgcacccctcatagcagtagtggcttcgccattctgttttctgcagcgtcctgtacaaaactgtgctgtgactgtgcggtaggcctggacatggcaaagagaatacagcgaagccccttctcttcctaccaaacgactctgtagagctctctgcaccctgtaccctttccaccttttgtatttaattttaaagtcagtgtactgcaaggaggctggatgcaagatagatactatattaaactgtactgttatttaagatgtaataaagcagtttgacatgaggaaaaaaaaaaaaaaaaaaaaaaaaaaaa

SEQ ID NO: 1854 - DNA, 1124 bp, Rattus norvegicus
  Genbank Accession No. NM_031000
gaattctggccactttgtcttctccacagcctgtgctcattgccaaggggacaatgacggcctccagtgtcctcctgcacactggacagaagatgcctctgattggtctggggacatggaagagtgagcctggtcaggtgaaagcagctattaaatatgcccttagcgtaggctaccgccacattgactgtgcttctgtatatggcaatgaaactgagattggagaggccctgaaggagagtgtgggagcaggcaaggcagtacctcgagaggagctgtttgtgacctccaagctgtggaatactaagcaccaccctgaggatgtagaacctgctgtccggaagacgctggctgatctgcagctggagtatttggacctctatttgatgcattggccttatgccttcgagcggggagacaatccctttcccaagaatgccgatggaactgtcaaatatgactccactcactataaggagacctggaaggctctggaggcactggtggcaaaggggctggtgaaagccttgggcttgtccaacttcagcagtcggcagatagatgatgtcctcagtgtggcctcggtgcgcccagctgtcttgcaggtggaatgccatccatacctggctcaaaatgagctcattgcccactgtcaagcacgaggcttggaggtgacagcttacagccccttgggttcatcggatcgtgcttggcgccaccctgatgagccagtcctgcttgaggaaccagttgtcttggcactagctgaaaaacatggccgatctccagctcagatcttgctcagatggcaggttcagcggaaagtaatctgcatccccaaaagcatcactccttcccgcatccttcagaacattcaggtatttgatttcacctttagtccagaggagatgaagcaattagatgctctgaacaaaaattggcggtatattgtgcccatgattacggtggatgggaagagagtccccagagatgctggacaccctctgtatccctttaatgacccatactgaggcccgtagtttctcagcttccctttcagttctcctgctaagcattgcctgctactcccaagaaagaaggactcaataaagccattgaagtgt

SEQ ID NO: 1855 - DNA, 1726 bp, Rattus norvegicus
  Genbank Accession No. NM_031003
cgatcgcgcaagtcggacccgtggatcacagcctgtagatcgcggcccgggcctggaggacaacagcaagtgaagggggttcctcttcctgaaggaggggtcatggccttcttgttgactacccgacggctggtctgcagttcccagaaaaacctccacctcttcacacctggatccagatacatcagccaagctgctgccaaagttgactttgagtttgattatgatggaccactcatgaagacagaagtcccgggccctagatctcaggagctaatgaaacagctgaacacaatccagaatgcagaggccgtgcactttttctgcaactacgaagagagccgaggcaactacctcgtggacgtggatggcaaccgcatgttggacctgtattctcagatctcctctgtacccatcggttacaaccatccggctctggcgaaactcgttcaacagcctcaaaacgcgagcactttcatcaacagacctgccctgggcatcctgcctccagagaactttgtggacaagctccgggagtccttgatgtcggtggcgcccaaaggcatgtgtcagctcatcacgatggcctgcgggtcctgctccaatgagaatgcattcaagaccatcttcatgtggtaccggagtaaagaacgaggtcagagaggtttctccaaagaggagctggagacttgcatggttaaccagagtcctggatgcccagactacagcatcctctccttcatgggtgctttccacgggaggaccatgggttgcttagcgaccacacactccaaagcaattcacaagattgacatcccttcctttgactggcccattgctccattcccacggctgaaatatcccctggaggagtttgtgacggacaatcagcaagaggaggcccgctgtctagaagaggtggaggatctaattgtgaaatatcggaaaaagaagagaacagtggctgggatcatcgtggagcccatccagtccgaaggtggagacaaccacgcatcagatgacttcttccggaagctgagagacatagccaggaagcatggctgtgccttcttggtggacgaggttcagactggaggaggctgtacaggcaagttctgggcccatgaacactggggcttggatgacccagccgacgtgatgtcgttcagcaagaagatgatgactgggggcttcttccacaaggaggagtttcgaccaagtgctccttaccggatcttcaacacctggctgggggacccatccaagaacttgctgctggctgaggtcatcaacatcatcaagcgggaagacctgctcaacaacgtggcccatgccgggaagaccctactgaccgggctgctggacctccaggcccagtacccccagttcgtcagccgggtgaggggacgaggcaccttctgttccttcgacactcccgacaaagccatacggaataaactcatcctaattgccaggaacaaaggtgtggtactggggggctgcggtgacaaatccatacgtttccgtcccacgctggtcttcagggatcaccatgcccacttgttcctcaacattttcagtggtatcttagcagacttcaagtaaagaagccatctccacgacattcagagaaagctctgtcccagcggtgtcaacttgattagtttgcctaattcatattttcacttcaaagtttatcagaggcgaatgcataaactaaagggtc

SEQ ID NO: 1856 - DNA, 2156 bp, Rattus norvegicus
  Genbank Accession No. NM_031009
gcacgagacacacagcctttccagcgccacgctgtggatggggagcggccaccaggcttgaaagaagcccagagctggcgactgcacacggtcgattttaaatagtgtcagagagcaattcacctcaccaaaggagacatgatccttaactcctctactgaagatggaattaaaagaatccaagatgactgccccaaggctggcaggcacaattacatatttgtcatgatccctactctctatagcatcatctttatggtgggaatatttggaaacagcttggtggtgattgtcatttacttttacatgaagctaaagactgtggccagtgtttttcttctgaatcttgccctggctgatttatgctttttgttgactttgccactgtgggcagtctataccgctatggaataccgatggcccttcggcaaccacctatgtaagatcgcttctgccagcgtcagtttcaatctctatgccagtgtgtttctgctcacgtgtctcagcatcgatcgctacctggccattgtccacccaatgaagtctcgcctccgccgcacgatgctggtagccaaagtcacctgcatcatcatctggctaatggctggcttggccagtttgccagccgtcatctaccgaaacgtatatttcatcgagaacaccaatatcacagtttgcgcttttcattatgaatctcagaactcaacactccccattggactgggtctaacaaagaacattctgggcttcgtgttccctttccttatcattctcaccagctatactcttatttggaaagccctaaagaaggcttataaaattcagaagaacacgccaagaaatgatgacatctttaggataattatggcgattgtgcttttcttcttcttttcctgggttccccaccaaatattcacttttctggatgtgctcattcagctgggcattatccgtgactgtgaaattgctgacattgtggacaccgctatgcccatcaccatctgcatagcttattttaacaattgcctgaatcctctgttttatggctttctggggaaaaaatttaaaaaatatttcctccagcttctgaaatacattcccccaacggccaagtcacatgcaggcttgtcaacaaaaatgagcactctttcctaccgcccttcagataacatgagttcatctgccaaaaagtctgcatctttttttgaagtggagtgagagggttcaaagcctgcaagtgaagtgatttcctgacagcagaagccagaggaccatttgggctaagcagctcactcactaccgaaggagtgttcaacctccagcaatcctttcagggttgaagcagagaaagcactcagtgtacacattttcaaaagtgggaaacaaaagcttttttcccctttaaaacaaattggagcaaagccactgttaaaagcctttttttgttgactgaataactgctttaaggacaatgtcagaaattgagtggctgtatggatttgggagttagggaggaggtgtactagcagaaacgtaatgtctccagtcccctctcaattctgttacttttgatttccacttgaaggtatttagaagctattaaatctgtagacaatcaaaaggagatgggaggtcaagagtttctaagggtccaggaagctacccatctgtttagttactagtgactatgacaccattgttcctgacacaacacagttaagacttgctagacagtagtcatcaagtttcaaaatgctttgtgaagttcagccagtgtcttaagaattcagagccatgtgccaaaacagtaccacagaacagcttgtctgaataatgtcttactgtagttgcaaagccaaactgcttgtcaagctgtgattctgtcccagatagttgtgtcttcctagttggatcagtttaatttcatatctaagaaatgtataatttcatatctaagaaatgtatatgaaatgtatatgaaatgtataatttcatatctaagaaatgttaagcagatttatcataaagtatgttttatggttctaaaaatgtatattttatatatgttatgtatatctatatctctaagctgttgtttgattgaagttgtagcaaagttgtatttatcttgaaataaaaatttatcataatataaa

SEQ ID NO: 1857 - DNA, 2048 bp, Rattus norvegicus
  Genbank Accession No. NM_031010
gggagaaatcatctgcaagatgggtgtctaccgcatccgcgtctccaccggagactccaagtacgcgggctccaacaacgaggtctacctgtggttggttggacagcatggagaggcatctctcgggaagctgctacgaccctgtcgggactcggaagcagaattcaaagtggatgtgtcagaataccttgggccactgctgttcgtaagagtgcagaaatggcattatctcacggatgacgcctggttctgcaactggatttctgtgaagggccccggagaccaaggatcagagtacatgttcccctgttaccgatgggttcagggcagaagcatcctgagcctccctgagggcactggctgcaccgtggttgaagattctcaaggactgttcaggaaacatagggaagaggagcttgaagagaggaggagtctgtacaggtggggcaactggaaggatggctcaatcctgaatgtggcggcggccagtatatctgacctccctgtagaccaacgatttcgagaggacaaaagaattgaatttgaagcttcacaggttataggggtaatggatactgttgtcaactttcctataaacactgtgacctgctggaaaagcctagatgacttcaactgcgttttcaagagtggccataccaaaatggctgagcgggttcgaaactcctggaaggaagatgcgttctttgggtaccaattcctcaatggtgctaaccccatggtgctgaagcgctctacttgtcttcctgcccgcctggtattccctccaggaatggagaagctacaggcccagctgaacaaggagctccagaaaggcactctgtttgaagcggatttcttccttctggatgggatcaaggccaatgtcatcctttgtagccagcagtacctggctgcccctctcgtcatgctgaagctgatgcctgatggacaactcttgcccatagccatccagcttgaactgcccaaaactgggtctactccaccacctattttcacgccctcggatcccccaatggactggctcctagccaaatgctgggtccggagctccgacttacagctccatgagctgcaggctcatcttctgaggggacacttgatggctgagctctttgctgtggccaccatgaggtgcctgccttccgtgcaccctgtttttaagcttctagttcctcatctgctttacaccatggaaattaatgtccgggccaggagtgacctgatctcagagagaggcttttttgacaaggcaatgagcacaggtgggggaggccacctggatcttctcaagcaagctggagcctttctgacctattgctcattgtgtccccccgatgacttggctgagcgaggactcttggatatcgagacttgcttctatgctaaagacgccctgcgactctggcagatcatgaatcggtacgtggtgggaatgttcaatctccactacaagaccgacaaagctgtgcaagacgactatgaactgcagagctggtgtcgagagatcactgacattggtcttcaaggggcccaggacagaggcttccctacctctcttcagtcccgggctcaggcttgctacttcatcaccatgtgcatcttcacgtgcaccgcacagcactcttccgtccatcttggccagctggattggttctactgggttcctaatgcaccctgcaccatgcggctgccaccacccaccaccaaggaagcaacaatggagaagctgatggctacactgcccaaccctaatcagtctactctccagataaatgtcgtttggctcctgggcagacgccaggctgttatggtgcccctgggccagcattcagaggaacactttccaaaccctgaggccaaggctgtgctgaagaagttcagagaggaactggctgccttggataaggaaattgagattcgtaataagagcttggacataccttatgagtacctgcggcccagcatggtggaaaacagcgtggccatatgagcatccccagactcctgctttgttgtttagttaagac

SEQ ID NO: 1858 - DNA, 3132 bp, Rattus norvegicus
  Genbank Accession No. NM_031020
gccgctggaaaatgtcgcaggaaaggcccacgttctaccggcaggagctgaacaagaccgtctgggaggtgcccgagcgataccagaacctgtccccggtgggctcgggagcctacggctcggtgtgtgctgcttttgatacaaagacgggacatcgtgtggcagtgaagaagctgtcgagaccgtttcagtccatcattcacgccaaaaggacctacagggagctgcggctgctgaagcacatgaagcacgagaatgtgattggtctgttggatgtgtttacacctgcaaggtccctggaagaattcaacgatgtgtacctggtgacccatctcatgggggcagacctgaacaacatcgtgaagtgtcagaagcttaccgatgaccacgttcagtttcttatctaccagatcctgcgagggctgaagtatatacactcggctgacataatccacagggacctaaagcccagcaacctcgctgtgaatgaagactgtgagctgaagattctggattttgggctggctcggcacactgatgacgaaatgaccggctacgtggctacccggtggtacagagcccccgagattatgctgaattggatgcactacaaccagacagtggatatttggtccgtgggctgcatcatggctgagctgttgaccggaagaacgttgtttcctggtacagaccatattgatcagttgaagctcattttaagactcgttggaaccccaggggctgagcttctgaagaaaatctcctcagagtctgcaagaaactacattcagtctctggcccagatgccgaagatgaacttcgcaaatgtatttattggtgccaatcccctggctgtcgacctgctggaaaagatgctggttttggactcggataagaggatcacagcagcccaagctcttgcgcatgcctactttgctcagtaccacgaccctgatgatgagccagtggctgaaccttatgaccagtcctttgaaagcagggacttccttatagacgaatggaagagcctgacctacgatgaagtcattagctttgtgccaccgccccttgaccaagaagaaatggagtcctgagcaccttgcttctgttctgtccatcccacttcactgtgaggggaaggcctgttcatgggaactctccaaataccattcaagtgcctcttgttgaaagattccttcatggtggaagggggtgcatgtatgtgcgtagtgtttgtgtgtgtctgtctgtctgtccgtttgtccatgtatctttgtggaagtcattgtgatggcagtgacttcatgagtggtagatgctccttggcagtctgcctgctctctcagagtccgggcaggccgatgggaactgccgtctccttagggatgtgtgtgtgtatgttaagtgcaaagtaagaatattaaaatatccctgttcctagttaccttgccacttcggcttctcctgtggccctgcctttaccatatcacagtgacagagagaggctgcttcaggtctgaggctatccctcagccatgcataaagcccaagagaaccaactggctcctgggctctagcctgtgatcggcttgctcatgtcctcagaacctgtcagtctgtttgtgccttaaaaggagagaagggcgcgttgtggtagttacagaatctcagttgctggcgttctgagccaggcaaggcacagggctgttggatggccagtggggagctggacaaaacaaggcagccttcaaggaggccatgggtgcatgtttgcatgagtgtatgtgcaaccgccctccctcacctccaggagcaagctgttttctatgcttacctaagttcacctcagtgcagaggtctccagtgccaggcacaggctcctgccatcagtagcttcctatgtcatcttcacgtcatgcgggtgtttgcatgctgtgctctggagcttgtcctgtcttctggaagccctgggccgggcgtgtgaagacttcccagcagtcctatccacgcacctcagctgaggccacgggcacactgctgcttcctcactccagctacgttgtgttgaacacaactgatcctccaggtgcttgtggtgcaggaaacgggacgaacagagcacctgaacccttgccatctgacatcaccgacacaggagaacagtcctctcctctcctctcctctcctctcctaggacagtccccggctctggaatcatgttcttctcactcatggtagccagctaagaaagctgcaaaccgaacaaagggagaaccgagctcctgaagccaggagctccttttactgtccttctcaaaatagggtcattagacacagccaagtcgtcaaaggcccctttccttgtacggggcccccccgcccccggcagcttgacactgatttcagtgtctatttggggagaaagcaattttgtcttggaattttgtatgttgtaggaatccttagagagtgtggttccttctgatggggagaaagggcaaattattttaatattttgtatttcacctttataaacatgaatcctcaggggtgaagaacagtttgcataattttctgaatttcaggcactttgtgctatatgaggacccatatatttaagctttttgtgcagtaagaaagtgtaaagccaattccagtgttggacgaaacaggtctcgtatttaggtcaaggtgtctccattctctatcagtgcagggacatgcagtttctgtggggcagggtaggaccctgcatcatttggagcccagaaggaggccgactggccaggcctcaccgcctcagtatgcagtccagctccacgtcatcccctcacaatggttagtagcaacgtctgggtttgaacgccaggcgtggttatattattgaggatgcctttgcacatgtggccatgctgtgttaggactgtgccccagggcccggacttgaagctagagctggcagaagagctcctggcatccatggtgcgatgctgccgccacccagtttctccattggaagacaagggaatgagaagactgctgtgtatgtgtatttgtgaacttggttgtgatctggtatgccataggatgtcagacaatatcactggttaaagtaaagcctatttttcagat

SEQ ID NO: 1859 - DNA, 1964 bp, Rattus norvegicus
  Genbank Accession No. NM_031021
ggctgccgcggcccggtcggctttctgcgctgtagcggtctctgccgttccttggaagcacagctccccttccccgccccagtcccagtccccgtccggccgcggacataaagatgagtagctctgaggaggtgtcctggatttcctggttctgtgggctccgtggtaatgaattcttctgtgaggtggatgaagactacatccaggacaaatttaatcttactggactcaatgagcaggtgcctcactatcgacaagccctagacatgatcttggacctggaacctgatgaagagctggaagacaaccccaaccagagtgacttgattgagcaggcggccgagatgctctatgggttgatccacgcccgctacatcctcaccaaccggggcattgcacaaatgttggaaaagtaccagcaaggagactttggctactgtcctcgagtatactgtgagaaccagccgatgcttcccatcggcctttcggacatcccaggagaggccatggtgaagctctactgccccaagtgcatggacgtgtacacacccaagtcctctaggcaccaccacacggatggcgcatacttcggcactggtttccctcacatgctcttcatggtgcatcccgagtaccggcccaagcggccggccaaccagtttgtgcccaggctctacggtttcaagatccatccaatggcctaccagctgcagctccaagccgccagcaacttcaagagcccagtcaagacgattcgctgagtgccctcccacctcctctgcctgtgacaccaccgtccctccgctgccaccctttcaggaagtctatggtttttagtttaaattaaaggaattgttactgtggtggggatatgaaataaaggaagagaaggctaaaaaaaaaaaaaaaaaccgaattcggcatctcacctaggtgtatacagctgcacattaccaatggctgcagaacacccaatcatgacctctagtgctttatagcaaaagtgtaaagtggtacctgggtgaccagcattgccatggttacatccatttgcgtaatcaagcagctgtgcaactgctcttctaacagatgaacagctgcatgcatctccagcaggcatggattgtctcttgtctatgatcctcagtgcgttcacttagagtatttctagagtttgagtccttgccgtgatagagccatgtagggaatgcactgattgcatgttaccccaagcgtcatgaaaccttccgacacggtgacctatttaatggtcttgtttgttgacatgacaaattaacattcttagagttacatctcgaaaaaagcatttgtgatagataagccctttgagccttgtggctaaatttttgtggctttgtttaactttcaaaggttatatatgcactaaccttttttgatggctaagtaggctttaaattacagtaaattttttcaaataaaactggctgtaaaatatattttgaattagagttgttcactttttcatagctacttatgtttttttcccaataatttatttcacatctctaccagtgaacgcagcccatcactagaaaatgaccttgtcctgatttcagtttcaactattagttttaaagctcactgttgaataagaggaagtggtggtgcattttaaattgactttcatgtgcttttaaaatatgacagatctccttgataatgtacttttatttgatctcaagttgtataaaaccaataaatttgtgttactttgattgcagtagtatcttatgcatagtgattccatgttatatgcagactagttaggcaactgttttcttagttacaagcttcacttttgtgcagttaaaaaaacaaaagtaggctacagtctgtgccatgttgatgtacagtttctgaaattgttttacaagactttgataataaaacccttaaactcacaaaaaaaaaaaaaaaaaacc

SEQ ID NO: 1860 - DNA, 2697 bp, Rattus norvegicus
  Genbank Accession No. NM_031024
gtcggtccgcccgtgcgtgcgtctgtccgttcggcctccgtccggcccgcagcatggccggcgtcagcttcagcggccaccgcctggagctgctggcggcgtacgaggaggtgatccgggaggagagtgcagccgactgggctctgtacacttacgaagatggctcagatgacctcaagcttgcagcatcaggagaaggaggcttgcaggagctttcaggccacttcgagaaccagaaagtgatgtacggtttctgcagcgtcaaggactcccaggctgccttgccaaaatatgtgctcatcaactgggttggtgaggatgtgcctgatgcccgaaaatgtgcttgtgccagccatgtggccaaggtggctgaattcttccagggcgttgacgtaattgtgaatgccagcagtgtggaggatatcgatgctggcgccattgggcagcggctctccaatggactggctcggctctctagcccagtgctgcaccgcctgcgccttcgggaggatgagaatgctgagccggtgggcaccacctaccagaagacggatgcggccgtggagatgaagcggattaaccgtgagcagttttgggagcaggccaagaaggaggaggagctgcggaaggaggaggagcggaagaaggctttggatgccaggctcaggtttgagcaggagcggatggagcaggagcggcaggagcaggaggaacgggaacggcgctaccgagagcgggagcagcagatcgaggagcacaggaggaaacagcagagtctggaagctgaagaggccaagaggaggttaaaggatcagtctatctttggtgatcagcgagatgaagaggaagagtcccagatgaagaagtcggaatctgaggtggaggaggcagctgccatcattgcccagcggcctgataacccacgggagttcttcagacagcaggaacgagtggcttcagcctctggtggcagctgtgacgcaccctcgcccttcaaccaccgaccaggtcgtccgtactgccctttcataaaggcatcggacagtgggccttcctcctcctcctcttcctcctcttcccctccacggactccctttccctatatcacctgccaccgcaccccaaacctctcttcctccctcccatgcagtcacctggacagccaccggaggatggcgcccactcccattcccacccggagcccatctgattccagcacagcctccacccccatcacggagcagatcgagagggccctggatgaggtcacatcctcgcagcctccacccccacctccaccacccccaccagctcaagaggcccaggagtctgctcccagactggacggtgaagaggtctgcaaggaggccaaagtagcagcagctcctcaggtctgggctggctgtgcagaggagcctcctcgggcacaggaacctcccctgttgcaaagcagccccacggaggacttgatgtgcacagaatctcctgagcaggctgtcctggcggcctctccagagcctgatgcctctgtcacctcagtagctgatgctcatgcagctgacaccatcgagaccaccactgccactactgccaccactattgccgacaacgtcacccctgccgccgccagcctcattgatctgtggcctggtaacggggaagaggcctcaacgcctcaggctgaacccagggtgcccaccccaccctcaggtgctgaggcctccctggcagaggtgcctctgttgaatgaggcagctcaggagccgctgccaccagtgggcgaaggctgtgccaaccttcttaatttcgatgagctgccagaacctccagccaccttctgtgacccagaggaggaagccgaaggagagccgctggctgcctcccaggtcctaactatgccctcagccctagaggaggtagatcaggtgttggagcaggagttggagccagaacctcatctgctgaccaatggagagaccactcagaaggaggggacccagcaggccagcgaaggatacttcagtcagtcacaggaggaagaattcgcccaatcagaagagccatgtgcaaaggctccacctcctgtattctacaacaagcctccagaaatcgacatcacctgctgggatgcagacccagttcctgaagaggaagagggcttcgagggtggtgattagtagtggcgactgccccctggctgccctcgccaaggctgcccacctgcagtgcctctggccagccggcttgcagcgccagcattagcagcagccccgcctggctcccactctggattccggcactggccggggacctgtctgcttctctacccacagggcctgacttttacagcttttctcttttttttaaaagttgatagacttgtacaattgactggttttcctcccgttggtagttgaaacaatgttgcagattccacccccttcctgcccagaccagattgtagcttagtccttcctgctcagctgaccagggtggaggcctcaccctgcttgggacctggtgggggtcgggggttctggtgggaaaatgttcccccccatcacttttcctagttttatgtttcttggaaaaaaaatatcactttgtattctctatccagggcttcagatattttgcacgaaatttaaaacatggcaataaatggctcgtgggctctgaaaaaaaaaaaaaaaaaaa

SEQ ID NO: 1861 - DNA, 4454 bp, Rattus norvegicus
  Genbank Accession No. NM_031030
gcgtcacggcgcgggcggaagatggccgggttggttgcccgcagctgctaacccggcagtgcggagctggagcctggctcccgctgccgcgaagcggccgtcgccatgtcgctgctgcagtctgcactggacttcctggcgggccctggttctcttggcggagctgccggccgtgaccagagtgacttcgtggggcagactgtggagctgggcgagctgcgtctgcgggtgcggcgggtcctggccgagggagggtttgcatttgtttatgaagctcaagatctgggaagtggcagagagtatgcattaaagagattactatccaatgaagaggaaaagaacagagccatcattcaggaagtatgtttcttgaaaaaactttctggccaccccaatattgtccagttctgctctgcagcatccataggaaaagaggaatcggacactgggcaggctgagttcctcctgcttacggagctctgtaaaggacagctggtggagtttctcaggagagttgaatgtaaaggccctctatcctgcgacagcattctgaagatcttctaccagacatgcagagcagtgcagcacatgcacaggcagaaaccacccatcatccacagggatctcaaggttgaaaacttactgcttagtaaccaggggaccattaagctgtgtgactttggcagtgccacaaccatctcccattatcctgactacagctggagcgcccagaagcgagcaatggtggaggaagagatcacgaggaacaccacacccatgtacagaacgccagaaattgtagacctgtattctaacttccctattggcgaaaagcaggatatctgggcactgggctgtatcttatacctgctgtgtttccggcagcatccttttgaagatggagcaaaacttcggatagtcaatgggaagtattccattcctgtgaatgacactcgttacacagtcttccatgaccttattcgtggcatgctaaaggtcaatccagaagagaggctatccattgctgaagttgtccgacaactgcaggaaattgcagcagcccggaatgtgaaccccaaagcccccatcacagaacttctggagcagaatggtggctatgggaactcagggccttcccgagcacaaccaccttctgggggccctgtgaacagcagtggagttttggctctggcagagtatgaccagccctatggtgggtttctcgatatcctacggggtgggacagaacggctcttcaccaacctcaaggatacttcctccaaggtcatccagtctgtggctaactatgcaaagggcgatcttgacatatcttacatcacatccaggattgcagtgatgtcgttcccagcagaaggtgtggagtcagcaatcaaaaacaatatagaggatgtacgattgtttctggatgccaagcatccaggacattatgctgtctacaacctttctccaagaatataccgggcttccaagttccacaatcgggtcactgagtgtggctgggcagtcaggcgggcaccacatctccacagtttgtatactctatgcaggagcatgcatgcctggctccgggaagaccacaggaacgtctgtgttgtacattgcatggatgggagagctgcgtctgctgtggcagtctgtgcattcctgtgcttctgccgtctcttcagcactgcagaggctgctgtgtacatgttcagcatgaagcgctgcccaccaggcatttggccatcccacaaaaggtacattgaatacgtgtgtgacatggtggcagaggaacccatcacgccccacagcaagccaatgctggtgaaatctgttgtcatgacccctgtgccactgttcagcaagcagaggaatggctgccgaccattctgtgaggtctatgttggggaggagcgtgtaaccaccacatcccaggagtatgacaggatgaaggaatttaaaattgaggatggcaaggctgtcatccccctgggcataacagttcaaggcgatgtcctcaccatcatttaccatgccagatccactttaggagggagactgcaggccaagatggcgtccatgaaaatgttccagattcagttccacactgggttcgtgcctcgaaacgcaaccactgtgaaatttgcaaagtatgacctggatgcttgtgacattcaagagaagtacccagatctgttccaggtgaacctggaagtggaggtggagcctagagacaggcccagccgagacgttccaccttgggagaataccagcctaagggggttaaaccccaagatcctcttttccaacagggaagagcaacaggacattctgtctaagtttgggaaaccagagctaccccggcagccgggctccacagctcagtatgatgctgaggcagggtctccagaggctgagatcacagagtcggactcaccacagagcagcagcacggacaccaaccactttcttcacacactggattggcaggaggaaaaagacccagagactggtgtagacaatacctctcctaaggagagtcagtctaacctgattgcagatggagatggaagtgaagtatcagatgaagaagaggcttcatgccctagtgaagagagaaagcctggggctggagaagatacaccaaggctggcagctgggaccagacagcaagacttaatatttgatgtgggcatgctggctgccccacaggagcctgtacagcctgaagaaggtgtcgatctcctggggctgcactctgaaggggacttaaggcctgctgctcccttgcaggctagcggggtccagtctagcaacactgacctgttgagctcccttcttgaaccatctgatgcttctcaagtgggacctcctggtgacctgcttggtggtgagactcctctgctgttagcaagcccagtttctcttcttggggtgcagagcaacctgcaaggaaaagtccctgacactgtggacccatttgaccagttcctgctgccatccagctcggacacccagccctgctccaagcctgatctctttggagagtttctcaactctgactctgtagcttcctcaactgccttcccatcgacccacagcgccccacccccatcctgcagcactgccttcctgcacctgggagatctgccagcagagcccaacaaggtgattgcttcatccagccacccagatctgctaggaggatgggatacgtgggctgagactgctctacctgggccggcctccatgccagtaccagaaggtactctcttctcttctgcaggtcacccagcccctccaggccccaaccccagccaaaccaagtctcagaacccagacccatttgctgacctcagtgatctcagctctagcctccaaggcttgcctgctggacttcctgcagggagcttcgttggcacatcagccaccactcacaaaagcaacagctcctggcagacaactcgtcccacagcccctggaacctcatggcccccgcaggccaagccagcccccagagcctctgaacaactaaggtctcactttagtgtgattggggcccgagaagagagaggtgtccgtgcgcccagctttgcccaaaagccaaaggtctcagaaaatgattttgaagatctgctgcctaatcaaggcttctctaagtctgacaagaaggggccaaagaccatggcagagatgcggaaacaggaacttgccagagatacagacccattcaaattgaagcttttggactggattgaaggcaaagagaggaatattcgtgcactgctgtccactctgcacacagtattgtgggatggggagagccgctggacacctgtgagtatggctgacctggtgactccagagcaggtgaagaagcagtaccgccgtgcagtgctggtagtgcatcctgataaggccacagggcagccatatgaacagtctgccaagatgatcttcatggagctgaatgatgcatggtctgagtttgaaaaccagggctcaaggcccctcttctgaggcctgtgatgactatggctgcaggagctgctcatgaatcctgaatgctgctggcctgactgaggcacaaatgggaccataacaggtgtggcaggtgatatcgccccaggggcctggaccatctactcccaatcatccctgcattcatcatggacaaataccattccatggctgggagagaaagcattcctcagatctgatatttgttgttttgtttttctttttcttgtcccagaggaaaagtgttgatttatattccttccacagctgtcacaatttgtgatttacttggtgtctggtggctgtcacctcttgaatggcacatgtcgctggcacttctctcctgtaatttcttcaaatatggggtgcatccacaccccactctgataagtttgccaatcatctgtacataattaaactattttccgatg

SEQ ID NO: 1862 - DNA, 2260 bp, Rattus norvegicus
  Genbank Accession No. NM_031031
gggcgactaggaccttgtgcacacagagcagcagcagaaaccggggcgatgctacgggtgcggtgtctgcgcggcggcagccgaggcgccgaggcggtgcactacatcggctctcggcttggaggatccttaacaggatgggtgcagcgaactttccagagcacccaggcagctacagcttcctcccaaaattcctgtgcagctgaagacaaggccacccaccccctgcccaaggactgccctgtctcctcttacaacgaatgggaccctttagaggaagtgatagtgggcagagctgaaaatgcctgtgtcccaccattcacagtggaggtgaaggccaatacatatgaaaagtactggccgttttaccagaaaaatggaggtctttattttcccaaagatcatctgaagaaggctgttgccgaggtcgaagagatgtgcaatattttatcaatggaaggcgtgaccgtgaagcggcctgaccccattgactggtcactgaagtataagactcctgattttgagtctacaggtttatacagcgcgatgcctcgagacatcctgatggttgtggggaatgagattatagaggctcccatggcatggcgctcacgcttctttgagtaccgcgcatacaggtcaattatcaaagactacttccaccgtggtgccaagtggacaacggcccccaagcccacaatggctgacgaactgtatgaccaggactatcccatccattctgtggaagacagacacaaattggccgctcaggggaagttcgtgacaaccgagttcgagccttgctttgatgctgctgacttcattcgagctggaagagatatttttgcgcagagaagccaggttacaaactacctgggcatcgagtggatgcgtaggcatcttgccccagactacagagtgcatatcatctcgtttaaagaccccaatccaatgcatattgatgccaccttcaacatcattggacctggtcttgtgctctccaaccctgaccgtccatgccatcagattgatcttttcaagaaagcaggatggaccatagttacccctccaacacctgtgatccccgatgatcatcccctctggatgtcatccaagtggctctccatgaacgtcttaatgctagatgagaagcgcgtgatggtagacgccaatgaggtcccaattcagaagatgtttgagaagctgggtatcagcaccattaaggttaacattcgaaatgccaattccctaggaggaggcttccactgctggacctgcgacgtccgccgccgaggcacccttcagtcctactttgactgagcggccgtggtgtggcttggggcatagcctcagatatacctaagaagcagcaaggcccttctctcgctttaataaatgcatgaactgtagtgctttgaacaatcacctccttaacagggttcccaaacctgggttactttttgttgacataaggaaggataacttttgataggtcttactttcttctcctaaagttatttacaatttggcttcaaatataaaagttgagtaaatgtataccagggcagaaattagtcatttgagtaacttggccgctaatatttaaccatctacctctgtttttaatcttctttcctaaaggcagcttgaaatgtcggtcctaaccttgtcttcttttcctctttggtggacttgtgaatgttcatattacttcaaagacttaggagaaaaacacagaccctaagtagaaccagatatttgtctatttttcaaaaataattggatgttttttaaaattttgtttttaaataacctagactatgcaaacactggaaaaaaaatgaagtaacttttccatgaatgcttttaacattcttgtgtcaccatttggtactaaactctagtcctgcctcttacctcatttcaagtgggttttcctcccttccttccttccttcctcccttccttctttccttcctttcttccaaaaacttagagaagtgcttggtttaatagagtgaaacttgtagatcctattcctaaaggttgatgatgttcagtatcaacaggtaaaatggcatctttgttaatctgtcttgtttacatatatgcaaattatttaaggcatagagttttaaagcattttttaaaaactaatgcaggtaaaagaaatacatgtgacatgaaataattttaatgttggatattgtatatgtatttttattctaataaagttttgtgttccagattggaaaaaaaa

SEQ ID NO: 1863 - DNA, 1423 bp, Rattus norvegicus
  Genbank Accession No. NM_031034
aggccggggcccgcgcgccatggacgcccctcagccggcgcggcgcggccgcggcctgagggcggtcatgtccggggtggtgcggaccctcagccgctgcttgctgccggccgaggccggagcccgcgagcgcagggcgggcgcggcgcgcgacgcggaacgcgaggcccgacggcgcagccgcgacatcgacgcgctgctggcccgcgagcggcgcgcggtgcggcggctggtcaagatcttgctgctgggcgccggcgagagcggcaagtccaccttcctcaagcagatgcgcatcatccacggccgggagttcgaccagaaggcgctgctggagttccgcgacaccatcttcgacaacatccttaagggctcgagggtgcttgtagacgctcgggacaagcttggcattccctggcagcactctgagaacgagaagcacgggatgtttctgatggccttcgagaacaaggcagggctgcctgtggagcctgccaccttccagctctacgttccagccctgagcgcactctggagagactccgggatcagggaagccttcagccgcagaagcgagttccagctgggtgagtcagtgaagtacttcctggataacttagaccggattggccagctgaactacttccccagtaagcaagacatcctgttggctagaaaggccaccaagggaatcgtggagcatgacttcgtgataaagaaaatcccatttaagatggtggatgtgggcggccagaggtcgcagcgccagaagtggttccagtgcttcgacgggatcacatcgatcctgttcatggtgtcctcaagcgagtatgaccaggtcctcatggaggataggcgcaccaaccggctggtggagtccatgaacatcttcgagaccatcgtcaacaacaagctcttcttcaacgtctccatcatcctcttcctcaacaagatggacctgctggtggagaaggtgaagtcggtgagcattaagaagcacttcccagacttcaagggcgacccgcaccggctggaggacgtccagcgctacctggtccagtgctttgacaggaagcgcaggaaccgcggcaagcctctgttccaccacttcaccactgccatagacaccgagaacatccgcttcgtgtttcatgccgtgaaggacaccatcctgcaggagaacctgaaagatatcatgctgcagtgagacagcccctctgccagtcctctcgtggcctctgtgtggccacatgtctctggtgtgtctgccacctgcatggacctgcagtgggcatctcgaagccacaccatctaatacctggcactaagaatgctggactgtcagccacaccagcgagctgcgggcaagaggatgggagtgtcagtgatagctactgaatcggggactgaaactactgaatcc

SEQ ID NO: 1864 - DNA, 1748 bp, Rattus norvegicus
  Genbank Accession No. NM_031035
ggcgggcgggaaggcgcctcccgcagtcgctcggaactgcggacctgagagcttcccgcagagggccggcggtgggagcggagtgggtcgggcggggccgagccgggccgtgggccgtgtgggggccaggccgggccggcggacggcaggatgggctgcaccgtgagcgccgaggacaaggcggcagccgagcgctctaagatgatcgacaagaacctgcgggaggacggcgagaaggcggcacgggaggtgaagttgcttctgttaggtgctggagaatcagggaagagcaccatcgtcaagcagatgaagatcatccacgaggatggctactcagaggaggagtgccggcagtaccgtgcggttgtctacagcaacaccatccagtctatcatggccatcgtcaaagccatgggcaacctgcagatcgactttgctgacccccagcgtgcggatgatgccaggcagctgttcgcactgtcctgtgctgccgaggagcaaggcatgcttccggaagacctgtcgggcgtcatccggaggctctgggctgaccatggtgtgcaagcctgctttggccgctcacgggaatatcaactcaatgactcagccgcttactacctgaatgacctggagcgcatagcacagagtgactatatccctacacagcaggatgtgctgcggacccgtgtgaagaccacaggcatcgtcgaaacacacttcaccttcaaggacttacacttcaagatgtttgatgtgggtggtcagcgatctgagcggaagaagtggatccactgctttgagggtgtcacggccatcatcttctgtgtcgccttgagcgcgtacgacttggtgctggctgaggatgaggagatgaatcgcatgcatgagagcatgaagctgtttgatagcatctgcaataataagtggttcacagacacctccatcatcctcttcctcaacaagaaggacctgtttgaagagaagatcacacagagccccctgaccatctgtttccctgagtacacaggggccaacaagtatgacgaggcagccagctacatccagagcaagtttgaggacctgaataaacgcaaagacaccaaggagatctacacgcacttcacatgcgccaccgacaccaagaacgtgcagtttgtgtttgatgccgtcactgacgtcatcatcaagaacaacctgaaggactgtggcctcttctgaggggcagtgggcctggcaggatgggccaccgctgactctgctccccactacctgtgaggaagatgggggcaagaagaccatgctccctgcctgttcccccagctgcttctcccctgtctcttctctctgttctcagctcccctgtcccctccctcggctctagacttgggggaggggttgccacaggcctccctgtctaaaacccacctttgtctgaggtgccgggagtggccatggtacctccttactgggcatccattcgggttttctaaccattgtcttgttctgggggtgagcggggagcgcatgcagagtttcccaaggcctatgtctggaggagtaccaattcctccagcctagacccctggctttgtccaacaccagccctgacccaagtccaaatgtttacagggagcctcctgcctaccccactctctgccgcttggaggccccaaaggaaaaagcacaagaagcgtgagagacaccaccattcctggagacaaagcccacctgctcattctcgtagcttt

SEQ ID NO: 1865 - DNA, 1744 bp, Rattus norvegicus
  Genbank Accession No. NM_031039
ctgcagtgtgaagggtgttgtcttacctctcgcagactttcccattcccagccctgatttccccactggacccttctccttctgaaccagcatcctgcctggtttgagcagtcatggcctcacgggtgaatgatcaaagccaggcttcaaggaatgggctgaagggaaaggtgctaactctggacactatgaacccatgtgtgcggagggtggagtatgcagttcgaggacccattgtgcagcgtgccttggagctggagcaggagctgcgtcagggtgtgaagaagccgtttactgaggtcatccgtgccaacattggggatgcacaagccatggggcagagacccatcaccttcttccgccaggtcctggccctctgtgtctaccccaatcttctgagcagtcctgacttcccagaggatgccaagagaagggcagaacgcatcttgcaggcctgcgggggccacagcctgggtgcctatagcattagctctggaatccagccgatccgggaggatgtggcgcaatacattgagagaagagacggaggcatccccgcagacccgaacaacatatttctatccacaggggccagcgatgccatcgtgacaatgctcaagctgctggtatctggcgagggccgtgcacgaacaggtgtactcattcccattcctcagtacccactgtactcagccgcgctggctgaactggacgccgtgcaagtggactactacctggacgaagagcgcgcctgggctctggacatcgcagagctgcggcgcgctctgtgccaggcacgtgaccgttgctgccctcgagtactgtgcgtcatcaaccccggcaaccccactgggcaggtgcagacccgtgagtgcatcgaggccgtaatccgctttgctttcaaagaaggactcttcttgatggctgatgaggtataccaggacaacgtgtatgccgagggctctcagttccattcattcaagaaggtgctcatggagatggggccaccgtattccacgcagcaggagcttgcttctttccactcagtctctaagggctacatgggcgagtgcgggtttcgtggtggctatgtggaggtggtaaacatggatgctgaggtgcagaaacagatggggaagctgatgagtgtgcggctgtgtccaccagtgccaggccaggccttgatggacatggtggtcagtccgccaacaccctccgagccgtccttcaagcagtttcaagcagagagacaggaggtgctggctgaactggcagccaaggctaagctcacggagcaggtcttcaatgaggctcccgggatccgctgcaacccagtgcagggcgccatgtattccttccctcaagtgcagctgcccttgaaagcggtgcagcgtgctcaggaactgggcctggcccctgacatgttcttctgcctgtgcctcctggaagagactggcatctgcgttgtgcccgggagtggctttgggcagcaggagggcacctatcatttccggatgaccattctgccccccatggagaaactgcggctgctgctggaaaaactcagtcacttccatgccaagttcacccatgagtactcctgaagccactgctagggccacactggacagtctctgacgcaacaaaccgagggtccttaggaaccctcagtatttctgattttgtctagggtctcggtaactgtcctgcgggtccctaataaatctgatgtcagcctgaaaaa

SEQ ID NO: 1866 - DNA, 1225 bp, Rattus norvegicus
  Genbank Accession No. NM_031044
aacccaatatggcatctttcatgaggagcttattttctgaccacagcagatatgttgaatcttttcggagatttctaaataattcaacggaacaccagtgcatgcaggaattcatggataagaagcttccaggcataatagcaaggattggagaaacaaaagcagaaattaagattctgagtataggcggaggtgcaggtgaaattgaccttcagattctctccaaagtccaggctcagtacccaggaatctgtattaacaatgaagttgtagagccaaatgccgaacaaattgtcaagtacaaagagcttgtagcaaagacatcaaacatggagaacataaaatttgcttggcataaggagacatcatctgaatatcaaaaacgtgtagtggaagaagacgaagaacctccaaagtgggactttattcatatgattcagatgctatattatgtaaaggatatcccagccaccctgaaattcttccacggtctcttagctgccaatgctaaaattctcattattcttgtgtcaggaactagtggctgggaaaagctatggaaaaaatatggattccgcctacccagggatgacctctgccagtatgtcacatcttctgatcttgctcagatactggacgacctgggtattaagtatgaatgttacgaccttttgtccactatggacataacagactgttttattgatggtaatgaaaatggagacctgctttgggattttttgacagaaacctgcaactttatcaaaacagcaccactggacctcaaagaggaaattatgaaagatcttcaagagcctgaatttagtgttaagaaagaggggaaggtacttttcaacaacaatctgagttttatagtggttgaggcaaatgtataagtcatgagtattcagaactcatattttgaccaaatgctgatttatttacatattaaatacatattatttaaatattgaagttaaaattaatcccataatagaatacaatattatttcttataaatgaaatctacaagtttccaagacaacttagactttctaagaactgagccacttccagttgtgaccttaaaagctaatactcaggctaaacactgcccaactggaaacatgagacttgagtttcattagcttactgatagtaaagttctttccattttcttagtgtactggaaatttttagaatagtaataaaatatgtgtcatcc

SEQ ID NO: 1867 - DNA, 551 bp, Rattus norvegicus
  Genbank Accession No. NM_031051
gggtcacgtagtcaggtcccagacttgggtcacaccgcacttaacaccgtcctccggccgtcgttcgcagtctctccgccaccatgcctatgttcatcgtgaacaccaatgttccccgcgcctccgtgccagaggggtttctctccgagctcacccagcagctggcgcaggccaccggcaagccggcacagtacatcgcagtgcacgtggtcccggaccagctcatgacttttagtggcacgagcgacccctgcgccctctgcagcctgcacagcatcggcaagatcggtggcgcccagaaccgcaactacagcaagctgctgtgcggcctgctgtccgatcgcctgcacatcagcccggaccgggtctacatcaactattacgacatgaacgcagccaacgtgggctggaacggttccaccttcgcttgagcccgggcctcacttacctgcaccgctgttcttcgagtcttgctgcacgccccgttctgtgtttatccacccgtaatgatggccaccttccggtcgggagaaataaatggtttgagacca

SEQ ID NO: 1868 - DNA, 2448 bp, Rattus norvegicus
  Genbank Accession No. NM_031056
ggcatttccaggagcaattccctcacctccaaggcgactgcgctctaggaatcacattccgttcctttagaagacaaaggcgcccaagagagcagcggcgcgaccccagggcgtgggccccgccgcggagccctcactgcccgacgccccgacgccgcggaccatgtctcccgcccctcgaccctcccgcagcctcctgctccccctgctcacgctcggcaccacgctcgcctccctcggctgggcccaaagcagcaacttcagccccgaagcttggctgcagcagtatggctacctacctccaggggacctgcgtacccacacacaacgctcaccccagtcactctcagctgccattgccgccatgcaaaggttctatggtttacaagtgacaggcaaggccgattcggacacgatgaaggctatgaggcgccctcgctgtggtgttccagataagtttgggactgagatcaaggccaatgttcggaggaagcgctatgccattcagggcctcaagtggcagcataatgagatcactttctgcatccagaattatacccccaaggtgggcgagtatgccacattcgaggccattcggaaagccttccgagtatgggagagtgccacgccactgcgcttccgagaagtgccctatgcctacatccgggagggtcatgagaagcaggctgacatcatgatcttgtttgctgagggtttccatggcgacagcacaccctttgatggtgaaggaggcttcctggctcatgcctatttcccaggccccaatatcggaggggatacccactttgattctgctgagccctggactgtccaaaatgaggatctaaatgggaatgacatcttcttggtggctgtgcatgagttggggcatgccctaggcctggaacattccaacgacccctccgccatcatggctcccttttaccagtggatggacaccgagaacttcgtgttgcctgatgacgatcgccgcggcatccagcaactttatggaagcaagtcagggtcacccacaaagatgccccctcaacccagaaccacctctaggccctctgtcccagataagcccagaaaccccacctatgggcccaacatctgtgatgggaactttgacaccgtggccatgctccgaggagagatgtttgtcttcaaggagcgatggttctggcgggtgaggaataaccaagtgatggacggatacccaatgcccattggccaattctggaggggcctgcctgcatccatcaacactgcctatgagaggaaggatggcaaatttgttttcttcaaaggagataagcactgggtgtttgacgaagcttccctggaacccggataccccaagcacattaaggagctgggccgaggactgcccacggacaagattgatgcagctctcttctggatgcccaacgggaagacctacttcttccggggaaataagtactaccgcttcaatgaggagttcagggcagtggacagcgaataccccaaaaacatcaaagtctgggaaggaatccctgagtctcccagaggctcattcatgggtagcgatgaagtcttcacatacttctacaaagggaacaaatactggaaattcaacaaccagaagctgaaggtagagccagggtaccccaagtcagctctgcgggactggatgggctgcccttcggggggccggcccgacgaggggactgaggaggagacggaggtgatcatcatcgaggtggatgaggagggcagcggagccgtgagtgcagctgctgtcgttctgccggtgctgctgctgctcctggtactggcagtgggccttgctgtcttcttctttagacgccatgggacacccaagcgactgctttactgccagcgttcactgctggacaaggtctgacccccaccactggcccacccgcttctaccacaaggactttgcctcctccgaaggcagtggcagccggtggtggcaggtgggctgttctcacccatcctgggctccctccctccagcctcccttctcagtccctaattggcttctcccaccctcaccccagccttgcttcatccataggtgggtcccttgagggctgagcagaagatggtctggcctctggccctcaagggaccctcatagcttggtgtgtgtccaaccctatttgaatgttgtcaaggctctgcacttgaaggcagggccctctgaccttacaggcaaaggccaaatggggtcatctgcttctcttccatccccctagctacatatcttaaatctctgaactatgacctcaggaggctttgggcatatgagccctatacgtaccaagtgtacccagttggcagcctcccgtcactctgactaaaaagaatcttcagagtgcatatttggaggtggaaagattgttcagttaccctaaagactttgaaagaaagaaa

SEQ ID NO: 1869 - DNA, 2059 bp, Rattus norvegicus
  Genbank Accession No. NM_031057
ggcaggagaagtgatctgttatctcacctggcacatgaagcccattcctggaactatgcaaagggcagagtctggtgagccatggcggcggcagtggcggcagcagcagcagtgcggtcccggatcctgcaggtttcttctaaagtaaactccacatggtatccagcatcttctttctcttcatcatcagtgccaactgtaaagctcttcattgatgggaaattcgttgaatccaaaagtgacaaatggattgacatccacaacccagccaccaatgaggttgttggtcgggttcctcagtccaccaaagctgaaatggaggcagccgtagccgcctgcaaacgcgctttccctgcgtgggcagacacatctattttaagccggcagcaggtcctgcttcgttatcagcaactcattaaagaaaacctgaaagaaatcgccaggttaatcacattggaacaagggaagactctggctgatgctgaaggagatgtgttccgaggccttcaggtggttgagcatgcctgcagtgtgacgtccctcatgctgggagagaccatgccatctattaccaaagacatggacctttattcctaccgcctgcctctgggagtgtgtgcaggcatcgcaccatttaattttcctgccatgatccccctttggatgtttcccatggctatggtctgtggaaatactttcctaatgaaaccatcagagcgagtacctggagcaaccatgcttcttgctaagttgcttcaggattctggtgccccggacggaacactgaacatcatccatggacaacatgaagctgtaaattttatttgcgatcatccagacatcaaggcaatcagctttgtgggatccaaccaggcgggagagtacatcttcgaaagagggtcaagaaatggcaagagggttcaagccaatatgggagccaagaaccatggggtagtcatgccagatgccaataaggaaaataccctcaaccagctggttggggcagcatttggagctgctgggcagcgctgcatggctctttcaacagccgtccttgtgggagaagctaagaagtggctgccagaactggtagagcgtgccaagaatctccgcgtcaatgcaggagatcagcctggagctgatcttggtcccctgatcaccccccaggccaaagagagagtctgcaatctgattgatagtggagcaaaagagggggcttccatccttctggatgggcggaaaattaaagttaagggctacgaaaacggtaactttgttggaccaaccatcatctccaatgttaagccaagtatgacttgttacaaagaggagatttttggtccagttcttgtggtcttagagacagaaaccctggatgaagccatcaagattgttaatgacaacccatatggaaacgggactgctatctttaccaccaacggagccatagctcggaaatacgctcacatggtggatgtgggacaggtgggcgtgaatgtccccattccagtgcctttgccaatgttttccttcaccggctctcgatcttccttcaggggagacaccaatttctatggcaaacagggcatccagttttacactcagttaaagactatcacatctcagtggaaggaagaagatgctactctttcctcacctgcagtggtcatgcctaccatggggcgttagaacgttcaagactccatccagcctgagtaacttcccactgtccttggcaatcttcgtctgccatctttgctcaaaacagatccatgaggatggagtatattgcaatgaaattctttctcagaactcgcaatcccttcaaagttatagggagtacaggataacaccaacgccaggccttcacttgttctccatacttctctacggtttttgaggttaactgttgttaagcgtgaagtgtttgcctagaataagagcttagaactgtcttctaacaattcttttctgatgacttggagggacaacgtaggggcccggtccttggcaatcttcgtctgccatctttgctcaaaaacagtccatgaggatggag

SEQ ID NO: 1870 - DNA, 710 bp, Rattus norvegicus
  Genbank Accession No. NM_031065
cttttccggttcccgcagccgcagccatgagcagcaaagtttcacgcgacaccctctacgaggcggtgcgggaagtcctgcacgggaaccagcgtaagcgccgcaagtttctggagacggtggagctgcagatcagcctgaagaactacgaccctcagaaggacaaacgcttctcgggcaccgtcaggcttaagtccacccctcgccccaagttctccgtgtgcgtcctgggggaccagcagcactgtgatgaagccaaggccgtggatatcccccacatggacatcgaggcgctcaagaagcttaacaagaacaagaagttggtcaaaaagctggccaagaagtatgatgcctttttggcctccgagtctctgatcaagcaaatcccacgtatcctgggcccaggcctaaacaaggcgggcaagttcccctccctgctgacacacaatgaaaacatggtggccaaagtggatgaggtgaaatccacaatcaagttccagatgaagaaggtgctgtgtctggccgttgccgtcggccacgtgaagatgaccgatgacgagctagtctacaacatccacctggctgtcaacttcttggtgtccttactcaagaaaaactggcagaacgtccgggctctgtacatcaagagcaccatgggcaagccccagcgtctgtattaggacgctccaataaacctcgttgctgccttc

SEQ ID NO: 1871 - DNA, 3237 bp, Rattus norvegicus
  Genbank Accession No. NM_031074
gtctacgcgctgccccgaacggcggtcggtggcggcggcggtggcgacggtttcctggcggtcgcgcgctgctctggtgagcggcgggtgacggaaggacctgggctctcactccagacacaccgctctttctgaagcaaacactcgttttgaagatgtttaacaaatcatttggaaccccctttggtggtacagggggctttggtacaacgtcaacatttggacaaaatactggctttggtactactagtggaggagcatttggaacatctgcatttggttctagcagtaatactggaggcttatttggtaattcacagaccaaaccaggaggactgtttggtaccagttcacttagccagccagcaacctccacaagcactggttttgggtttggcacatcaacaggaacatcaaatagtttgtttggaactgcaaatacagggaccagtcttttctcatcccagaacaatgcatttgcacaaaataaaccaactggatttgggaattttggaaccagtactagcagtggaggactctttggaactacaaataccacctctaatccttttggtaacacatctggctccctctttgggccaagtagttttacagcagcacctacaggaactaccatcaaatttaatcctcccactggtacagatactatggtcaaagctggagttagcactaacatcagcaccaagcatcagtgtattactgccatgaaagaatatgaaagcaagtcattagaggagcttcgtttggaggactatcaggctaaccggaaaggcccacagaaccaagtgggggcaggtaccacaactggcttatttgggtcttctccagcgacttccagtgcaacaggactcttcagctcttccaccactaattcagccttttcatatggtcagaacaaaactgcctttggaactagcacaactggatttgggacaaatccaggtggcctctttggccaacagaatcaacagactaccagtctcttcagcaaaccatttggccaggctacaaccaccccaaatactggcttttcctttggtaataccagcacccttggacaaccaagcaccaatactatgggcctatttggtgtaacccaagcctcacagccaggaggtctttttgggaccgctacaaacaccagcactgggacagcatttgggacaggaacaggtctctttgggcagcccaatactggatttggtgcagttggttcgacgctgtttggcaataacaagcttacaacttttggaaccagcacaaccagtgctccctcatttggtacaaccagtggcgggctcttcggtaacaaaccaaccctgactttaggaaccaatacaaacacttccaattttggttttggcacaaataacagtgggagtagtatttttggaagtaagccagcagccgggactctgggaacaggacttggtacaggatttggaacagctcttggtgctggacaggcatctttgtttggaaacaaccaacctaagattggagggcctcttggtacaggagcctttggggcccctggatttaatacttcgactgccattttgggctttggcgccccccaggccccagtagctttgacagatccaaatgcttctgctgcccagcaggctgttctccagcagcacctcaatagtctaacatactcaccctttggagactcccctctcttccggaatcctatgtcagatcctaagaagaaagaagagagactgaaaccaaccaatccagcggctcagaaagctcttacaacccctactcattataaacttacacctcgccctgccaccagagtcagaccaaaggctttgcaaacaacaggtacagccaaatcacatctctttgatgggctggatgacgatgaaccatctctagccaacggagcgtttatgccgaaaaagagcatcaagaagttggttttgaaaaatcttaacaatagcaatctcttttctcctgttaatcatgattcagaagatctagcttcaccctctgagtatccagaaaatggagagagattcagcttcctgagcaaacctgttgatgagaaccatcagcaggatggagatgatgactctcttgtatcacgattttacactaatcctattgccaaacctattccacaaactccagagagtgctggaaacaaaaataacagtagcagcaatgtggaagacactttcattgctttgaacatgcgtgctgctttgcgaaatggactggaaggaagcagtgaagaaacgtctttccatgatgagtcattgcaagatgaccgagacgagatagaaaacagtgctttccaaatccatccagcaggcattgttctcacaaaagttggttattatactattccatctatggatgaccttgctaaaattaccaatgagaaaggagaatgcattgtttctgacttcaccattggccgtaaagggtatggctcaatctattttgaaggagatgtgaatttgacaaatctaaatctggatgacattgtgcatatccggaggaaagaagttattgtctatgtagatgataaccaaaagccacctgtgggtgaaggactaaataggaaggctgaagttactttggatggagtttggccaacagataaaacatcccggtgtttaataaagagtccagatcgacttgctgatatcaattatgaggggagattagaagcagtctcaagaaagcaaggggcccaattcaaggagtatcggcctgaaactggttcttgggtgtttaaggtttcccatttttctaagtatggccttcaggattctgatgaagaggaggaggaacacccacccaaaactacttcaaagaagctgaagactgcccctttgccccctgcaggccaggcaaccactttccagatgactcttaatggcaaacctgcaccccccacctcaggtagagaagggcagagaatgtgaatgcggccgtgataaagaagtcagaggtcattcagcttttcagctgttcagcccttggaactaagtgcaagggaggggcacagtgctgcaggctgttatttttttactcaagatttaaagaattctcttgctgtttggatcgttcttctacaaattgtaacttaatttctctcatttggacttgtaatgttttgatcagtgatcagcttgagatagcattttgcttgtgtggggttgatgcaaagtaaatcctacttttattgatttc

SEQ ID NO: 1872 - DNA, 3205 bp, Rattus norvegicus
  Genbank Accession No. NM_031083
ttactatggcatcggtagtgtcctgacagttcggaaagcaggaaagcaagcgccgagaagaaaggctcgggcccagcggactcttacatcgcaacccatcaaggaattgttattttgggtcctgcaagtggggtccggtccaacttgaggtagcgtgaaggccccttcaggcggcgccgcgggcagccccgcagccggggcctggtgcagccgccgcggccgctgtcagggaagcgcaggcggccaatggaacccgggagcggccgctgctgctgaggcggcggtgtcggcagtccgaccccgaccgcctgcaccccctccgcgagggtcccccggagcttggaagctcgaagtctggctgtagccatgggagacatggtagtggagcctgccaccctgaagccaacttctgagcctactcctagcccatcagggaataacgggggctccctactaagcgtcatcacggagggggtcggggaactgtcagtgattgaccctgaggtggcccagaaggcctgccaggaggtactggagaaagtcaagcttttgcatggaggtgtagccatctctagcaaaggcagcccactggagttggttaatggggatggtgtggacaatgagatccgttgcctagatgatccacctaccgagatcagggaggaagaagatgagatggagcctggtgtggtctctggcacagccaaaggaacaagaagaagacgacagaacaactcagccaaacagtcttggctcctgaggctgtttgaatcaaaactatttgacatctctatggccatttcatacttgtataactccaaggagccgggagtgcaagcctacattggcaaccggctcttctgctttcgcaatgaggatgtggacttctatttgccccagttgcttaacatgtatatccatatggatgaggatgtgggtgatgccattaaaccctacatagtccaccgttgtcgccagagcatcaacttttccctccagtgtgccctgttgcttggggcctactcttcagacatgcacatttccactcaacgacactcccgagggaccaagttacggaagctaatcctctcagatgagctgaagccagctcaccgaaagagggagctgccaactttaagcccagcccctgacacaggactgtctccctctaaaaggactcaccagcgctctaagtcagatgccacggccagcataagtctcagcagcaacctgaaacgaacagccagcaaccctaaagtggagaatgaggatgaggagctctcctccagcaccgagagtattgataattcattcagttcccctgtccggctggcccctgagcgagaattcatcaagtccttgatggcaatcggcaaacggctggccacgctccccactaaagagcaaaaaacacaaaggctgatctcagaactttccctgctcaaccataagctccctgcccgagtctggctgcccacagctggctttgaccaccacgtggtccgtgtgccccacacacaagctgttgtcctcaattccaaggataaggctccctacctgatctatgtggaagttcttgaatgtgaaaacttcgacacaactaatgttcctgcccggattcctgaaaaccgaattcggagtacgaggtctgtggagaacctgccggaatgtggtatcactcacgagcagcgggctggcagcttcagcactgtgcccaattatgacaatgacgatgaagcctggtcggtggatgacataggcgagctgcaggtggagctcccagaagtgcacaccaacagctgtgacaacatctctcagttctcggtggacagcatcaccagccaggagagcaaggagcctgtgttcattgcggcaggggacatcagacggcgcctttcagaacagctggctcacactcccacagccttcaaacgagaccctgaagacccttctgcagtcgccctcaaagagccctggcaggagaaagtgcggaggatcagagaaggttccccgtatggccatcttcccaattggcgactcctttcagtcattgtcaagtgtggagatgaccttcgccaggagctgctggctttccaggtgttgaaacaactgcagtccatttgggaacaggagcgagtgcctctttggatcaagccatataagattcttgtgatttcagctgacagtggcatgattgaaccagtagtcaacgctgtgtccatccaccaggtgaagaaacagtcacagctctccttgctcgattacttcctgcaggagcatggcagttacaccactgaggcattcctcagtgcccagcgcaattttgtgcaaagttgtgctggctactgcttggtctgctacctattacaagtcaaggacaggcacaatgggaacatccttctggacgcagaaggtcacatcatccacatcgactttggcttcatcctttccagctcaccccgaaacctgggcttcgagacgtcagcctttaagctgaccacagaatttgtggatgtaatgggcggcctgaacggtgatatgttcaactactataagatgctcatgctgcaagggctgatcgctgctcgcaaacacatggacaaggtggtacagattgtggagatcatgcagcaaggttctcagcttccttgcttccatggctccagcaccattcgcaacctcaaagagaggttccacatgagcatgactgaggagcagctgcagctgctggtggagcagatggtggacggcagcatgaggtccatcaccaccaaactctacgatggcttccagtacctcaccaatggcatcatgtgacaccactttcaggcccagaagtggtgggattgaaggcaccctccttaggaggacccttgcctaagaaaacctaaatcacaaaatcccacctacctaaccacctacccaagggaaatggaaggcaaaaaacacaaaggatcatgtggtaaccatgagagctggccaaagggtaggagagccaaccatggggtccagacttgctggggcttccccacctcttgctgtgtcagtattgccacctgacagatcccaggactcactgccctccagagaacagagatgatgaacatgaggaggactggaaccttcttcccctcggggatctcatcttttactatccctgggtcccagcaagatgggaggagtgggttcttggtacttaggactt

SEQ ID NO: 1873 - DNA, 952 bp, Rattus norvegicus
  Genbank Accession No. NM_031093
cggccaggttgacagttgggcagaagctcttggttcctcttcaagtggtaatgccttcatgccaactttgccgaagtaacctggatgatatttgtcaaagttgatcctgtggtgatgcatgcctccagcattcccgcggcctcctgggtgcttgcggtgcttaccgatgcgaccgtggccgtggctcacgtggccccggagtttccgtcttcctaccagtctggatggcatggcggtgcagattcttttcagtcctctgaagactgcacacaggatggctgcaaacaagcccaagggtcagaattctttggccttacacaaagtcatcatggtgggcagtggtggtgtgggcaagtctgctctgactctgcagttcatgtatgatgagtttgtagaagactatgaacctaccaaagcagacagctacaggaagaaggtagtgctggatggggaggaagtgcagatcgacatcttagatacagcagggcaggaagactacgctgcaattagagacaactacttccgaagtggggaaggattcctctgtgtcttctctatcacagagatggagtcctttgcagctacagcggacttcagggaacagattttaagagtaaaagaagatgagaatgtcccatttctcctggttggtaacaaatcagatttagaagataaaaggcaggtttctgtagaagaggcaaaaaacagagctgaccagtggaacgttaactatgtggagacgtctgctaaaacgcgcgccaacgttgacaaggtattttttgatttaatgagggaaatacgagccagaaagatggaagacagcaaagaaaaaaatggaaaaaagaagaggaaaagtttagccaagagaatcagagaaagatgctgcattttataatcaaagcccaaactcctttcttatcctgacctgaccatactaataaatataatttat

SEQ ID NO: 1874 - DNA, 1069 bp, Rattus norvegicus
  Genbank Accession No. NM_031099
tcgcttgcgtcctggaggtgctacatactgcgcatgcgtacgcgactccggtctttttccccctagcgcggccgactctgcaggtctgcgtggagccgcagttgcgggtctctgttccgcaggatggggttcgtgaaagttgtcaagaataaggcctactttaaaagataccaagtgagatttagaaggcggcgagagggtaaaactgactactatgcacggaaacgattggtgatccaggacaaaaataagtacaacacaccgaaatacaggatgatagttcgtgtaacgaacagagacatcatctgccagattgcatatgcccgtatagaaggggatatgatcgtctgtgcagcatatgcacatgaacttccaaaatacggtgtgaaagttggcctgacaaactatgctgcagcctattgcactggcctgctgctggcccgcaggcttctgaataggtttggcatggacaagatctatgaaggccaagtggaggtgaatggagacgagtacaatgtggaaagcatagacggtcagcctggtgccttcacttgctatctggatgcgggtcttgcccgaactacaactggcaataaagtttttggcgccctgaagggagctgtggatggaggcttatctatcccccatagtactaaacgattccctggctatgactctgaaagcaaggagttcaatgcagaggtgcaccggaagcacatcatgggtcagaatgtggcagactacatgcgctacctgatggaggaggatgaggatgcgtataagaaacagttctctcagtacatcaagaacaacgtgactccagacatgatggaggagatgtataagaaagctcatgctgctatccgagagaatccagtctacgagaagaagcccaagagagaagtgaagaagaagaggtggaatcgtcccaaaatgtctcttgcccagaagaaagaccgggttgctcaaaagaaggcaagcttcctcagagctcaggaacgggctgctgaaagctaaagccattttctatgaagattttttcataaagacaataaacattgatcaaagc

SEQ ID NO: 1875 - DNA, 769 bp, Rattus norvegicus
  Genbank Accession No. NM_031100
tcaggcctgggagcgtctcttttcctctggcaccccatcgacgatcctagttgtcatcatgggccgccgccccgcccggtgttatcgctattgtaagaacaagccatacccaaagtctcgtttctgtcgtggtgtccctgatgctaagatccgcatctttgacttgggacggaagaaagcaaaagtggatgaatttccactttgtggccacatggtgtcagatgaatatgaacaactctcttctgaagctctggaggctgctcgtatttgtgccaacaaatacatggtaaagagttgtggcaaggatggctttcatatccgggtgaggctccaccctttccatgtcatccgtatcaacaagatgttgtcctgtgctggggctgacaggctccagacaggtatgcgtggtgcctttgggaaaccccaggggacagtagccagggttcacattggccaagtcatcatgtctatccgaaccaagctgcagaataaggaacatgtgattgaggctctgcgcagggccaagttcaagttccctggccggcagaagatccacatctcaaagaaatggggttttaccaagttcaatgcagatgaatttgaagacatggttgctgagaagcggctcattcctgatggctgtggtgtcaaatatatccccaatcgtggtcctcttgacaagtggagagccctgcattcctgaaggcttccacagtgcgctcctatgcgctatcaaatgaggttcaataataaagtctcgcgttcaaaa

SEQ ID NO: 1876 - DNA, 703 bp, Rattus norvegicus
  Genbank Accession No. NM_031103
ctttcctttcgctgctgcgtctgcagccatgagtatgcttaggctacagaagaggcttgcctctagcgtcctccgctgtggtaaaaagaaggtgtggttggaccccaatgaaaccaacgaaatcgccaatgccaactctcgtcaacagatcaggaagctgatcaaagatggcctgatcatccggaagcctgtgactgtccattcccgggctcgatgccggaagaacaccttggcccgacggaagggcaggcatatgggcatagggaagaggaagggtactgccaacgctcggatgcccgagaaggtgacctggatgcgaaggatgaggatcctgcgccggcttctcaggagataccgggaatctaagaagattgaccgtcatatgtatcacagcctgtacctgaaggtcaaagggaatgtgttcaaaaacaagcggattctcatggagcacatccacaaactgaaggcagacaaggcccgcaagaagctactggctgaccaggctgaggctcgcaggtctaagaccaaggaagcacgaaagcgccgggaggagcgcctccaagccaagaaggaggagatcatcaagactctgtccaaggaggaagagaccaagaaatgaagcgtccctcgtgtctgtacatagtggccaggctatggcctcacatggatcagtcattaaaataaaacaagccttcgtccttgt

SEQ ID NO: 1877 - DNA, 465 bp, Rattus norvegicus
  Genbank Accession No. NM_031104
ctcctctgccgccatggctcctgtgaaaaagcttgtggcgaaggggggcaaaaaaaagaagcaggttttgaagttcacccttgactgcactcaccctgtagaagatggaatcatggatgctgccaattttgagcagttcctccaggagaggatcaaggtgaacgggaaagctggtaaccttggcggaggggttgtgaccatcgagcggagcaagagcaagatcactgtcacttccgaggagcctttctccaaaaggtatttgaaatatctcaccaaaaaatatttgaagaagaacaacctccgagactggctgcgcgtcgttgccaacagcaaggagagctacgagctgcgctacttccagatcaaccaggacgaggaggaggaggaggacgaggattaagacacattggtctgccatgttttgtattaattcataaataaaatttaggaacaaaaaaaaaaaaa

SEQ ID NO: 1878 - DNA, 688 bp, Rattus norvegicus
  Genbank Accession No. NM_031108
ggcgcagcgggcctagcctagtcaacatgccggtcgccagaagctgggtttgtcgcaaaacctatgtgaccccacggagacccttcgagaaatcgcgtctcgaccaggagctaaagttgattggagagtatggactccggaacaaacgtgaggtgtggagggtcaaatttaccctggcgaagattcgtaaggctgcccgggagctgttgacgctggacgagaaggatcctcggcgtctgtttgaaggcaacgctctgctgagacgacttgttcgaattggggtgctggatgagggcaagatgaagctggattacattctgggcctgaagattgaggatttcttggagagaaggctgcagacccaggtctttaagctgggcctggccaaatctattcaccatgcccgtgtgctcatccgccaacgtcacatcagggtcctcaagcaggtggtgaacatcccatctttcattgttcgcctggactctcagaagcacattgacttttccctcctttctccttatggtggtggccgcccaggacgagtgaagaggaagaatgccaagaaaggccagggtggtgctggagctggtgatgatgaggaagaggattaattaattaattaataccttgttgcactggaggattgtctagttttcccgttgacaaataaaacagaattgatacttga

SEQ ID NO: 1879 - DNA, 534 bp, Rattus norvegicus
  Genbank Accession No. NM_031110
agatggcggacattcagacggagcgtgcttaccaaaagcagcctacaatctttcaaaacaagaaacgtgttttgctgggagaaactggcaaggaaaaactccctcggtactacaaaaacatcggtctaggcttcaagacgcccaaggaggccatcgagggcacctacatagacaagaaatgccccttcactggtaatgtctccatccgaggacggatcctgtctggtgttgtgacgaagatgaagatgcagaggaccattgtcatccgccgggactatctccattatatccgaaagtacaaccgctttgagaagcgtcacaagaacatgtctgtgcacctgtccccctgtttcagggacgtccagattggcgacattgtcactgttggagagtgcaggcctctgagcaagactgttcgattcaatgtgctcaaggtcaccaaggctgctggcaccaagaagcagttccagaagttctgaggggggactgtagccaatgctctagaacaaataaaagttattttccaacttacag

SEQ ID NO: 1880 - DNA, 359 bp, Rattus norvegicus
  Genbank Accession No. NM_031111
tttctgtgttctccgtagacccgtgagcagggacggcctcggtatgcagaacgacgccggcgagtttgtggacctgtacgtgccgcggaaatgctccgcgagcaaccgcatcattgctgccaaggaccacgcgtccatccagatgaatgtggccgaggttgacaggagtacaggccgatttaatggtcagtttaaaacctacggcatctgcggggccattcgcaggatgggcgagtcagatgattctattctccgattggctaaggctgatggaattgtctcaaagaacttttgagccagaagaaatcgggaataatttgttataaataaaagtgataataagtaaaaaaaaaaaaaaa

SEQ ID NO: 1881 - DNA, 466 bp, Rattus norvegicus
  Genbank Accession No. NM_031112
tcctcctttacagctcgggcaccgtagccatcatgaatgacacggtaaccatccggaccaggaagttcatgacaaaccgtctgcttcagaggaaacagatggtcattgatgtccttcatcctgggaaggccacagtaccaaagacagaaattcgggaaaagctggccaagatgtacaaaaccacaccagatgtcatctttgtatttggattcagaacccactttggtggaggcaagacaactggctttggcatgatctatgattctttagattatgcaaagaagaatgagcctaaacacagacttgcgagacatggcctttatgagaagaaaaagacctcccgcaaacagcgaaaagaacgaaagaacagaatgaagaaggtcagggggactgcaaaggccaatgttggtgctggcaaaaagccaaaggagtagttctacggtgacttgatgttctgctgtgatat

SEQ ID NO: 1882 - DNA, 552 bp, Rattus norvegicus
  Genbank Accession No. NM_031113
  misc_feature (1)..(552): n = a or c or g or t
cttcctttccgatccgccatcgttggtggagcagccgccacgatgcagatttttgtgaagacccttacagggaagaccatcacgctcgaggttgaaccctcggacactatagaaaatgtaaaggccaagatccaggataaggaaggaattcctcctgatcagcagaggttgatctttgctggtaagcagttggaagatggccgtactttgtctgactacaacattcaaaaggagtccactctccatctcgtgctgagacttcgtggtggcgctaagaaaaggaagaagaagtcttacaccaccccaaagaagaacaagcataagagaaagaaggtcaagttggctgtgctgaaatactataaggtggatgaaaatggcaaaatcagccgacttcgtcgggaatgtccttctgatgaatgtggtgctggagttttcatgggtagccactttgacaggcattactgtggcaagtgttgtctgacttactgcttcaacaaaccagaagacaagtagttgtgtatgagttaataaagagaaggaactgatgttaan

SEQ ID NO: 1883 - DNA, 573 bp, Rattus norvegicus
  Genbank Accession No. NM_031114
aagactgcagcgcctcagggcccaggtttcaacagattcttcaaaatgccatcccaaatggagcatgccatggaaaccatgatgcttacatttcacaggtttgcaggggaaaaaaactacttgacaaaggaggacctgagagtgctcatggaaagggagttccctgggtttttggaaaatcaaaaggaccctctggctgtggacaaaataatgaaagacctggaccagtgccgagatggaaaagtgggcttccagagctttctatcactagtggcggggctcatcattgcatgcaatgactattttgtagtacacatgaagcagaagaagtaggccaactggagccctggtacccacaccttgatgcgtcctctcccatggggtcaactgaggaatctgccccactgcttcctgtgagcagatcaggacccttaggaaatgtgcaaataacatccaactccaattcgacaagcagagaaagaaaagttaatccaatgacagaggagctttcgagttttatattgtttgcatccggttgccctcaataaagaaagtctttttttttaagttccg

SEQ ID NO: 1884 - DNA, 1796 bp, Rattus norvegicus
  Genbank Accession No. NM_031115
tttgttaacagtcttgccacctccttcagggagcagcagcctcaagcctggctgtggatctgatcggactgggtaggtccagccatggtctctctgggcttggaggtcgcccagggtcctggaccacgtgcaggtcgctgagctggacgcagaaccggccaccaagctcctgaaggggccagaacgcaaaggggagcaacagtgggcggagcatgctcagcaccatgagaccccggctgtccctgcttctgctgaggctgttgctgctcaccaaagcagcgcacaccgttggagttccgccccgactgtgtgacgtgcggcgtgtgctgcttgaggaacgggcccactgcctacagcaactctccaaagagaagaaaggagcactgggcccggagacagcatcaggctgtgaggggctttgggacaacatgagctgctggccctcctctgcaccagcacggacagtggaagtgcagtgtccgaagttcctcctgatgctctcaaacaaaaatgggtctctgttccggaactgcacacaagatggatggtcagaaaccttccccaggcctgacctggcctgtggggtcaacataaacaactcctttaatgagagacggcatgcgtacctgctgaaactcaaggtcatgtacactgtaggctacagttcctccttggccatgctcctggtcgccctcagcatcctgtgctctttccggaggctgcactgcactcgcaactacatccacatgcacctgttcgtgtccttcatcctgcgcgccctgtccaacttcatcaaggacgccgtactcttctcctcggacgacgtcacctactgtgatgcccataaggtgggctgcaagctggtcatgatcttcttccagtactgcatcatggccaactacgcatggctgctggtggagggcctctaccttcacacactccttgccatctccttcttctcagaaaggaagtacctgcaggcctttgtgctcctcggatggggttctccagccatttttgttgctttgtgggctatcaccaggcactttctagaaaatactggatgctgggacatcaacgccaatgcttccgtctggtgggtcattcgagggcctgtgattctgtccatcctgatcaatttcatcttcttcataaacattctaagaatcctgatgaggaaacttagaacacaagaaacaagaggaagtgaaacaaaccattataagcgcctggccaagtccaccctcctgctgatcccgctctttggcatccactacattgtcttcgccttctccccagaggacgccatggaggtccagctgttcttcgaactggccctgggctccttccagggtctggtggtagctgtcctttactgcttcctcaatggtgaggtgcagttggaagttcagaaaaaatggcgccagtggcaccttcaagagttcccgctgcgccctgtggccttcaataactccttcagcaacgccaccaacggccccacccacagcaccaaggctagcactgagcaaagccggagcatccccagggccagtatcatctgaggctgcagcaaggcgccagcggacgaagggttggatattcggtaggacggacatctgtctgatagccatctcgtgctcgactggctgaacaggcttgtctctcgggtccgagcttcctcggagatcaagcaagaggagactactaggtcatcgcggagcaggaaacggacccatgacttggtttttcttgttcttctaagaagagcaattcagcaactccagaaggggcagggg

SEQ ID NO: 1885 - DNA, 1777 bp, Rattus norvegicus
  Genbank Accession No. NM_031127
cagcctcaccttttctgatgataactcaaggactcggggatggaaagtcatggggaccctgataggccttggtgccgtgctggcctatcatgaccatcggtgtagggcttctcaggagtcaccacggatatactctaaagaggatgtgcgttctcacaacaaccttcaaactggagtctgggtaactctaggctctgaggtcttcgatgtcacaaaatttgtggacctgcatccaggaggacaatcaaaactgatgctagctgctggaggtcccctagaacccttctgggccctctatgctgttcacaaccagccccatgtacgtgagttactggctgagtataagattggggagctgaaccccgaagatagaatgtcccctcccttggaggcctctgacccttattccaatgaccctatgcgtcatccagccctgaggattaatagccagcgcccctttaatgcagagcctcctcctgaactgcttacagaaagctacatcacaccaaaccctattttctttacccggaaccatctgcctgtacctaacctggacccagacacctatcgcttgcatgtagtaggggcacctggaggtcagtcgctctctctctccttggatgatttgcataagttccccaaacatgaggtcactgtcactctgcagtgtgctggtaaccggcgctcggagatgaataaggtcaaggaagtgaaaggtctggagtggagaacaggggccatcagcacggcacgctgggccggggcacggctctgtgatgtcttagcccaggctggtcaccgactccgtgaaaccgaggcccatgtctgttttgaaggactggattcagaccccactggaactgcctatggggcatccatccctctggctcgggccatggatccccaagccgaggtcctcctggcttatgagatgaatggtcagcctctgcctcgtgaccatggcttccccgtaagggtggtggttcctggtgtggtaggtgctcgccatgtcaagtggttgggcagagtgagtgtggagtcagaggaaagttatagtcactggcagaggcgggattacaaaggcttttctccatctgtggactgggacactgtagactttgatctagccccatcaattcaggaactacccatccagtcagctatcacacagcctcaagatgggacgactgtagaatcaggagaggtgattatcaagggctatgcatggagtggtggtggtagggctgtgattcgagtggatgtgtctatggatggtggactgacctggcaggaagctgagctggagggagaggaacagcatcccaggaaggcctgggcttggcgaatatggcagttgaaagctcacgtgccagctgagcagaaggaattgaacatcatttgtaaagcggtagatgacagttacaatgtgcagccagacactgtggccccaatctggaaccttcgaggcgtgctcagcaatgcctggcaccgtgtccacgttcaggtggttccatgaaagcatggaacagcagtttgtacccaaaggacccctacacctctttaccaacccagccttaatcctcggtgccatagataaacgtttccttcctctactgaggggagaaagcagctctcaagacatcactttcttaccctaccatacctttacttctcatgcctcccctcaggccttgttttgcattgcttagattcttcagatatgtgtgtgatgtatggaatgtgtaaaaactgtacgttatttctttttcttcttccc

SEQ ID NO: 1886 - DNA, 2460 bp, Rattus norvegicus
  Genbank Accession No. NM_031134
agggtaattagacctctgcctggcggtagtagatcccgagatgaaaggggctctggcgtcactggcaggattttatgtccatgaatgcagggaacaaaccagaaacccccccaattctcccctgcgagtgaaagctattatatctgaaaatgacatctttctcaaaacgtttcaccgagcgtcgctcctggacagagccgcaggggggatgaggtatctccagacaggacaagtctctgaagacttcccagcccctaacccagtaccatttaccaagccagcttgcccctagctctcccacctgccactccccagcccctctaaccaccggccctcccgtttttttggggcacagggcatggtgtgaaaggctgagtactgagggggatactatgggtgctgtcccctagggcctgggtggcggggggtgggtggcctgtgggcgtggggggggggcagtgtgcccaccccagtctcttggcgtgctggagggcatcccggatggaattgaagtgaatggaacagaagccaagcaaggtggagtgtgggtcagacccagaggagaacagtgccaggtcaccagatggaaagcgaaaaaggaagaacggccaatgtcccctgaaaagcagcatgtcagggtatatccctagttacctggacaaagacgagcagtgtgtcgtgtgtggggacaaggccaccggttatcactaccgctgtatcacttgtgagtgctgcaagggcttctttcgccgtacaatccagaagaacctccatcccacctattcctgcaaatatgacagctgctgcgtcatcgacaagatcacccggaatcagtgccagttgtgccgcttcaagaagtgcatcgctgtgggcatggccatggacctggttctagacgattcaaagcgggtggccaaacgcaagctgattgagcagaaccgggagaggaggcgaaaggaggagatgatccgctcgctgcagcaacgaccagagcccactcctgaagagtgggatctgatccacgttgctacagaggcccatcgcagcaccaatgcccagggcagccattggaaacagaggcgaaaattcctgccggatgacattggccagtcacctattgtctccatgccggacggagacaaggtagacctagaggccttcagcgagtttaccaagatcatcaccccggccatcacccgcgtggtggactttgccaaaaaactgcccatgttctccgagctgccttgtgaagaccagatcatcctcctgaagggctgctgcatggagatcatgtccctgcgggcagctgtccgctatgaccctgagagcgacaccctgaccctgagtggggagatggcggttaagcgggagcagctcaagaatggtggcttgggtgtagtctccgacgccatctttgaactgggcaagtcactctctgcctttaacctggatgatacggaagtggctctgctgcaggctgtgctgttaatgtcaacagaccgctctggcctgctgtgtgtggacaagatcgagaagagtcaggaggcctacctgctggcgtttgagcactacgtcaaccaccgcaaacacaacattccgcacttctggcccaagctgctgatgaaggagagagaagtgcagagttcgattctgtacaagggggcagcggcagaaggccggccgggcgggtcactgggcgtccacccggaaggacagcagcttctcggaatgcatgttgttcagggtccgcaggtccggcagcttgagcagcagtttggtgaagcgggaagtctccgagggccggttcttcagcaccagagcccgaagagcccgcagcagcgtctcctggagctgctccaccgaagcggaattctccattcccgagcggtctgtggggaagacgacagcagtgaggcaagctccctgagctcctcttcctctgacgaggacacggaggtctgcgaggacctggcaggcaaggcagcctctccctgaggccccttggagggcgatggggaaggagaaggagcatgctactccttctccagggcctctgccctagagctgggcacgcccacatgctgggagcaaggccacaggctggccgcctcccactcaagaccaccctcctacccctgagcacgccacacgtggccaagctcccttgttatttgttctgtagttccctctgcctgggatgcccttccccctctctatgcctggcaataccttgtccctttgaggccccactcaagtgtcacctccttccccagctctcccaggcagaaatagttgtctgtgcttacgtggttcatgcttcttctgtgacacttctcactgttttataattagtcgggcatgagtctgtttcccaagctagactgtgtctgaatcatgtctgtagcccagtgcccagtgccgggcctggcatagagtaggaactccataaaaggtatgttg

SEQ ID NO: 1887 - DNA, 3115 bp, Rattus norvegicus
  Genbank Accession No. NM_031135
ggagggaacacggtgcctcgggttgtgtacacgctccactgacagagcttcttgcagccgggcagccgctgatcacgcgtggccccgccagcccattggctgaggcctcacacacctttgccgctgattggtcgataccacgccccgccttccaccccgcccgcggcgcggggcaggcagagcggctacctgcatggggagggggggcagacagcgcggagcgcggtggcgtcgacgtctagtgtctcagtgctccgtctgtggctaggcagccagcagccaagcagctcgcgacctacggccaggcagccaaccatgcttaacttcggcgcttctctccagcaagcttcggaggggaaaatggaactaatttctgaaaagtccaaagagggagcacatccctgggacaaagctgaacagagtgactttgaagctgtggaagcgctcatgtccatgagctgcgactggaagtctcacttcaagaaataccttgaaaacaggcctgtcacaccagtgtctgatacctcagaggaagacagtttgcttccagggacgcctgaccttcagaccgtcccagcattctgtttgactccaccttacagcccctctgacttcgaaccctcgcaggggtcaaatctgacggcaccagcgccacctactggtcacttcagatcgctctccgatgctgccaagcctcccagcatcgctccttttaaagaggaggaaaagagcccattagctgcccctcccctccctaaggctcaagccaccagtgtcatccgtcacacagctgatgcccaactctgtaaccaccagtcctgccctgtgaaagcagctagcatcctcaactaccaggacaattctttccggagaagaacccacataaatgtcgaggctactcgaaagaacataccctgtgctgctgtgtcaccaaacagacccaagcctgagcccagcacagcggcgaatggcgctgagaaggccggcactgcgccgtatgactttgctgtgccttcctcagagacagtcatctgtaggtcttctcagccagctcccacgtccccagtacagaagtcagtactgatgtcttcacctacagtgtccactgggggagtgccacccttgcctgtcatctgccagatggttccccttccagcaaacaactctctcgttaccacagttgtccccagcagtccgcccagccagccacccgctgtctgctcacccgtgttgttcatgggcactcaggtgcccaagggcacggtcatgtttgtggtaccccagcccgttgtacagagcccaaagcctccagtggtgagccccaatggcaccagactgtctcccattgcccctgcgcctggattctctccttcagcagcaagggttactccccagattgattcgtccagagtaagaagtcacatctgtagccacccaggatgtggcaagacttactttaaaagttcccatctgaaggcccacgtgagaacacacacaggggaaaaacctttcagctgcagctggaaaggctgtgaaaggaggtttgctcgttccgatgaactgtccagacaccggcggacacacacaggtgagaagaaatttgcctgtcccatgtgtgaccgtcggttcatgagaagtgaccatttaaccaaacatgcccggcgacacctatcagccaagaagctgccaaactggcaaatggaagtgagcaagttaaatgacatcgctctgcctccggccacagcgtcggcacagtgacggccagaagatggagactcagaataaactttggtcagagtcgagccggtgaccgtgtcaaatgcttctgcaagtctgcggccctccaacagggcctaaagcagaagcccctggcctggggggaggcccagcctgggttagatgacgagaagtgcttcagccacaggcagttcacagaagggcggggttcatttcttaccacgtagagagatgagaacactcgtgtcccttgagtagttttggaaggtttcggatgagatgagcacagcacaggttttgaatcacatacacatcaggtactttgtttttgccatttatacttgagaccagctttgcagtgtgattcttttaaagcgttggtttcgagaatatagaggctgaaattacggtacagaaatgcagctagaaagtgagtttgtgtcatcttctcctagagttatcttgcttattattcctagtctttacagtcaactccgtggacgtggctaagtatagaaaactatcatttcttccactgttgttggtatttgaggttgaacagctgtacattgctaaggggagcccaaggattggaactctcattaatttaattgcttggaagtgcagctaaagttcttttttttggccttttgttttgaaagtttaggcattttactctaccttagatattagtttgcttgcagttttttgtgtagatttgaaaactgtacaccaatgtgtttcctatagacttaagatacgctgcgctttgtttagaaaacaatctggcagtgaaaatatgtgtcgtaaagaagagatgtcaagaatttgagatgactccttgagaaagatggcttatgtcatcagcaaaggacacttacgtcagacgtacactgtttctatcaaatcaggaagttagtgaccatcacagatggacaggtgtccttttatttataggagtttgtcaggatgtctgagtagataggtaggaaattgttactagaacattcacttccgacttgacaaggatattcatggtgcagatacgttcttcctgccgctgcagtgtctgggtgtccgggaaactccgagactttaaagtgtcataatgtggtcacacctgcagttctggggatccagagccttgcttgtgttctgtaagctctgtcaccgagttgtatccccacctgaaagcagtgacttttgctaacagtatttctgttctgttgtaaagtggatagaagacacacttggtagtaaaggtaaattattcaaagtccacagtgaaaaactcaccataccttcccatttaaaccgtttctgtatctcataggtttctgacatgcaaacttgaacccttgaaaaaaagagttttctt

SEQ ID NO: 1888 - DNA, 686 bp, Rattus norvegicus
  Genbank Accession No. NM_031136
gcggcctctgagcagatcgtctctccttgttcgcccagctcgctcagctccttccagcaaccatgtctgacaaacccgatatggctgagatcgagaaattcgataagtcgaagttgaagaagacagaaacacaagagaaaaatcctctgccttcaaaagaaacaattgaacaagagaagcaagctggcgaatcgtaatgaggcgagcgccgccaatatgcactgtacattccacgagcattgccttcttattttacttcttttagctgtttaacttcgtaagatgcaaagaggttggatcaagtttaaatgactgtgctgcccctttcacatcaaagaatcagaactactgaccaggaaggcctccccccgcctctcccgcccacctgctggcctggctggcagagagggaaaagaacttgcatgttggtgaaggaaaaagctgggtgggagatggtggaattgagagtaaaataaagatgtcttgcaggatataaaatgcagtttaatcagagtgccatttttttttgttcaaacgattttaattattggaatgcacaatttttttaatatgcaaataaagttttaaaacctgaaaaaaaaaaaaaaaaagaaacaacagtcgttatggccataaaacacatcatctgtgattttggagagaaccactggaaagaaagtttgagg

SEQ ID NO: 1889 - DNA, 1796 bp, Rattus norvegicus
  Genbank Accession No. NM_031140
gttcacagccactgcgccctcgctctcttcttgcagatcttgcagccgcagcaagccaggccacctcgtccttcgaagccatgtccaccaggtccgtgtcctcgtcctcctaccgcaggatgttcggtggctccggcacatcgagccggcccagctccaaccggagctatgtgaccacatccacccgcacctacagcctaggcagcgcgctgcgccccagcactagccgcagcctctattcctcgtccccgggtggcgcctatgtgacccggtcctccgccgtgcgcctgcggagcagcatgcccggcgtgcggctgctgcaggactccgtggacttctcgctggccgacgccatcaacaccgagttcaagaacacccgcaccaacgagaaggtggaattgcaggagctgaatgaccgcttcgccaactacatcgacaaggtgcgcttcctcgagcagcagaacaaaatcctgctggccgagctcgagcagcttaagggccagggcaagtcgcgcctgggcgacctctacgaggaggagatgagggagttgcgccggcaggtggatcagctcaccaatgacaaggcccgtgtcgaggtggagagggacaacctggccgaggacatcatgcggctgcgagaaaaattgcaggaggagatgctccagagggaggaagccgagagcaccctgcagtcattcagacaggatgttgacaatgcttctctggcacgtcttgaccttgaacgtaaagtggaatccttgcaggaagaaattgcctttttgaagaagctgcacgatgaagagatccaggagctgcaggcccagattcaggaacagcatgtccagatcgatgtggacgtttccaagcctgacctcaccgctgccctgcgtgatgtccgccagcagtatgaaagtgtggctgccaagaacctccaggaggccgaggaatggtacaagtccaagtttgctgacctctctgaggctgccaaccggaacaacgatgccctgcgccaggcaaagcaggagtcaaacgaataccggagacaggtgcagtcactcacctgcgaagtggatgcccttaaaggcactaatgagtccctggagcgccagatgcgtgaaatggaagagaattttgcccttgaagctgctaactaccaggacactattggccgcctgcaggatgagatccagaacatgaaggaagagatggctcgccaccttcgtgaataccaggacctgctcaatgtaaagatggctcttgacattgagatcgccacctacaggaagctgctggaaggggaggagagcaggatttctctgcctcttccaaacttttcttccctgaacctgagagaaactaacctggagtcacttcctctggttgacacccactccaaaagaacactcctgattaagacggttgaaaccagagacggacaggtgatcaatgagacttctcagcaccacgatgaccttgaataaaaactgcacaggctcagtgcaacggcgcagtaccagcaagaaggaaaaaaaaatcgtatcttagaaaaaagagctttcaagtgcctttactgcagttttcaggagcgcaagatagatctgggatagaaacgagctcagcacataacaactgacacccccaaaaggcgtagaaaaggtttacaaaataatctagttttacgaagaaatcttgtgctagaatactttttaaagtatttttgaataccattaaaactgctttctttttccagaaaatatctgaccaacttgttactgcttcaataaaacttcagaaat

SEQ ID NO: 1890 - DNA, 1128 bp, Rattus norvegicus
  Genbank Accession No. NM_031144
atggatgacgatatcgctgcgctcgtcgtcgacaacggctccggcatgtgcaaggccggcttcgcgggcgacgatgctccccgggccgtcttcccctccatcgtgggccgccctaggcaccagggtgtgatggtgggtatgggtcagaaggactcctacgtgggcgacgaggcccagagcaagagaggcatcctgaccctgaagtaccccattgaacacggcattgtaaccaactgggacgatatggagaagatttggcaccacactttctacaatgagctgcgtgtggcccctgaggagcaccctgtgctgctcaccgaggcccctctgaaccctaaggccaaccgtgaaaagatgacccagatcatgtttgagaccttcaacaccccagccatgtacgtagccatccaggctgtgttgtccctgtatgcctctggtcgtaccactggcattgtgatggactccggagacggggtcacccacactgtgcccatctatgagggttacgcgctccctcatgccatcctgcgtctggacctggctggccgggacctgacagactacctcatgaagatcctgaccgagcgtggctacagcttcaccaccacagctgagagggaaatcgtgcgtgacattaaagagaagctgtgctatgttgccctagacttcgagcaagagatggccactgccgcatcctcttcctccctggagaagagctatgagctgcctgacggtcaggtcatcactatcggcaatgagcggttccgatgccccgaggctctcttccagccttccttcctgggtatggaatcctgtggcatccatgaaactacattcaattccatcatgaagtgtgacgttgacatccgtaaagacctctatgccaacacagtgctgtctggtggcaccaccatgtacccaggcatcgctgacaggatgcagaaggagattactgccctggctcctagcaccatgaagatcaagatcattgctcctcctgagcgcaagtactctgtgtggattggtggctctatcctggcctcactgtccaccttccagcagatgtggatcagcaagcaggagtacgatgagtccggcccctccatcgtgcaccgcaaatgcttctag

SEQ ID NO: 1891 - DNA, 895 bp, Rattus norvegicus
  Genbank Accession No. NM_031152
atgggcacccgcgacgacgagtacgactacctctttaaagttgtccttattggagattctggtgttgggaagagtaacctcctgtctcgatttactcggaatgagtttaatctggaaagcaagagtaccattggagtagaatttgcaacaagaagcatccaggttgatgggaaaacaataaaggcacagatatgggacacagcagggcaggagcggtacagggctataacgtctgcatactatcgtggagcagtaggtgccttattggtttatgacattgctaagcatctcacatatgaaaatgtagaacgatggctgaaagaactgagagatcatgctgatagtaacattgttatcatgcttgtgggcaataagagtgatttacgtcatctcagggcagttcctacagatgaagcaagagcatttgcagagaagaatggtttgtcgttcattgagacatctgctctagattctacaaatgttgaagctgcttttcagacaattctaacagagatataccgcattgtttctcagaagcaaatgtcagacagacgtgaaaatgacatgtctccaagcaacaatgtggttcctattcatgtcccacccaccactgagaacaagccaaaggtgcagtgctgtcagaacatctaaggcgcctctctcccctagacggctgtgtatagtccatttcccaggtctgagatttaaatatatttgtaattcttgtggtcactttctgtgttttattacttccttacacttaagaatcttcccatgtcttaagtctttgatttggctttataaaatcctcaactttgtcctgaatgactcgagttctttttcatgctatggcttctctagccttagtttaataaactgaatgtttgaagtcctc

SEQ ID NO: 1892 - DNA, 1531 bp, Rattus norvegicus
  Genbank Accession No. NM_031237
ctctgggcgaagcgcggatataagtagctggtggctctgccaccccaccctgcccggatcgcgacggttttcagggttctggaatcagcagggttcctctgaggccttggcgagtggctgatctgctccgtttttgcaaaaggcgcctgtgtctggcagagccggtgtgagaagaagagagaatccttccccgccgccgggataatcaagagttttggccggacctttgagtacacatcgggatagtgagaagcccggcgaaaagcacagactatggcgctgaaacggattaataaggaacttagtgatttggcccgtgaccctccagcacaatgttctgcaggtccagttggagatgacatgtttcattggcaagccacaattatgggacctaatgacagcccatatcaaggtggtgtattctttttgacaattcattttcctacagactaccccttcaaaccacctaaggttgcatttacaacaagaatttatcatccaaatattaacagtaatggcagcatttgtcttgatattctaagatcacagtggtctcctgctttaactatttctaaagttcttttatccatttgttcactgctatgtgatccaaacccagatgaccccctagtgccagagattgcacggatctataaaacagacagagacaagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttccctccctccattcattcacatgctcatctgagaagacctaagttcttccagctttggacaataactgcttttagaaactgtaaagtagttacaagagaacagttgcccaagattcagaaatttttttaaaactggagcatgtgtattatgtggccaatgtcttcactctaacttggttatgagactaaaccaatcctcactgctctaacatgctgaagaagccatctgagggggagggggatggatgctgagctgtcacatcaaaggaaacagcattattccagcagcatccattcttgtctaaaccttccactgttagagatttgaggttacatgatatactttatgctcataactgatgtggctggagaattggtattgaattatagcatcagcagaacagaaaatgtgatgtattttatgcatgtcaataaaggaatgacctgttcttgttctacagagaatggaaattggaagtcaaacaccctttgtattccaaaatagggtctcaaaacattttgtaattttcatttaaattgttaggcttggagctattagttaatctatcttccaatactgtttaatatagcactgaataaatgatgcgagttgtcaatggatgagtgatcaactaatagctctcctagtaattgatttatttttcttcaataaagttgcataaacc

SEQ ID NO: 1893 - DNA, 1591 bp, Rattus norvegicus
  Genbank Accession No. NM_031315
cggctcgaaatggaggcgactctgagcctggggcccgccggccgcagctgctgggatgagccgctgagcatcaccgtgcgcggcctggtccccgagcagcccgtcacgctgcgcgcggccctgcgcgacgagaagggcgcgctcttccgagcccgcgcgctctaccgcgccgatgcccacggagagctggacctggcgcgcgcgcccgctctggggggcagcttcacggggctcgagcccatggggctgctctgggccatggagcccgaacggcctttctggcgcttggtcaagcgcgacgtgcagacgcccttcgtggtggagctggaggtgctggacggacacaaacccgacggcgggcggctgctggcgcgggcggtgcacgagcgtcacttcatggctcccggggtgcggcgggtgcccgtgcgcgagggcagggtgcgcgccacgctcttcctgcccccagaacctgggccctttcctggaatcataaacctttttggagttggaggcggccttctggagtaccgggcgagtctgctggctgggaagggttttgccgtcatggctctggcttattacaactacgacgacctccccaagaccatggaaaccatgcgcattgagtactttgaagaagccgtgaactacctgcgtggccaccctgaggtaaaaggaccaggaattgggctgcttgggatttccaaagggggtgaacttggccttgctatggcctccttcctgaagggcatcacggctgctgttgtcatcaatggctccgtggctgctgttgggaacaccatatgctacaaggatgagactataccccctgtgactatcctgagaaaccaggtcaaaatgaccaaggatggcctcaaggatgttgtagatgctttgcaaagccctctggtagaacagaagagcttcatccctgtggaaaggtctgacacgaccttcctgttcctcgttggtcaggatgaccacaactggaagagcgagttctatgccaatgagatctccaaacgcttgcaggcccacgggaaagagaagccccagatcatttgctacccagaagcagggcactatatcgagcctccttacttcccactgtgcagcgctggcatgcacctcctggtgggtgctaacatcacctttggaggggagcctaagcctcactctgtggcccagttggatgcatggcagcaactccagactttcttccacaaacagttgggtggtaagagtcatggggtgtcccctaaaatataacctgttatgtgatggttttggcaggaaaagtacaaatactttgtaggaatatcagttcagattacttcatctgaacatataaccgcttttggtttacatttttaaaaattaattttagtatcaaaatagtgctgattcaaaggctggaaatatagttcagttgtagagtccttgactgactcatgcaagttcctgggttcaatctccgtgctgtaagggaaaagagcacattttatggaaactgtagctattcaagaaatagtgcctagaatttaaaggaaccatgagtaaacactcttatgtaacttaaaaaaaaaaaaaa

SEQ ID NO: 1894 - DNA, 698 bp, Rattus norvegicus
  Genbank Accession No. NM_031318
gcgctagagggaagatggaagacttccaggcctccgaggagactgcatttgttgtggatgaagtgagcaacattgtaaaggaggctatagaaagtgccatcggcggtaacgcctaccagcacagcaaagtcaaccagtggaccactaatgttgtagaacagactttgagccaactcaccaaactggggaaaccatttaaatacattgtgacctgtgtgatcatgcagaagaatggtgctgggttacacaccgcaagttcctgcttctgggacagctccacggacgggagctgcacagtccgatgggagaacaagaccatgtactgcatcgtcagtgccttcggactgtccatctgaccgcctgactgcctcagcctccggttccagcgtttctagtccatcttaccaccagctatgttgggcggataccttcctcctctttaagttgttctgaggcactcccaaaatgtagagaaataaaccaaatgaccctggccacaggaaccacacgacggacactaggcagatgagcagccacctgtcatccaaggcaggcagtaccagttgtcttaactgtcttctcaaaggtgctaagatctcaagtctgctagtggaaacttctctactttctgaaatgattcagatacactaattttccacactttatacttttgttagaataataaattattcagaatt

SEQ ID NO: 1895 - DNA, 2743 bp, Rattus norvegicus
  Genbank Accession No. NM_031324
cgcgcctgtaacgttcgcccgtgcacgcccggcccgccagctgtccgcctgctcgcacgccgccgtccgccgcagtccgcgcccagccttgcccgctctccccctccttcggcccacgcccggctccggccatgctgtccttccagtaccctgacgtgtaccgcgacgagacctcagtacaggattatcatggacataaaatttgcgacccttatgcttggcttgaagacccagacagtgaacagacaaaggctttcgtggaggcacagaacaagatcacagtgccgtttcttgagcagtgtccaatcagaggtctatacaaggagaggatgactgagctgtatgactaccccaagtacagctgccacttcaagaaaggaaagcggtatttttatttttacaatacaggtttgcagaaccagcgagtattatatgtacaggactccttagagggggaagccagagtgttcctggatcccaacactctgtcggatgacggcacggtggcactccgaggttatgccttcagcgaagatggtgaatacttcgcctatggtctgagcgccagcggctcagactgggtgaccatcaagttcatgaaggtcgacggtgccaaagagcttcccgacgtgctggagagagtcaagttcacctgtatggcctggacgcacgatggcaaaggaatgttctacaactcatacccacagcaggacggcaagagcgacggcacagagacgtccaccaatctccaccagaagctctgttatcacgtcttggggacggatcagtcagaagacgttctgtgtgccgagttccccgatgagcctaaatggatgggaggagccgagttatccgatgacggtcgctatgtcttgttatcgatctgggagggatgtgatccagtgaatcggctgtggtactgtgacctccagcagggatccaatggtatcaacgggatcctgaagtgggtaaaactgatagacaactttgaaggggagtacgattacataaccaacgagggtacggtgttcaccttcaagaccaaccgcaactcccccaattaccggctgatcaacatcgacttcacggaccccgacgagtccaagtggaaagttctcgttccggagcacgagaaagatgtcttagagtgggtggcttgcgtcaggtccaacttcctggtcttgtgctacctccgcaacgtgaagaacattctgcagcttcacgacctgacaactggtgctctcctcaagaccttcccgctggacgtgggcagcgtggtggggtacagtgggcgcaagaaggactctgagatcttctaccagttcacatccttcttatctccaggtgtcatttaccactgtgatcttaccagagaggaactggaaccccgggttttccgagaggtgacggtgaagggaatcgatgcgtctgattaccagactatccaggttttctaccctagcaaggatggcacaaagattcccatgtttattgtgcataaaaagggcataaagttggatggctcgcatcccgctttcctgtatggctatggtggcttcaacatctccatcacacccaactacagtgtgtccaggctcatttttgtgagacatatgggcggcgtcctcgcggtagctaacatcagaggcggtggtgaatacggagaaacatggcataaaggtgggatcttggccaacaagcagaactgctttgatgacttccagtgtgctgctgagtacctcatcaaggaaggctacacaacttccaagaggctcacgatcaatggaggctccaatggcggcctcttagtggctgcttgcgcaaatcagcgcccggacctcttcggctgtgtgatcgcccaggttggagtgatggacatgttgaagttccacaaatttactattggccatgcctggaccactgattacgggtgctccgacagcaaacaacacttcgaatggcttctcaagtactcgccgctgcacaacgtgaagcttccggaggcggatgacatccagtacccgtccatgctcctcctcacggctgaccacgacgaccgcgtggtcccgctgcactcgctcaagttcatcgccacgcttcagtacatcgtgggccgcagccggaagcagagcaaccccctgctcatccacgtggacaccaaggccggccacgggccgggaaaacccaccgccaaggtgatagaagaagtctcggatatgtttgcgttcatagcgcggtgcctgaacatcgagtggatccagtaagtggggattcccggcccctcccaccagacacagaaaacctcaagggctttttcacaccatcctgaccaagaaaccaccggcgaacgctgcctggagtgagcaccgtgccgctgctcacagacagcaagccgccgagcaggactgccaccgggattttagcttttctatctcctttctagcaagcccttgatgttttggttttgttttgttttgttttccccactctctccaggcacatatattgaaagggggggaaagggagggtatgtttatataagaaactaaatggcagtgaacgtattgtgaatatcagagccctgaactcgtaaagggatctaagttaagggtcatagttgggcatactcatctataatagcataatgaagtcacgtctctaaccatagcatataaccttaaataagtgggagacctcaaggcagagtccgctgcattactaataaatgctactgaagagtggg

SEQ ID NO: 1896 - DNA, 2318 bp, Rattus norvegicus
  Genbank Accession No. NM_031325
ggagcggcgggcggagaggtgtgtggagcttgtggcttgggaggaaggcgctgtccgagagaacgtgatctgcgcggccgctgtgtcctggccttggaagtggttcagtcatggttgagatcaagaagatctgttgcattggtgcgggctacgtcggcggacccacatgcagtgtcattgctcgcatgtgccctgaaatcagggtaacggttgtggatgtcaatgaggccaggatcaatgcatggaattctccaacgcttcctatttatgagcctggactaaaagaagtagtcgaatcctgtcgagggaaaaacctctttttttctaccaatattgatgatgccatcagagaagccgatctagtgtttatttctgtgaacacaccaacaaaaacatatggaatgggaaaaggccgggcggcagatctgaagtatatcgaagcttgtgctcgccgcattgtgcagaactcaaatgggtacaaaattgtgactgagaaaagcacagtccctgtgcgggcagcggaaagcatccgccgcatatttgatgccaacacaaagcccaacttgaatctacaggttctgtccaatcctgagttcttggcagagggaacagccatcaaggacctaaagaacccagacagagtcctgattggaggggatgagaccccagagggccagagagctgttcaggcactctgtgctgtgtacgagcactgggttcccaaggaaaagatcctcaccaccaacacttggtcctcagagctttccaaactggcagccaatgcttttcttgcccagaggatcagcagcattaactccataagtgctctgtgtgaaagcacaggcgccgatgtggaagaggtggcaacggctatcgggatggaccaaagaattggaaataagtttctaaaagccagcgttggttttggtgggggctgcttccaaaaagatgttctgaatttggtttatctctgtgaggctctgaatctgcccgaagtagctcgttactggcagcaggtcatagacatgaatgactaccagaggaggaggtttgcatcacggatcatagacagcctgtttaatacagtgactgataagaagatagctatcttggggtttgcgttcaaaaaggatactggtgataccagggagtcctccagtatctacattagcaaatacctgatggacgagggtgcgcacctccacatctacgaccccaaagtacccagggagcagatagtggtggatctttctcatccaggcgtctcagcggatgaccaagtgtccagactggtgaccatttccaaggatccatatgaagcatgtgatggcgcccatgccctcgttatctgcacagagtgggacatgtttaaggaactggattatgaacggattcataaaagaatgctgaagccagccttcatatttgatggccggcgtgtcctggatgggctccacaatgagctacagaccattggcttccagattgaaacaattggcaaaaaggtatcttccaagagaattccatacactcctggtgaaattccaaagtttagtcttcaggatccacctaacaagaagcccaaagtctagacgtcgcccttttgcctgtgatgatttggtactgcagggtagccagcgtctgtctgatactaagtggtaaatgaactacgtgtttttatggaaacaaaaatatttttgtaatcatcaaatttatactagctatctgggtgttagcatatctagtaattatgagtctagaataatttttatatatttttatattattgtactctcagttactgaatggatggaaaacaatcatgttggtttaaatgtcagtttttataaataaaaatgaaaccttgaattttttagcattacaggttgttacagactgcactgtaataacacaagggaaaggcagtctcatttccctacctgttgtctctgcttatcactaaatgggacttcgaagccgtgaaatcactgtgctaggatggctgatgaaggtctctggacttttgttttaatgagattatgtcattagtggttttagttgtctttgtgtctcccaaaaccactctgtctttctctccatgcgtaactcgggcagtgctttcttttttgaaaattcagcctgaggaggaaatcagtctatggtctagttcgtcctgcctcttagcttctgtacctgcttgtcacatttgcacctatgagtcaagatatgtttgttacctttattttgatttatttctattacaattcaatttttttcctttaattaagaaaaccaataaagtctcatgtgtaaactgg

SEQ ID NO: 1897 - DNA, 1871 bp, Rattus norvegicus
  Genbank Accession No. NM_031327
ttgttggttctgtgtcgccgcgctcgccccggctcctcctgcgcgccacaatgagctccagcaccatcaagacgctcgctgtcgccgtcacccttctccacttgaccaggctggcactctccacctgccctgcctcctgccactgccctctggaggcgcccaagtgcgccccgggagtcggcttggtccgggacggctgcggctgctgtaaggtctgcgcgaagcaactcaacgaggactgcagcaaaacgcaaccctgcgaccacaccaaggggctggaatgcaatttcggcgccaattccaccgctctgaaagggatctgcagagctcagtcagaaggcagaccttgtgaatataactccaggatctaccagaacggggagagcttccaacccaactgtaaacatcagtgcacatgtattgacggtgctgtgggctgcattcctctgtgtccccaagaactgtctctccccaatctgggctgtcccaacccccggctggtgaaagtcagcgggcagtgctgtgaggaatgggtctgtgatgaagacagcattaaggactccctggacgaccaggacgacctccttggattcgatgcctcggaggtggagttaacaagaaacaatgagttaatcgcaactggcaaaggcagctcactgaagaggcttcctgtctttggcacggaacctcgagtcctttacaaccccctgcatgcccatggccagaaatgcatcgttcagactacgtcctggtcccagtgctccaagagctgcggaactggcatctccacacgagttaccaatgacaacccggagtgccgcctggtgaaagagacccggatctgtgaagtgcgtccttgtggacaaccagtgtacagcagcctaaaaaagggcaagaaatgcagcaagaccaagaaatccccagaaccagtccgatttacttatgcaggatgctccagtgtgaagaaataccggcccaaatactgcggctcctgcgtggacggccggtgctgcacacctctgcagaccaggaccgtgaagatgcggttccggtgcgaagatggcgagatgttctccaagaacgtcatgatgattcagtcctgcaagtgtaactacaactgcccgcatcccaacgaggcgtcgtttcgcctctacagtctgttcaacgatatccacaagttcagggactaaaggtctcctgggtttctagtgtgggtcggacagaggtgttgagcatcgtggagacgtgggcagacggtgggcgaacagtgccttgctcatcatcaagtaggattaaggtgtttcaaaactgccgtaggggctgctgctatggatggacagtaacgcagtcgcagttggagaatacttcgcttcatagtactggagcccgggttacgtacgcttcatattggagcatgtttatagatgatgttctgttttctgtttgtaaattattttgctaagtgtttttttttctttctttttttttttttttttttgctccatttctccccctccccccttggttctacaattgtaatagagataaaataagactagttgggtcaagtgaaagccccgcttgtcctttgacagaagtaaaatgaaaggcctctcctgccttccccagtggaggcaggggacactctgtgagtgcccttgaggctactacctgcactctaaactgcaaacagaaaccaggtgttctaagattgaatgtttttatttatcaaaatgtagctttcggggagggatggggaaatgtaatactggaataatttgtaaatgattttaattttatatcagtgaagagaatttatttataaaattaatcatttaataaagaaatatttacctaaaaaaaaaaaaaaa

SEQ ID NO: 1898 - DNA, 3061 bp, Rattus norvegicus
  Genbank Accession No. NM_031330
tgtgaccgcggccaagcccgctcgccttctgcggcgagtagggcctcgcggcgtcatcggcggcgaggagccgctgcggcctggccgaccatgtcggacgcggctgaggagcagcccatggagacgacgggcgccaccgagaacggacacgaggccgcccccgaaggcgaggccccggtcgagcctagccctggcagcggccccgcgactccggcggggtctgtgggcgggaccacggccgccccgagcgggaaccagaacggcgccgaaggcgaccagatcaacgccagcaagaacgaggaggacgcgggaaaaatgttcgttggtggtctgagctgggataccagcaaaaaagatctaaaggattattttactaagtttggagaggtcgttgactgtacaataaaaatggatccgaacactggtcgatcaagagggtttgggtttattctcttcaaagattcttctagtgtggagaaggtcttagatcagaaggagcacagactggatggtcgtgtcattgaccctaaaaaggctatggctatgaagaaggaccctgtgaagaaaatctttgtgggaggtctaaaccctgaagccacagaggaaaagatcagagaatactttggccagtttggggagattgaggccattgaacttccaatagatcccaagttgaacaaaagacggggttttgtttttattacatttaaagaggaagaccctgtgaagaaagttctggagaaaaaattccatactgtcagtggtagcaagtgtgaaatcaaggttgcccagcccaaagaggtgtaccagcaacagcagtatggctctgggggccgaggaaatcgcaatcgagggaaccgaggcagtggtggaggtcagagtcagagttggaatcagggctacggcaactactggaaccagggctacggctaccagcagggctacgggccgggctatggcggctacgactactcgccctatggctattacggctacggccccggctacgactacagtcagggtagtacaaattacgggaagagccagcgacgtggtggtcatcagaataactacaagccatactgagaggcagcaggagcggccgagtgacgacgcacacgctttgtttggacgcggagtgaacacaattatgtaccaaatttaacttggcaaacttttatggcctgtcccatgtgcatcttatttaaaatttcccccggaaatcactctcctgtttactattccagagctctagttgttgtaggcagcgtgtggcgtctcagaggtcagagcggcattagggggctgattttattaccaggttaccctgttctagattggagggtctgcttcctgctgccgctctgcagcctggacctgtggaccctggttgtaaagagtaaactgtatcttaggaaaccagtgtcacctttttcaccttttaattttatattatttgtgtcatacatttccagtaatggaagtgttaattttactgtactttttggtaccttttgggaatctaatgtattgtaaggtattttacacgtgtcctgattttgccacgacctggatattgaagctatccaagcttttgaaataaaaatccctgagagtctggtccactaactccagggactgtgggacagaggaacaaacaagaaagaactcgaggcctcgctgagtggcacgcttgctgagtgctgccacatcccgcaagctgagcaggtatcccaactctgttcctgcccggtagaccacccgaggtgtgagtgtggtcttgtcttccagattcgtaggacagaagctccaggaggaggacccgcccaacatggcatcggagagcgggaagctatggggtggccgatttgcaggctcggtcgaccccaccatggacaagttcaactcatctatcgcctatgaccggcatctgtggaatgtggacctgcagggaagcaaggcctacagcaggggcctggagaaggcagggcttcttcaccaaagctgagatgcagcagatactgcaaggcctggacaaggtggctgaagagtgggcccaaggcatcttcaaattgtaccctaatgatgaagacatccaccttcctcaaggtgctcattgaagccatggtagaccgggcagaggcggagtgtgaagtcctcttccctgggtacacacacttgcagagagctcagcccatccgctggagccactggatcctgagtcacgccgttgcgctgacacgagatttagagagactgaaggaggtgcagaagcggatcaatgtcctgccactgggcagtggggccattgcaggcaaccctctaggtgtggaccgggagttcctctgtgcagaactgaactttggagccattacgctcaacagtatggatgccaccagcgagagagacttcgtggctgagttcctgttttgggcttctctgtgcatgacccatctcagcaggatggcagaagacctgattctctacggtaccaaggaattcaactttgtgcagctctccgatgcctacagcaccggaagcagcttgatgccccagaagaaaaacccagacagcttggagctgatccggagcaaggcgggccgagtgtttgaagtgtctgataccatgacagctgtcctccaagtagccactggagtcatctctacactgcagattcatcgtgagaacatggcacaggcactcagccctgacatgctggctaccgaccttgcctactacctggtccgcaaagggatgccattccgccagcccacgaggcctcagggaaagctgtggtcgtggcagagatgaaaggggtggctctcaaccagctgtcacttcaggagatgcagaccgtcagtcccctgttctcgagtgacgtgaatctcgtgtgggactacagccacagcgtggagcagtacacagccttgggtggcacagcacagtccagtgttgagtggcagatcagccaggtgcgggccctgctgcagatgtagcagccctagattccacccagtcaaagctgcgccccaataaagtggagccctggagaggccgccat

SEQ ID NO: 1899 - DNA, 1334 bp, Rattus norvegicus
  Genbank Accession No. NM_031331
gagcgccaggccaatcggaggtgctgttgtttgtcagtcccggagccggtccgcaaaggaaaggtggcaagatggtgttggagagcactatggtttgtgtggacaacagtgagtacatgcggaatggagacttccttcccacccggctgcaggcccagcaggatgctgtcaacattgtatgtcactcaaagacccgaagcaaccctgagaataacgtgggcttgatcacgctggccaatgactgtgaggtgctgaccacactcacccctgacactggccgaatcctctccaagctccacactgtccagcccaaaggcaagatcaccttctgcactggcatccgcgtggcccatctggctctgaagcaccggcagggcaagaatcacaagatgcgcatcatcgccttcgtgggtagccctgtggaggacaacgagaaggatctggtgaaactagctaaacgccttaagaaagaaaaagtgaatgttgacatcatcaattttggggaagaggaggtgaacacagagaagctgacagcctttgtgaacacattaaacggcaaggacggaactggatcacatctagtgacagtgcctcctgggcccagcctggccgatgctctcatcagttctcctattctagctggggaaggcggcgccatgctgggtcttggtgccagtgactttgagtttggagtagatcccagtgctgatcctgaattggccctggcccttcgtgtctctatggaagagcagcggcagcggcaggaggaggaggcacgacgggctgctgcagcctctgcagctgaggctggaattgccacacctgggactgaaggtgaacgagactcagatgatgccctactgaagatgaccatcagccagcaggagtttggccgtgcggggcttcctgacctaagcagcatgacagaggaagagcagattgcctatgccatgcagatgtccctgcagggagcagagtttggccaagcagaatcaggggacatcgatgccagctcagccatggacacatctgagccagtcaaggaggaggatgactatgacgtgatgcaggacccagagttccttcagagcgtcctagagaaccttcccggtgtggatcccaacaatgaagccattcgaaatgcaatgggctctctggcctcccaggccaccaaggatggcaagaaggacaagaaagaggaagagaagaagtgaggccggagggaggggtagccgagtctgccctggggactgtaaggatggggttggataaagacttagatgtgctctgcggccttgacaacggaataaagcttggagttttccctttgcttc

SEQ ID NO: 1900 - DNA, 4396 bp, Rattus norvegicus
  Genbank Accession No. NM_031334
ctggtgtgggagccgcggcgcactactgagttctcaagaacttctgctagacttcagcccggcctaacccggctctgcccgaccgcacccgagctcagtgtttgctcggcgtttgcccggccagccatgggagcccggtgccgcagcttctccgcgctcctgctcctgctgcaggtctcctcgtggctttgtcagcagccggagtcggagtctgactcctgccgtcccggcttcagttccgaggtctacaccttcctggtgccggagaggcacctggagagaggccacatcctgggcagagtgaaatttgaaggatgcaccggccgtccaaggacagccttcttttctgaagactcccgattcaaagtgtctacagatggcgtcatcacagtcaaacggcatctaaagcttcacaagctggagaccagttttctcgtccatgcctgggactccagttacaggaagctttctaccaaagtgacactgaagtccctgggccaccaccaccaccggcatcaccacagagaccctgtctctgaatccaacccagagctgctcacgtttcccagctttcaccagggtctgagaagacagaaacgagactgggtcatccctcccatcaactgcccggaaaatcaaaagggcgaattcccccagcgactggttcagatcaaatccaacagggacaaagagacaacggttttctacagcatcaccggcccaggagctgacaaaccccctgttggcgttttcatcattgagagggagacaggctggctgaaagtgacgcagcctctggacagagaagccattgacaagtaccttctctactctcatgctgtgtcatcaaatggggaagccgtggaggatcccatggagatagtggtcacagtcacagatcagaatgacaacaggccagagtttatccaggaggtctttgagggatctgttgcagaaggcgctcttccaggaacctccgtgatgcaggtctcagccactgatgcagacgatgacataaacacctacaatgctgccatcgcctacaccatcctcagccaagatcctgagctgcctcacaaaaacatgttcactgtcaaccgggacactggggtcatcagtgtggtcacctccggactggaccgagagagttaccctacatatactctggtggttcaggctgccgaccttcaaggcgaaggcctaagcacaacagcaaaagctgtgatcactgtcaaggatattaatgacaacgctcccatcttcaacccaagcacgtaccagggtcaagtgcttgagaatgaggtcggtgcccgtattgccacactcaaggtgactgatgatgatgcccccaacactccagcgtggaatgctgtgtacaccgtagtcaatgatcctgatcatcagttcactgtcatcacagaccccaagaccaacgagggcattctgaaaacagccaagggcttggattttgaggccaagcagcagtacattctgcacgtgacagtggaaaatgaggagccctttgaggggtctcttgtcccttccacagccactgtcaccgtggatgtggtagacgtgaatgaagcccccatttttgtgcctgcggagaagagagtcgaggtgcctgaggactttggtgtgggtctggagatcgcatcttacactgcgcgagagccagacacattcatggaacagaagatcacgtatcggatttggagggacactgccaattggctggagattaacccagagactggggtcatttccactcgggctgagatggacagagaagattcggagcatgtgaagaacagcacgtatacagctctcatcattgccacagatgatggttcacccattgccactggcacagggactcttctcctggtcctgtcagacgtcaacgacaatgctcccatcccagaacctcgaaatatgcagttctgccagagaaacccgaagccccatgtcatcaccatcttggatccagaccttcccccaaacacatcccccttcactgcagagctcacccatggggccagcgtcaactggaccattgagtacaatgacgcagaacaagaatctctcattttgcaaccaagaaaggacttagagattggcgaatacaaaatcaatctcaagctctcggataaccagaataaagaccaggtgaccacgttggaggtccacgtgtgtgactgtgaagggaccgtcaacaactgcatgaaggcgatctccctggaagcaggattacaagttcccgccatccttggaatcctgggagggatcctggccctcctgattctgatcctcctgctcctactgtttctacggaggagaacggtggtcaaagagcccttgctgccaccagatgacgatacccgggacaatgtgtattactatgatgaagagggaggtggagaagaagaccaggactttgatttgagccagctgcacaggggccttgatgccagaccggaagtgattcgaaatgatgtggctcccaccctcatgagcatgccccagtatcgtccccgtccagccaatcctgatgaaatcgggaacttcatcgatgaaaacctgaaggcagcggacagtgaccccacagcgcccccttacgactctctgttggtgtttgactatgaggggagtggttctgaagctgcctccctgagctcgctgaactcctctgagtcagatcaggaccaggactacgattatctgaacgaatggggcaaccggttcaagaagctggccgatatgtatggtggcggcgaagaagactagagagtcgttcctgtgtggcaccatgggagatgcagaatcatgatgtcagtggtctttcagctccttccctgactttgtagaagagagactgatctgagaagtatgcagattgcatactggtcccactctacctaccagtctgtctgtgttaggagggttttcactggttgttggaatctttttctaaaatgtttttgtttttacagtgctgtgatgtgatgaactgtaccctctttttgtttttgttttgagctatgttctgctccggacacacagcccccaagcccttcacccctcactaatttttttacattgtatactttcactcaattaccatgtttatgttctgtattctaatagccactaagttcctgaattctgttgcctggcccaggtgctattctgtgacacagtagtgcctgggcccttttatggtaagagacaggtttcttggtgtgggtgcaactgagctggatagtgtatgtttcaaacacctttcctgtgttctctccccacctccagagtgtctttacttattcagctgtgtgtttggggcagaacaaaaaaataatgggaccactatgcaagctgcgaagattctaaggtgcacacctgattcttaggcagatgccatagtgagatatgttgctttggttctctatccaatgctgtgaccgggacctgcagcgaggttttcggacaccgtggtttcttgcgtttctttcaaaccagcagtaaaaaatggttttttctgagagagactggagtgccaccaccaaagatagaggagagaagccaagcttggggacagcaagcatgccagtgaacctgaccactgtcatgagtcatgtgggtggccacatgtccgtgaacctggccagttggcacactgatggtgagggtacaaggaggctagacctcgtcccacaaaatttctggaagaattagggttgtctcagccaatgtttcctagctggaatcctgtccatgtatgtgttcctgaagcccaggaaatacacccctctagtgcctgcttttgatggtagttatagaaaagaccggctgatttggacctgagttgcccaatcttaagtacaaatagaaaactgagactatgctgggtgtgttggtgcacgcctttaatcccggcactcgggaggcagagacagtctcagatctctctgagttcaaggtcagcctggtatagtaagtgaattccaggacagccagggctacacagaaactctgtcttggaaaaccaaaaaagaaaactgagaatattagagattgtgcattttctcagaaagcaggaagaaaacaccactctgatgggaaaagggaggcaaggcccttgagacttttcattgaaattgctgtactcacataattttggaagcaaatgatgactgcaatcaactgtgagaactgttggtttctctgtagtttaattgtctaatgttgatagcgtgccctttgtatgtagtttgagtgtatatgtgtgtgggtgctgataattttgtattttgtggggagtggaaaaggcaagcaatcggaactgttctctaagatgcatttttatgaattttattaaagagttttgttaaactgt

SEQ ID NO: 1901 - DNA, 2485 bp, Rattus norvegicus
  Genbank Accession No. NM_031357
ccaaaatgggactccaagcccgcttcctaggactccttgctctcgtcatcgccggcaaatgcactcacagccccgagccggaccaacggtggatgctgcctccaggctgggtgtcactgggccgagtggatcccgaggaagagctgagtcttacttttgcgctgaaacagcagaacctggacagactctcggagctggtgcaggctgtgtcggatcccagctctcctcgatatggaaagtacctcaccctagaggatgtagctgagctggtccaaccatcaccactgaccctccgcactgtccaaaagtggctcttggcagctggagcccgggactgccattcagtgaccacccaggactttctgacttgctggctgagtgtccggcaggctgagctgctgcttcctggggctgagtttcatcgctatgtagggggacctgcaaagacccacattataaggtccccacatccctatcagctcccccaggccttggcccctcatgtggaccttgtggcggggctgcaccgtttcccccctttatcatctccgagacaacgtccagagccacaaggagtgggacctgttggcctgcacctgggagtgactccatctgtgcttcgtcagcgatataacctgacagcccgagatgtgggctctggcaccaccaacaatagccaggcctgtgcccagttcctggaacagtacttccataactcggatctgactgagttcatgcgcctgtttggtagcagttttgcacaccaggcctcagtagcaagagtggttggaaagcaggggcgaggccgagcgggcatcgaggccagtctagatgtggaatacctgatgagtgctggtgccaatatctccacttgggtctacagtagccctggccgccatgaggcacaggagcccttcttacaatggctcctgcttcttagcaatgagtcatccttgccgcatgtacatactgtgagttacggagacgatgaagactccctcagcagtgtctacatccagagagtcaacactgagttcatgaaggctgctgctcggggtctcaccctcctttttgcctcaggtgacactggagctgggtgttggtctgtctccggaagacacaagttccgtcctagcttccctgcttctagcccctatgtcactacagtaggaggaacctccttcaagaatcctttccttgtcacaaatgaagtagtcgactatatcagtggtggaggcttcagcaatgttttcccacagccttcataccaggaggaagcagtagcccagttcttgaagtccagctctcatctaccaccatctagttacttcaatgctagtggccgtgcttacccagatgttgccgcgctttctgatggctactgggtggtcagcaacatggtccccattccgtgggtatctggaacctcggcctctactccagtgtttgggggaattttatccttgataaatgagcacagactcctcaatggccgcccccctctaggctttctcaatcccaggctctatcagcagcatggggcaggactctttgatgtaacccatggctgccatgagtcctgtctgaatgaagaagtggagggtcagggtttctgctctggtcctggctgggatcctgtgacaggttggggaacacccaacttcccagccctactgaagactctactcaacccttgacccttccctgccctgacgagaaagcagaactgtttcctgtactacaagggaaggctcagtttctcgttattcctcaatggaagccctgatgaactcttaactgttgcctgctgcagatagcttctccctaaccctcaaatgctgtgagcaggactggactcccaaccctgtgagccatcaaactcaggtctccaaacttctacttcgagatccccaacaagatgctataaccagcattttgtctcaccccaaccccatctctccttcctctttccagcttgagatgtgaaagcagggcgagaagattcagtctgcattactgacaccagcagtcccacctaatgcttaccacctctgcactgaccgtatgctctttctcttccagctgcttcttcgttcactgaaatgagacctttgtgctaatcgtttagtctttcttcccctggcactgaagtgcaatggtctccctgacattctatccagttatacacttctcagtgttttatgggctttcttgtttaagaacaggttggtgatgggttggggatttagctcagtggtagagcgcttgcctaggaagcgcaaggccctgggttcggtccccagctccgaaaaaaagaaccaaaaaaaaaaaaagaacaggttggtgacaatctatataactattctaaggaaagttcaagtttgaaaattttaaatgttttaaatgttcttattggcaaagctcctcaacaaaataaataggtgttacaaattttgcttcaaaaaaaaaaaaaaaaaaaaaaaaa

SEQ ID NO: 1902 - DNA, 2452 bp, Rattus norvegicus
  Genbank Accession No. NM_031359
atggcggctggcggggctgttgctgcggcgcccgagtgccggcttctgccctacgcgctgcataagtggagctccttctcctccacctaccttcccgagaacattttagtggataaaccaaatgatcagtcttccagatggtcttcagagagcaactatcctccccagtacttgattctgaagcttgaaaggcctgctatagttcagaatattacatttggaaaatatgagaaaactcatgtctgcaatttgaagaaattcaaagttttcggtggaatgaatgaagaaaatatgacagagctgctgtccagcggcttgaagaatgattataacaaagagacatttaccttgaaacataaaattgatgaacagatgttcccttgtcgattcattaaaattgttccacttttgtcctgggggcccagctttaattttagcatctggtatgttgaactcagtggcattgatgatcctgatatagtgcagccctgtctgaactggtacagcaagtaccgcgaacaggaagccattcgcctttgtctaaaacacttcagacaacacaactatacagaggcttttgaatccctgcagaagaaaaccaagattgcactggagcatccaatgttgacagatatgcacgacaaattggtgttaaagggtgactttgatgcttgcgaggagttgattgaaaaagcggtaaatgatggcttgttcaatcagtatatcagtcaacaggagtataagccacggtggagtcagattattcctaagagcaccaaaggtgatggagaagataaccgtccaggaatgagagggggccatcagatggtcattgatgttcagacagagactgtttatttgtttggtggctgggatggaacacaagatcttgctgacttctgggcatacagtgtgaaggagaaccagtggacatgtatttctagagacactgagaaagagaatggtcctagtgccagatcatgtcataaaatgtgcattgatattcagcggagacaaatctacacattgggccgttacttggattcctctgtgaggaacagcaaatctctgaaaagtgatttctaccgttacgacattgacaccaacacctggatgttactaagtgaagacactgctgccgacggtggaccaaaattggtgtttgatcatcagatgtgtatggactcagaaaagcatatgatctatacctttggtggtaggattttgacatgtaatggcagtgtagatgacagcagagccagtgaaccacaattcagtgggctgtttgcattcaactgccagtgtcaaacctggaaacttcttcgagaggactcctgtaacgcaggccctgaggacatccagtctcggattggacactgcatgctgttccactcgaaaaaccgttgtttatacgtgtttggtggccagagatctaagacctatttgaatgatttttttagttatgatgtggactctgatcatgtagacataatttcagatggcaccaagaaagactctggaatggttccaatgaccggattcacacagagagcaactattgatccagaactgaatgaaatacatgttttatccggacttagcaaagacaaagaaaagagggaagagaatgtcagaaattcattctggatttatgacattgtgaggaatagctggtcttgtgtctataagaatgatcaagctgcaaaagagaatctgagtaaaagtcttcaggaagaagaaccatgtccaaggtttgcccatcagctcgtttatgatgaattacacaaggttcattatttatttggtgggaatccaggaaagtcttgctctccaaagatgagactagatgacttctggtcgctgaagttgtgcagaccttcgaaggactacttactgaggcattgcaagtacctcatcaggaagcacaggtttgaagaaaaggcccagatggatccccttagtgctctgaagtatttacagaatgatctttatataactgtggatcattcggacccagaagagacaaaagagtttcaactcctagcctcagccctgttcaaatctggctcagatttcacagctttaggcttttcagacgtggatcacacctatgctcagagaactcagctctttgacaccttagtgaatttctttcctgacagcatgactcctcctaagggcaacctggtagacctcatcacactgtaactgggcgtggattgaggagttactgggctcagaagtggagacaggaaccggaggttgctgtttgtgtgggcagaggtgacgttgcagtgactgaggactgaggactgcatccgagttttgaaggatccttactgtcacaagttttaaccctcttccttcatacctgacctcaatccccttttccttatattcctgcattaggctaataaagtgaaattgatatacttcccattaaaaaaaaaaa

SEQ ID NO: 1903 - DNA, 1178 bp, Rattus norvegicus
  Genbank Accession No. NM_031509
acattaaccaactgtttagcaactcaggcatgactttgcatttttcttctaatctttcatagaaatttctggccactggacactgtgggagcagcttttaccttattggactatctccccttaagtgggaagggcttagtcaaatgcagtaaagagctataaaacaccgagaactcttgatgtgttgtgaaacttagagggagcagctttttaacaagagaactcaagcaattgctgccatgccggggaagccagtccttcactacttcgatggcagggggagaatggagcccatccggtggctcctggctgcagctggagtagagtttgaagaacaatttctgaaaactcgggatgacctggccaggctaaggaatgatgggagtttgatgttccagcaagtgcccatggtggagattgatgggatgaagctggtgcagaccagagccattctcaactacattgccaccaaatacaacctctatgggaaggacatgaaggagagagccctcatcgacatgtatgcagaaggagtggcggatctggatgaaatagttctccattacccttacattccccctggggagaaagaggcaagtcttgccaaaatcaaggacaaagcaaggaaccgttactttcctgcctttgaaaaggtgttgaagagccatggacaagattatctcgttggcaataggctgagcagggctgatgtttacctagttcaagttctctaccatgtggaagagctggaccccagcgctttggccaacttccctctgctgaaggccctgagaaccagagtcagcaacctccccacagtgaagaagtttcttcagcctggcagccagaggaagccattagaggatgagaaatgtgtagaatctgcagttaagatcttcagttaattcaggcatctatggatacactgtacccacaaagccagccttcgaaagctttgcaacaatcgcatattttgactaaatgttgaccctacttattgggaggccaacacgttttctaatgcttctgtgttaattcatatagacatgactgatgaggaattgctgggatgctatttggttgtagttaaaatttgaaatcatgatcacttcctcagatattactttgaatctcaataaaaacttcgcaagctttttaaaaaaaaaaaaaaaaaaaaa

SEQ ID NO: 1904 - DNA, 4189 bp, Rattus norvegicus
  Genbank Accession No. NM_031517
atgaaggctcccaccgcgctggcacctggcattctgctgctgctgctgaccttggcgcagaggagccatggggagtgcaaggaggccctagtgaagtctgagatgaacgtgaacatgaagtaccagcttcccaacttcaccgcagaaacccccatccagaatgtcgtcctccatgggcaccatatttatctcggagccacaaactacatttatgttttaaatgacaaagaccttcagaaggtatctgagttcaagaccgggcccgtggtggaacacccagattgttttccttgtcaggactgcagcagcaaagccaatgtgtcaggaggtgtttggaaagacaacgtcaacatggcgctgcttgttgacacttactatgacgaccagctcatcagctgtggcagcgtcaacagagggacctgccaaaggcatgtccttcctcctgacaatgctgccgacattcagtccgaggttcactgcatgttctccccacttgcggaggaagagtcaggccagtgtcccgactgtgtagtgagtgccctgggagccaaagtcctcctgtctgaaaaggaccggttcatcaatttcttcgtggggaatacgataaactcttcctaccctcccgattattcattgcattcaatatcggtgaggcggctgaaggaaacccaggacggttttaagtttttgacagaccagtcctacattgatgtcctgggagaattccgagattcctaccccatcaagtacatacatgccttcgaaagcaaccattttatctactttctgactgtccagaaggaaaccctagatgctcagactttccatacaagaataatcaggttctgttctgtagactctgggttgcactcctacatggaaatgcctctggagtgcattctgacggaaaaaagaagaaagagatccacaagggaagaagtgtttaatatcctccaagccgcgtatgtcagtaaaccaggggccaatcttgctaagcaaataggggccagcccgtatgatgacattctctacggggtgtttgcacaaagcaagccagattctgctgagcccatgaaccgatcagcggtctgtgcattccccatcaaatatgtcaatgacttcttcaacaagattgtcaacaaaaacaacgtacggtgtctccagcatttttatggacccaaccacgagcactgtttcaataggaccctgctgagaaattcatcgggctgcgaagtgcgcagtgacgagtaccggacggagtttaccacagcgctgcaggctgtggatttattcatgggccggctcaaccatgtactcttgacgtctatctctaccttcatcaaaggtgacctcaccattgctaatctagggacatcagaaggtcgcttcatgcaggtggtgctctctcgcacagcacatttcaccccccatgtgaatttcctcctggattcccatcctgtgtctccggaagttattgtcgaacatccatcaaatcaaaatggctataccctggtggtcacagggaagaagatcaccaagattccactgaatggcctaggctgtgggcatttccagtcctgcagtcagtgtctctctgccccctactttatacagtgtggctggtgccacaatcggtgtgtgcattccaatgaatgccccagcggtacatggactcaagagatctgtctgccagcagtttataaggttttccccactagtgcacccctcgaaggaggaacaatgctgaccatatgtggctgggactttggattcaagaagaataataaatttgatttaaggaaaaccaaagttctgcttggcaacgagagctgtaccttgaccttaagcgagagcacgacaaatacgttgaaatgcacagttggccccgcgatgagtgagcacttcaatgtgtctgtgatcgtctcaaacagtcgagagacaacacagtacagtgcgttttcctatgtggatcctgtaataacaagtatttctccaaggtatggtcctcatgccggaggcaccttactcactttgactggaaaatacctcaacagcggcaattctagacacatttcaatcggagggaaaacatgtactttaaaaagtgtatcagatagcattctcgaatgctacaccccaggccacaccgtctctgccgagtttcccgtgaaattgaaaatcgacctggctgaccgagtgacaagcagcttcagttacggggaagacccgtttgtctctgaaatccacccgaccaaatcttttatcagtggtggaagcacaataacggggattggaaagaacctgaattcagttagcaccccaaagctggtaatagaagtgcatgacgtgggcgtgaactacaccgtggcgtgccaacatcgctcgagttcagagatcatctgctgcaccactccttccctgcaacagctggacctgcaactccccctgaagaccaaagccttcttcctgctggacgggatcctttccaaacactttgatctcacttatgtacatgatcctatgtttaagccttttgaaaagccagtaatgatctccatgggcaatgagaatgtagtggaaattaagggagacgatattgaccctgaagcagttaaaggtgaagtgttaaaagtcgggaataagagctgtgagaatctccactggcattctgaagctttgttgtgtacggtccccagtgacctgctgaagctgaacggcggcgagctaaatatagagtggaagcaagcagtctcttcaactgtccttggaaaagtgatcgttcaaccggatcagaattttgcaggattgatcattggtgcggtctcaatatcagtggtagttttgttagtatccgggctcttcctgtggctgagaaagagaaagcataaagatctgggcagtgaattagttcgctatgacgcaagagtacacactcctcatttggataggcttgtaagtgcccgaagtgtaagcccaactacagagatggtctcaaatgagtctgtagactacagagctacttttccagaagaccagtttcccaactcctctcagaatggagcctgcagacaagtgcagtatccactgacagatctgtcccccatcctgacgagtggagactctgatatatccagcccattactacaaaacactgttcacattgacctcagcgctctaaatccagagctggtccaagcggtgcagcacgtagtgattggacccagtagcctgattgtgcatttcaatgaagtcataggaagagggcattttggctgtgtctatcatgggactttgttggacagtgacggaaagaaaattcactgtgctgtgaaatccttgaatagaatcacagatatagaagaagtctcccagtttctgactgagggaatcatcatgaaagatttcagccaccccaatgttctctcactcttgggaatctgcctgcggagtgaagggtcccctctggtggttctgccctatatgaagcacggagatcttcgcaatttcattcgaaacgagactcataacccaactgtgaaagatcttataggattcggtcttcaagtagccaagggcatgaaatatcttgccagcaaaaagtttgtccacagagacttagctgcaagaaactgcatgttggatgaaaaattcactgtcaaggttgctgatttcggtcttgccagagacatgtacgacaaagagtattatagcgtccacaacaaaacgggtgcgaaactaccggtgaagtggatggctttagagagtctgcagacgcaaaagttcaccaccaagtcagacgtgtggtccttcggtgtgcttctctgggagctcatgacgagaggagcccctccttatcctgacgtgaacacatttgatatcactatatacctgttgcaaggcagaagactcttgcaaccagagtactgtccagacgccttgtatgaagtgatgctaaaatgctggcaccccaaagcagaaatgcgcccatcgttttctgaactggtctccagaatatcctcaatcttctccactttcattggcgagcactatgtccatgtgaacgctacttatgtgaatgtaaaatgtgttgctccatatccttctctgttgccatcccaagacaacattgacggcgaagcgaacacatgacggataagaggcccgccagcccacttccaagaaacagttc

SEQ ID NO: 1905 - DNA, 873 bp, Rattus norvegicus
  Genbank Accession No. NM_031523
agctccaagctcagcacctgctgctcctgcatgcctgttaccatgtggttcctgatcctgttcctcgccctgtccctgggacggaatgatgctgcacctcccgtccagtctcgggttgttggaggatataactgtgagatgaattcccaaccctggcaagtggctgtgtactacttcggcgaatacctatgtgggggtgtcctgatagaccccagctgggtgatcacagctgctcactgcgcaaccgacaattaccaggtttggctgggccgaaacaacctatatgaagatgaaccctttgctcagcaccggcttgtcagccaaagcttccctcaccccggtttcaaccaggacctcatatggaaccacacccgacaacctggggacgactacagcaatgatttgatgctgctccacctcagccagcctgcggacatcacagatggtgtgaaggtcatcgatctgcccattgaggagcccaaggtggggagcacctgccttgcctcgggctggggcagcatcacacctgacggattggaattaagtgatgatctccagtgtgtgaacatcgatcttctgtctaatgagaagtgcgtcgaggcacacaaagaagaggtgacagatctcatgctgtgtgcaggagagatggatgggggcaaagacacttgcaagggtgactcaggaggccccctcatctgtaatggtgtgctccaaggcatcacgtcctggggctttaacccatgcggtgaacccaagaagccaggcatctacaccaaacttattaagttcaccccctggataaaagaagttatgaaggaaaacccctgagtgtcacacagtcccctggtctcaataaaacccaccatgcagcac

SEQ ID NO: 1906 - DNA, 1392 bp, Rattus norvegicus
  Genbank Accession No. NM_031527
aggaggctgcaagagggcgggaggcaggagagggcccggagctggtgggccggagcggcggcgccgccatgtccgacagcgagaagctcaacctggattccatcatcgggcgcctgctggaagtgcagggctcacggcctggaaagaatgtgcagctgacagagaacgagatccgtggtctttgcctcaaatcccgggagattttcctgagccagcctattcttctggagcttgaggcgcctctcaagatctgtggtgacatccatggccagtactatgaccttctacggctgttcgagtatggtggcttccctccagagagcaactacctcttcttgggggactatgtggatcggggaaagcagtctttggagaccatctgcttgttgctggcctataagatcaaatacccggagaatttctttctactacgtgggaaccatgagtgtgccagcatcaaccgcatctatggcttctatgatgaatgcaagagacgatacaacatcaaactgtggaagactttcaccgactgcttcaactgcctgcccattgcagccattgtagatgagaagatcttctgctgccacggaggcctgtctccagacttgcaatccatggagcagattagacgtattatgcggcccacggacgtgcctgaccagggcctgttgtgtgatctgctgtggtctgaccctgacaaggatgttcaaggctggggcgagaatgaccgtggagtctcctttacctttggggccgaggttgtagccaagttcctgcacaagcatgatttggacctcatctgcagagcacatcaggttgtagaagatggctatgagttctttgccaagaggcagctggtgacactcttctcagctcccaactactgtggcgagtttgacaacgctggcgccatgatgagtgtggacgagacactcatgtgttccttccagatcctcaagcccgctgataagaataaggggaagtatgggcagttcagtggcctgaaccccggaggccgtcccatcactccaccccgcaattctgccaaagccaagaaatagcctccatgtgctgccctctgccccagatgacggattatttgtacagaaatcatgctgccatgggtcacactggcctctcaggcccacccatcatggggaacacagcgttaagtgtctttcctttattttttaaagaatcaatagcagcatctaattccccagggctccctcccaccagcacctgtggtggctgcaagtggaatcctggggccaaggctgcagctcagggcaatggcagaccagattgtgggtctccagccttgcatggctggcagccagatcctggggcaacccatctggtctcttgaataaaggtcaaagctggattctc

SEQ ID NO: 1907 - DNA, 780 bp, Rattus norvegicus
  Genbank Accession No. NM_031530
gcagagacacagacagaggccagcccagaaaccagccaactctcactgaagccagatctctcttcctccaccactatgcaggtctctgtcacgcttctgggcctgttgttcacagttgctgcctgtagcatccacgtgctgtctcagccagatgcagttaatgccccactcacctgctgctactcattcactggcaagatgatcccaatgagtcggctggagaactacaagagaatcaccagcagcaggtgtcccaaagaagctgtagtatttgtcaccaagctcaagagagagatctgtgctgaccccaataaggaatgggtccagaagtacattagaaaactggaccagaaccaagtgagatcagaaactacagtcttctataaaattgcatcaaccctaaggacttcagcacctttgaatgtgaacttgacccataaatctgaagctaatgcatccactctcttttccacaaccacctcaagcacttctgtagaagtgaccagtatgacagagaactagtgtgatttggaatgtgatgccttaagtaatgttaaacttatttaacttattgatattacactattcccttccatgaatactagaaatccttaaatgcaagatgtagatccatttttttatttctctgtgaatcctggttcaacactttcaatgtatgagagatgaatgggtaaactttgtgtttgagagtccaaggtattgtttaaaatattattatggatattcctaattattaaaagaaatatattatttttgtac

SEQ ID NO: 1908 - DNA, 1593 bp, Rattus norvegicus
  Genbank Accession No. NM_031533
atgcccagaaagtggatttctgctctgttcctgctacagataagttactgtttcaaatctgggcactgtgggaaggtgttggtgtggccgatggactttagtcactggatgaatataaaaataatccttgatgaacttgtacagaggggccatgaggtcactgttctgaaaccttcggcttacttttttcttgatccgaaaaaatcgtctgaccttaagtttgaaattttttctacatctatcagtaaagatgagctgcaaaatcatttcataaaacttttggatgtgtggacttatgagttgccaagagatacatgtttgtcatattctcctatccttcaaaatctagtttatgaattttcttatttttatctaagtatttgtaaagacgctgtttcaaacaagcagctcatgacaaaactacaggaatccaagtttgatgttcttttcgcagatcctgtggcttcctgtggggatctgatagctgaactgctccacattccttttctgtacagtcttagcttctctccaggccacaaacttgaaaagtccattggaaaatttatactccctccatcttatgtgcctgtaattttgtcgggactggctggcaaaatgacattcatagacagggtaaaaaatatgatatgtatgctttatttcgacttttggttcgagagacttagacacaaggaatgggacacgttttacagtgagattttgggaaggcccaccaccgtagatgagacaatgagcaaagtagaaatatggcttattagatcctattgggatttgaaatttccccacccaacattaccaaatgttgactatattggaggactccattgcaaacctgctaaacccttgcctaaggatatggaagaatttgtccagagctctggagagcacggtgtggtggtgttttctctggggtcaatggtcagcaacatgacagaagaaaaggccaacgcaattgcatgggcccttgcccagattccacaaaaggttctttggaaatttgatggcaaaaccccagcaacattaggacccaataccagagtctacaagtggctcccgcagaatgacctcctgggtcacccaaaaaccaaagcctttgtaactcatggtggagccaatggcctctatgaggcaatctatcatggaatccctatgattggcattcctctgtttggagatcaacctgataatattgcccacatggtggccaaaggagcagctgtttcattgaatatcaggacaatgtcaaagttagattttctcagtgcactggaggaagtcatagacaatccgttctataaaaaaaatgttatgttgttgtcaaccattcaccatgaccagcctatgaagcccctggacagagctgtcttctggattgagtttatcatgcgccacaaaggggccaagcacctgagaccacttggacataaccttccctggtaccagtaccactctctggatgtgattggattcctgctcacctgttttgcagtcattgcagctcttactgtaaaatgtctcttgttcatgtaccgattctttgtaaagaaggaaaagaaaatgaagaatgagtag

SEQ ID NO: 1909 - DNA, 2497 bp, Rattus norvegicus
  Genbank Accession No. NM_031541
ggaatcccgcgccgaacacgggggcgggctgcccgggccatggcgcataaaacctctggccacctgcagggctactgctgctctggccactgtcaggcacacaccttgctgctcggtttctgtcatctctgtggcctccgtcgcctctgtcgccgtccccttcaggtcctgagcccagcgactctcggccgcgcacgcggacatgggcgtcagctccagggcacgctgggtggccttggggctgggcgttctagggctgctgtgtgctgcgctcggcgttatcatgattctcatggtgccctcgctcatcaagcagcaggtgctcaagaatgtccgcatagaccccagcagcctgtcctttgggatgtggaaggagatccctgttcccttctacttgtccgtctacttcttcgaggtggtcaaccccagcgaggtcctaaatggccagaagccagtagtccgggagcgcggaccctatgtctacagggagttcagacaaaaggttaacatcaccttcaatgacaatgacacggtgtcctacatagagaaccgaagccttcgtttccagccagacaggtcccagggctcagagagtgactacattgtactgcctaacatcctggtcctgggaggggcagtgatgatggaggacaagcccacaagcctgaagctgctaatgaccttggggttggtcaccatgggccagcgggcctttatgaaccgcacggttggtgagatcctgtggggctacgaagatccctttgtgaatttcctcagcaaatatttcccagacatgttccccatcaaaggcaaatttggcctgttcgttgggatgaacgactcgagttctggcgtcttcaccgtcttcacaggtgtccagaatttcagcaagatccatctggtggataagtggaacggcctcagcgaggtcaactattggcattcggaacagtgcaacatgatcaatggtactgccgggcagatgtgggcaccattcatgacacccgaatcctcactggaattcttcagcccagaagcctgcagatctatgaagctcacctaccaggaatcaagggtgttcgaaggcatccccacttatcgcttcacggcccccgatactttgtttgccaacgggtccgtctacccacctaatgaaggcttctgcccgtgccgcgagtccggcattcagaatgtcagcacctgcaggtttggtgcgcccctgtttctctcccagccccacttctacaatgctgaccccgtgctgtcagaagctgttcttggtctgaaccctgacccaaaggagcattccttgttcctagacatccacccggtcactgggatccccatgaactgttccgtgaagatgcagctgagtctgtacatcaaatccgtcaagggcgtcgggcaaacagggaagatcgagccagtagtcctgccattgctgtggttcgaacagagcgggatgatgggtggcaagaccctgaacacgttctacacgcagctggtgctgatgccccaggttcttcactacgcgcagtatgtgctgctggggcttggaggcctcctgcttctggtgcccatcatttaccaactgcgcagccaggagaaatgctttttattttggagtggtagtaaaaagggctcgcaggataaggaggccatgcaggcctactctgagtctctgatgtcaccagctgccaagggcacggtactgcaagaagccaagctgtagggcccagaagacaccacgagccccccaaacctgatagcttggtcagaccagccgcccagtccctacaccccacttctcgaggactctctcagcggacaacccgccagtgccacgtcctgagcccccagatgtcacactgtccacacggcacatagtgtgcggaaacactcagggaccagggacagacccgctgctgagtagagcctgttgggccacaggcgacctcttctaagtgacctgtgagccaggctgtgggaactgtagctgcccctcctgtaggagctggcgccgccggggctcctgactttctccgtctttctccagcaggctgaaagccttagttcccacagaggacacagatctgtcactcctaggggctgggcaaacatcggcctcttgcgtcacggctggacaagcagttccagatcctgaccagtctgcacacacactctggcgctgtatctggcccttctcctacagtctctgctgtcacctgaacactgaattggccactgtaagtggcagcggtggcaggccccctcagggtccttatttttcaggcgtggggtcaaagagagaggtgtgggccgtctacccctggcacctagtatatctcaccagagggtagggtatacagaggcccagcgtcccacaatcgaccccttttttttctactggaagagaaattttatcgtcttttgaaagaaagtcatgactgaagcaataaaccttttcacaaattcaaaaaaaaaaaaaaaaaaaaaa

SEQ ID NO: 1910 - DNA, 1624 bp, Rattus norvegicus
  Genbank Accession No. NM_031543
gccctagcgcacatggcggttcttggcatcaccattgccttgctggtgtgggtggccaccctcctcgtcatatccatctggaagaagatctataacagttggaacctgcccccaggacctttccctcttcccatccttgggaacatttttcagctggatttgaaggatatccccaagtctttcaccaagttggcaaagcgcttcgggccagtgttcacactgcaccttggctcaaggcgcatcgtggtcctgcatggctacaaggctgtcaaggaggtgctactgaaccacaagaatgagttttctggacggggggacattcctgtgttccaggagtacaagaacaaggggattattttcaataatgggcccacatggaaggatgtgcggaggttttccctaagcattctccgagactggggaatggggaaacagggtaatgaggcccgcatccaaagggaggcgcaattcctggtggaggagctcaaaaagaccaaaggccagccttttgaccccacatttctgattggctgcgcaccctgcaatgtcattgcggatatcctcttcaacaaacgtttcgactacaatgacaagaagtgtctgaggctcatgagtttgttcaatgaaaacttctacctgctgagcaccccctggatccagctttacaataactttgcggattatctacgatacctacctggaagccatagaaaaatcatgaaaaatgtgtctgaaataaaacagtacacacttgaaaaagccaaggaacaccttcagtcactggacatcaactgcgcccgggatgtgactgactgtctcctcatagagatggagaaggaaaaacacagccaagaacccatgtacacaatggaaaatgtttctgtgactttggccgacctgttctttgcaggaactgagaccaccagcacaactctgagatatgggctcctgatcctcatgaaatacccagaaattgaagagaaacttcatgaagaaattgacagggttattgggccaagccgcgtccctgctgtcagagacagactggatatgccctacatggatgctgtggtgcatgagatccagagattcatcaatcttgtcccttccaacctaccccatgaagcaaccagagatactgtgttccaaggatatgtcatccccaagggtacagttgtgattccaactctggactccctcttatatgacagccatgagtttccagatccagagaagtttaaacctgagcatttcctgaatgaaaatgggaagttcaagtacagtgactatttcaaggcattttctgcaggaaagcgtgtgtgtgttggagaaggcctggcccgcatggaattgtttctgctcctgtctgctattctgcagcattttaacctgaagtctctggttgaccctaaggatatcgacctcagtcctgtcacagttggctttggcagtatcccaccccaatttaaactctgtgtcattccccgttcatgagacctgaaaacttcctgatatcccttccattgttatcccttaaactatgactgtttttaaaaaacccaagcatatagagttcctatcataaaatgaaaccgaaaaaataaataaaaccttgatgaattgt

SEQ ID NO: 1911 - DNA, 1605 bp, Rattus norvegicus
  Genbank Accession No. NM_031546
agtcattacaacccaggtgtggatgctggagtgtttcctttgtcttctattttaaagatatcttgaaaaaaacctgtcactgtccttttcctgcgaccatgtcttccatcaagattgaatgtgttttaagggagaactacaggtgtggggagtcccctgtgtgggaggaggcatcaaagtgtctgctgtttgtagacatcccttcaaagactgtctgccgatgggattcgatcagcaatcgagtgcagcgagttggtgtagatgccccagtcagttcagtggcacttcgacagtcaggaggctatgttgccaccattggaaccaagttctgtgctttgaactgggaagatcaatcagtatttatcctagccatggtggatgaagataagaaaaacaatcgattcaatgatgggaaggtggatcctgctgggagatactttgctggtaccatggctgaggaaacggccccagctgttctggagcggcaccaagggtccttgtactccctttttcctgatcacagtgtgaagaaatactttgaccaagtggatatctccaatggtttggattggtccctggaccataaaatcttctactacattgacagcctgtcctacactgtggatgcctttgactatgacctgccaacaggacagatttccaaccgcagaactgtttacaagatggaaaaagatgaacaaatcccagatggaatgtgcattgatgttgaggggaagctttgggtggcctgttacaatggaggaagagtaattcgcctagatcctgagacagggaaaagactgcaaactgtgaagttgcctgttgataaaacaacttcatgctgctttggagggaaggattactctgaaatgtacgtgacatgtgccagggatgggatgagcgccgaaggtcttttgaggcagcctgatgctggtaacattttcaagataacaggtcttggggtcaaaggaattgctccatattcctatgcagggtaaactgcagctcttccttgctgtcagaagaaaaagctttgaagacaactggagaattaagggagagaaatcaatgaactttcaatcttgtttttttaatgaggcagtgatattatagcatggttaaactgctttaatttacacttttgattgggtgctggggaataaacctaaagcatggcatattaatgaagaacatatggtaaccatgaactccatctctggattcctttatttacaattttttaaaggttgaatattcgcaccagagaatgacaagtggttttgacaacatactctaggccttctattaaaaacaatctgtagaaaaggagctcaactatcaatcatcctgatcaattgctctggggcttgaaatgagacaatttccattctttttttttgcattccatacttgctgtacataaggcttccaaaaaatcaacgcatagaaacttagttgtaatttataatgattgtgtgacttttcatgtgttattttacaaactaaaatattaccagatgttattcaaacactggagcacaaactgtggttttaactgccacctagtggctatacaaataaatgcatcacattacaaagaaaaaa

SEQ ID NO: 1912 - DNA, 3081 bp, Rattus norvegicus
  Genbank Accession No. NM_031548
tcagcctgggatgcgggcacggtcccggacagccccattctgccttcacgctaatgatgctggaccacaccagagcccctgagctcaacattgacctagaccttcacgcctccaactcgcctaaggggtccatgaagggcaaccaattcaaggagcaagacccttgtcctcctcagcccatgcaaggactggggaagggggacaaacgtgaagagcagggcctgggcccggaaccctcagcaccccggcagcccaccgaggaggaggaggcactgattgaattccaccgctcctaccgggagctcttccagttcttctgcaacaacaccaccatccacggggccatccgcctggtgtgctccaaacacaaccgcatgaagacggccttctgggcggtgctgtggctgtgcaccttcggcatgatgtactggcagttcgccttgctgttcgaggagtacctcagctacccagtgagcctcaacatcaacctcaattcagacaagctggtcttccctgccgtcactgtctgcacccttaatccttacagatacactgaaattaaagaggagctggaagagctggaccgcatcacggagcagacgctttttgacttgtacaaatacaactcttcctacactcgccaggctggggcccgacgccgcagctcccgcgacctcctgggtgctttcccgcaccccctgcagcgcctgcgcactccacctccgccctactccggccgcacggcgcgcagcgggtcttccagcgtacgcgacaacaatccccaagtggaccggaaggactggaagatcggcttccaactgtgcaaccagaacaaatcagactgtttctaccagacatactcctctggggtggatgcagtgagggagtggtaccgcttccattacatcaacattctgtccagactgtcggacacctcgcccgctctagaggaagaagccctgggcaacttcatcttcacctgtcgcttcaaccaggccccctgcaaccaggcgaattattccaagttccaccaccccatgtacgggaactgctacactttcaatgacaagaacaactccaatctctggatgtcctccatgcctggagtcaacaatggtttgtccctgacactgcgcacagagcagaatgacttcatccccctgctgtccacagtgacgggggccagggtgatggtgcatggtcaggatgagcctgcctttatggatgatggtggcttcaacttgaggcctggcgtggagacctccatcagtatgagaaaggaagccctggacagcctcggaggaaattacggcgactgtactgagaatggtagcgatgtcccggtcaagaacctttacccttccaagtatacacagcaggtgtgcattcactcctgcttccaggagaacatgatcaagaagtgtggctgtgcctacatcttctaccctaagcccaagggagttgagttctgtgactaccgaaagcagagctcctggggctattgctattataaactgcagggcgccttctccttggacagcctgggctgtttctccaagtgtcggaagccttgtagtgtgatcaactacaaactctctgccggctactcacggtggccatctgtgaagtcccaggattggatcttcgagatgctgtccttgcagaacaattacactattaacaacaaaagaaacggagttgcaaagctcaacatcttcttcaaggagctgaactataaaactaattcggagtctccttctgtcacgatggtcagcctcctgtccaacctgggcagccagtggagcctgtggtttggctcgtccgtgctctctgtggtggagatggcggagctcatcttcgacctcctggtcatcacacttctcatgctgctacgccggttccggagccggtactggtctccaggacgaggggccaggggtgccagggaggtggcctccactccagcttcctccttcccgtcccgtttctgtcctcaccctacatccccaccaccttctttgccccagcagggcatgacccctcccctggccctgacagcccctccacctgcctatgctactctaggccccagtgcccctccactggactctgcggcgcctgactgttctgcctgtgccctggcggcgctctgagagaggagaaggatcctctcacccagccctgagctcccttgtaaactgatggatatctcacttcagcacatcttccccagcggccccgccgagccctctgtggtgtgcctgcctgagggaacaggctgagtaaggggcccaggaagccgtccagaggacaggggctaacgatctgctcagagctgccctgcccctgcttctgaacactgccttccacacaagcacagacaagttccctcttccctcggatcagcccagccagacttggagctctgacaaggaactttcctgggagaggaccaaggaacaaatagaacagccatcgcactcctacccccgtgaccagaggctggcctggcctcactgccttcagggacactgatgtctgctcctctccttgaacttgggtggggaaccccacccaaaagcccccttgttagttctttggcaattcccctcccctcactcctcagggtggggactagagtaagacagaccagggtaggcctggtgttctctctcattctcaagactctctcatttgatacaccataccccagtgcctctgtggtgttgtctccttctttctgtttcctcagcctggaagcttctttcactgtccctcagaacacacagtctatgcatcccttagaaacctgcccaaaggcaccatttcttttgtgaactcagttaccctgttatgtctcccccagaattgtcgccctctcccctcacccccacagtgtactgtattatatgttcacattcttttgtgtctgcctccctgggtaaactgagctccttgtgtggtcagggatgagatttgctctgttttgtatccttccggtctagcccagtctcccacttgggacgggtaggcaggtactcaataaaggcttgttccatcaaaaaaaaaaaaaaaaaaaaa

SEQ ID NO: 1913 - DNA, 1186 bp, Rattus norvegicus
  Genbank Accession No. NM_031549
agggcgggttctcaggcaccttcactggcttggatccctcggggtacaggctgttcaccaacttgctcagaatcacgccattcttcagccacacctggaagcccagacagcaacgctactctccttccagcccacaaacgaccaagccttttctgcctcaacatggccaacaagggtccatcctatggcatgagccgtgaagtgcagtccaagattgagaagaagtatgatgaggagctggaggagcggctagtggagtggattgtaatgcagtgtggccctgatgtgggccgtccagatcgtgggcgcctgggcttccaggtgtggctgaagaatggcgtgattctgagcaagttggtgaacagcctgtaccccgagggatccaagccagtgaaggtgcctgagaacccgccctccatggtcttcaagcagatggaacaggtggctcaattcttgaaggcagctgaggattatggagtcacgaagactgacatgttccagactgttgacctctttgaaggaaaagatatggcagcagtgcagaggactgtaatggctttgggcagtttggccgtgaccaagaacgatggacactaccgtggagatcccaactggtttatgaagaaagcccaggagcataagagggagttcacagacagtcaactgcaggaggggaagcacgtcattggccttcaaatgggcagcaacagaggggcctcacaggctggcatgacaggctatgggcgaccccggcagatcatcagttagaaagggaaggccagctctgagctgcagcatcctgcttagcctgcctcacccacgcctatataggttcttagcccggacagctttgaggtatcactgggcaaagatgactgcacatgggcagctcccacctatcctcagcctcagccccgcttcttaccccagagccaccactgtcctggcccctgttcccagctgtccccccacctctaccgtttcccccatcctggagtaagcagggagaagtgggctgaggtagcctgactgtaggccagcccactgtccttggaagccaatgtcctttgaaagagaccctgcctctacatctttttctggaatattttttgggttgaaattcaaaaaggaaaaaaatatatacatatacatatatctccaaaaaaaataaaaaaaaaaaaaaaaa

SEQ ID NO: 1914 - DNA, 2246 bp, Rattus norvegicus
  Genbank Accession No. NM_031552
ggcaggagtcggatgtagatcgctcctgagttcaattcccagcaaccacacctagccgggaagacggacacgcgtcggctcccctgcacgcaaagcagctttggatcgcctgcagggcaagaagactggaagcatgagttcagacagcagccaagcggtgatcaccacccctcctcctcccagcatgcctcacaaagagaggtattttgaccgaatcaatgaaagtgatccagaatacctccgagagaggaacatgtctcctgatctacgggaggacttcaatatgatggagcagaggaagcgagtcactcagatcctgcagagtcctgcctttcgggaagacctagagtgcctcacccaagaacagatgaagaaaggccacgacccgaccggattgctagcgttacagcagatcgccgactacatcatggccaactccttcaccggtttttcttcacctcccctgagtcttggcatggtcactcctattaatgaccttcctggtgcagacacatcctcgtatgtgaagggagagaagctcactcgttgcgaactcgccagcctgtacagactcgcagatctgtttgggtgggcacatctggcaaatacatacatctcggtacgagtaagtaaggagcaggaccacatcataatcatccccagaggcctccctttctctgaagccacagcctctgctctggtgaaggtcaacataataggagaagtggtggaccaggggagtactaatttgaaaattgaccattcaggattcagtccccatgctgcaatctattcaacccgtcccgatgtgaagtgtgtgatacacatccacaccctcgctacagcagctgtgtcttccatgaagtgtgggatccttccaatttcccaagagtctctcatcctgggagatgtagcctattatgactaccaggggtcgcttgatgaggaggaggaaagaatcgaacttcagaaagttctgggtccaagctgtaaggtgctggtcctcaggaaccatggcgtggtagctcttggagaaacacttgaggaggctttccactacatcttcaatgtacagatggcctgtgagattcaggtgcaggctgtagcaggggcagggggagtggacaatcttctcatactggatcttcagaaatacaaagctttcacccacggtgttgccatgactggaggaggcggtgtgaatatgggttcccatcagaagtggaaagttggcgagattgagtttgaagggctcatgagaaccctggacaacttgggctacagaacaggctacgcatacaggcatcctctagttcgagagaagcctcggcacaagagtgacgtggagatcccagcaactgtgactgcattctcctttgaagatgatagtgtgccactctctcccctcaagtacatggcacagagacagcagcgtgaaaaaacaagatggctgaattctccaaatacatacatgaaagtgaatgtgccggaggagtcccggaacggggaaactagtcccaggaccaaaataacgtggatgaaagcagaggacccctctaaagttagtagtggaacacctatcaaaattgaagatcccaatcagtttgttcctctaaacacgaacccgactgaggtgctggagaagagaaataagattcgggaacagaatcgctatgacctgaagacagcagggccacagtctcagctgctggcggggatcgttgtggacaaaccgccttctaccatgcggtttgaagacgatgatcagggcccaccagcccctcctaacccattcagtcatctcatggaaggagaacttgaagaatatacgaagacaatcgagagacagcagcaaggcctggacgaaaaccacgagctgttttccaagagcttcacctctgtggatgtgcctgtcattgtgaatggcaaggacgagatgcacgatgttgaagacgagctcgctcagcgcgtcagcaggctcacgacgagcaccaccatagagaacatcgagatcaccatcaagtccccagacagaactgaagaggtcctgtcacccgatggctcgccttcaaagtcaccatccaagaaaaagaagaaattccgcacaccttcttttctcaaaaagaacaaaaaaaaaggagaaagttgaggcctaagtagtctttctgtaatttgtacattacattgtggcattgcacagttaaataccatattttagttaatcgttaatatacggtggtagagcc

SEQ ID NO: 1915 - DNA, 4377 bp, Rattus norvegicus
  Genbank Accession No. NM_031559
agtcggtcgactccgagctcagtgaggacctaaagcagaggactgtggtgcggaggacagtgcttgctccggggagtgcagagcaataggtccccactcaagatggcagaggctcaccaagctgtggccttccagttcaccgtcacccccgatggcattgacctccgcctgagccacgaagccctcaaacagatctgcctgtcggggctgcactcctggaagaagaagttcatccggttcaagaatggcatcatcactggtgtgttccccgcgaatccgtccagctggcttatcgtggtggtgggtgtgatttcatccatgcatgccaaagtggacccctccctgggcatgatcgcaaagatcagtcggaccctagacaccactggccgcatgtcaagccagacgaagaacattgtgagcggcgtcctctttggtacagggctctgggtggcagtcatcatgaccatgcgctactcgctgaaggtgctgctctcctaccacggctggatgtttgcagaacacggcaaaatgagccgcagcaccaagatctggatggctatggtcaaggtcctctcaggtcggaagcccatgttgtacagcttccagacgtctctgccacgcctgcctgtcccagctgtcaaagatactgtgagcaggtacctggaatctgtaaggccactgatgaaggaagaagacttccagcgcatgacagcactggcccaggattttgctgtcaacctcggacccaaattgcagtggtatttgaagctaaaatcctggtgggccacaaattacgtgagtgactggtgggaagaatatatctacctgcggggccgagggccgctcatggtcaacagcaactactacgccatggagatgctgtacatcaccccaacccatatccaggcagcgagagctggcaacaccatccacgccatactgctgtatcgtcgcacattagaccgtgaggaactcaaacccattcgtcttctgggatccaccattccactctgctcagcccagtgggagcgactcttcaatacttcccggatccctggggaggagacagacaccatccaacatatcaaggacagcaggcacattgttgtgtaccacagagggcggtacttcaaggtctggctctaccacgatgggaggctgctgaggccccgagagctggagcagcagatgcagcagatcctggatgatccctcagagccacagcctggggaggccaagctggccgccctcactgctgcagacagagtgccctgggcaaagtgtcggcagacctattttgcacgagggaaaaataagcagtccctggatgcggtggaaaaggcagcgttcttcgtgacgttggacgaatcggagcagggatacagagaggaggatcctgaggcatccatcgacagctacgccaaatccctgctgcatggaagatgctttgacaggtggtttgacaagtccatcacctttgttgtcttcaaaaacagcaagataggcataaatgcagagcactcctgggcggacgcgcccatcgtgggccatttgtgggagtatgtcatggccaccgacgtcttccagctgggttactcagaggatggacactgtaaaggagacaccaaccccaacatccctaagcccacaaggctacaatgggacattccaggagagtgccaggaggtcatagatgcatccctgagcagcgccagtcttttggcaaatgatgtggacctgcattccttcccatttgactctttcggcaaaggcttgatcaagaagtgccggacgagtcccgatgccttcatccagctggcgctgcagctcgcacattacaaggacatgggcaagttctgcctcacatatgaggcctccatgacccggctcttccgagaagggaggacagagactgtacgctcctgcactatggagtcctgcaactttgtgcaggccatgatggaccccaagtcaacggcagagcagaggctcaagctgttcaagatagcttgtgagaagcaccagcacctgtaccgcctcgccatgacgggcgccggcatcgaccgccatctcttctgcctctatgtggtgtccaagtatcttgcagtcgactcacctttcctgaaggaggtattgtctgagccatggaggttgtctacgagccagactcctcagcagcaggtggagctctttgactttgagaaaaaccctgactatgtgtcctgtggagggggctttgggccggttgccgatgacggctatggtgtctcctacattatagtgggagagaatttcatccacttccatatttcttccaagttctctagccctgagacagactcacaccgctttgggaagcacttgagacaagccatgatggacattatcaccttgtttggcctcaccatcaattctaaaaagtaaacccctgagccacacggaaggaaaacggaccctcgtgatacaaaccaaatgaatagatgttgctcctgaccataggacaggcagaaaattgctcttataaaactcagttttccttccagaaggtttaccgtcagtctccctagaacaacagtaggcttcacgtgtgaattgtgaccctactacatccagagatgccttggctccaggaatattgggcacagtcccctgatgtcttttgaatcggctcctactggataaagggatttaaatgctggtgaattcctggattctgggggttgtttcttcacatgtgttggaggtgacagacttcctcagtggtgaccctgtgaatacttgggcgtctgactccacccaggcagtgtgagcatcaccttgtggaaagagaaagtgtcttcagagccagcagaggcaacagctgtagctaacacatctgtaacacactaatggaatggttaggcctggggattaaggttctgctatgagtgacagccactgtccctttggaagttcacatttccaggaagcagagtaccacctccccagtgccaccttcctcacacatcttcaaaacccagtgccttaaagaaggggcccattggcaagcgggaccatagagaagacttagcatctgtgaagcctttgggtggatatgtgaggatgctgcttccccttactggttcctgcataaagatgtccctaagtaagcacttcccccacccctagaaaatgaggtccttggtgaaggcagggatgctggagtctcattgcctgccagttccattaagccacaaaatagcagacatgtgtccacagagggaggggcttggtagtcaaaggctgcatagctggacaacagcgggagagtgtggcttgctgtatttgacagctgttggcaagaggagtgagaccctggtcaccaagtcagacatactgacacaggcagccaaagctcacggagccaggagatatagatagatactggcttgtattctggcagatacacccctgggcttatcttctaatcccacccagtcagattccaaccagagtcaaattccatagaaggctaggtcattttggcgacagactcagggatctcaagtaatgggtgcttttacccacatgccatccctcagtgggagtgcctttcttgaaagcatccaatgggctaaagcagctctaccaagtctgtttggtatttaatgtaaacattagcattaatggagtggtctctcctacctgtcaccatcctgtcctgacaagcttagctctccgaggtttacatcatgtatttattttccagtgcccctttggccttgtttgattcctgcccctgtgccagaagtggcccagaagtgaggggtggggtgaccagcagtgcagagaggtgctggctgaacagttcatgtgtgtcttatgggtatacatgtataaattttgtaatgtaaaaaaaaaaatcatacctaaaagggccaaagttttttttttttttactaaaaccaagaaaacaaaagacaacataaagacataagcagaaacaaactgttgtaagtcagagcggcctgactctcgctgctgtgaccactcaccaacctgtgttactcagagtagcccggctagtgcccgagtgggacattcctctctcaggtttccagtgtccttgctgctcctgagcagttaccaatgcaatttcgcattccttacaaggcagaagagtgggctctcactgtatgtgttcaaaggaggaggtaagactattgtgtatttaatttaatgtggaacaaaatatagtcttaccgcagccaaggttcaaatttggtgttctaatctgtccattgcatgtaaataccatatctgtttggatataaatcttagaagtgcatgtgtgagcgaatgtagctggccattaataaaacattaatactgtctact

SEQ ID NO: 1916 - DNA, 1489 bp, Rattus norvegicus
  Genbank Accession No. NM_031563
gaattccgagagccccaccgccgccgccggcctagtcaccatcacacccgggaggagccgcagccgtcgccgccggccccagtcaccatcaccgcaaccatgagcagcgaggccgagacccagcagccgcccgccgcccccgccgccgccctcagcgccgccgacaccaagcccggctccacgggcagcggcgcgggtagtggcggcccgggcggcctcacatcggcggcgcccgccggcggggacaagaaggtcatcgcaacgaaggttttgggaacagtaaaatggttcaatgtaaggaacggatacggtttcatcaacaggaatgacaccaaggaagacgtatttgtacaccagacggccataaagaagaataaccccaggaagtaccttcgcagtgtaggagatggagagactgtggagtttgatgttgttgaaggagaaaagggtgcggaggcagctaatgttacaggccctggtggagttccagttcaaggcagtaaatacgcagcagaccgtaaccattataggcgctatccacgtcgtaggggtcctccacgcaattaccagcaaaattaccagaatagtgagagtggggaaaagaatgaaggatcggaaagcgctcctgaaggccaggcccaacaacgccggccctatcgcaggcgaaggttcccaccttactacatgcggagaccctatgcgcgtcgaccacagtattccaacccccctgtgcaaggagaagtgatggagggtgctgacaaccagggtgcaggagagcaaggtagaccagtgagacagaatatgtatcggggttacagaccacgattccgcaggggccctcctcgccaaagacagcctagagaggatggcaatgaagaggacaaagaaaatcaaggagatgagacccaaggtcagcagccacctcaacgtcggtatcgccgcaacttcaattaccgacgcagacgcccagagaaccctaaaccacaagatggcaaagagacaaaagcagccgattcaccagctgagaattcgtccgctcccgaggctgagcagggcggggctgagtaaatgccggcttaccatctctaccatcatccggtttggtcatccaacaagaagaaatgaatatgaaattccagcaataagaaatgaacaaagattggagctgaagaccttaagtgcttgctttttgcccgttgaccagatccactagaactgtctgcattatctatgcagcatggggtttttattatttttacctaaagatgtctctttttggtaatgacaaacgtgttttttaagaaaaaaaaaaaaaaggcctggtttttctcaatacacctttaacggtttttaaattgtttcatatctggtcaagttgagatttttaagaacgttcgatttttaatttgtaataaagtttacaacttgattttttcaaaaaagtcaacaaactgcaagcacctgttaataaaggtcttaaatggaattc

SEQ ID NO: 1917 - DNA, 650 bp, Rattus norvegicus
  Genbank Accession No. NM_031570
cactccgtaagacgaagccatgtctagctcgagcgccaagattgtgaagcccaatggcaagaagcgagacgagttcgagtctggcatctctcaggcgctgctcgagctggagatgaactccgaactgaagacgcagctgtgggaactcaacatcaccgcggcaaaggaaatcgaagtcggtggtggtcgaaaagccatcataatttttgtaccagttcctcagctgaaatctttccagaaaatggccaagtccggcaaggttcgcgaattggagaaaaagttcagtgggaaacacgtagtcttcattgctcagaggaggattctgcccaagccaacccgaaaaagccgtacgaaaaataagcaaaaggcccagaagccgaccctgacgagcagtgcagaccgacgcatccttgaggatttggtcttcccaagtgaaattgtgggcaagaggatccgtgtgaaactggtaggcagccggctcataaaagttcatttagacaaagcacagcagaacaacgtggagcacaaggtcgaaactttttctggcgtgtacaagaagccactaggcaaggatgttaactttgaattcccagaagtttcagtttaaagaaaaatgactgaataaaatgtcattcataataaaaaaaaaa

SEQ ID NO: 1918 - DNA, 1388 bp, Rattus norvegicus
  Genbank Accession No. NM_031573
gaattcctgtcacttccattcaagagcctacaagaacctaactaggtgcttgggatcccctgagatccagctgaccatgacccgggatgaggccctccctgactctcattctgcacagaatttctatgagaactacgagcccaaggagatcctgggcaggggagtcagcagcgtggtcaggagatgcattcacaaacctacgtgccaagaatacgcagtaaaaatcatcgacatcaccggcggaggaagctttagctccgaggaggtacaggagcttcgggaagccaccctgaaggaggtggacattctgcagaaggtctcaggacaccccaacatcatacagctgaaggacacttacgagaccaacactttcttcttcttggtatttgatctgatgaagagaggggaactctttgactatctcacagagaaggtcaccttgactgagaaggaaaccagaaagatcatgcgggccctgctggaggtggtctgcaccttgcacaaactcaacattgtccatcgggacctgaagccggagaacatccttctggatgacaacatgaacatcaagctcactgacttcgggttttcctgccagctgcagccaggagagaagctccgagaggtttgtgggactcccagttatctggcccccgaaatcatccagtgctccatggacgaaggccatcctggctatggaaaggaggtggacatgtggagcacaggagtcatcatgtatacgctgctggctggctccccgcccttctggcaccggaagcaaatgctaatgttgaggatgatcatggatggcaaataccagttcggctcaccagagtgggatgactactcagataccgtgaaagacttggtatctcgcttcttggtggtgcaaccccaggaccgctgctcggcggaagaggccttggcgcatcctttcttccaggagtacgtggtggaagaggtgcggcacttcagccctcgagggaagttcaaggtcatctgtctaactgtgctggcctcggtaaggatctactaccagtaccgtcgggtgaagccggtaaccagggagatcgtcatccgagacccctacgccctacggccattgcgcagactcatcgacgcctatgctttccgcatctacggccactgggtgaagaaagggcaacagcagaacagagctgccctcttcgagaacacgcccaaggcagtgctcctctccttggctgaggaggaggacttctgaggggtggcggggcacaggggagaaagcaaacagggtacgcgcccccagaactgtgagaagaggatgcctcaaggaggaggcttctgcaaaggagctgtgaccctactctgcactctcaaaggctcgccactagatgcgggaattc

SEQ ID NO: 1919 - DNA, 2441 bp, Rattus norvegicus
  Genbank Accession No. NM_031576
gatctggtcggtaccggagagcgcaggttgtatcaccaacatgggggactctcacgaagacaccagtgccaccatgcctgaggccgtggctgaagaagtgtctctattcagcacgacggacatggttctgttttctctcatcgtgggggtcctgacctactggttcatctttagaaagaagaaagaagagataccggagttcagcaagatccaaacaacggccccacccgtcaaagagagcagcttcgtggaaaagatgaagaaaacgggaaggaacattatcgtattctatggctcccagacgggaaccgctgaggagtttgccaaccggctgtccaaggatgcccaccgctacgggatgcggggcatgtccgcagaccctgaagagtatgacttggccgacctgagcagcctgcctgagatcgacaagtccctggtagtcttctgcatggccacatacggagagggcgaccccacggacaatgcgcaggacttctatgactggctgcaggagactgacgtggacctcactggggtcaagtttgctgtatttggtcttgggaacaagacctatgagcacttcaatgccatgggcaagtatgtggaccagcggctggagcagcttggcgcccagcgcatctttgagttgggccttggtgatgatgacgggaacttggaagaggatttcatcacgtggagggagcagttctggccagctgtgtgcgagttctttggggtagaagccactggggaggagtcgagcattcgccagtatgagctcgtggtccacgaagacatggacgtagccaaggtgtacacgggtgagatgggccgtctgaagagctacgagaaccagaaaccccccttcgatgctaagaatccattcctggctgctgtcaccgccaaccggaagctgaaccaaggcactgagcggcatctaatgcacctggagttggacatctcagactccaagatcaggtatgaatctggagatcacgtggctgtgtacccagccaatgactcagccctggtcaaccagattggggagatcctgggagctgacctggatgtcatcatgtctctaaacaatctcgatgaggagtcaaacaagaagcatccgttcccctgccccaccacctaccgcacggccctcacctactacctggacatcactaacccgccacgcaccaatgtgctctacgaactggcacagtacgcctcagagccctcggagcaggagcacctgcacaagatggcgtcatcctcaggcgagggcaaggagctgtacctgagctgggtggtggaagcccggaggcacatcctagccatcctccaagactacccatcactgcggccacccatcgaccacctgtgtgagctgctgccacgcctgcaggcccgatactactccattgcctcatcctccaaggtccaccccaactccgtgcacatctgtgccgtggccgtggagtacgaagcgaagtctggccgagtgaacaagggggtggccactagctggcttcgggccaaggaaccagcaggcgagaatggcggccgcgccctggtacccatgttcgtgcgcaaatctcagttccgcttgcctttcaagtccaccacacctgtcatcatggtgggccccggcactgggattgcccctttcatgggcttcatccaggaacgagcttggcttcgagagcaaggcaaggaggtgggagagacgctgctatactatggctgccggcgctcggatgaggactatctgtaccgtgaagagctagcccgcttccacaaggacggtgccctcacgcagcttaatgtggccttttcccgggagcaggcccacaaggtctatgtccagcaccttctgaagagagacagggaacacctgtggaagctgatccacgagggcggtgcccacatctatgtgtgcggggatgctcgaaatatggccaaagatgtgcaaaacacattctatgacattgtggctgagttcgggcccatggagcacacccaggctgtggactatgttaagaagctgatgaccaagggccgctactcactagatgtgtggagctaggagctaccagcctcccacccctcgctccctgtaatcacctaacttctgccgacctcacctctggtggttcctgcctggcctggacacagggaggcccagggactgactcctcctggcctgagtggtgccctcctgggcccctaggcagagcccggtccattgtatcaggcagcccagccccagggcacatggcaagagggactggacccacctttgggtgatgggtgccttaggtcctctgcagctgtacagaaggggctcttctctccacagagctggggtgcagcccccacacgtgattttgaatgagtgtaaataattttaaataacctggcccttggaataaagttgttttcagtaaatt

SEQ ID NO: 1920 - DNA, 2638 bp, Rattus norvegicus
  Genbank Accession No. NM_031579
cacaatcttcaatgagtagacatattcctcagttctgtggtgttctcggtcacacatttatggagtttctgaagggcagtggagactactgccaggcacagcacgacctctatgcagacaagtgaactgtagaaattcattactactccaccaagaagcccccataagagtggatagcctggacacagtcgtgttgaattgaaatctgcagagcattttccaagagctcagacctggatggggtaaacctcagtgcacttcctctgtatcgcctcagtattcctggattgaagagtcactgcttcttgtgaggaggttcatttcattgcccgtttctcccgactcatactcaaagcactgagaatttcaagtggagtatattgaatattgaagtagacttcaggttgttttttggttttgttttggttttttgttttgttttgttttgttttgttttggttttcagtttttgtttggaatcatttctgtattcaattttttaattctttcataaccctattgggtgtttttttaaactaaattaacatggctcgaatgaaccgccctgctcctgtggaagtcacatacaagaacatgagatttcttattacacacaatccaaccaatgcgaccttaaacaaatttatagaggaacttaagaagtatggagttaccacaatagtaagagtatgcgaagcaacttacgacactactcttgtggagaaagaaggcattcatgttcttgactggccttttgatgatggtgcaccaccatccaaccagattgttgatgactggttaagtcttgtgaagattaagtttcgtgaagaacctggttgctgtattgctgtccattgtgtcgcaggccttggcagagctccggtgcttgttgccctagcattaattgaaggtggaatgaaatatgaagatgcagtacaattcataagacaaaagcggcgcggagcttttaacagcaagcaacttctgtacctggagaagtaccgtcctaaaatgcggctccgcttcaaggattccaacggtcatagaaacaactgttgtattcaataaaactggggtgcctgatgccattgccttggaagaggaacttcagatgggacctgatttgttatttacccaatgtgtccacttacctgtggaagctccaggggaatattgaaaaagttttaccaggccacaagcttgacagaattgcaacctctataattgggctatgatcaacacgtttggacacttagcaaaagatttttgctggtcagcatttaaaatgtgcttattatttgtaccaattgacctttcctaaaataaggtattgagtaatgtcattaaatgtactcctgtgccagaatattattagtctataaggaatttagaaggattaggtgccaaaatacccagcacaatacttgtatatttttagcatcatacagaaccaaaattccaagaactaagaactctccagaccttccatggtgtattccttcagtcatttcaaacaccgcagggcttctcttgttatctgcctgctcactctatgtttacatctcccacacttacaccagaacacatcaggtttgcttagctatcttttaagtcttgcaatgattatttaatgtctctgtcttattttgtgctgttttgggaaacctccatttgaaaatcaactttgttacagaagcacatatcttcaataatgtctccagacaaaaagccttatagttaatttaatgtttgcactcgggtgcaacctgacagggagggcctgaacaagaaaggagaggaggctattaaatatttttagtaatatgttgcctttgtcttgtgcagaacatgtagagtatgctctttaatttagtaaatatttttaagacgtagagatacattgttgtagctaaccacttaatcaaaatttctgaaattcttgtgttttccatacctatctgaggttttccaacttgtttgaattatggttttccccttctcttcccaatctcttgcaaaaaagtaaaagtgggatctgctagtgaactgagcagaaatattttatacgccttttgagctatgtaacttaataattggatacttgatcatttgttttattatgtaatcgataaaatggtgatgtgtattaatgttagttcaaccatatatttatactgtctgggaatgtgtggttatagttctgtgggagaaatagtttgtcagtgttcaccagcttgtaaaaacttagtgcgagagcttcaacatctaaataaatgatgaaacgcattcgtcactgaggtcactttgcttaaaattaacttaatttgtagaaaacagtggattcaattattatcatttcagtttatggacaaatttgttagggttaccaagtgcgtttaaaaattgctctttaaaggtctagataattgtgaatcaattgaatgttgggtaccaagggaaaacggtttgtaatagttgatgaccttgatttttaattcaattccaccagtcacttgtagctttatgcagtttccaatccacttttctcatttttaagtttattacttacctgtatatattttgaaattaatttgaacctgcgtatttggcacatgatggcttataaattttaactttc

SEQ ID NO: 1921 - DNA, 2152 bp, Rattus norvegicus
  Genbank Accession No. NM_031584
atgcacgcgtccgcctgagctgagcgcgctgccttcagcagcatttggagccctgtgggtgaagcctcaggaacagctgcctccagggaccatgtcgaccgtggatgatattctagaacatataggggaattccacctttttcagaaacaaacatttttcctcttagctctgctgtctggtgccttcacccccatctacgtgggcatcgttttcctaggatttacccctgaccaccactgctggagtcctggggcagccaagctgagccagcggtgtggctggagccaggcagaggagctgaactacaccgtgccgggtctgggaccttcggacgaggcctccttcctcagccagtgcatgaggtatgaagtggactggaaccagagcacccttgactgtgtggacccactgtccagcctggctgcggacaggaaccagttgccattgggcccctgcgagcatggctgggtatacaacactcccggctcctccattgtcactgagtttaacctggtgtgtgctcactcctggatgctggacctgtttcagtcagtagtgaacgtggggtttttcatcggtgctatgatgattggctacctagcggacaggtttggccggaagttctgcctcttggtcaccatcctcatcaatgctatctctggggctctcatggcgatttctcccaactatgcctggatgttggtgtttcgctttctccagggactggtcagcaaagcaggctggttaattggctacatcctgattacagaatttgttgggctgggctatcgcagaatggtggggatttgctatcaaatcgccttcaccgttggcctcctgatcctggctggagtggcctatgtgattcccaactggagatggctacaatttgctgtgactctgcccaacttctgcttcctgctctatttctggtgcataccggaatctccaagatggctgatctcccagaacaaaatcgtaaaagccatgaagataattaaacatattgctaagaaaaatggaaagtcggtgccggtctctcttcagaacctgacaccagatgaggacgctggcaagaaattgaaaccttcaatcctggacttggtcagaacccctcagataaggaaacacacgttgatcttgatgtacaattggttcacgagctctgttctctaccagggcctcatcatgcacatgggccttgcaggggacaacatctacctggatttcttctactccgccctggtggagtttccagccgccttcatcatcatcctcaccatcgaccgggttggtcgccgctatccctgggctgtgtcaaatatggtggcaggagcagcctgtctagcctctgtttttatccctgatgatctacagtggctgaaaattaccattgcatgcttgggtagaatgggcatcaccatggcctatgaaatggtctgcctggtcaatgctgagctgtaccccacatacatcaggaatcttggtgtccttgtctgctcctccatgtgtgacattggcggcatcatcacgcctttcctcgtctaccgtctcacggacatctggatggagttcccactggttgtatttgctgtggttggccttgtcgctggggcacttgtgctgttgctacctgagaccaaagggaaggctctgcctgagaccatcgaggatgccgagaatatgcagaggccaagaaaaaaagaaagaaaagagaatttacctccaagtcaagcaagcagaccgtccgctaagctaaaaagaaagggcatcattgctgctggagctgactttgctctctctgaggccagagatggagcttctctctcccctccccccaaacccacacaaaccaacctcacttacccctgaactccatcagcaagagctgtagcttgcacggtctgttgcactgatgtgtcaagctcttcctcccagccaggattttccgcctcactctgctctcagcactcccaggaaatgaccattgctttactggattcgttatggttgttttttcatctttacattctttatttagtttccttctccaccacaacatcaaaccaaaatacccaagggagctgtgggccaggacaaccaactattaaagaagtaagaaatctgaaaaaacaataaacgtgggagaag

SEQ ID NO: 1922 - DNA, 3272 bp, Rattus norvegicus
  Genbank Accession No. NM_031588
gcggccgcagctgccgggagatgcgagcgcagaccggattgtgatcacctttccctcttcgggctgtaagagagcgagacaagccaccgaagcgaggccactccagagccggcagcggagggacccgggacactagagcagctccgagccactccagactgagcggacgctccaggtgatcgagtccacgctgcttcctgcaggcgacaggcgacgcctcccgagcagcccggccactggctcttcccctcctgggacaaacttttctgcaagcccttggaccaaacttgtcgcgcgtcaccgtcacccaaccgggtccgcgtagagcgctcatcttcggcgagatgtctgagcgcaaagaaggcagaggcaaggggaagggcaagaagaaggaccggggatcccgcgggaagcccgggcccgccgagggcgacccgagcccagcactgcctcccagattgaaagaaatgaagagccaggagtcagctgcaggctccaagctagtgctccggtgcgaaaccagctccgagtactcctcactcagattcaaatggttcaagaatgggaacgagctgaaccgcaaaaataaaccagaaaacatcaagatacagaagaagccagggaagtcagagcttcgaattaacaaagcatccctggctgactctggagagtatatgtgcaaagtgatcagcaagttaggaaatgacagtgcctctgccaacatcaccattgttgagtcaaacgagttcatcactggcatgccagcctcgactgagacagcctatgtgtcctcagagtctcccattagaatctcagtttcaacagaaggcgcaaacacttcttcatccacatcaacatccacgactgggaccagccatctcataaagtgtgcggagaaggagaaaactttctgtgtgaatgggggcgagtgcttcacggtgaaggacctgtcaaacccgtcaagatacttgtgcaagtgcccaaatgagtttactggtgatcgttgccaaaactacgtaatggccagcttctacaaagcggaggaactctaccagaagagggtgctgacaattactggcatctgtatcgccctgctggtggtcggcatcatgtgtgtggtggcctactgcaaaaccaagaagcagcggcagaagcttcatgatcggcttcggcagagtcttcggtcagaacggagcaacctggtgaacatagcgaatgggcctcaccacccaaacccaccgccagagaacgtgcagctggtgaatcaatacgtatctaaaaacgtcatctccagtgagcatattgttgagagagaagtggagacttccttttccaccagtcattacacttccacagcccatcactccacgactgtcacccagactcctagtcacagctggagtaatgggcacacggagagcgtcatttcagaaagcaactccgtaatcatgatgtcttcggtagagaacagcaggcacagcagtcccgccgggggcccacgaggacgtcttcatggcctgggaggccctcgtgataacagcttcctcaggcatgccagagaaacccctgactcctacagagactctcctcatagcgaaaggtatgtatcagccatgaccaccccggctcgtatgtcacctgtagatttccacacgccaagctcccctaaatcgcccccttcggaaatgtctccacccgtgtccagcatgacggtgtccatgccctctgtggcagtcagcccctttgtggaagaagagaggcctctgctgcttgtgacgccaccaaggctacgggagaagaaatatgatcatcacccccagcaactcaactcctttcatcacaaccctgcacatcagagtaccagcctcccccctagcccactgaggatagtggaggatgaggagtacgagacgacccaggagtatgagtcagttcaagagcccgttaagaaagtcaccaatagccggcgggccaaaagaaccaagcccaatggccacattgccaataggttggaaatggacagcaacacaagttctgtgagcagtaactcagaaagtgagacagaagacgaaagagtaggtgaagacacaccattcctgggcatacagaaccccctggcagccagccttgaggtggcccctgccttccgtctggctgagagcaggactaacccagcaggccgcttctccacacaggaggaattacaggccaggctgtctagtgtaatcgctaaccaagaccctattgctgtataaaacctaaataaacacatagattcacctgtaaaactttattttatataataaagtatttcaccttaaattaaacaatttattttattttagcagttctgcaaatagaaaacaggaagaaaaaaaaacttttataaattaaatatatgtatgtaaaaatgtgttatgtgccatatgtagcaatttttttacagtatttcaaaaacgagaaagatatcaatggtgcctttatgttctgttatgtcgagagcaagttttataaagttatggtgatttctttttcacagtatttcagcaaaacctcccatatattcagtttctgctggctttttgtgcattgcattatgatgttgactggatgtatggtttgcaaggctagcagctcgctcgtgttctctctctctctctctctctctctctctctgtctctctctctgtctctctctctctctctctctctctctctctctctctctctctctctctctctctgtctctctctctgcttcccgtagctcccaaccagtactgtcttggactggcacatccatccaaatacctttctactttgtatgaagttttctttgctttcccaatatgaaatgagttctctctactctgtcagccaaaggtttgcttcactggactctgagataatagtagacccagcagcatgctactattacgtatagcaggaaactgcaccaagtaatgtccaataataggaagaaagtaatactgtgatttaaaaaaaaaaacaaactatattattaatcagaagacagcttgctcttggtaaaaggagctaccattgactctaattttgactttttagttattgttcttgacaaagagtaacagcttcaagtacagcctagaaaaaaaaatgggttctggcctgctatcaggataaatctatcgacgtagatagattcaactcagtttcactttctgtcttgggggaaatgatccagccactcatatgacgaccaaccaaccacaggtgcctctgctccctgt

SEQ ID NO: 1923 - DNA, 1627 bp, Rattus norvegicus
  Genbank Accession No. NM_031595
catttctccctcacaaactggagcaaccggcgagcccggggcgggccctgtggcctcggtttggttcgtggagtcccagcggcagattcgctcggcaacgcggacagggccaattctgtcgcgtcaggaatcgcgggtgaagttcgccaccggtggagagaagacgttgagaaaagccgcgctgggctccctcaggggctcgtgcgcactcccagtttcggccttttcatgcaggaaatgaatctgctgccgacgcccgagagtccagtgactcggcaggagaagatggcgaccgtgtgggatgaagctgagcaagatggcattggggaggaggtgctcaagatgtccacagaagagatcgtccagcgcacacggctgctagacagcgagatcaagatcatgaagagtgaagtgctgcgagtcacccacgaactccaagccatgaaagacaaaatcaaagagaacagtgagaaaatcaaagtgaacaacaccctcccatacctagtctccaacgttattgagttgctggatgttgaccccaatgaccaggaggaggatggtgccaatattgacctggactcgcagaggaagggcaagtgtgcagtgatcaaaacttctacccgacaaacgtacttcctgccagtgattgggttggtagatgccgaaaagctgaagccgggagacctggtgggtgtgaacaaagactcctatctgatcctggagaccctgcccaccgaatatgactctcgggtgaaggccatggaggtggacgagcggcccacagagcaatacagtgacattggcggcctggacaagcagatccaggagctggtggaagccattgtcctgcctatgaaccacaaagagaagtttgagaacttgggtatccagcccccaaaaggagtgctgatgtatgggccgcctggtacagggaagactctcctcgcccgagcctgtgctgctcagaccaaggccaccttcttgaagctggcaggccctcagctggtgcagatgtttattggagatggcgccaagctggtccgtgatgcttttgccctggccaaggagaaggcaccatctattatctttatagatgagttggatgccattggcaccaagcgcttcgacagtgaaaaggcaggggaccgagaggtgcagaggaccatgctagagctcctgaaccagatggatggcttccagcccaacacccaagtgaaggtaattgcagccactaacagggtggacatcctggaccctgccctgctccgctcaggacgcctagaccgcaagattgagtttccaatgcccaatgaggaggcccgagccagaattatgcagatccactcacggaagatgaacgtcagtcctgatgtgaactatgaagagctggctcgctgcactgatgacttcaatggggcccagtgcaaggccgtgtgtgtggaggcgggtatgatcgcactgcgcaggggtgccacggagctcactcacgaggactacatggagggcatcctggaggtgcaggccaagaagaaagccaaccttcagtactatgcctagggacacctctagtctgtctgctggggcgggggctcggttgataataaagggggtttttgttcttttccca

(The sequence listing continues in the following parts.)

We claim:

1. A method for determining whether a test compound is a renal toxin, comprising:
   (a) exposing kidney tissue or kidney cells to the test compound;
   (b) preparing a normalized gene expression profile of at least ten genes for said kidney tissue or kidney cells, wherein the gene expression profile contains the differential gene expression values for said at least ten genes upon exposure to the test compound, and wherein said at least ten genes correspond to sequences listed in one of Tables 5-5CC;
   (c) comparing the gene expression profile to a renal toxicity model, the renal toxicity model comprising information from one or more of Tables 5-5CC, and comprising:
      (i) the normalized mean expression levels of said at least ten genes in kidney tissue or kidney cells exposed to a known renal toxin, and
      (ii) the normalized mean expression levels of said at least ten genes in unexposed kidney tissue or kidney cells; and
   (d) scoring the comparison to determine whether the test compound is a renal toxin.

2. The method of claim 1, wherein the gene expression profile comprises the differential gene expression values for at least 100 genes that correspond to sequences listed in Table 5, and wherein the renal toxicity model comprises the Tox Mean and Nontox Mean gene expression values in Tables 5-5CC.

3. The method of claim 1, wherein said gene expression profile is generated by hybridization of nucleic acids to a microarray, and is normalized for hybridization conditions, label intensity, and reading efficiency prior to comparison.

4. The method of claim 1, wherein the renal toxicity model comprises all the information in any one of Tables 5-5CC.

5. The method of claim 1, wherein the kidney tissue or kidney cells are exposed to the test compound in vivo and the renal toxicity model is generated by exposure of kidney tissue or kidney cells to the known renal toxin in vivo.

6. The method of claim 1, wherein the known renal toxin is associated with at least one of nephritis, kidney necrosis, glomerular or tubular injury, and focal segmental glomerulosclerosis.

7. The method of claim 1, wherein the known renal toxin is one or more of cephaloridine, cisplatin, puromycin aminonucleoside (PAN), bromoethylamine hydrobromide (BEA), gentamicin, ifosfamide, cyclophosphamide, carboplatin, AY-25329, indomethacin, acyclovir, citrinin, mercuric chloride, diflunisal, cidofovir, pamidronate, lithium chloride, hydralazine, coichicine, sulfadiazine, and adriamycin.

8. The method of claim 1, wherein the kidney tissue or kidney cells exposed to the test compound are rat kidney tissue or rat kidney cells, and the renal toxicity model is generated by exposure of rat kidney tissue or rat kidney cells to the known renal toxin.

9. The method of claim 1, wherein the gene expression profile contains the differential gene expression values for at least 20 genes that correspond to sequences listed in Table 5.

10. The method of claim 1, wherein the gene expression profile contains the differential gene expression values for at least 30 genes that correspond to sequences listed in Table 5.

11. The method of claim 1, wherein the known renal toxin is associated with nephrogenic diabetes insipidus.

* * * * *